United States Patent 9,328,346 (POLYCOMB-ASSOCIATED NON-CODING RNAS) - sequence listing, part 49

SEQ ID NO: 8868 - RNA, 136574 nt, Mus musculus
ccgcccgcccguccccgccgcaggcuguucccugagucuccuccccuccuuccccucguggguucgggucugcgugcccggaggccaaaccaaaaggacuucugggggucccggccuggaguugccaggcuaccuuccgggugggaggcucucccuagaaagcgccggcugcgccaggccgggaccggcgguauggaggccgcgggaggcgccgggaagagcgcgcggagggaggugccgggaagggcgggcgcggcgcggggcgggccgggggcgggggcgcagggcggcccauuuccuccugggagccggacgggcgggagacaaagcggcggccgucggcuuggcgccucaggagucgucccgugcucgcccaguucgcugcagguaacucuucguaccuccccucggggcgcgcggggcccccuaguggggcgcggggcuccucaggcuggggucccggguguccggcucgggcucucggcugccgccgcccuagagcgucgggcuagggcggcauccccgagcagccugggccugggcgggcggagcccgacgcucgggaagcgggucgaccgccggggcgccuucuuggaaaacuuucucccucuuucuaaacuuuguucccggagcagggagcgcgcgcgggacuagcgucgcgccucaggccgccucccucacugagggacaaccgcggcgugucccuggcggucgggcagugggguguuguagggacgcgauuguucccuggauuuguuccggccacuccccucccccuucccgcugcugaaacuugggcguuugcgggaccagaggucggaggagccgacauuccugcccggcccacggagaaugggagucguagcuuccuguucuccagcgcucuuguccuuaaggugcgccacacccguguggacuuguggcaaggacuuuaauuuuuaccuuaaaauuacucagucucuuuugcugugaaaccucacugacauuacgcucaauuuccaggaguggcuuuagaguuacuaacuuuggguuaccgagagcggguagcccagauuggccugggacgcugggucucccugccccagcuucccgagggcggguaucgcuggcauucgaugucaaugaccugccuuucgacuuuaaaaggaacuuguuaaugugcguguagaacuugggggcggggauguuguugacuggauucguaaccuugguuuucaagcaguggccaccccaauaauccagugagcgguuggcucaagucaaggauugauauccucucauguucugugccuucauaacacuugguuugauuuuagaugugaguguguauggaauuuacaauaauuuaugauguaaauauaugcuuuaucauuguaucuuucagggguuuuaauaaggauauuuuguguuuagcguugaguuuuaaagacuacagguggauguuaccuuaagaaauggaauuuguuuuguuuuacuaaaggauugaauggggaaauaauuucauagccucuguuuaauuguucauccuuucugacuuacuaaguuaaaaaaaaacaaacagguuuuaaaaauucuuucuuugagaccugaaagcuuuucuagugucauauccuuuuuuuuuuuuuuuuuuuuuuuuuuuaaauuccauucuggaucucacuaugaagccccaaacuagcucaagcuuccugaguguugggguucagaugugugccaucacaccugucugggccauauuguguauaaugcaaacaacagaagcgagugggagcauggaugggguguuaguaaguuuuuaagucuggcaguucugaggugauggcuuuugaacuggaugaagcaugaguugaaggggcauuuaaguggaaucgugauauuauucuguucuuucccccuauacuuuucaacuccuuuucuugaauaugauucuaacagaauauauugguuuucagcaccagcuaugugguaccauccaucuccauucccaucagagacauuuuauauagugaucagaggugaggggugucuguuuucuucucacucacugccuugugccuuuucucaucaaaccccaccccaacacugugguauuggagagcaaaccuuauacuugcucggcaagugcucuguauuugagcugcgcacccccuaccucugucuuaagccuuagcugcaaacauccaguucuguauuuugaguguaguuucucuccugacccacaugggucuccuaucuuguaauuuuaaagaaagucacguuagugauaguacagcuaucccugcuuguugaaggcagcaguggucugaguacuggcugagacuuagacaggaugaaggaauaggaugaauaggauucuuaacaggaguaaguggccugagcguuggcuaagcauuuggaggccuagagguuuaaaggagaucuauuuauugaguacugaaguagggagaaggucucaccuaagguggucagggaaggcaaaggccaggucacagaugucuauguuuagauuuuauucuaaagcuguaugaugccauuguagggguuuucaugaucugagcagcauuuuauucauugcugaugcuuagagaaaacuugaauugguguguguguaaagcauggaguugaguggggaaggucauguggguaaaggcgaucuggaucaguggaaaggauccaacuaaagauuggguuaggguggcaccuaggcaucuggguaaagcuucggaaguguuggacucuuggucauaucucaagauccagcauuuucauuccugguagcaaauuuugugucaguuuucuuaguaacuuauguuuguguuguauugauaucccuguuugcuguccuuguuggaaaguauaaccucauguaaaccucuucaaggcagggcucaugcccuaccuaaccuuugguuugguaauugguaaggggggcaaauuagaugcucuauugaaugaaggaaggaggcaggaagucuuucuggagucuaagcuuccgacaguaagcacaaugacacgugaggcaauugauuacaaucaaauugcuguuuugggcaacuugagcuuucuucaacuuuguccccuuucuuuccuucuacccagaucuagucagugacagaauccgcucuaguguuuuguuuacaugucuuucuuuacuuccacuccacuuuuagacuugacuuuucuuuuuucuuuuuggugcuguggacuacuaaguaguaucugaguaagcuguuuaguuguuuguuugguuuauuauuuauuuaguaaagggucuggagugaauuuagugaucuuccugccuuagucucccuaaugcugggauuaauuguguaccaccucacuuuacuuuauuuuauucccccuguguuuuuccuucuggaccauguugcuuucuuuuaaucaccuggcaaacuuacuuauuuuuugaagccucuggauuuucucuugguuuucagugcuuugguaucuuacacaguuuuuauauuacauuuuuuauacuguuugguaaauguuuucugggaaguguauguguagggguaauaaguuuuucagacaggucuaugcaguccuggcugucuuacaauucuaaguagaccaggcuggccucaagacuuacagagauccaccugccucugcuucccagugccaggaucaaacaccugugccaucacuccugguuuaaggcuuaaucuuuuuuuuuuuuucaauuaauuuauguaugugaguacacuguagcuguacagaugguugugagccuucaugugguuguuggggaucgaauuuuuaggaaaucugcucgcucuggucaacucugcucgaacucugcuugcucagucccugcuugcuucagcccaaagcuucauuuauuguuauauauaagcacacugcagacaccagaagaggacuucagaucucauuacaggugguugugagccaccaugugguugcugggauuugaacucaggaccuucagaagagcagucaguguucuuacccacugacccaucucgccagccccuaaggcuuaaucuuuaauaggaaccuaaucaaaauugaaguauaauuagagaaaagugcucaaauuaggaucacuuguccagugaauugauauaaacuaaacacuauguauauccacuaagaaacaacacacuguuagcaccccaggaauucccaguaucaguugacuuuauuugcccuucugccucuguauuuugaaaccaggcgcuauucagggugauugagcucuuaaaguuucuaaaagaaaaaagaaaaccccuuugagaaguucauguuauuuuguguguuuguguguguaaguguggucagaagacaacuuggaaaaguugcuucucuucuuugaauaaacaugugggucccagugacccagcugagguuguuagguaggcugguggcagguaucuucaucugcugagccaccuuggcagcccagaguucccacacuuauguuugaaaccuaaugcugcuguguaauugugcugguuagucuuaugguuggguuuaagaucuucuaaauucuagcuuuuacuuaaaauuucagaccaauuuacuuucauuaauuuuugggggggugugggaggagguggggcaggggcuggugcaauggcucauacugcagaggcagaauugaguucaaagccagccugguauauauagggaguuccaggccagcuaaggcuauguaguaagagucuguuucagaacaaaauauuuuucauaagaauauuuacauucauguacuuacacauucacacaagugaagauacaggacagcuuuugugaauugguuuuuuccuuccaccaugugauuccuggggaucuaacucaaauuucagucuuauuaguuaagugccuuuacccaaugagccuuuuagcagccuguaauucuuauuuuugagaccgugucucauguagcccagaauggucucugcuuguuauguagccccagaugaccuuggacuuuugaaacucuuguuuccacaaccugaguguuggaauuacaagguucaccaucagguguaugugguacuggggauuaaccuaggaccucuuuugcuauacccacuccaguagugacucucgugacagcacuuacuaacugagcuacauaccaggcugauuuucuucuguaaauuauucccuauccuuuguauccuauccugggucguuggccauuuguuggaaugcuuuguaauaauugcuuccauaccccuccaaaaacugaauaacaccccuccacccucguuugagaaaggauccaaaaaucuuaaaacuuguaaaaaugaaugguaguguuauuuacuauccuucauuucuuguuaggaauuuuauuuuauuucauuucaugugugugcaccugaauguaugucugugcaucauguguguguaguacccauagagaggucagaacagguaucugaaugagagcuagagacaguugugugcuaccauguggauggugaacugauuauguuuuuuugugguaagaugugcacaacaaaaguuaccauuuaaaccuuuuuuuuguguguaugcacgcucacugacuuuaaaugaacauuauuaugcaaucucugccaauuccagggaaaccugugagugucuuugugccaccagggcuaacaaagugacaauccacauggggccagaaggaaauccaguucaacgcaacucaguggucagcaucggucugacacugggcaguuuauugcaggcacauuuaaguauaguacaacaugggaaaauguuuccugauucucuagagcuauuuuuaucuguccaaagugaauucuguacuucuuaaacaguaguuucucauucaccucucuccuggcagcuaaccauucuuuuuuucucuuugaguuuaaccauuuuuaugauuacccuccaccccccaaaguaaguuuuuaaguuugauguguacuggguuugccagcauggguggcugugcaccuugugugcuuggugcccuggggccagaagaagguguuggauuucuguugucagcacagagauucuugugcucacagauggcacuagggaaaccaagaauguuaaauauucaggguuguuguuuacaaggaaaagauguaggaccugcuuucuguccggaagacugggaaugguggcuaauaacuugggugauucuuguccuaucuguaggggcaggccauaccaagcucccccaagcaggaccagaggaggcuaauuaucuaggcagcuguuguauuaucuauauggcuaggggcucccccaacccccugcagucaggaccagaaauuuuuuuuuaaagauuuauuuauuucacguaugugaguacacuguugcugucuucagaagagggcauuggaucccuguuacagaugguugugagccaccaugugguugcugggauuugaacucagaaccucuggaagagcagccagugcucuuaacugcugagcggucucuccagcucccagaaaugcuuaauaggcagguguccuuuguguugucuguauggcaagcuuccauaaccaggacuggaggugacugacagcccaaaugaccuuuguacuaugugucugacacggaccacaccagauccccuaagcccuuaagauaauacauguagccuauuucuagaacccaucuucaugaaagaaaugacauguauuuugagaagcguuuugauguaguuaugccuccugugcaaagaggauuguuuuauaccaggaaacuuuuaaauuuaaccaaacuuaaauuuaucuaaaauaaacugcccaauguuagacucuagaaguuugaaccaguguaaugaauuauuuugaacuggauuucauucuugcuccaugcagacuguuacucuguaggcccuggugguugcauagauuuccuuggaacuggcagaguuaaagaccauugugagcuaccauuuggguauugggaauugaacccacaggaucuuauguguucaaggccagagcaauaccacugaucagaucucuaauuuuuuuuuggugguguacuugagcuguagcuuuuauauauuuugguccuuuuuuuuuuugagacaggaccucucucuauguucccuggcuggaacuccuuagguagcugguucuaucagauacugccugccucugcuucuccagugcuaaagauuaaaaauauucuauaugguaacccuuaucagagaagugauuuguaaauacucucucugguuccauuggaugucuuuuuacucccuguugauuguauuccuuuguuagacaaaaguccuauugcaucccuagacaaggguggcuuugaacucagaaaaucugccuuccucugucugcccccugagagcuggagucaaaggugugcaccaccauugccccagcuuaaaaguuuguguguguguauauguguguguguguuuuuaaaauuguuuuuguucuuaaagauuuauuuauuuuaugugaguacaccauaacugccuucagacacaccagaagagggcacuagaucccauuacagaugguugugagccaccaugugguugcuggaaauugaacucaggaccccuggaagagcagucaguguuuuuaaucacugagccaucucuccagcccaguuugcuauuuuguuuuuuuguuuuuguuuugcuuuguuuuuugagacaggguuucuccuuguagcccuggcugucuguagaccaggcuggcaucgaacucaaagauuagcuagucugccucugcuucccaagugcugugcugggguuaaaggcaugugccaccacugcucagcucagaauguuucuauuuuugaugaaguguaauuuguacuuuaguuuucucugcuuuuggugucaugucuaaagucaugaaauccaaagacgcggaacuuuuccccugugggguuuuuuuuuuucccuaccccuuucagcuaaauuggacacuauaagggcaggaacuauguuauucuaaccacuucacuucuguucauugggcauugaaguuugaaauugagauugcauuuccuauuguuuuacuuugaagcuuucucuaacucaggcuggccucaaacucaaugguuaucuuauugucucaguuuuccaagugcugacauaacaggcaugaaccaccaugccuaaccccauaauagaauuuuuaaaauauauauuuuuuacuuaugugacuguguguaucuggguguaugccgaaaugugugcauaccugugugugugugugugugugugugugucucacagaggccagagagggugcuauucccuugugugugugugugugugugugugugugugugugugugugugugcucacagaggccagagagggugcuauucccuuggagcuggaaucacaggcauuugggaacugcccgaagugugugcuggggucugaacucugcuccucagugauuggguagcaagugcucuuaacuugagccaguuuugcagcccuuaauauauaauucucuuauaaaucuuacuuguuuuagauuuauuuauuuauuuauuuuauguaugugaguacacuggcacucucuuuagacacaccagaagagggcaucggaucccauuauagaugguugugagccaccauuugguugcuggaaauugaacucaggacccguggaagagcagucagggcucuugacuguugagccaucucuccagcccccaauauaugauccuuaaaaggcuaaacuaaacaguagaguuagaauuaugugaugagguauuucuuguuucuaauuuuucacugaucguaugucuguuaucugaauuaugauagcaugaccuuuggaauuuuuacucuuacgagacucaggcuuaguuugaacuuuuucaucugucuaauaagaugauggugaugaugauguuaucgauguauaaaggguguuuauuuucacuuccgaugugauaaaaugcuaguagagucuuucuguuacaaaguucuggacaagcucuauuuuuauuuauauuacauggguuuucuuagggguaaaccgaugaaucaaguuuaaaauuuaaauauucccauguuguuaacuuccuuaccuuaaaauucugauaguagggcuggagagauggcucagcaguuaaaggacuaacuguccuuucauagguccuaaguucaauuccaagcaacuacaugguggcuaacaaccaucuauaaugggaucuaaugcccucuucuggugugucucaagaaggcuaguguacucaaaaauaagucuuuuaaaaaauucugagagucgccgggcgugguggcgcacaccuuuaaucccagcacuugggaggcagaggcagguggauuucugaguucgaggccagccuggucuacaaagugaguuccaggacagccagggcuauacagagaaacccugucucgaaaaaccaaaaaaaaaaaaaaaauucugagaguaaagauuauuuugcuagcugcucugcuagauggugaaauccuucaagucaagauguucauuuuuaucauucugcaucugugguaccagacuuguuucuuuguucacaguagguaguagucaauaaaugcuaaguuacugggagugccaaguaagcugaggggaugguucaggagcuaaagcauugcugcacaagcaugugggucugaguucuuauucucaacacucauguacauaaaaaagugggcauacuagcucaaacaguccugcccacaggaaggcagagauaggcaugcaguacuaugccuggcugguuguauaucuauaccauguuuuuuauauauauaaaagaaagaauuauauguugaacacacacaugcacacauacacacacaagugcgcuugugccuuuaggacagcaccccuguaccuuaaugacuuucacuagacccuuccucuccuuuugaagacagagucuuuaaaggcuugccuugaacucaagauccucuugccucauccuacccaguacuaauacuagcuacggauuauagccauguuaccaugcucaguccugccaacuggggacuaacauccucaauccauauguaaaaaacacugaggaccaggaagcaccaugauaacauucuaaucaccucuuuccccuauaugauugccuuuacauuuuuuaaacccccaucucccagaagagaauuaagagaaaaauuaaguaggagggaagaaagguguugguucacuacauuuggggaggaauuauauuuagcuggaggagaacuagcauuagcagaaguguaauaguggaugcucuucuguuucucuaucucccucauuagaaccaguaauuagcaauaagaguacaauuucucauuaucuggagugcagggcccuuauuugcccaccugguaggcuguuggguaagaugugccuggcuggggggauagaguagggaaguuucaggauuuuuuuuuccccauucuuuuucaagacaggguuugccuguauaucccugcuguccuguaacucuguagaccaagcugucucaaacucagaucuaucugccucugccuccugagcacugggauuuaaggcaugcgccacaaacccuggcuguaggaccucaaguguuccaaaguaguuaaaucagauagacucugccaauauaguuguuagguggguaggauuauugguguucccuguaaugcuguuuuucuuccagaauuugucuuuuaaaguugaauaucauuacauuguacacaugugcaauauuuuguauuuguauguguguguuuguauaguauaauauguguacagugugcauguuuaauguguacagguguguguguguguagacaagaggaccacuuuuggggguuuguucuuguuuugcacccuguuuugagggagaugcucucuuuuuaaacaauuuuuuuuguauguguguggauacaugcauaccauuugaauguggagaucagagaacaaauuauggggaucuguuuuaucucuacagaguuagaguuuugagaauugaacuuagaugaucaggcuugguggcaguuggcuuuucccaaugaaccaucuagcugacuaucuaguuguucuugcuguugugcucuuggauagcugcuuuggagcuguggguaggugauuccacuucuaucacucuguaugauugcugugauuacagacagaucaucaauuuauuucuuuuauuacagucauuaauuuuauuuguaugugaguguuccugaguaugggcacuguaugcagguaggcagagagagcucuagaccugcacuuacagguugucgucagcugccugcucucagugcccccucuguaagaguaguaagugccuuagcuguuuacuauuaguuaucucuucagccccuccgguaauuuauuuuguguauaugugggccaugguacaaguauggagauagaaggaucaccuguaggaauugguucucuccuccuaccaugcgaccggaucagaaggauuugaacuuagguugccaggcuuggugauaagcaccuuaacugccgugccaucuggcugccccugcaucuggcuuuuucaucuugguccaugaacucagauggcaaggcuugugaagcaagugcuuuuaccauugaaccaucucuggggacucuauauaccgugacauuuugauuauuuguuuauuuguuuagggacauuuggguuacuuagaaguuaagcuuuuucuuauagcuuuaaaauuuuuaggucagcugggcaugguggugcaugccuuuaaucccagcacuugggaggcagaggcaggcagauuucugaguuugaggccagccuggucuacaaagugaguuccaggacagccagggcuauacagagaaacccugccucgaaaaaaaauuuuuuuuaggucagccaugguggcacuugucuuuaauugcaacacucaggaggcagaggcaggcugaucuugaguucaaggccagcuuggucuaaguagcaaguuccaggacagccaagguuauauagauagacccagucuaaaacccaaaaccaaaaccaaaaccuacccccaaaaagaaaagguuuuuuuuuuuuuuuuuuuuuugcgccaguuuuuucuccauaaauguacuuuaucugugguaugucauauuauuuuacacuuuagaauucaggcucuguugauguucuguuuuuuaauagacuaguuguugagugaagcuagaagacuuggaugacagaugacauuccuuggaugcgaaugccaaugucuguccuuucugcuguguagugaggcugugagaguuccaaguuggugcuggugucauuuagaguauaacucucaauugucuguguccagcagugcucugugucucagaugguuucagacucacuuucucaucuguaaucuuccuucugccucuuuagagucuguauugcuguagcucugaaagcagauuauauauuauauauuuuuaguauuaauuggaacuuaacaucagauggcugaguuguaugcuugugcaguucuugguuuaccuugcuuugggugacuacacaacuuuuuuggggaugguauuucaaagaacuguguuucauaggucauuuuugaauccuggacucaguaguccuuguguaucagccuucugauaacucaugguuauccuuucaccucucucugugugcugaguaugcucagguccacauuugcuagcaaucucuuuccccacuaauaacacauacauauguauagaaauauaugcagacaaaauagagaaaaauugaaaaaaaaauaaacaauucaguggaggagaacacauuuuacauucuguauggggaugaagugguaguaacaugaacuagaacauuaggaauuugaccucuguagcaccuucuguuuccuuuugggauacagggaguugaguguugggcaugagggagaggccugcagagcagcagccagugcuugcugaagaugaugcuugugcagccuagucugcucagcccgcauguuggggaucaggaccuaacaguguaaugaucaggggcaaucuggcuugaauugcuuaguuuauuuuuucuguaaguggugagagcacaguacugaauuaaccagauuuaaaguucucaaaguguguaaaaguaaccauguuucacaauaaaaugucuuuuuguguuuuguuuugguuagaacuuuuuucuuuuuaaaaaagauuuauuuauuuauauuuaugugaguacacuguagcugucuucagacacaccagaagagggcacuagaucccauuacagauggucgugagccaccaugugguugcugggaauugaacucaauucauugugcuucuacucuauuucuaauggggcucgaaaugagcauauauuucuauuuacuugacggaaucaaacucaguuucuauuuauuuauuuaacagccuuaucacagcuccccucucucuucuccucccauuuccacuuucacucacaccccuauccccuagacuuacuuuuugacugugauuuaacuuauacucccuauagguuuggagucaugcacaugguguaauggaguuccaaaggcaacuuuggauucucuauaaacauuuguaacuaagauuugaaacaaguauuguggguguaugacuugauuuguaaaauguuagccuuuccuuauucuugauuuauuaaaagaagaaauggaauuguggaauuuauguaacuuuaauuuuuagcauuaaaauuuauuuuuuagauuuauuuaugucauguguaugcauauuuugcuugcauguauguauguguguguaccacguguguuccugguaccaucagaggucagaaaagaggacauuggauccccuaaacuggaguuauagacaguuguaaguugcucuguggugcugggaaaugaauccaauccucucuguaagagcaacaaguggucuagccacugagggccccgucuuaaaaaaaagacugaaaagacauuccaaaauauuuaaauuaguguuggaauuuuauaaugauuaauccaguuuaaucuuggugcuguaauuuaucuaauuuuugaauugcuaauuuaaagacuauuuccuggauuauuuaauuuugguuuccugucauuauauaaagcuguguuuuuuucugucuuuuucugaguuuguauuguuaaaauuggcaaaauaaguggacuauugaagguugucaugaaaauguuuuauuguagccggguguaguggcgcacgccuuuaaucccagcacuggggaggcagaggcagguggauuucugaguuugaggccagccugguuuacaaagugaguuccaggacagccagggcuauacagagaagaaaccuugucuugaaaaacaaaacaaaaaacaaacaaaaaaacaaacaaaaagaaaauguuuuauuguuuuaguuuauauuauuuuauuaguauuugacuccagaauugaagauuuaagauggaaaccugaauaagauuagguuauauagccaugcgcugcuuuauuagucaggcuaagcugcagaguguucuugaagcugggaguaucaucuuaacucaggaaacacauccagugugcuccauuuccaucugguaccugaaggagaggggccuuugcuaaugaguccacuugccuugcacgguggcuccaauacaugcuuucuuuccaagauaagaugcaguauuaccauuuacuuauacugcacuggauauuuuauuauaucauauacuucauuauucgggcucuuaaucauuuguaaaauauagggagugaauaagacagaugcugaaaaggagagguagguuacaucaccaaggaccaaggucacuuuacagugacuuugaagugcaucuuuaaagcucugucauuuuagagagaaauggucaaaugaaaugugagcuugaucccuugggaaggggugaaacucaaggaaauggaagaagcuaacccuuggggaaaaaugauguaaacuuacuucagacuagugaaagauaaaggcuguuuucuagguaguguuauugagucuaaggaaguguuaugcagaaugucaauaacauuaggaaauauuuacuuaaauauagaccuucauuaaaaaucugccgcugugcaagauucuuccuagcuaaugaccucagcccugguaguacagugauaggugagaauugcaaucuguagugauuuuugcuaaucuuuuuccuuauuucuuucuauaugucaguguugcuagaugaaaacugaaguagcuuugggucauguaaguugaacauacaagauuauaagcauguacccuugcaccuagguagaguguuauuuuaguugaaucagaaaagugaugcuggaccagagagacucaacugucaaugcaccugccuucacgcaggaugauuagaauuccuggaaaccacagaauaggagagaauuaacaaaguuguccccuguccuugacuccuguaaauaauuguuaaauaggauuaggaacaggguuucucuguguagcucuggcuguccuggaacuugcucuguagaccaggcuagccucagaacucagaaauccaccugccucugcuuccugagugcugggcuuaaaggcgugcaucaccaccgucuggcaaguguuauuuuguuuguuuguuuguuucuaagugcuggcuuaugguuuugguggcacauaccugaggcacaagaccgaggcagggcuuaauggcauguaagggcuuaauggcgguaucuugucuuagaacagacagccaugauccauguguguucacagugacucgguuuuauaguuucauguggcaaauucuggaggaaucuagagaagcaggaacaacccuuuccaugagguagaggacaagaugugucugagucuugaaaaaagaugaguagcuuuccauuuggaaacuucugagggcucucuuggcagagggaaagugaaugcaaagaccugaaggccuuccuguucuacuggguugaggcugggaaggcuagugggccagugcaggugaaguuggcugaguaagguuuugacuuuauccuccuuguucuccacccaaugacagugauaacaagagcugcuuguagaagggcagggaauguagauucauggguaacaacccuuccacccacacucuauaagcaguucugggaauggagcccagggcucagcagcuacuaagaaagugcugugucacugagcuuaacacugcuggcuuauacauauacuccagaccagagauaagaccuaggcuagagcuucagaacaguguguauuuuaucaguaggaagguugugaggucaguguugacuaagggaagaacuaggaaggggagagaagggaagggaaaagaaccuagagucuccuuagagggacacgauuggucucuaaccauaaaauuauuuuuauugcuacuuuacaacuguaauuuugcuacuguuaggaauuuuaauguaaauucuuuuggagauaagagguuugccaaaugggucucgacccacaggaugagaaccacugcuuuaggagacggggccuaaugagaagucuugaagucacuggaggaaugucuuccaagggcuuuauggaacauuggggucucucccacauuggccugcagaauuuauuucaccauguuuuucuuggugugcugccauagguucaaaguuguggagccaaccaguuacacacucaaauaccuaaaaucaugagcugaauacaaucuuuuuuguuuuuuugggacagggacucucuguguagcucuggcugucuuggaacucucuguagaucaggguggccucgaaacucagagauccgucugccuuugccuccugagugcuggguuuaauggcaugcaccucuaugccugacccaaaccaauguuuuaaaaguuaguugauuauccccagcugggggauaaaaaugaaacaaaagaaaauguugauuaucucauguauuuguuauaaucauagcaaacugacucuguauagacccucuucaccuuugaagaggauuuuuguuucauaaaauaauuguuauaaacaauaagaauaaaauaguucuagaauauauaaguuaggaggaacaaaguccagagaucuguaaugccuuauaauuucuuagguuuuuguguuugauuugguugcuguuuuaccaccuacucuguuuuucaguuaugcugugguugcuggaaggugucuguguuauucacaaccugagagaaccacuugcuucugaagugauaccagacagaucuuaauuaggccucucugacagcucggggcagcuccuuuaagcuuucagagccucuugugaagaacggagaccuguacaaccuuagcuuuacauuuguguucgaacucucuauaccuggaacauuuuucuuucccacucuucuucuuucuucuccccucuuugagacaaagguuuguauagcuguagcagaccaagaacuuuguagaccaagaacuggcuuuaaacugccucugccucuucaguggugagguuaaaagcaggugucacuaugcucugcuuccuacaacuuuugaggggaauuuucaaaccuaauagagaaguugaaauaguaaaguauuaguugcuuugcuuauuguugugacagaauaccugacagacaauguaauugaggaagggcuuauuuugacuuacaguuugggagaacagucagucaucagauuugcuauguagcacaguugaaguccugaucuuccuaccucugucucccaagugcagggauuuuagacugguacagguucaguuugacugguucuuggcccucuaagcaccccaccugcuuucauuuuucuucuggugcugauauccucucuuguuuaugcugucacugcaguguuuauuuuaauauccaggcuuguucucuggucucagucucucgugcuagauugcaagugagagccuccauaccuaguucauuuuugugguauccacuguugacuggaauaguguucuuggagguggcacacaaauacuggcugaaugcaugaugcucaaugguugaauaccauuggauuuagauuuugucuuuugcuuagugcuuuuuguauguuuccugaugguuauggcuuaguaugguuguuuuaauuuugcuauuuccuuugguauguauccuagaaaaaaauaaaaaaugaaaaaaauaaaaggaaaaauaagagcaauuggagugguuucuuuuucuuuuuuucuuuuuuaugucugucugucuaucuaucuaucuaucuaucuaucuaucuaucuaucuaucgagacaggguuucuuuuuugagacagccuuggcuguccugggcuuuguagaccaggcuguccucgaacucguaaagaucugcuugccucugcucucucauggacuggauuaaaggcaugugucacuaccaccuggcagaguguuuugcuuuauuuacaaugaugaugaugaugauuaagauuaaaccuaguugucauugucguccugucauuccuccuuuacaguucuguauaauugcaaguggagugacaucuacuuuuugugccagaggauaccugaugcucuggguugaucauguaacacaugauagaugauucaguuacccuuguagcagauggggaacuuaaaaaacuuuguuuauuuguauucuauguguaaauguuuuuuucucuguauguguguguguaccaccuguguaccugguaccugcagaugccagaaggccccagaucuccuggaacuccaguuuuggaugauugugagccaccaccugaaugcugggccugaggggucugaauccagguccucuggaagagcagucaguauuccuaaaccaucuccagcuccagggaaacuugagaagauauauauauauauauauauauauauguguguguguguguguguguguguguguguauauauacauuacuuuugcuuauguguaaaugcauguguauaugggguacaugcuugcguuagugcagguaccuacacaggccagaagagggccaggaguagguuagaacucaaauuauaguacucaccauggguguuagggucugaacucuugguccucuucaagagcaggauacucuuuccagcugugugggaaacuuuuugcucuggcuuuauauagauagauagauagauagauagauagauagauagauagauagauaguuagauaguuuggcugucagaccugacugagaugcugcugcugaaauuguaauuagaaauauuggcuauaauuauaagaaaauaauuuucuuuuuaugaggacuaucuucauuuaaaacuuaauauuuccuuauugcucccuuaaucucaacuaguuuauagugcaaaauugaagaugauaggcugggauuuagagauuuagucaaauacaauuugguuuucagagugaguuaauuauaaggguuauccuuguuuuuugggcaguuaccaagagauuugggagcugagguuccuacagcuguguuaagucugcuuaaugcagauacaaccuggcacaccuauaacuguauagaguaauucacaauccuggauccugugcacugugacaaguuaauguugcugugaguacuuuuaauuucuaaaucuccucugauuugcauuuaaaugaaccauccuaacauuucauuaacauaaccuugcuguuuaaaaaauuggcuucgacuugcaucccaagguuggaaaagacacacuuuaggaaugaugugaccauuguguuguaaaugaacuuguaaugucuugugaggagguguauagcucuucucacaaagaggcaguuugccaacagucagcucccuuggguucuaaugggacugugcuguauuuccuuucuugcuuuuccuuucauacaggcugcuagacaagcaauugaagcucuuucuggguuuguagugauauuuugcauuauagacaagaucacuauuuuuagauaaugaagaccaaauaacuacguuuuagcuuuucauuucauuccacuaaguauaauucuuccuggaaaaacuuaaguuugcuguuuuuuauuaauguuggccagcucuagcagauuuuauaauagauuuuggaaaggagugcucuguaaguuaauugggaaacuagaagcugccaagagcuuuaaaaguuauuuguuuagcgauucuaaacaauaccauuaauuguaaauaaccaggagaauaugauuaagaugaaggcaggaacuuuuucuugguagguuugugaauauuuucaaauggguugcauaaauucaguucagcuuguacugcugugcccuguacaaaguacuuuguuagcaucuuauagaauauaaaaauguauaacuauuguugccuuuaaauuuaaucacugagccauuuccccagcccccuaccuuuaguccuaaaacauggaacauauauuaagguugagaaaauuaaguuuaauaaaacaguucaaaggcuguuaagucaguggguccuaagcucugggucuucaccccuuggggguccuauauccuucauaucagauauuuauauuacaauuuauaacaguagcaaaauuauaguuaugaaauagcaauaaaaauuuuuaugauuauaauauaauacaguucugcaacaugagguacuguauuuaaggguugcagcauuaggaagguugagaaccacugacauuagugaaagacccuguugcugcagauaccagccacauaccuugcuugcaggaugcaguuugaacuggaagcuuacuccuuguuggcuacuuuuuauaguggugagaggugcuaccuguguaggcuaguagaggagaaaaaggcaucagugguuuuaauuagauacgaaccuuacugcaauaacaacuggccaagaaagaucuguugucuuguguaauaguggugugacuguuaugggcguaaccaaccaucuucugauaggauauaguccuacuccacaggaggaaacccauguacaguacuguaaacuuggucaaaaauaugggucgggaagugauaggcacuaaugaggaacuuaauacaguuuaguuggauugauguagugucaauuaaguaucuuuuaaaugucuuuguuuggggguuggagagaugacuuagugauuaagaaugcauauuguucuugcagagaacccacauuugguucccacacccaaaucaggcaguugacuuguaacuacagguccagggaauccaaagccccuaacggcaccauacagaaagggauuugugggaaggaggaguugucagggaugggaaugcauuuuauacacaugugaacauuuuaaagaacaaauuuaauaauaaaaagaacacuuugauuacagaacucaaaggauguagaauaugaaauauaacaucuuuaaaauaaaaaauguauuuuuauuuuauaauuuuauguuuaugaguguuuuaaaggcuuagauuuuucaaagccuauuuuguuuaggguucucaaaugcuucaaccucccuucuagcccaccgaccaaaguggggagaaagauuguuaauaagaccaagggaguuguggaccuguuuagaaguaguuguuugggggcgauuccaagcuucguugucaggauaucagcaguccaguccaauagcaaacaacaaacaugaauaaguagcagcagcuuaaucgaguggagaccucacugcucuggcaaauuagcacgagucuguggaagcagcaagaaucagccaguacaguguugcaaggcguuagcaaugcaagaguguccucucacugucugugggguuauauuuauauucuuucuaaauaucacacgcccuuucaagcgucugcuccagcaaaacaucaugcccucucaugugucugcuucagcaaaacacccucucacaggaaacuuccagaaaaacaucacaugacacaacugaguuuccaaagaaaccagaaauuuccacuucaguguuugcuauaugugcaccacauacacggaguaccuggguguaggcuuagauuuuucaaauccuucuuuaacaaggguucuuaaucuagcucacuguucaaaggcagggggagaaaagaugguuaauaggacaaggggauguggaccuguuuagaaguaguucuuugggugaauucaauuuuaguuugucaggauaccagcaguccaguucuguagugucagguuaccaacaguuuuaaagaaucgcuaaacacagaucagcaguggcagcacagccaggccucugcugaauugacguugagucagucggagugacuaggacccgcugaauauacaguaagucaaacaaaacaaccugaaauucuuaccaauauacaauaauucaaacaaaacaaccugaaauuuuaauaguauauaauaaaaacaagacaaccuuaaauuccuaucaguauauaaugauucaaacaaagcaaccuuaaguuccuaucaauauacaauaaaaacaaaacaaccuuaaauuucuaucaauguauaauaaaaacaaaaccuuaaauuccuaucaguguacaacaauuuaaaucuaccauccuagaugauaacaaccauagcauaucaaacacacaaacuguccauuccaauuuaagggguuuggggugacggucuucuuauaauugcuucaugcugaauuggggugaagaauuccuguuuggagcccaaggggcaaaaugauuaaucccuagcacguauguagcagauguggaucucaaacaacuaaagugggggcuaucccaaaugcuguugccuguacaugggauauguucuucuaguugggcuggcugccuugucuguccugagugggagaggaugcuccuagccucacagagacuugaagugccaauacucagggguaccccuauaugcacagaggagaaggggauaggggaaaggguugugggagggggugaccaggaggggagcaaugcaggauguaaagugaauaaguuaaauaaauaaauaaauaaauaguuacuaagaggaaaacaaaauaaagucuagcuguagcaucuguugcccagucucuguuuuuauccagucuauguguugucugucaaguuuacguauuguccagucucugugugauugaucauuuuggcuagcccuuugaaguugaugugcaugcauauuuuugagaaaucaguaacugagacagucugugaaagugcaucaccugggcuauuugcuuugugaagauauugaugucucagcugguuuucccuggucagaucuaaucuuuauaaguuuuguugguaaccauauuuucucauccccuguagauacauaaguguaaccaugucccugucuuaagagcauugcagguuuccacuccaauguuaaacuuuuuuauaguauauugguuggcuuagugccuuagguuuuuuuuuuuuuuuuuuuuuuuuuuuucccguuaacccagugucucucagaugccauuguuccucuucacuaacauuaagaaaauguagaguuaacaaggcauuauuuaaucuguuucugaggguuuaauucucccuuuuuguuuaauaagcaucucuucuaagguaugauuggcucuuucuauagugggauugugugguauaccaguaacaugcuuuauauuguaacauauaaagaauuauuucauuuuauuggauauauaugagggaccauuaucagucuuaauuuguauagguauccccauaauugccauuauuuccaauaaguguguaauaacacaguuaggcauuucagaacuuaaagcaguugccaauuuacacccugaguauguaucagugguaugguguauauaucuuaguuuuucaaauucugcaaaauggaaaauauccaucugccaaaugucauuucuuuugguccccuaggguuacuaccagcagguaacagaauuugauuguauagagaacaaaguaggacuuuuuuuuuuuaauuaauuaaaaaaauuuuuuuuuggcuuuuugaaacaggguuucucuggauagcccuggcuguccuggaacucacucuguagaccaggcuggccucgaacucagaaauccuccugccucugccucccaagugcugggauuaaaggcgugugccaccaccgcccagcuuuuuuuuuuuuuuuuaauugccaagugaugggaauucuuuaaaccucucccauuaauaugauauuuuuuuucaugaaauuuugaggcuuauaacacguuucuauuaguaauggucaauuucaucauuuccuugagcuaauggaccuggcaaaccuauagaagaccaaauaugaguaacauacaauggauaguuucacuucugauggccuguuguaauuguauacauaaugagguuauuucugaguuaucagguacaaauuuagcagucucuauauccaugcaaguuucuuucugcauauaaagaauacgugauuauguuaagagauucaggauaaucuaguaauauaaggauuucauauaauucugacuuuugaacugaggcauaaggacuuuuuugaguaccuugcucauuuugucugauuuauaaccugccauccccaucuuggucacaucaguauaaaguguugaugucucugcauuugguguucccuuuaugauauguggaagacuccaguuuuuuuuaugaacuguauucguuugcuuuuuggguauuuguuauuaauuuugcccaaguaauuacuacaagcucuaugccagucuuuauugauccccauaaugacauaaucucagcauuuguaagagauacuauaguuuuggcugaauuuauuccugacaauuggcauaaucuuauuuuaccauucauaauuaacucagaaaucuuuguauauaugucuucaauuuuuuaaauuuguuuaugagcuaagaaaauccauuccauaauacuaucuucucuuugcauaaugagccagcccacuaggagaaugaaucgaaggcaaaaugaccaaaauacaagcaaguuuagaaucaauuugauuauauuugcauguugcagucuucguuuuacaagaauuaauuaauuacaagaauucuuuuucugcuucagcuguuuaaauuugaaucuucuugcaauguugaaacaaauuacuuaacucauauguauuuaauccaauuguaggccacagccaguuaauaacacuaguuaauaacauuugaaaaucauuaaguguuucaguuggucccuauggaucuguaccuuuugugguggaauuuucuguugauugauuuuauaacccaaauaacuaaaugaaccuccucuuuguauuuuuucuggagcaaucuguaagccccagcauggcagaauucuuuguguuaccuuaaacauauucucuaaaacaucuuuaucagaaucagccaacagaauaacauccauauaaugauaaaugauagcuuaagggacuugcuuaccacauaaaguuggauuauuuaacauucccugcgcaaguaccuuccagugguaucucuuuccagugguacugagaaagcagaccuuuccuuauccugcucaaaagaaaucuuucaagucaguuauuuuuauaggccaugaucuuggccuauaaaagauuguaaaggaaguccaggcuguaaaggaucuauugauugaauuaccuuguuaauugcuuuugaaucuguuauccuccuccauuuuccuaaucuauuuuuuacaucaaacacaggagaauuccauggacagguagacucuuuuauauguugauccuccagcuguucuuuaccaguuguucaagugccugugauuuucuuuuguuaugguccacugcucuugcccuacaggucuguuugauaaccauuucaggggcaaggcuguugguuugucaacaguggccccuuuuauacauuuggaaaugugauuccugugauaucuuguuuuuggaccaugagcacaguuugugauuuuucucgaucccuguaucaauaccuuccccaggagcaucuaccauauaacacucaauuuccucauuugcugucccuggaauugcaagaauauuaauuugugugccccauugcuauaaaggauccaaagaucccuuccccauaaauuuauggguauaucagcuacauaaguuucagcuucccuguuugccuuucuguuccuacacaguuccugucagacacuucgauuuauuccugauaauuuaucaauucuauaaacuauggccuucugaaguagccaaucuggauucuaagacuuuugagaauguauacuaacaagcuccuguaucuaccaagccuucuaugucaaugccauucauuuacaucauuaacuuggguuucugaucauuaaccaaucuaaucauuaauguuugccagaacacacauuuuucuguauucccaaaagcuuauguccuuucuacuggagcagccuugcccuuuauguaagaaaaugagggggcaggugagaugacucaccguguaagagcacugacugcucuucugaagguccugaguucaaaucccagcaaccacaugguggcucacaaccaccuguaauggaaucugacgcucuuuucaggugcgucugaagacagcuacaguguacuuacuuuuaauaauaaauaaauaaaagucuuuuuaaaaaauguaagaaaacgacaguugaacaguccuauucccuguaucaauuugcaucucuuuucuuacauaugccacgauucuaauuucuucuuugcuauccccaucuacuauaccuggaugcauaauaaguccuugagaaguuaaccuacugcucccaaaauuauucccacuguuucugaggguacauuauucccacuguuucugaggguaccagugguagcuaguaacauucaacuuuuggggauagggaaagagguguaacuguggccagauccaaaccugcacuccguucuguggcauguauaagauuagaaauacuuaguuuuaguuuucuuuccugcuugguacuuucugguugacaaaggaagacaacuuguauugcuuacugugggaccuggagcugacaugcccccugcucauuuccugagagcagauuaccucacgugucccucuuggacuggcaauccuuugaccaauauuugcccuuaccacaguagcuacaauacccaggaaaccuuugugguuuuuaacagucagaaccugcuuguucucuucuaugaauacuuuguucccuagagucaguguaccugcuauuuugagcucugaaucuucuagccuuaaaucucuuuggaaauggccaaaccuaucauaauuaaagcaucagguauugauuucuaagacuucuagcuauucauugccuuaugauauuagcaugaugcuccccaaaaccaauaucaguuaucucucuuacccauuugucuauuggggcuccucaugcuuccaguuugauugcuuucugaugaauacauucaguauucauguuuucaaaggccaguauuucuaucaaugacugguucagggucugauaaggcuauuaaagcuggacccaaucucuguaagaaaucggugaaugcuucuacagguccauguauuaccuucauaaauaaaguagauuuucccccuccuggcuucucaguuauaucccaggcucuuaaagccccaauacaacauuguucaauuaugccaucaacagauuggauuuguucuuggaaaucagcauaaagcccuucacuaugcaguuugucuuuaguaacauuuauccuuuuuugcuauaucuuauuguucuauuuguggcuugcaccaccaccacgacaucauuguaauuguccagcuuauagaauagcuaacaccaaucucuuccaaucuugggggaauaacccuauucugcauagcccaaguauuuagcauuucuuuaaguaauggagagugcaagcuauauaauaccauagccucuuuaaaaugcuucaguucuagcauuucuguuggaugccaggucagcucauuauaggcagaaccagcaucauuaguaggcuugugcugcacaaagacugggaaggcugaaggugccugugaaggccugagcaaauccucugguggugcgcuggacugaauacuaucccaugguaccuguacugagccccuagucagggaggugcucuggguaucucuagugaaaaugcauguagcagagcaaggcagcaguuuacuuucuagcuuauuuaguuucccuuuuucuuuuuuuauuuuuaaagauuuauuauuuuauuuaugagaacacuguagcuguuuucagacacacuggaaaagggcauuggaucccauuacauaugguugugagccuccaugugguugcugggaguggaacuuaggaccccuggaagagcagucagugccaucucuccagccuccuagcccuuccccuuuucauugugugguacauuccuggucucagacaucaaguuugaacacuguuguuccucucccacuggcuuagcacuucuaccucuauuugcaaacucucuuaagugcuuagcuaacucugcaaucuuaucuaacauaaagaguauugucaggggcuggagagauggcucaaugguuaagaguacugacuguucuuccgaagguccugaguucaaaucccagcaaccacaugguggcucacacucaucuguaacaacaucugacacccucuucuggagugucugaagacagcuacaguguacuuacauauaauaaauaaauaaaucuuuaaaaagaguacugucaguuuuccccccaaucuuuuuaaaaaggucuuaaauuuuuuuauuuuuauuuuuuuaaaccaggaaacaaaaucaaaaaccuuccuccaagaacaagguaguagaucacuuaccgguuuucacugcuauuuugccaaccuuaagguacauugcuaaccgcucauaaccugaccuuuccucuagcacauuagaagaauuucccauuaugucuaagccauguugggugucaucuguaggcuuaaauuucucaaaaccuacuuuaauaagggcucucaaacgccccuccccuuguucgagcccaccauccaaagguagggaagaaagaagauaaauagaacaagaggauguguaccuuauagaaguaauuuuucaggauacuagcaguccaguuauauacugucaggauaccaacaguccaguucagaagaguuagcaauaguuaaguuuggggauuucaaauagaaauuuguauguuugguuucucuuaaauucaggucauuugaaguaacuuugugauaauugcuuggaguugaucaguuggacacaagcuuuuugaguuggucuuuucuguaggacuaucuguccaucucugaccuggggaggcugggugucauuugacuuauuguuggauuuauaguuugucaguuguuguauuuuugaaaguagcagagccuuaaaccacaacacccccccccccgccccccguuuuucgaggcagggcuucucuguauagcccuggcuguccuggaacucacucuguagaccaggcuggccucgaacucagaaaucgccugccucugccucccaagugcugggaugaaaggccugcgccaccacugcccagccuuaacuuucucacuggagcucccuuuaacacaugggaagcccuggggcucugaauccucggauucaggaaaguaaaagauucagaaggcuuuuuguuguuuugggaucagguuucguucuguagcuaaagcuggauucaacugagugucuaggauggccuugagaugauccuccugccucaaucaaguguuguuauuauagacauagaccaccauuuccaucuuguuaaaauaauuuaauuugggggcuggagcacuugcugcuuuuccagaggauuuugguuugguucuggugcacacauggcaacucauucaguuuuaggaaauccgauggucucuucuggcuuuauaggcacucuguaugugugugguacacauacauaacaugaaagcaaaaugaaacauaaaaagaaaucuuaaauuaauuucacuguagguguaggucuaauuccagcacugcagaggcagagacagguagaucugugugaguuccaggccagccaaggcuauguagugagacucugucucaaauaaaauaaauccugaaacacugaagcgucuuuucuuuuuguuuuuccugugucuagagaguuuuuuauaucagaaaaauauuagaagaguuucuuugggaaaacgaggcagcgucaguggcagagcuucuccagagcuuugccuagugcaugucuggcaggcucuggguucaguuccaaguacaagcgcccgaccccucaaagugagaauuguguuuugcgucucagcaacuaggaguugcucuaaaugcccaccuggguuugcuuuccuuaaucacagggucuaguccucuaauccugaaagguucucguauuuguacuggugcagucucuuugaaaugccaggaagcuaggauccacagggcaaauacuuucuucugaacugucuuaucuaugacauuugaugacauuugcuugaaguguuaguggucuuuaacaaccuagaccaucccaucucuuaaggauuacugacuuguguuuaucgguuuaguggacaaauaaccuuuaaagacccaaaauauguaggcccagcauaauguaaguauagggaacaaauugucuggaaacugcauuuugugauucaguguuuuauugaugcguggauaauuuaaagugaaauaaugaaaauuuggaaauuuaacaugaauuacuaugcuuauuauaaauaaagaauccauuuuaaaauuuuauacauuugguuuucuugaccuuuucuuaauuuuguggaauaugccuuacuaacacccugguauuuaccaacauuagacugaaguuaaguaguuuugugauguacuacaaaaaugauuuuuuaaauuaaauuuuaaauuaugaguauguauguguguuuuuugugcauguaaguguuggugccuacagaggccagaggugucaggugcaguggaguuagagauagaguugugagcugaccaaugugggugcugaugauugaaccugggucuucuagaagagcagucucuacucuuaacugcugagcugucccuagagccucagaguggguuaaagggccauggggccagguggauuucugauuuugaggucagccugauuuacauagcaaguuccagaccagccaggccuacacagugagaccuugucucacccugccaugucccccccucccccccaacuguguguguguguguguguguguguguguguguguguguacauaugcagucuaugguugugugcaugggggugcagaggcauugguuccgucuggacugggguucuuuguaggaauaguaaaugcucuuaacuauggagcugucuuucugccccaugcuuuagucuccuugauucuuacaugaaucaaggaaucauugauuacuuuggauguccuaaaaggugcuuucccuuuuucuuaacuuuaaacuuguuuuaaauuuugugacaggauuuuuauuccucagcccagauuggccuuuaauuugugaucuuucuuccuaagucuuuugagugcugguacuaacagaguaagcuauauucuuggccuaaauggugucuuauuuaaauacauuauccuauauuuauuagaucuuuuguuugaagaaccuuuuccuuaauucauauuaagauagacuguacguacuauccagaggaucauaaucuauuuuaucuaauuaaaucuguagaaaagcuuuuuugaaaaaggugcugguugguagucuucauguauaaaugagacaaguugaaaguaguuaaaaugaugugugcucuuggaugcuguuguccucauuauauuauguagagaguuuaauuuuguuaauuaugaaaauagcuuuccccccugaauaguaguuauauaguucuauaauauuagaaaacacaguuaauaaaaagaaaaauguuaaugcuacuuuuaauagguuguuucuaacuuuuagacuugacuuuguuaaauauuuugguagaugcauuucagcuccccccuacucuacauuuauuuauuuauuuauuuauuuauuuauuuuucaagacaggguuucucuuuguagcccugguuguccuggaacucacucuguagaccaggcuggccuugaacucagaaaucugccugccucugccucccaauugcugggauuaaaggugugugccacuacugcccggccccccuuuacauuuauacuucagauuguuuucuguagucaguaguauacauuuugaacauuuuucauauacuucuguaaaguguuacuaauguuuaauuugaggucccccccccccaaucuuuaauuuugguguacaccccccacucccccgagacaggauuucauucucuuuaagauuagacuggccugaacucacuaugcagacuuggaguuacaaaauuccugcuucaaucuauugaguguuugggauuauagccaugcaccacucugcccagcucccuaguucccucuggcauuuuuuuuccuuuugugugcguaugggccucacuccauagcucagacuggccuugaauuuacaucauuuuuuucugacucauucuucugaggguuugggauuacaggcaugcuaaaccacaccuagcuuuguuuaccccaucuaaaacuuuuuaaauuuaagcuuauuuauuguuuauaugauagcuauguguauguuccauguuagguuuguagaggucagaggacaacuuuggagcagguauucuccuauccuacucuuacuuggguuccaggguuaucugcugagcagccaucucuuauacuacccuugcacguuuuguuuuucuuuuuugauacauagucucaaguguaacuaagguugaccauaaauuuauagcagucuuuuggccccagguucccagaugcugggauuauaugugugaacuaccguaugcucaaauuaaucugaauuccuggguucaaaugacuuucaugccucaauuuacuguggauuuggaaauacagacagauaccacuauacccaaugagaaaaagaaauuuaaaaauggggucuugcuauguagacauuuguaacuaacuaggaaauauacuguucaguccaggcuggccuugaacucaugaacucccccugccucaaccuuucucuagugcuaagauuacaggcacggaccacagugcucugcuuagagcuauaucuguuuucucauagacaugauuacuguacuucuguguuuccuuuaucuauuaacucaaaauuuaguuucgauuaggauuucuuuauauuuuuugaaagauugguuuuuuauuauauauauaugagugauuugccugcauguauguauaugcacauguaccauauuggcuagagcuggaguuacaggugguguuuagcugccauauggguucugggaauaaauccugggucauucagaagggaggccaguguuuuuaaugcugagacauuuaauuaaugggcugagauucccuccuucccucccuccuuucuuuccuuccuuccuacaguauauagcccuggcugugcuagaacucauuguguagaccaggcuggcuuugaauucacagagauuuacuggcuucugccuccugagugcugggauuaaaggugugugccaccauaccuguauggauugaaauuucuuuguuuuaauuuauuuuuuauuuuguguguauugguguuuugcuuguauguaugccuguguuaggguguuagaucaccuggaacuagaguuauagacaguugugaacugaaaacuucaguccuggaaacugaaccugggguccucuggaagagcagccagugcucuuaacuaccgagucaucucucuagccaggauugagaucuuaaucuauagugaauuuguauuggaaaaauguugucaagauugucucuucauguaaacacagaguuccuauguguaagacucauuuguggguuaguuacaguuacuuccucuuguaaaugcugcaguacugauaggaaagucuuugugagagcuugauaauguauuucauguuucuguuugauguuugccugacuuuggguuuuuguuuaucucuuagaaaugacugccguccacgcaggcaacauaaacuucaaaugggaccccaaaagucuggagauuaggacucuggcuguugaaagacuguuggagccucuuguuacacagguaacaaucugaaaacacaaauaguuguaacauucuuuagcaauaggccuggccaccaaacccuaacuaagguucuuuagcucagagucuuaacuugaguugguugaguuuuaauuaguuugacaguccuuuugaauacugguacauuucuuuauuuaauucuuucuacuguugcaauugagacaagguuuucuaucaccacacugaccucaaccuccuuagguauaugaggguagacuugaacucuccuggucccuguuuccaccucuugaaugccacuuguauuaaagucaugugccacuaugccuggcuuuauuuaauucuuuagacuacagcuucacuuuucugaaaucuuacugcugauaguaaagguuauugguauuauauaguacagauuucuaaauauuugugcuuugcagauaacuucacccuccaucagacaggaaauucaaugaaggugggacuugaugguuaagguucuccacuuaucuuaaugcacccuucauuguguaggauuaguuagcagguaauuuaguuugaggguguaggcuugguauauucuguuacaaauacaugcgucauagugugaugacauugauuagcuuagcagcuguauaguuuuacucuuuuggcauaguuaauguauguguauauuuauauaugagaggagagagaaaacaagaaugacauuugcugucuuuaaaaaacuugccuucuaagccauaaacuaagguuuuauaugucuauauguagauguguggggguuagugggauacuugcugucuugaacccaguauucuguacuuuucaggucuuauguuuggcagguuuacacuguaacaaaacuuuaaucaucuucaaccuacagaucaucuggcauauuaaacuuauuaaugaugucuaaugcucuggaacuuuuaagcaucaucgcaguaggcuuuugugggcaaucuuucauuucuuuauuaaggaccuuuacuaauuaaugcuaagauuugcauuaauaaacuugagcagacuucagaaguaaguugucugagaacauuuugcggacuaguaacaaugacaaaaauguagucuucugguaaaucuaaauuuauuguccagccguuucuggaauaccuugacuuaaaaaaaugacguuucacuuauccccaaucauaguuugagucugaagucucucuaaaaacuuaaugauuacuuaagaacuuaagauaugcauuauauuucucucucucuuuuuuuaagauuuauuuauuuauuuauuguauaugaauacacuguagcugucuucagacacaccagaagagggcaucagaucccauuacagaugguugagagccaccaugugguugcugggauuugaacucaggaccucuggaagagcagucagugcucuuaaccacugagccaucucuccagccggcauuauauuucuuaucguauacauuaagaaacaaaauuauuuuggaaacuaaauauagcauaauuuuaagaauuguguuauuucauguuuaguaagaucucuaagugugucugucaccuaacuuacuuaugaacuuggaauugcuaucuuuaaagauacuagucuacuauuuuucauucuaaaugauuuuuuuuuuaaauuaaacuucuagguuacaacccugguaaacaccaauaguaaagggccgucuaauaaaaagagaggccguucuaagaaggcccauguuuuggcugcaucuguugaacaagcaacugagaauuucuuggaaaagggggauaaaauugcaaaagagagccaguuucucaaggaggagcuugugguugcuguagaagauguucgaaaacaagguaggucaauauaugaagagagacagguuuuccuagaaauacauuaaaauuuuaaauuuacauuuauuuauacgugugucugugauucuauauaugggugccacagcauggcauauggaagucagaagacaacugugggagcccccucccucccucccucccucccucccuccuccccccuuuccccccucccuuccuuccuuccucccgucaugugagucuggagauugaacucugguuaucugguuaucaaauguggcagcagcucucacugagccaucucacuggcccuaacugggcuucuuucucauggguuauucaccaggggagaguuggcugcugugccaugagaacacuuaggaaguucuguagcaaggagguaacgucugcugcuaauggccagcagcauacuuuugccaagcauaugaauggacuacuuuggacagauagccauuuacauucaagauucagaagacagcacucccaacuaaccccaaaggauuauaaaugcuccuuuuaagcuaucauuaauuuuugaaugauuagucagcagaagaaaauaugauuuccuuucucuauaagguuuucaguggucugaaacauaaccuaacuugucuuagguuagcaauuaaauaauugcuuaucuaaggaaugcuuaguugguaucuauggaaacauuugguuccuuaagggacuguaagauguguuuguucuggaucaauguugacuaccuuugauuagauagggguuucuaguuuuuuuuugguagagggccagcuaguauuuuaguuuuacuggccauagagucucuguugaagcuacuuagccaugcuauaagcaugcuguggagaauauauacacaaaugugcaagguaugaucugauaaaacuuacaaaagcagagguaugcuguuuugauauacaaaauauaguuugcuaauuucuaaucuaagauuuuccuacacuguuaaaaauagaagcuugcuggguucaaagaagaaguacuuguuuaugugaguuucaagucagauuucuguguuugggguuugugugugcccugugcuuucuaugcaaccauaauuuuuaaaaaagauuuauuuauuuauauaugaaugcucuaucugcauguacaccugcaugggagaagagggcaucagaucacauuacagaugguugugagccaccauggguugcuaggaauugaacucagaaccucuggaagagcagcaagugcucauaacugcuuagccaucucuccagccccuaugcaaccauaacaaugaaugcauacaguuuuguauaauuuuuuauaugaauaacguaugaaaauuugggugucuuaaaauaccaccauaaaugcuauaaguguaucagaaacauccacauucauaaaacucaaguccauuuuauuucaagguaaugaaaugagccucccaagaaccuaccaugggagccaguuaucaauuucacagcaucuaaacucauguggucuagggucacaucauaaugacaaucugcuuaaacuaggugcugagccuuauacaggcugauguauauugcugcuuuuuguaugugcccuuucuuguuuaguggguacacauccauaugucuacucuuugguuaggucaaucaaguguuuucuaauuuuuauaguaauaauuaauuagauugcccuccccuucccagucucuaguagggcagauuacuuuauaguuugguggucuuuucugugcuaccuaacauggugucaggucugugguagauaauagguauuguguuuuaggauaauuagcuauuuccuaaagaguauggugugagaaagaaaaguuccuuucucacauuuuaaguguauuuacaaauaugaaugcuuucauguaggugaagaaucauaaaaagcugauguagugcauacuauaucagccuuucagaguuuguaguauauucuuaggguuguguagcugugguugcugucuuaaguccagagcauuucugucacccccaaagacaccuguacucaucauaagucacugacgucuuuggcacacaguagggucuuacuaucuaccucaggcuugcccaggacgcuggaucauuuugccugguucccaaauguuugaauuauaaucgugugccaucaugauauauauuucaaaaguucacaaagaggagggcugccucugguuauuuuaaguauauuuuaugaguccuugaauaauaaguguucuaacuagaaaaagaaagcauuuagcuggcuuaagggaugccagacagauaagaugaggcaaaugauuagaaaaugagaaguauagaaaacagaacuagugcuguuaaguuggaaguaaggggaugaggaauaguuucuguguuaguugcuuugucucauugcucuaagaaaguuccugacaagugcaacauaaggaaguuauuuuggcucgaaguuguaggguuacaugcauacuguccagccuggugaggaagaucugaaggcaggaagaggagguaucuguucacauugcaccuccaccuccacucuagaagcagagaguuaggaauacuugugccuagcuuguuuucuccuuuuuaucaguccaguaucccacccauuaaauaguauuguccacauuuaggguaggucuuucucaguuaacauaaucuagauaauuccacauagacaugcucagaaaauuguuuccauaacucuaaaucugaagaauuuggcaaucaagauaacuuucagacacacauuggaauaggauuuuacuugaugguuguuguggggcuuuccuguaaucuuaccucuuagaaagcaugagcaggaagauugaaagucauaccuggacucuauagucaaccuuaccuuaaaaaacaaaacgaaacacugggcugcagucaguaguuggcuuuuaaaagcuuauaguagggacuugcucuaauaugaguaacuucuuccuugcuacucaugugcacgucugagugaugacucaagaagcagaugcacaucuuuguauaauccuacauugcauucaacauuugguucaguaaaaaaggcuaagaagcuagccugagcuacugaaugagacacugucuggaguguguguguguguguguguguguguguguauguauauguguguguguguguguguguguguguguguguguaccuacaaaaaccagaaagaaaauagaagagggcucaauuaagcauaugauuagguaaaagugaauuuucuaggaaggauagauguuggggaaaaaaccaaaugggguaaguuggcugguuacauguguuccucugaugggcaagacacucuuguauagccuuuaguuacuuuucuauugcuguacagacaugaugaccaagaccacuugcagaaggaauuguuuauuggugcuuacaguuucagaggguugguuagaguccaugaugauuaugguggggagcuugggaacaggcagggguggugcuagaguaguagcugacaccuuacauuuuugucacaagcaugaagcagagagagagagagagagagagagagagggagagagagagagagagagagagagagacagacacuggggauggugugaguuuuugaaaccucaaagcccccauccccagggacacaccucaucuuuaccuucuaauccuuaauaaacaguuucaucaacugggggcaaacauuaaaauauaugagccuguggaggcaauucucauucagacgacugcaaguagaaaaguuguuuuuccuguuuuguuguagaaugauacaugggcaugaaauguaaauuaauagcaugaauauuagaaagaaugaugagcagauaaacagcagguuagaaauguuucuuauguguuaaaacauccauuggaucuuuaaauggagaagaaagggaggaugccaucuagggaaguuggagcacaguaagccaugccuggggaauguugagggcucuuacuuuaggagaacauuauggagcacugcugauaggaaagguuaggacaguguaugguguuuuggcucaaaucauagagcacacacaggguccuggguuugaucucagaaaauauccuucuuccaaaagguuuagaaaauuauuauguccugugaguuuuugguuguguuuuguuuucagaaccaggcuguccuuuaguagcuugccuuucagccucucagcuaaagauaagggugugcucuuggcuuagggugccacuugagagugguuuggaaugccagguguggaaugaaggacuucuagggaaugguguagaaccacaggauucuguuguuaggacaaguuuacagcuuaguauaucaagugauacagggcucuuuccaguauugguuuguguguauuuauaaagcuuuuucuuaauuuaaaccagaauguuucuuuaauuuucuuauguugaaguucuaccaucuggacaacauaaaacauagggacaggugaugcucaugggagauuaagucucuggaacucgguacaggaagguucaagagguugacagauaggagguagucuagaggcaggauucugagucuagacaccauuaucacugcuguaugguaacgggaaugcagggaaaaaugcaaaggaauaaguugucaugugggcuaacucuuguucaaauaacuguuccuuuuaauggauaaaguuaagggaugugguacaugaaauacugcgugauuuauuuucuuguaaccugaaucaauuaaggaacauguugaggccaugggagcuaaaaacuuaggcauauuauugaaaguuaaaaguauuuguucuaggugcuuuggauguagcuaaggugguagaguacuugcuuagugugcuugaaacccagguuuugaucucagcaucgcauacaaccaggcagaaguggcauccuccuguagucucacuacucaguagguagaugcaggaaguucuaggccauccuuagauacauagugaauucauagccagccuaagauacauccuggguuauaugagacacugggguuguggggguggggguggggauggggguggggaaucuuaggauagagccaguugaauucaguugggccacuucuuagucaaguuaacauuguuugacaauauuuaguccaguaguuuaguugauuaacaacagucaguuaaugaguugcuuuauuuuaacuuuuaaaaaaaauaauuauaaaucacuggaaauuguaaaaauagagaagugcaguguauccugcagccagcuucucacuuguuuacaucuuuuagaacuauauauaauagugcaauuucuaaaucaggacacuagcacugguucaauguguacauacaacucuuuguccuuuuuaguauaucuguagauuuuauagaacuacuguuucaagauucaaggaauuaguucauuuucuuaaagaucuaauuuacuuccuuguucucauucauuuaccucuucucuucuucucugaaucacuuuguaauucuguuguuuuaaggauguuauguucaagugaucguuuaaauuuucauugcuacuccauggcaugguuguaacuuagucaccggaaaguaaaaagaugccucuuguaaauauucucaacauuuuuguguguguguguguguuguuuauaaagguuuuauauuuaacuguguauauauguguuugucuguauuucugcaugggaaugugugugugaggugugugugugggggggugggggugucuaggugcacuucaaagacagaagaggauguuggauaaucuggaacuggaauuacugcaguuuugagcugcccaguaugagaguugguaaccaaaaccgggucaucugcuagagcaaucugcagucuuaacuauugaaccauuucuucagccucuuaacaacucccaccccaguaaaaacuuuaucaucuuauuuaucucuuuguguagguagcacuggcucuccuagaacucacuauguagacaaggcuagcuuucaacucagauugccccugcugggguuaaaagcaugugccacuaugcccacuuacuuuuguauuuuuaaauuauguguuuaaaucugaauuguuuuggguugcguuuuauuuauuuauuuauuuauuuauuuauuuauuuacuuaucaauuguguuuaggucaccuucuccuucggcuucuuuugccuauggagaacucaguugccucagcauuuuuggaaauguugucuuuuuucaguugaauuaauuuugcacauuuguuaacaaucuauagguuguauguguaaaguuagauuuccuuccauugauuuaugagucuucauuuucuuucuaccaauucuacaaagauuugguuauauaacacacuguuuguuuguuuguuuguuuuaaacuuucuauagcagaacaaggagcagcuuguauguauguguauguaucucauaagugugugggugucuguagaggucagaguuguugggucuccuggagcugcaguuguaugcuuugugaacugccuaaugagggacuggauuacgaauuugggucuucugaaagaacugcaaauguuuuuaacugcugagccauuuuccuagcugcaagagaaauacauguacuuuuuuaaaugucuugauucugugucuguguaagagagguaccccugcaaugguguacauguagaguugucucacuucauuagagauugaauuuagauccuuaggcuugcuggaaaguuccuguaucucagccauuucucuggcuuaguauuuuauuuuuauuuauuuuuuauuaucuuauuaaaaauguuuuauguguaugggucuuuuuugccugcaugugucuguuguauaccacacaugucuagugccucugaaggcuagagaaggguauucgauccacugggcaaguuaaagaugugugacuugcuggguaggugcuggaaauugaaccuagguccucuggaagagcagccagugcuuuaagccacugaguugucuucaaccugggacagaucuuuuuaaaaaaauaaaauauaaaauacauacaacaaaauacauauacucagcauacagcuuggugaaauacauuuagaacauuucccaaggguauaguuucuaggaacuuaaaagauaguuuuuguaaaucauuuucuagaagaguuuuaucuucaguuuggugauguucauauaaccucagcuacuaugugccauagaaauccagcucagaccuguuugaccugggagagaucuugaaccuuugcaauugggauuucuagaaguaucucuugaguauagguauuggucaaagaugcagggacuugaucccgagaaccuuucaccucccaguuuugguaauuugguuugucucuguuuucauguacucuguguacauguccuagacagaugccaacauaagauagucaucucaguuaggucgucagcagaacaucuuuucuuccucagugucuauaacuagcccaguuugacucaugcucagucuggaauagguuuucuguuggcagaggacaguaaaacaaaucuggauacaucuuuaccccacacacaagacauuggggggagagcucucuauaggcucauguauacuccauaaagugauguugugcaggaaaaaaaugguagucuugacagauacuaggauagucccauaugauuuuuguuuuguuuuguaagcguaaaauguuuucuuaaaaaaaaauuguucuggagccagagggguggcuuaggggucaagaacauuugcuguacuucccgagagccaacauuuguuuuauagcacuugcacugagcagcucgcacuugaguggaacuccagcuccaagcgauccggcacccuguucuuuccugcugggaauguauacacgugacauauauacacauaaauaaaaugacaaaaauaaguuuuaaaaaaaugagucuuuugaagcugggcuguagcuuagugguuaaauguuuucuuagcaugcauaggauccugacuuugauccccugcagcaaggggaaaauuauacuguuguuggugguagauacugaauuuuuuauugcuauauuugaauuguccuagugcaguacugguuaucuauaagccuuaguuuucuuuuguugauuuguugaagccuuuguuuuucuuauuaauugaaacuaccaguuuuuuuuuaaaguuuuugugguaugugugugugagagagagagagagagagugagagagagagagagcgcgcaagugugcgagagcacaagaacauuugcaggugcuuguagaaaauagaggacagagaacuuucaggagccaguccugucuuccuagcagacuugcaggauugaucaaaaugaccaggacuguucucaagcacuuaguuuugagucaggaacuaggcuggucuggaaucuacuguguguacaaaguugaucucgaguuccugaucauuuucccacuccugagccuuggcuuuaaacucgugcaccaccaugcucagcugaaauaacugugacuguuauaucaaccacaguaaauuacuucucgauauguacuguaguucuccuggugaacuucaggagcuugguaaccugauucagccuuuucuucaguaucaaagaaacuguagugugaaccuuaaacgucugcuccaaauggcuagaaggugaagagggggucguuuaguaaauagaaagagaaugcuuuaauauuuuggcuugcauuucccuccuuucaugucuguuugcgcuucaguaguaagcguuuuaagauuuggggggaaacuucuuaaguucuggccuuugggucaguauuccauuguagauaauucgguaaugaugcauugcagagauaaaauuucaaguuauugaaagcaaccaaaauuguucuaaguaucagucuuuacauaaguuccucccucccuccuucuaccucucucccuuccugagaacaggaucuuacuagcucaggcuggcuuugaacauacuauguagucugaauucuugauuaucuuccaucuccugaauugugaaauagcaggcauguaccauguucuagacuauuaagcccuuuuaugugacacauaacugauucauuucagagcaagaaacuuuuucugcaaaagcucaggacuuuguaagcacaguugcuuuguaaacuucucuaauggcuuaguuaucuccagcuauuuuuacauaaacucagggacauacaguuuuauaaucauguaaaacugguggucuuuuacaacauuccacagaggaugaauaaugaaagcuuuuguuauuuuuuuuaguacaguucaaaugauuuguagugagugugugugagcuuuauuuuauuuuaggaguguguguguguguguguguguguguguguguguaaugguugucaagauugauauuggaugucuugauugcuuuccagcuagugcaacaagccagucugcucugaggauucccccucucugccaagacuuguagguucuggcuaucagugaagaauacuucucuuuuuguuuguuuguuuguuuguuuuguuuucuucuucaauuguuaaucuuggcaagggaauuuuaaaugauguauuuaguuccugaccaaagggauuuugaguuuuaagauguaugugugugugcgugugcgugcguguauaauuuuuaaaaauuauuuauuuauuuauuuauuuuccugccagcugaugaaagucacauugaaggaagugaaaauuggaccuguguccaguguggauguugacagcuguuauucaaucuguguaaaaugccuggaaaauagauguuaaaagagauaggacagaguaacugucagugaccacuuugaacaggguuugagagguuaacaagaggcagaaugaaguccgagguugcugaauuuaugauguagagacaagcagcuaugaggagauuuguguggaugugugggucuuucuagucagguggagguugugagcuugauauuacacaguggcccuuucauaggaaacaaucaacaaguguuucuacuuuggaaugccgaguaugaguuucaagacauaacgaugcucauggaggagugugaaaacaucuaagucacuagguucuuagauugcuguaauaacuuucuucauuagguccaauaacucagcugauuuuucucauagucuuccuuugagcccuggcuugcuuuucaacuuuuuucucuuugcugcauggauaaaauugucugaucuuuccaacccccugccccuuuuaugucucucuucauuugaucuuuucuaucuggaucuguuagaaguacauccauuuucuaaccuccauauguucugaagccuaugauuagauaaaaacauuguuuauuauuuacccucagaccccugaucuuaucacuuaauucuucucuugcuuuucauuuuaguugagcaggguaagcaaaauauaaauuuuggaaaaucauuagcaaguugucaccugagagcuuuaugucuuaaguugucugucggucucaaauuguaagucucuaggguugaggcuguacuugguuugacuugggaugugucaaggaugcugucugcuucuggaucagugcccaugugugagcauaugcugcucugcagagauucaagugcuaaugcagccaacuuguaagugaggaaagaagagugaaaucauuaaauucuaauguuucuuaccauuuugaaauuguuccucuuuuaaagaucugucuuguuaaauucacaaaaauaacacccacugagauaaugcucuugaguuacagcagguaauauuguugccuuaauauauuuguacaguguagcagagguuaucucaguauuguucuguuuuuguuuuuuaaaaauucuuuucucuuuuaauguuuauguaugcauauauguacaucugugugcuaugccauuggaaauuagagaaaaucaguuuucucaccuuacucuguugggucugggagagaacuugggcuauccagcuuggugguaaguaccgcuguuaccugcugagccagcuuguuggccccuuuuaaaauuuugagauggaguuuccugccacuaacugaccauguagcagaggaugaccucagauucuuggaccuccugccucugucucccuagugcuaagaguauaggaaugcacuccacugacuugguuuuguguuuuggagacugaaucucauucugaggccaggcuggccucaaacuugcaucaauccuccuaccuaagcauacuaaguggugauauuacgggucugcaccaccauacccagcuuaauuuagguguugacuucaugugugauauugcaguaacuugguuacugcuaguuaauuucuuaaagaaagcgauuccagguugaaaugcauguuaugcauuuauuugaauguguaaucaggaagcaagugucucucuuuggaguguuucugaauagcagcagggcacacuugaauuagaaaggaaaaugagaacaugaauaugugugguacucuauuuuaauuuaaagaaauauucugucaacuauaaaaguggaaaaugcaaagcuucuuucugugccaccaggggguaggagggaggaggguaaauugaaagguuuucuaggcucugugaguucagauuuaaauaacuugauauuaacuugaugcaguugggcugacucuaaaaagauaaaguguaaaaaucacgugucagagauuuccugggaucuugucuuauguuucuguagcugugcuguaucuggggcccagggcuuugccagaccuccuucagugaauacagggugagagaggacgcugccucugguuuagaggaguaagugaugcccucucuuccuuuccucuuuauucucucucucuucugaaauucuguaucuuuagggguuaagaucugagacauauguaugaagauguuaaacucuuagguacaggauacuugguaguagagcuuucuguaaugcccauuucuugcuacucuggguagaauggaaaacaaacaaacauggaucuucuuagggaguugagaugaaacaacagucuuaccauguaacucaaggugguauugaauuugugauuuuucugcucagcuuucugaauauagacauuauaguccuguaccauuuugcgccccccccccuguguauguguguagauaggaauaaagaguauuauguagcccaggcuagccuccaacuugauauauggaugaccuagaacuugcugacucuugaaagguaagauuauagauguguggcaccaagccuggccaaaacaauuuuaaucgaaaucuuacauuucaaaaacaaagcaacauuaacaaaaaggagaggaggagaaguaguaguaguaauaauaauaauaauaauaaucugagccgggugugguggcgcacgccuuugaucccagcacucgggaggcagaggcagguggauuucugaguucgaggccagccuggucuacagagugaguuccaggacagccagggcuauacagagaaacccugucucgaaaaaccaaaaaaaaaaaaaaauaauaauaauaauaaucuguagugaauguauuucgauucuagucaaaaaaagaaaaguaaaaguuaccuauaauuuuguaacugagauacuaaaaacauauguuugugauuggggagauaguuuagcaguuaagagcauugacugcucuuucaaaggacccugauucaauuccuaguacccaaauauucgcucauagcuuucuguaacuugaguuucagaggacucaaugccaucuucugauuuccuagggcuccuucauauucauaauacacauacauucaggcauguacacagacauguaaacuaaauaacuuuacaggcuguuuucccugacugugcuaacaugaguaggacagugugcuugguugcuucauucguuuauuauuuauuuauuuuaaauuuauuuauuauuauacauaaguacacuguagcugucuucagacgcaccagaagagggcgucagaucucguuauggaugguugugagccaccaugugguugcugggaauugaacucaggacgucuagaagagcagucagugcucuuacccgcugagccaucuaucucaccagcgcucacccccuuuguuuauuuuuuacuuuaugauacugaaagauguuuaggaucuaguuuuuuuuccuacaauauaauuuuuauccuugcaaaacauuuuguauggagugauuaaauuuagacacacuguuuuguuuuuuuguuuguuuguuuuuuuuaaaaagauuuauuuuauuuauaugaguacacuguagcugucuucagacacaccagaagagggcgucagaucucauuacaggugguugugagccaccaugugguugcugggaauugaacucaggaccucuggaagagcagucagugcucuuacccgcugagccaucucuccagccccacacuguuuuguaccagcaaaccauacauuuuaauuuuuccguuuuauuuguuugugugugugcacgugcacuauaguguguuuguggaggagccguuauugccuucaccugcugggcucuguagauggaaccuaagccugguggcaagugcuuucauucauugagcugacucccuggcccuaaugauuuaaaaaauacuguuaacuuuacucacuuuucaugcuuguaagcacuuuuaaauuuuaaauaaaagacugaaggcagguaugagauaagggagaaggaaaaagguuugagagcauuaauauaauauccuaaugaguuagaaagaacaauugaacaaagucuuggaaaacacgacaaggugccacaauuuccugaauguccaaaaaaauucauccuggccgggcgugguagcgcacgccuuuuuuaaucccagcacuugggaggcagaggcgggcggauuucugaguuucugaggccagccuggucuacaaagugaguuccaggacagccagggcuacacagagaaacccugucuugaaaaaacaaaaacaaaacaaacaaacaaacaaaaagauucugaaauaauuucuacauuuugaaaggugguuaguagcacucaguuguuuaccuaaagcuucugucauuuuaacacagccccccccccuuccccugguucgcagaaugcacaucuagguagauaucucaaaaggucauuugaauuuggcaguuaauaagaaacaguaaaauguuucagaaaugacuaucuaaggucaucuaauaauuggaauuuuuuucuuuguguuagcuguaaacauaaaauaaaaaugugauugggcuuuguaaauaaccacuuuaucuguuuaaccauauuuaaacaccugauuuuauaaagcuuuuaaaaaggauuuuagagacuagaaguagugguauacccuuguaagcucaguauugaggaggcucagucaggaggaacagaagugugagacucgccucgucugaaaccucgucugaaagaagaaaagacuuagcaauguauuaauuuugccuuuucaguuuuguaauaaacuagcaaacauaagauuuuuaugccuuaaaaacaaaaaauuugaaacaugacacaauguguacacacacacacaaacacacgcacacacacaacacagacacacacagacacacacgagaauuuugagacagguuuucucucuguauuccuggcuaucuuagaauuuguucuguagaccaggcuggccucccucugucucccaagugcugggauuaaagguucuugucacuaaugcccaucaaauuuuauauauuacuuguauaaauaacagauauuuuaaugguuuucaucauuuauaaaccuuuucuuuaaaaaauuauauucgugaggcugaagugauggcuguucuucuaggggucgauuucuaguacccacaugugucucacgaccaucuguaaguccaguuccaaggaaucuguaccuuuugcuggccucugaggcacagagcaaacauuuguugcauagacauaaacacagacaaagcacucauacacauaaaauaaugaugaugaugauauugcuuauaaacaugcagagaacuauuaggaaaauaaguaacucauagcacaccaccuuugguacaccauagucuauugcacucgauguagugcacauacacaccaguacccuguucacuguccaacacugauuauuauauaccuguuauuaggacucauuaguaaagacuuggggcaggagaacuguaauuugcagcuguguaccucuacaaaaugaguguuuuuuuccuucccccuccuaccuugcuccugccuuuuugugugccccacucccuucuuucuuggacauagaauauaggaaaauucuggucaagaagcaagguacaaguauuuuuaaggggcuggaaggguuguugagccauucaagagugcuuccugcuuugugaccugaguuuggauccuaaggaagcaccuguguaauagugagcacaguagcucacuguucccugugacuccagggcaucagacuccucuucuugcuuccuugugcacacauacucaaauacacaaaaauuaaaauuaaguaucauuaauauuguuguagacaaaaacauaaacucuuguauucauuggcguuucuuuguauagaguacagggagugugaagugguuaaugggguaacugagggagaugagaacucccuugagaacuacaaaagucuuagcuuggaacaguuuuuuaaaauauaaaaaaguugggacuguugagauagcuuaguucuagagcccauggguagaggggagaacugacauuggcaggcuauuuuuugaucucauguauacuguggcaucuucauucuccaaauaauauguaaaugcgugaaugaguaaguauauguauggagaauaaaaugugggaaaaccaagggucagcaaggcgaguuucuucagucagugaugguucacagaaggaccagcuucuuuucuaaaagugacuuucugugguguauagguugacuagaggaggugacuggugcagcauuuccugcuaggagccaacaucuacuuuauccuuaagaaacuugcuagcauaacuauugcguuuucuuuuuguuugccauuuaaaacaggaugucauuuauccugggcugcccuggcacuuacuaucuauccuagaauggcguugaacuaguuuucuugccuugguccugacuugggauuacagacuuguuggggagcaggcagcucugucauaaacucaagaucauccucaacuauuuagccagccugggcuacagaacauuuugucucaaaacaaagaaacuaacauacaaaguacccccccccuuggaacuaagcaaacaaacaaaaacuuagcauagcauaauagaaucuuugagcaacauguggcagcucaucucaugccuguaaucccaguucuguggagguggaagagacgggggauggagguucaggaccguuugcaaguauauaagagauggagccauucugggaucuauaguacaugcuuuuaguuuuugaaaauuuagauguguaaauguuuuugugugcaugcauaucuguguaccacuugauuuccuugaaggaguuacagauaguugugaucugacauaugggucugggaauuuaaguucagggcucagauuaaaaaagaaaaaccuacaauuuuuuuuuuuuuggcucaaaaaagaaaagaaaagaaaaacuuacucuccuuuauagucauccccccccuauuuuuuugcccauauuucuuuuccuauaacuuuauaaaguuugauugcuuugagggaauauacuuaagguaauugauucuuaagaaaggucuuggucuuaaucuuauucuaauaaagaacuagggguuuauuuccccuuuuugucuuuguuuugaaugaauagaaguucuuaacugcuacugucucugaaggagaagaaaacuuugggguugacagaucuggauucaugacagaugauguaauaguagaagguucucuuucuuguuuuuuucuuuguuuuguuuuuuugagacaggguuucucuguauagcccagguuguccuagaacucacuuuguagaccaggcuggccucaaacucagaaauccgccugccucugccuccugagugcugggauuaaaugugugcaccacuacaccuggcuucuuucuuguuuuuaaacuuacuuauuuuuuuuuuaauuuauuuauuuauuauauguaaguacacuguagcuguccucagacacuccagaagagggagucagaucucguuagggaugguugugagccaccaugugguugcugggauuugaacuccugaccuuuggaagagcagucgggugcucuuacccacuuagccaucucaccagcccuauuuuuuuguuuuuuaaagacaggguuucucuguguauucuuggcuguccugguucuugcucuguagaccagccuggccucgaacuuaaagcucuaccuaccucaacugaguucugggauuaaaugcaugugccaccacuccuggcaaccccuccccccuuuaauuuuauguguauggguguuuugacugcauguguauaugugugccaaugccuggugcccucaaaggccagaagagggugucagauccccuggaacuagaguuacagaggguuguaagcugagccaacucuccagcccuaaggguuaugaugcaggaaguaaguaguccuuaucuuacaagcacuuuaacuuccugagcuauguccccagguacaagguucucuugaguuuagucuccuuuguaucuuaguacuacacaugugguagaauugucuaggagguacugggaaacaggguuagagucugaguucuuaguggugacuauaugaucugggguaccauuuuuguuugcuucaguucccuugcaccucuuuauauaggaagaaugcuuugaucucuuaggaauguacuuuaaagacuuacugacaauuacaguuuuuauuuauuuuuuugagacagggucucacuauauaacccuugauaccuuagaacucauuaaguagaugagucuggccuugaacuuacagaaaucugcuuguguguuuuucuuuuuucuuuuuuuuuuuuaaagauuuauuuaauguauaugcauacauacagauaugugugcuccaucccugucuucagacacaucagaagagcgcaucagaucccuuuauggaugguugugagccaccaugugguugcugggaauugaacucaggaccucuggaagagcaguuggugcucuuaaccacugagccaucucuccagcccccuuguguguuuuucuaguguugagaacauagaugcaccaucacuuacuggcuugcuaauuuucuuuuuagacacagguuucauguagccgggauggguuggaacauuuuuauguauucaaaucugacuuuuuaauuuuguugccuucccaaacugugggacgguaggcaugagccauuuuuucucacuuaagaaucaaucaguuaaucaacccuuucucccucccuuccuuccuuccuuccuuccuuccuuccuuccuuccuuccuuccuuccuuccuuccuuccuuccuuccuuccuuccuuugauaggguuucacuggauagcccgggauagccuggaaugcucacguguucguucucucucucucauuuuuuuuaauuauuuguacuuauuuuauauguuaugggggaagcauguaugcauacacguggaguucauaguucaacuugugagugcugguucucuccuuccauuauguaguuuucaggaaucaaauucagcuggccagggauggugacaaguacguugaucggcugagucaucuugcugaucuuguucaaguuuugcugauugcugcugaugaucaugaugauuuccuuuuauuuuugcagauaaaaagcuuauugcaauuuuacugggcuggggagaagguuaaagugcuuguauuguaagugugggucuuggaauuuguaucuucucaaccugcauaaauguuggauggguguaguguacccauguaauuccagcauugggaaggcaaggauagaagaaagauguccagaguggacucaguggaggccaugccucagugaggaaggcuggaggugguugaggaagaugcccagucuugcuuacuuuacggucacagggagggccuuuaagcaggcucuugaacuuaggucuuuuagaaccugcuucucuaucuuuucuuucugugugugugaauucagaaauuguuuucauuguucauuuuguuuauuggauuuuuguaggugagugauaggacacuggaucugacuuuguugucugccagccuugaaccagaaagucuucuuucuucuacaguagaggccacaggcuucuacacuuacauguucagugugauuugcguauauuuuuauuuuauuuuauuacuaauaagcaccuguuaaauaggagaugaagaaguuguuaugguugaaaucuagcuagacugcauuauaauugauguaaauguuuaucugauuccuuauagucacugaguuaagggaagagguauuuuaagcccuuuuguuauauaguacccagaucucuguuauaugaagauacuuaaguaauaguacaaaccgaagagagaaaaacagaaacaaagacucuuuaaaauacacguauauaugaaauaauggagugugggcuaucuuacccuuuaaauaaaauguuaguuuuuaaugaauaaauuauuugaauuaauuucugcugguuuuguguuuucauucuguaaaauaggagauuugaugaagagcgcugcuggggaguuugcagaugauccaugcucuucugugaagcgaggcaacaugguccgggcagcucgagcuuugcucucugccgucacccggcugcugauucuggcugacauggcagaugucuacaaauuacuuguucagcugaaaguugugaguuuguaucuauauuuauaauuuguucuuuguguccuagugaagcugguguuggccauauuuuguuuaguauuaagaauuauuuuggggcuggagagauggcucagaggugaagagcacuuacugcucuuccagaggugcugaguucaauucccagcaaccacaagauggcucacaaccaucuguaaaggaaucggaugcccucuucugguaugucugaagacagcugcagugcacucacauacauaaaauaaauaaauaauucuuuaagaaugcuuuugguuuugacucagugauugcuuuguucaauuucuucucuaguucaaguauuuaugacacaggcucuucuacaggccaccuuugucucaguuuugcugaagaaauuguaacaaagguauuuuugacugccuuuuauuuuauuuuuuuuauaguacucauucuauguuucuuuguacuaauaguguuccagaauuagaaagccaaaguauaaacuaauuaggugcuccucaauaccuccaaaucacucagacaaugccaggccauaucagcuacgcauacuuguuuggguugcuuucggaauagcuguuaaagaagguagcaucuuagacuuuauuaauuuucaccuauagauuugucuguuuuagaguuguugcuuuugugguuuguuuuuuuagguggaagaugguauauugaaacugaggaaugcuggcaaugaacaagacuuagggauacaguacaaagcucugaaaccagaaguagauaagcugaacaucauggcagcaaaaagacaacagguacaaacaugacuugcagacauuuuauguuacuuccuuccuuauuucuuuguuguugagacaggaucuuacugugaagcccuagcugauuuggagcucacuauguggaccaggauggaguguauuuuaauauccaguagggauacccugauuugccuaaguuuucuaauguuaccauuacuuucaccccuguucaugugguucuaauaagugcuuaagagauaccggccuggugagauggcucagcgguuaagagcacugacugcucuuccucaggucuugaguucuaaucucagcaaccacauggugacucacaaccauccguaaugaaaucuuauacccucuucuggagugucugaagacagcuacagugcacuuacauauaauaaauaaguaaauaaauaaauaaauaaauaaauaaauaauuuaaaaaaaguuaagaaauauccuuucaacccgauggugguggcauuuaggaggcagagguagguggaucucugaguuugaggcuaaccugguuuacagaguaaguuccaggacagacaggacuacacagagauacccugucuugauacacccccacaaaaaaagagagggguggagagagagagagagagagagagagcgcuuuucaguauuauaaauaaguuucacucaucuuuccauauuguguuucuaaguaguucaaggcuugccuuaaacuugugaucuuccucccuucuguuuucuccagcaucugagugcuaaaguuaaaggcauaucccaggauguguggcuaaaaacauagcagcaguucaaaauuuaugucuaauuagagaaacuuacuagaaaguaauucugucugaauuuucauucucugugucccuaaguccaguaggaauuccuuacauaucagcaguccucaaccugugaauggcgaucccaaaauauuuauauuaggauuccuaguaguagcaaaauuagaguuaugaaguagcaacagaaauaauuuuauaguuggggggggucaccacaauaugaggaacuguauuaaagggucacugcauuaggaagguuguuagacaugauccucaguguauuaaagagaaguaucaauaaauguugaauguuuuuuaaauaagguaccaaaaagucuuguuuucucugugcccuuuuucuacccuuguuugcccuguuccugccucugaggcauaaccuguuuggauuguacccgugagcuccuuucccuuagguuccuguugagguuuggccaguggaaacaugaccagaaaaucugaaaagagaaugaagcugugugcugucuauaggccuucuuuccugcuguucaucuuacguggcgagaagucacacuguauaccuugcuucucuccucagaacauguguucagugccucuguucacccuucacuuuccaucuaucugccuuuguaacacucauccuuuuaauuacucaguauauugccuuuuuuuuauguugagauuuugauacaugcuuccauugucuuggguugucacaugucagaggucaugcuuaauauucccuaucauuuccugugcugagauugaauguagggucuuggcaagaguucugcacucggcuacaucccuaaauauaauuuacauaguuguuuaauucuuuuaucuuuagauuuuuacacuuuucauaauguuaagagggaaaugagaagaaacuuucacuuggauuuccaguuuucuuuuagaguuggauuacuuagagguuaacuaagucacaaugcaugggaugaauaaaucagauuuauggaaauuaguuuuucuucuauauguguauauguuuucuguauguccuuagucagcuugaacuguaaucagauugguaaagucaaucuaaaacacagaauuaucuuuuaaguaauuuguuaaguugcuuuauagcccacuuuucaccaaaauuuagauuauuaaucagcacuauauagcuugaaaggaauacuuuuucauugauuucuucauauuacauuaccaguacucuuaguaguguccacuugcuuauuuguacaaugcaaacaugacuuuaaagagggaaggcagaacccucagcaccuaggauaagcaagacuuaguuguuauccucaucauagaugcuuagcagaugagggcuuauucaaaaaugcucauguagaaaauauuuuccaguuauuuaaaccucuugacuagccacauugccuguuguacuucauucuugaaaugaucaccaacucucuaaagccacaggguagauaguuaugaauauuuagccuagugcagucuuuaaauaagcuuauuguacuagacuauggacuacccaguggcugaggaaaaucugaaguuuggcuacucauuggguaccuguuaacuuuaggugaucauaaauaccugcaacagccuuugauggagacugugcugaugugucuuuuaagugcuuagcaacacuaaggcuuauuguagagcauuuuauaaaacuaagcguaguauuuauacuaaaggcagauauggccuuaggagacuuaaggggccuugacauugcggcaagggcaaaauaauuagaaaaugcccgcagaguaugugugccacacguuuaagcuuaauguuagccacagccccuuaucauaacuugaguacugaaauggcucacacucuaaaucuacaggguccuguuucugaauauuuagccuaauauaguaugcuacagggcauuuggaguguuguaagcuauuacucaaaaauucagguucuaaaugagaaaaaaauucuuggugggaaaguagcugucacuguacaagauuugaauaaagaugugaacauccccaguaguguacugagaugaaguuucagaagaaagaaauggguuggugucucuaauguuuuauuaagaagucauuuugggggccuggagagcacugacugcucuuccaguggucuugaguucaauucccagcaaccacaugauggcucaugaccaucuguaauaggaucuggugcccucuucuggugugucugaagacagcaacaguguacucacauacaaaaaaauaaauaaauccuaaaauaaaaaauuaaucugggggcuagagaaaugacucaaugguuaagaacacuggcugcucuuccacaugaccuggguucaauucccugcauucacauggcaacugaaaauugucuguuaacucuaguuccaggagaucugacacccucacacuaauguacguaagauaaaaauuaaauuauauauguaugugugugcauacauauguauguauauaugucagcuauaaaaaugagucauuaaauagcuaacucagacuuuuugaauaauuggcuuuucuacauuauuuaaauuuucuuauaguuuauauugcaauacuaaucuuauuuaaaucuguauucuaacauuaaguuagugauauuaauacuggaauuuuauguucacauguaaguacugcuggagcagacuuugaguuuaggguaauucuuccucuccaguagugauccacauauaucaaagacuccugugucuuuaaguuucagugaugaccagaugccagcaguguuuccuuuugucuuuuguguacuuaauacuuaccacauccauccuucuuuguguucucuaugucacuaguuaaaaugacgucagcagccucauauucuuguaauugugggguagaagaaaugauaaaagauauuuuugcuugagaccacauuucagaauuuuauaaucaugaauugcagucaaguagcacguguuccuucauuuugugacuuaaugaccaguaaaaugaguaaucuuacuuugugagaagaguguaguuuuauaaucuggaauggucuuugggguccgaaaauggggaggaagugguguauagcugaucguauacuuaccuaguugguuugcaaaguucauauacacguggaauuguguucccaauuucauaaaauucuuguaauaaacuacgacaacuuaaauucucauguuuuuccauuuaaauaugucuauauggacuuucuauuugauauauauauauauauauauauauauacauacauauauauauauauguggauauauauguguguguguguguguauucuauuucuauggaucugaugaagguguuaagcaguuuuauauaguaacauuuauuuuaugccuuauuuagugcuagguacuauguauguauuaucccauuuuauuccucaaaauguuaaaaguuuuauaguauuguuucuguuuugcaaaaggagaaacuggacauuaaguuuacaguuaggauacaacaaauggccaggaaaaaguaggcuaggagauucaagucaaggcugugacugcauagcuccguccuugcuuacuuugccauguaaccuccuuugugaucacuuuuuaggcuacguuaaugcaguugugucuugauaugaauagaacccuucaauauuuuauuuuauuucauuuuuaggaacuaaaagaugugggcaaucgugaucagauggcugcagcuagaggaauccugcagaaaaauguuccaauccucuauacugcaucccaggcaugucuacaacacccugauguugcagccuauaaggccaaccgggacuugauauacaagcagcugcagcaggccgucacaggaauuucuaaugcagcccaggcuacugcaucagaugaugcugcccagcaccaggguggcaguggcggagagcuggcauacgcucucaacaacuuugauguaaguuauauuugggaggaaaguuugggcucuucaccaacugccaaaagauaacugguucuuggggaaauaggaucaaggcuugugaugaaagcccauuuuccaauuaaaucuguuauccaaguggaaagaaauuguuaugacucauaaguuuacuuuauuguaacuuggcuuaaagcguuuuuucccucuucuugugugguuaaacuucaggauucuuuuaugcaauuuguguuuccuugcgugguucuuuuucuuuuuuaauaugguucuuauugagacuaugagucugguucauuccaacuaggaauuugaccaucuggcaaauguggaccugugauagguacagaagcaaagugcauuguaggcuuugucucuggggagcucauggucuagugagugguggagauaaaucaugcugcugucaucuuaaccuuaccugacugccuagacagauuucugcuuuuugugauuuccuuugagccaugaacauaggaguuuaaacacauugaaacagauuugaaauuaauuugaauuuuuuuaucauaaugcuuuuauagaugguaccuagaucucuccgguguauaugaugcguaucuauuauccucuguccucacauuaauuaauguguuggauggacuuuguucuaaauuuuaacccaaagugaguuguggccaccaguagauggcagcaguuuaaguugguuuuuauuugaaauugggucugaucauguagcuuaggcuaccuuccagcccauuaucuugcccuaggcucuucaucucuccaugugucaucaugacugucuuugguugugugugugagugaguguguuugugugugugugugagaggugggaggggggaaagaguuggaggaggucgauugagauuuccuuuguguagcuuuggcuggccaucuguguuggccucuccaguguugggauuaaaggcauaugccaucaagcccuaugauucuuuguuuuagguguguuagagagaauuuauaggaaguuauugucuuucauaguugaaauuuuugaaauauggcaucaauguguuggaauguauuuuguuuucagcagggguuuuuguuuuuguuuuuuuuuuuuuuuuguuuuuuguuuuugaugcuuguaucuugagcuuggguagugguucuugcugauagucacugauucaggcuuuucauaaaacaagggaaaagaagcuaguguuuugcuuaaagaccuuaguguugaaauuuaguguuuucccaggaguucuacuuuugaauugcagaaaauugaacuuaaggacucauccaugcuaggcaaguuaccaccgaacuuguccucuaguucuucuccuauagaauuaagcguaagauagccuuuaugguuguuaggacaugucuuguaauguauugguaccguuguuuucuucugcuucaaguuugguaacauuagguauuugguuuuuuuuuuuuuugaguuaguaaggagcguguuugcccugaauugaauuguagacuagggucaugguuuuguuauuuguaaggugaggagccugcacuaacugaucucuaacaguucucaucuauuguccagagguauuuuguugucuccuccuccgugacuaggcaguguuggagagugacugcagggccuacacaugcuuaggccgaugcgcuacugaucagcuacaucuccagcccuguauucaaccuugaucagagaaauccuuuaauaaccaaaucuagcaagaaaaauggucagcuaaaauguagucuaauaauuaacugaaggugguacaugaucacuuucaaaaugaagcuuccuuggaaagaaagggcgaaauguuuacucacugaaaaauaccaaguuuuuggcagaaaaaaauuggcauuuaaguugaaauuauuaaggaagaaaauuaaaaguuaaugcccaaauauuugcauagacauuuauugguaugaaagucaguuguauuuaaugaacaugugucuagucgauuauaaguucauuauaaauacauuuuuuaaagaggaaaaguuaguacuuuaguuguuuaaauugucuauggucaaacaguucugucuuguagcagcuauauaccucacauagagguauuuuuucuuacgauuaacaugugauaauuuuaauaaccaauauucuacagggugaccuuuagauguauaggaaaaguagugugaacauggcagcacuguuugcauuugugauaucauacuuaauuccggcuuugcgaaguaaucacugauguggggugacagcuuacaugggauggccuuugcuguuaggauuacaucuugauauuccugaucaauacuuuccuugcaguuugaauaacugaggggacagaaaugaggauuaacucuaguaacccuuucucuguagaaacaaaucauuguggaccccuugagcuucagcgaggagcgcuuuaggccgucccuggaggagcgccuggaaagcauuauuaguggggcugcccugauggcugacucauccugcacacgugaugaccgucgggagcgcauuguggcagaguguaaugcuguccgccaggcucuacaggaccugcucucagaauacaugggcaacguaagugccaaaaccucucuuggaacuaagauggcugaggaauuuguuuuuaugacugaugguacccccucauauauccauccauccauccauccauccauucauucauucauucauucauucauugugugggugcuuuaucugcauuggguacuggggagaaguuuugguugguaaagucuugccauacaagcaugaugacuuggauucagguuuuuagcuucguuuuuaagaagcuaagcaauauggugcuuauaaucccagagcuauaaucccagagccgguggaggcagguggacagguaccugggucuuggccagugagucuagucaagucuuugaguuccuggcucaguaagagacuugucuaaaaagauaauauggagaacaacugaggaagacacuagaggcuuccucacacacacgugcacauguguacacauguacauaagaaaaaauaucagaacaaaaaaaaaagaaagaaaaaauaucacaaagaaaccaguauuauaaaauuugcugucugguuccuuuuaaccauagaaaacaccaugucuguugguuucucucuuuaugugccuuguucuccuuccuuuauacucugccacucaaugauuuaguucuagcuuaaguuuacuguaauuuagacuggguacccaguauuucgcuguucuaaagaagggaugaauaaauagaaguaucuuaaaggauucuguuccucacacugugcuggcugccccaugcugacacuacuuugcuuuguguaaauaacaguagaucugaaucuuggcugugcugugcugaguaugaaugacuucauccuucagcacuuuguauagugaagauauuguuacuguguacaauagagaacugucucauuaacuauuaauacauuuuaauauuuuuaaaaauaaaaauauuuuaaagggugaaacaaugaaacaaaugaguuuuuccuaaugguuuuauuucacuuuuuuguuuugcuuauauaauuaauacuuuuccacauaaagauacugauuuuuuugguuuuuugguuuuauuuuuuucuucucauauguucauugcuacacaucuuguuuuguucacuuacaugucuuuauaagugaaaggguaauggugagccaugaugguguuucuagggugaaagaugaauguuuuuacuuaauucaaccauauugugauguuagcgaauuauguaauuuuaagucauuggcauguuuugauuauaggugaucuaccuaagaaaaaugagauuagaauuaaauagaaagugguugauaagucacaguggaaauaugagaucuauuaaaaaugcuuaucuaugcuuaaacauuaaaaaauaugaaaguguauagguuaaggaguauuugauagugucggaaucaugaaccaguguguauauauagaucaucugcucuuauguguagcacugaaagucauauagaaguauguagugugguugucauuaggaagccacuuugaguauauuccagugcaauuaugacaaucauagagcuuucuaaacagucuagaaaauagcucuugaauuauggaauugcuuggacucuacagcuagucacccuggucacgaguaaucugauuucuuccuugguugacauguaaguaauauuacuuuuucuucauguuaugaauguaggaaacugugugaacauuuauacugaauguauaugcuaagucucuaauguaauaucuacucuuauguggauacuaggauaauacuugauauauagaccaaaauuuuaaguauuguagaggucaugaaagaacuuuucuugagauucaaauugggaaaugauccuuggguauguuucuuuugaagguaaaacuuuuuauguauuucuuuucaucaauucacauaacaaggaagggaucaaucuuguacagaauuaguagaaauccaggaguggcaguucacaugcucuacaggcaguugaaucuccauaaguuccacacuagcuagggauacauagggagacccugucucaaaauuaauggagguaggguugaagagaaaguguuuaagaguauuuccuacucuuccugaagacccaaguucaguuuccaauacuuacauuggguagcucaugaccacauguaacuccaaucugaugcccucuucuuacauuugagggcauugcacaaacccacauacagauauuuuaagaucgcucuaucugucuauccauccauccaucuaccuaccuaucaucuaucuuaauuuuaaaugguggagaugaguuaguggcauguaccuuuaauccuggcauugggaugaggagacaaguggaucucauauguagcccaggagagccagggcuacacaguaagaccuucaaacaaacaaauaaguaaaaucuuuaaaaaucagaaauuaauagagucaggcuaaaagggaaggcauuggaacacaucagaagaauggggaaaaaaaguccaaagaaucauaagugaccagacaaaggcuucugcuuauaaaacaucuggaaacauuucagaccaccaauaauaaucaauuuaacuggccaguuuuguauuaacauaugucucaugaaaagcaaugucuugagcgucauauaaggggaaauaugagacucugauuucuccuuuuuggaacagaaugguugucuacaaggaguugauaugaauguuguuagagguacauuaaaaauuuuguaggaauaggggucuggagaaaugacucauugguuaaaauggaaugggcugcucuuacugaggauccagauuugauucccagcacacacgugguagcuaauaaucaucuauaacuccaguuccagaagaucugacaccuucuggccucugggacaccuggcauacauggugcacagacaaacgugcaagaagaauucauacauagacgcacauacacauaaaauagaaaaagaacgaauuaaccucagcacucucauaagaaaacuucauaggaauugcaugagguugagaguccugccucucaagcacugugcaguucagagcucuuucugcucuugcagagaacacaggauuuguccaucauuucucucuauuucuucacuaauuuuaugcuugcuugauuuuucuccauuucuuucuuuagcuugcuacauuagacuaagccaagccugugucuuuaguaguauauugcucauuuuguuacugaaguuuccaccaauuguauacuuccuugaauuguuccuuguguuucuuuuauucauacagguuuuaaacuuuuggaagacuagcuaggccgcagacuagccagcauggaggcucaugccuuuaucccagcacucaggaggcagaggcagguggaucucugagacuagccugaucuacaaagcuaguuccaggacagcgagggcuguuagacagagaaccugucucaaaacauuaaaacuaaaccaaaccaaaccaaccaacaaacaaacaaauaacucagacaaacaacaacaaaaaacuuuggaagacuaaaccauuuaaaaaaaaaaaccuuuuauggucuguauaaugcuagaaguacucagcaugcuuaaggaauccaugauggcaugggggaaugauuaaagccagcaauuuuggauauucaugauacuaagaauaguuaguaaggggaaaacccccucaaucucgcccuuacagauuuugcguucaaugugugugucuguguguaucuacuuucugaaugucaguauucucaaguagguaauuaguaaaagugguaucuuguagcagaacgagcuuaaauuuaauuacuuaggugaaaaccaaauuucccaauuaaaggcucuaagggcaaggaggccagcagcuuuaaugcuccuguuuacuucauaguuugaaggaauggaagguuagguggucuugccuuuaguucaaucacucuauaggccaacagugauacugaugauguaaaaguaauaccgcugacucuacuuaacagugaaaugccacaaaugcaugacaacaaaagggucuagaauguauccuuguggcuuuacaaaugucugcuuaguuauauugaaaugaaaucuggcgauugugguuugguuuauuuugccucucgucuuucagucuaaaguggcacuggguauggagguucuagagaaagaaaaacagcuuuggaugagugucauaaucuuugaggguuucaaaguaaguggauugaaaguaauuaagccugguauggcucugcaugcuuguaaucaaucuuagcagucaggaggcgguaggaagacugaguuugagacccaucuaagcuauauuguaaaacccuguaucaaaggaacaaaacaaauuuuuauaccguaauucuugguucuguauauaaguacaaaauacauguuuaaguaggaguuacaguuuguugugagguuagcuuaacauaaugaauguuuggaauauaaaggauccucaguuuuugaaaggacauccauuugguuuugucuugagcagucuuaugacuggccauaugacugcagugagggcuuguaaaauuggugagaacaaagcuuuaugcugucagcuuacauagcuuuagguuugugguuuuucuucucuuagccauucauaauauuuccauagagaacuuaaaaauaugacaggugauauuuuagauagcuauaauguauauauaaacugaauacuacauuucaaauaguuugcaaaaaagaauguaaaguagcucauugauaagcaucaaaauaaaaucucuuaaguuuuauuuuuacaaaacugcagaugaaauguaaugugugagaguagaauaaaaacaaguuuuauuuuuauuugugcuuuauugaacuugagagauagaaaguuuaaaagccuaugcauagaauauguuucugacuugcauauuguuucuguugcauaguucuaauugaauaaccaaccagcuaaggugggugaauggccagaaugauacaguaaucauacauauagccauuguacuuuguauuuacuucuuugugcuuagaacuguaguuuuagguuacagggcuguguuaggcuaaagauaguaaggguauauuuauuugcauuugugucugccugucuuucuucuuccuucuccuuuguguuuaguuucacaguauguugcccacaacuacagcaucuuggagcaguauuggaauuguagauaugagcuaccacugugcccagcuaagauguuucuuaaggauuugaacgugugugugugugugugugugugugugugugugugugugugugugugacaaauuuuuguuuucauguauguuuauaccauguauguaccuuguaccuucagguuagaggagggcucaagaccccccuugaacuggaguuaagaaugguuguaagccaugauguaggugcugggaaaugaaccucuguuagaacaagugcuuuuggcucugagccaucuuucuagcucccuuaaggauacauauuaacuuuguguuuguguuugucugugugugugugagaaauauguauuauuuauaugucuuuguguuguuccugcauguauuucuuuguacuacaugugucucugguacuguggaggucagcaagaaggcaucaagaucuuauggaacuagaguuauaagccacaaugugagugaugggaauuaauuccaaauucucuacaagagaaacaaguguuuuaaacuggugagcuccaaacucuccagucuuuauuugcuuauuuucuaaaacauugaacgugguuaguuguaagaucucaaaacaagaacacaguaacuggccauguuuuuuaauugaacuguacauguauuaugccuucauuaugcguaucaggcagaacauuauucaauuuguuguuagcuugguuuggaaugcaugaauauaaugcaguuaauauuuauauuguaguaaagggaaacacucaguguggauaucagucccuuugaaauuuugcaaauauuuuuccuggaaucacuuucgauuucuccccuucaguugugugugugugugugugugugugugugugugugcgcgcgcgcauucagaguugaccauuugguauaaccaccuuguguucucuuuccuagguaagccuuuccccagcucucagaguuccuuaguucccuguaauucuuuguguggguugaagccuuuaucugguuuagcuccucuauuguaauugucauguuggugaugcuuuauggguguagcuucuaacauuccuaggagacacaagcucacagcaaacuucuauuucucugucucuuccaagauuucugaucgcccugaccugcagugauccuuagguguuggauuuguguuauagauguauccuuuuuuggcuggauucauguucuuucucauucuuuuugguucaagguagcuuuagccuuugcccagagcugucauauauugcuaaugauuuauuuaaaauaaugugauuguuugaauaucacaaauuugugguuuugggaggcuaccaauuuauuuuauccaugaugcccauauaugacaaauaucuaaaaccugauauuuauuuaacccuugaugguuacuguaauucacauuugguauccuagcacccuagagauggagacagaggggucacaaauuugagacccacuugggcaaccuaguaaguucugggccagccugacuacauagugagucccaguaacaacacacaaauaugcauuguguauacauuugcacauauaaaugauaacuauacuaguauuauaauacuaguuauauauaacuaauauaguuaacuauauuaguuuagcuauacuaaucuuuuuugguuucuucauuuaaaauuuguuuugaauagugagguaucuuagaggcuuaaggaucuuuuuuuuuuuuuuuuuuuuuaaagauuuauuuauuuauuuauuauauguaaguacacuguagcugucuucagacauuccagaagagggagucagaucucauuauggaugguugugagccaccaugugguugcugggauuugaacuccggaccuucggaagagcagucgggugcucuuacccacugagccaucucaccagcccgaggcuuaaggaucuuaagguaguaaauauauguuaagauuauggguuuuguuuuguuuuguuuuguuuuuucuuuucuuaaauagaguuugauguagguaaggaugaccuugcaccuugaacuucugauccuccugccucuacuuucaaagugguguuaaaggaugauggggcugggaugggugguuuuugccuccaauccuguguauuuguuccuuuugcuuuagggcagcaugucucucccccauuccgaaaauauauuuauuuagagaugccuguuuagacgcuuugugacaggcaguuacaguucuccugugagcacuguuucaacuuccccaggacugacugaguccugcgugucugcauguuccaacucugacuuuaggcuuauucucuugaaaauggacuugguugacacauuuuuaucauguugcaaaauuagaggagcaaaaguuugcagaguauauuauuuucccuuucugaggguacauccucauuuucguugguuuugggauaucuguggucaccucugaugguugcuagugagcacugcuugccaaucacuagauagcugauuucuuuaaaagugcaacauuugcuguauuaaaacaaagagugauuauuuuucuuugaucauucucaagaaauggauguaaggccuuuuuauaauggggugauuugaaagcauauaaggaaaagguucuuuugaaguuugcuuuaugcuaaagugucaucugaccaguaaguugucuugcaaguuuuauuuuccgauauguuagaacaacuagcuucugcugugacuuuauaguuacacauauucuaauuucugguuuuguuauugcaguuuauauuagucagugaaguauaauccagugugucaucacaugccaugacuuccuugcuaauuacucuuuaaauuuaacucugaauucacgguuggaguacuuuuuccuguuuugaauuacauuuuaucucagaguuugggaggcagaggcaagugguucacugagauugaggcuagcugguuuauauagugaguaccuguacagggaguggaagguggagaggaaaaaaaaaaugcuauauugcugguuuaaaaaacaaaaaggcauguaagcugaaauaacccuuuccuccccagguuacuuuuggucaugauguuuugucacagcacuaggaacccugacuaggauauauuugggaagaguuaagaaaaggugucacuuaccaucauuguagcugagugucacuguaguagauguuaaggaugcaguccuuagcaucauuuucuuccugcaacaaccagcaguuuuuauuuuaucccacuuagcucccuauuccucacuuggcagacuugauaguaccugagauguuucugguaauucuccuaggauuuguguguaaauaauuguacaguguuucaguuaacacugggaacuaaaggagggagauaacagagcacagccaggccaggagcaguacuggugagcagcagugugaaugagaagauuccagaagucuuccuaauccuccuucccgccucuccucaaggcuaaucuugaucuccugaucuucugacuccaccuuccaaguauugagaucacagggcauaugccaccauauucucccugccacagcuagccuuagucauauuuuuaaagaucuaguaugguagcaaaacaccauuuauuugacuauaauaauuugguaguuauuacuuuuauugugguuuagauuuugaauggaauauaauaaaugacagugauggaguuuuuuuguucuuguuugggccagcuuguccuauaaguuuuugauuaugaaguucuuacaguuguaggcacuuuaagcauuuuggguucauaugaugaagguuuugggauugaacccaaaaucuccacuuaugcuagaccacugaacuacauuccagacccauuuuuuuuuuuuuucaacaugauuucagagucuuugcuuuggagauuggccauuaaaaaguaacacucaaaguuaaaaggagccuuacuugauaguuauguauccaguuuacaucuacacuuacauuuuaucuaauuuuugcuuuuugguguucauuugggggggggguguauaaaaguaagaaugcagaccucacgcuaagcagauaauauuaguauagcaggcuguaaagcacauuaccauucuacagcacuggagcaaguaugaaacugucuguacuaagaucuguacagaagaaaggguggcuaucgggaagagaguggcaggaguaauagacucaggaguaauuggggugauuaguuaacaagucacagcaacuguguggguuaguauuuuauaagcaacuggcuaagacucuuuuucuucuucgucucaugcuacuaaguaagcuuaccaacaaauaucaagagacuuuaguaaaucucugaggugguuuuucucuuuuuuaauuugccucucugaggaagguacuuuuguaaaagcuaggacuaacucauacucuagugaaaagagggucaucgagagguauuuugaucaucauuguuauuauguuauauuaucuuuaauacauuuucugagguccaagaaaaugagcugcagaaguagaaaugaaggaaacaauuucauuuauccucuagacagugacacauuaagcacuaaugacugccaaaaggaaaugucaaacacuaaacuagucuacuuuuuuuggcagccaagaauccggugaaucaacaguuuuaggguguguguauuuaaugugggcgaaggaagagaaugucugacauuccuuaaggcccuguuaagaucacuacaguuggacuuggagcuaguuucuacuuuuuaaaacccaagcaaggcaaaugcaacaaaaauaaaguugguuauggggugugagagauggcucugugucuaagagcacguugcugugcaagcaagaggaccugagucuaggucucuggcaucacugugagugucaagcaugggcaugcuuugccuguagucagucccagcauuggaauguggagacaagugaaucccgaaaacuugauggccagccagguuagcugaaguggucaacuuuagauucagugagagacccugccucaaaaaauaagguggagagcgauggaggaaaacacucugcauucuccucuuguuuccauaugcacacaguagcacaacauccccuucccaugcacacaugcacacauacacacauaagaaaaaauauauauauauaaauagauauuuggaugagguagguggcacacgccguuaauccaaucauuuggggacaaaggcaggcagaucucuuugaguuugauaccagccugguuauacauugaguuucaggccagguaaagcuacuugaugaaacucuccucucaaaaaacaaaacaaaacacaaacaaagccaaaaaagggugaguauuuguuguuauauugggauaggagacauuguaaacuuauuuauggccuuuaauguauuuuuauuuaguuguugguagaccugaagaaauguuuuuuauauauauaugaaaacccaaguuucauaucaaaugaaaaaauauaucaaaaguugaaguacuugagaggcagaggcaggcgaugcucaguagguuugauugaauccugucuugugugaugacuaaaagguauuuucuacaggaauucaggcaauuugucuauccuguaugaaguagaaauuuuuuuuuuccauuuugaacauuaucuaugcuguuacuacagacagaauuauauggguaguguuuaaagccuauauugugugcaaaauugguuuaacuuaaguauaauaauagccuauagauuuugguagcuauuuuacuuauacaaauguugaauuagaaguugcucaaucagaaacuguucauaucagggcaaaaaugguccaagauggcucagcagguaaagguagcuacuuuuaagucuaaagaucugauuuuuggucuccagaaccuguaguguguuggccugaugcugcuuguauucuaauacuaauauugggccuccaagacuuggagucugcaugcagacucaagugauccuacccucaaguuauuucugguuaguaaauaaaguuuccgacagccacagaaacacaggugggguuacguuuccugggcuugggguugggggaaaccaugaggagaaggugcaggaggaagaagaagccacuauagguuaggugagccauaaaaacauggcucuaaagggccggccuguugaaguuaagagcugcccagaugaaacauaguaaguaauaaccugggguuaccgauaggaaaguggaauguaaugguauagaaaguaaaugucugcgcagcucuuaugcuguuuaaggcucaugguaaauauauagguuuuaugucuuuucuccggaaacuaaauggucauggcaggguagaaacucuggguaggaauuaaaaguuuucacaagaacucauauagugaaagaagagaacagacuauucccacaaguuguucucugaccuuuacaccacauuguggcaugagcauacccuacacugauacacacacacacacacacacacacacacacacuaauacauaaguaaauauaauaguucaugaauugagaacuagaagucaggcugacuaauuuuuauuuauacuuugucuccuuuuuugaaacagguauaauuuaaaaugcaaauuguuugccuuuagaauauuuuauuaacauuaggacuuuguauauaugugugugugcgcacauguacgugcucauguguauaucugcauggucaacuuuguagcauugauucucuuuuuuguagguucaagggauugaauccaaguuucuaggcuuuauaccaccuaccuacuuuuaccuguugagccaauuaccauauuuuuaaauguuagguucuuaauagaaaauuguguauauaauucaccuagagguugaguauaacauucuaagaguugugaaagggcuuacuuuaucuuagcuuccuaacuggauuugagagggcacaaagagaaugagucaaugagucuagagauuuagacugaaauacuggugcuuccuggaaccugaaggacuuguaaacaguggguagugauaaguguaaugucucuucauuguugcuguauuggaguucuuucuuuuucugaaagaaacuugcugguauuucuacugcugugguagaaaguaagaucaguuuugguagagauuugugagaggcaucucaauugacaaccagagagaaauaguauguaccaucgcugcccuaaguaagucucagugggcuauauagcaggagccagguggcuucagggccucauugcuguuuucuagggcggcaugccaccggcauuuccucauguaggaccaaggagccagggauaggacaugaagauggcaaagccugugcuggcuaggaggugugucuccaguugguuguaaagcuaucgggaaugcuuacuguugccagugcuucuuuagaucauccugguggccucagauggcucagccaggaaaaagucuugccaccaaacugacaaugugaguuagguccuuggaacccagaguagaaggauaaaaccaacucuugacaucugcaaaccagaccauggcacgcacuaaaauaaaagcauagaaaugucuaagaaauuauaugaaaaaauuguacuuugccuuggugagauugguuuguuuuguaguaggauaaacaugcucuuauuuugaagcuuuauuuucagguauguuugaauggcuugcuuacuaauacauguguauuauguaacuguaggaauugucugcgaagagacuuuguucugauaacuuaacaucuacauugaguaugaaaaguuaccuaaacuugcccaaguuucuguggcuaccucugggcacagggugugaugauggugcccaugcagauagcaugguugugaggcuagagagcugcaucaaaggcaugccacuccuuuauaacaucgcugggauuacugaaacugaucauuugcuuuaucaccaauggaucaaacaucaaauccuccuuuguuuuuaaacuuagguuuccagggguuuugucaggugauugcauuuagcacucucuugguaaagagcuuauucuuuuugauccacuuccuucucucugcuuucugcuauggucauuauguggacccugguaauaauggccaaagacuagauuaauuuuuuagcgagcauguccccacugacuguugcagagcuuauuuuauuguguccuguuaucuugagugaaguugguggccucguucccagauucauauuauggucuccuuacuauuaaaauguacauuuugcuggagucuggcauacuccauaguuaauucugaguuauuuggcauagggaagcgagacugaucaucaauguucauucucugaauggaguuuugaauaggcuucucuguauaaaaaucucuucauuauucauuccuacuccuuuucgauuuauuugaugauugaauuugaaauagacuugcuauuugaauauuauauauguuucucuucuuauucauuuuuauaggcuguauuuguauuuuucucuaguuuauuuaagaaaaauagaaugcuagugggaaagcuaguaugaagcugcuccccacccccucugauuaaaacagcucucuagcucaucguuucagggacucaauagcugcuuggguaauuagccaagugaguuuaaauguugucuauauguuccuaaaaaugacugugggacagguagugugaagucuagaaggucuuuuucccuuucauguuauaaucgguuuuucuauugaagguuuucaaaagacugaguggaagauucuuauuaagagaaagucuuuauaguuaagguggacugacuuugaagugaggcucaugggaugucugguaucaucgcucugcuuuugaaauaugaacaguugccaucagauguuaucaguggaauuauucaucgguuacuugcuuuaguaauaauauccaaaacuaagaauaguggaguguauuuaauauuuugacaaggaucucaguguuuaacugagauuuuuauuauuuuaucuucuaccucccuccauuucucucugagacaaggucucucucuguagcccuggcuggucugcaacuaacagagauauucucugcuucuaggacuaaagaaauacacaccccauuuuauuuuuuuuauacuugcuaaaagcauuuuaaaaaagaaaaccaccuuaaaauuaucuuuguauuuauaugauccaaauguaaagaguauaaaauuaaaagacuuuguaaaaagaaauccuuucacaucacucuuauaaccauauauagguuuucuauuuaauuucuuguaucuuucaaaacaauuucauauagauauaguaaaccacaugcguaaguuaaccuaaagauauuuuuaagagggaaguauuauuuccuuaaaagguuaagguuuuucuguuuauguauuuauagagaugggauucaccauguggucaugcuugccuugagcuugcagcuguccuccauguccucuggagugccugaauugcauucaugcagcccacacccaguuccuaaagauccuuuuuaaaaaauacuuucuagccuuauaaugagucacugauugugaaacaggugcuauuauaauuugaagcaguguuuuaugguucacuuugcuucuaggccacuaaauuuuguucuucauacuucuugucuuuccuuuucugucucucccaaggacgcuaauucccaucucugcgugucugcuccuguaguagguguuuagucccuaugcuucccuuccuuucucugucuguuguggcauuaguguguagugccacaacacagugaccuguggaggucauguguagaguauuaccauuuugucuuguuucucaugucauagugaguggccuuagcuaggugauuuuuauauauuguuccauauaguauugcuauucuuuuuaaacaauaauuaguaauaauccaucuuagugcugucuuuauugcuuuaggcauuuaguucauucauucagaugcuuuuguugagaugucaggacucuuugcacuuuauuaacuucguauccuuuugucaucauagguuguugaaagucuuuaacaacuggagaacuuuuacuuuauuuucuguuguuuacuugcuuaucugcuauagucuuuaauuccuaacccugguucuuguacagaaaugcaugaguuuacucuuuauuaauauuugguugcuauuauuacaucaucaucauaacucaaacaagcucccauuccuaucuaauaaugugagaggucgcagaguucuaauauuggaacuucccucuaaccaugcaaaagagcuuuauauuuguucuaagggauucugaaaaaaaaaaucaucauagaauuugggugcuaugcucuaaggagaaagaaguuuauaucaacagaagguacuuuaugccaugugccagcugcuaucaguauaaaaacaugcaguauaaaucucacuggugaugucugggaagucaagauuuaggaggauuucaaaaaacauguuuuguuaugaacacggcauaggcaaacugagagaaaggaaagacuacauuaacccucuccccuuucuuuaucuuuuuguguugcuagauaccaaaucuagggcuuuguguguguuagccagaacugcuugacuacugagcugcauucuagccugccgucuucagucuucauuuggggaucuuguucuucccugcuguauauuacugccaugucugguuucccaccaagagucuucuggaauccuuccauucucuucccuuaaccuacaucucucuuacauucuuuccccgcucagacacuguuguuagcaaucuggcaugaguacuuuccauacuuuuuuccauuuacaugauaaguccuuaguuuucccagaauguaaaacuauaaucauuucccccauuugacauaaauguucucuuaauuaagaugaaugauaucauugcuuacaauccugcauguuauuauuuaaaagcacuucauagaaaagguagguuuuguuuguuuuuaaagauuugccuauuuuacuuuauaugcaugaguguuuuuccuauauuuuguauaugcaucaugugugcaucuggugcccauggagguuagaagaggcagucggaucccugauugcugucaguuaugaaugguuguaaaccaccugugggugcugggaaccaaauuuggguccucagcaagaaugacaagugcccuugaccuccaagccagcucuccggucuugagaagacuuuaaagccucauucuuauugcugaguuuggguuuacuuauaauugauuaaaaguguauuauuuuaauucagagugugguuuugucauacauuauuuaacgaucaccuuuuuuaaugaacauuugcuuuuuaaauuguuuuaaagcauuguguaugcuguagcagugaucaaccuugaaagauauacccuuauauuuuguuccuuuacuuuuacauauaagauucucaauuuuauuuuuauggagauguuugaguuggggagggaggggaagaaaggauauuuuccacaaagugcuaagcucaguggcuauuguaccaccagcauaagaaaauaaccuucaugcucucucuaacaggagggguuguuucaauuuuguuugugugccaugugaucuuucuguucugucaaguacuuacuuguaguuagcuccauuuuucuaauaguacaagggcuuuuuuuauuagaagcuguugaauauuacagcuguuacucuaauagcugccauuuauuuuauauuuuuucacuguuuuuguugguagauuuuaaaccaacacguugaacuuuuguauaucuuuugucuuauggauaauggaguuccugcuugugaugaaagcaucuuucucaucuuugauuacuuguauguacacauucgagucuguccuaguuagauuacaagagucagagcuacuuagagagagacacagacacacagagagaaacagauugauuguagagauuaacaauauauaaucauggaaguaguuaaauucugaaguagauuaaaaguauaugugaggcuguugcuuucauacaucuuuuauaaaagaaaaaggacuuuaagcuugguguuucuaggaaagaauugucacauuaaauggguuucauauaaauugacauauuccaaauauagauuucuuugaaaaaugucaugguugaauacaagguaguaauuaauugccucacuuugaguacuuagauuuuuaaauuuuuuuaaaguucuuuuacauagaccauuuuaauuggaucaaaauuauuugaccuggauggcuggaagaagcagcccaguuauagauguuuuaaugaugcuuuuagacuuuauuucugugagauaaaucuuccuuuuguaauucucauugguaccacauuugcaggauucuguuuauguaaauaguguuuucuuuugugugugcaugcguauguauguguguguuuguaugugugugugugucuguguauaagaacccugagacaucucauugucuuggccuguaaauaguuuuauuauuuaauuuuuuucuauuuguauuggcagaauuugucugcucauuauuuaugguuauacaaguacuaguuggaaauauugagugugacuacacacauacauucaacuuagugguucucugucugucucaucaaauauaagcagccaguacuagaauaaaauggagauaaugaaauggguuaaaaaaaaggaaaaaaugacuggaagugagcuaaguaguggcuuucucuuugauaugaccuggguuucaucuugaucauuuugugccccuacucucuaccaccuuagauuuauacauuuggguaugugcacuuguguucucuuccccuuccccaaguauaaguagaaaguguaaauucuugcguuuucaaggaaagacugaaugaaaugcugaaugaguagacugccaggcaucaccgaagaaaaacugcuguaggggaggagaggaaagaacaauuugguaacuucucagacugcaguuaacuaaaauccggaacuuauuuaugugggcauuggaaguaggauauagagaggguuguuagagcacaacugauuugacccauuagggcuuucuaauagaagaaaaaugccauuaggucuccaucauuuuucaguuuccuucucuuuagcgagggguuuccuuauucucugucacuacuguucaguggaaaggguacuaagggcuuacauaauaaugccauucugcauaagaguaagaaauacucuaugaggcauacucuuggauggcuuucccucaguacugcuaauguauauugaucuccuuauaguuuucagaaucaauuaugaucauuuacaaguauugaucauuucagagaaaaacgaagcagacaaaugcaaaauaaauauugggguuuagaaugugaagagcaagacugguccacacaaagaccaaucucauggcuugucuuuuaaccuagaugcaugagcuugacagggcaggggcccagcuccucuguuucuuaaacacagguaccauuguggcuguagggaacugcaauuaaccauuaaaaucccuugaauaguaaaugaaagaaaaugcaguucauacuggacuaaacuaagaggaucccccucuccccuaaaacuugcuccuuggugagccaucuacccgagaugaagaggguuugguuggaccauagagcaaugguucucaaccucuuaggucaaaugaccauuucauagggguugccuaagaccauuggaaaaacacauguuuacauuauguucauaacaguaggaaaaucacaaaaagucacagugaaaauaauuucaugguugagggucaccacaauaugaggcacuguacuaaagggucgaaacauuaggagguugagaagcacugccuuagaguaucuauuaccuguucuaaguugcuuguuccagguugccugggguauugggaccuuuugucccucagugauuauaagugaggcaaguucucaacaaccuguuacuuccagguugcgcacaaagcaucuuuuaccuaguucugaaagggggcaaaagcaguaagaagcgguuucuguuggguguuccucauuuggauugauuaaauucaaauuagaauagaauuuuacugucugcccaucuaagaauuuuuacuuugccuaaauagagaaauuagaguugugagcuaguacugacuuuuaagaaaaaugaggaaacuauucuuugaguuguuaaagaggcacuacaaugacaaugacuucuaaauacauauuuuguaaagaaaaagaaggcauuugauaaugacaguaacuagagccaccagaguuaaauuucaguaaggaauaaagugauuuuaaauucugaaacuuguagcuauuaugaaguguagcauguagaugcaauuguuuagucucaguuucuguuuaguugggagguagauaaaggcuuuuauuaaaauuuauacuggcaggcacacacaugauuguauuuuauaugugugagaguuuugccuguauguaugucuccaccacauagauacaguagucauggaggucacaagagaacguuugauucuccuagaccuggaguuacagacgagcuguuacguaggugcugcaaauugaacuccaguccguuggaagaacagccaauaaagccauuaguuucgccgggagguggcggcggcacaggccuuuaaucccugcacucgggaggcagaggcagguggauuucugaguucaaggcaagccuggucuacaaagugaguuccaggacagccagggcuacacagagaaacccugucucgaaaagacaaacaaacaaacaaacaaaacaauaguaguuucacuguauuuuauaacagugaugccauuaauaucucuuauauauuagaauaacacuuuaagccuuacagcaaaauuuucuaguuguagaaagagcaaaauuaguacguuaucuuuacuuuguaguguuguguucauacugaauauuuauaucacacuggggagccagaaagguauuguucuaagaauuugaugcuuuauuuggaaauaguauaaaaacacauggguaagaaauagaaaucaauagauuuuacuagacgaaaagaauggaagguagagcuuuaccuuugucccagcacauauuuuacaaaguagacauuuauucugcuuuuccaugugggauauccuuaugagagcuguaaaagaaagcuggaaauauggaaauaucuuagagcuuaugugucuuuucuggaagcaguuuuaaacuggauaaucaacaugcaguuaauuuaggggugggugugguggcucauccccauaagcucaguauuuaggaaguggaggcagaagcaccagaaaugaagaccacccuugagcuacaugccaaguucucuuaaaaaauuaacaaacagggacaggaaagauggcuuaacaauuaagcuguucuucagaggaccuagguuugaagccguguucacuuacaacugucuguaguaacucuaauuucaggggguccauuauccucuucuggccucauugggcacuguaugcaugugguauaaagacauacaugcagagccaugcauacaaaauuuaagaaaaaauuaaauacuaaacaauaaagauuggaaaaagguugaaguuaagagcacuugcugcucuuguagaggaccuuguuuuaguucccagcaccuacacgguagcucacuccagugucagggggucugaugcccugcuggucuccaugcauaucaggcuguacauacaugugagcuaaacauucauacauaaaauaauuagaauguccuagauacaucuugauaagugaaugguuucuuaaauauuuuaccccaguaccucaacauccuguucguuucucuuguauaaaaauguucuuccuuccuuuuguuauuuaucacauuaauuccuucugucugucuucucacaguauguuguuaacauggguguguaugucuguguggauacagcuuugucugugaacacauuuauguggagaccagagaguuaguucuaucugguaucuuugcucaguugcucuccagauuuauuuauuuaagauuuaauuuuuuuacaugaguguauauguguguacuaucuguuuaucuggucccuaaaggugucagagcuccuggaacugcaaggagacaguugggaggcugucacauggauacugggaaccaaaccuggguccucugugagaguaccaggugcucguaacugcugagccaucucuccagcaccuucgaguuuuacuuuuugauacaguaucuaguuuuaucuaaacuuaaucaguuuggcuagucuggcuggccagagagauucagugaugagggauucaccaccucccauauuuuccagguuuauucucuuauauuauuuguuaaguguuacuaguuuuauuuuugaguagcuauaaauucuggaggggaggugaccuagaccugugaauuuuauauacuaaucauagaguagaaauugaggaagcacucguugaauuaguuguaaauauuuaauaacauuaguguaaacauaauaaaggaaccuucuguacccacugugugccaggacuaaguagcuauauccuguuugaucuuauuugaaaguaugaacuugguacuguugaagcaugucaguccagucagaucccacaacuagaaacuggaagugcuucauugugaaccaaaugauucuagaauucugucuuuaacuaucaugcaacauuguauggcuuguugagauguucuauuagguugcuaauauuaugaauuacaauaguaucauuuucugcccucaauaguuuauuauaaaagcaccaacauuuagagagaagcugaaagaauacaaugaauagccuuauauauauccauuuucuugagucuguuaagguuugguacauuuaccuaaucacauacuuaaauaccuucauccaccuuuugcuacauuucagucauuugacaacauacaacuuuauucuuaacacuauagcuuaggucauuauugaaauuguguuuccuuuuuuuuuuuuuuuuuuuuuuucuauaaaacugacuugguucccagcugguggugcuuugugagguauuagaucaugaauacugacccaucugauggauucgugauuggcugacauuuuugguaggugguagaaacuaggagaugggauagcuguaggaaguaggucaguaggagugcucuggaauaauaauuguucucugucccugucucuggaguccagccgcccucucuacugcaugcucuugugauguucugcucaucucaccacaggcccauagcaaugaagccagcgcagcacgcugugaaguccuuuaaaccgugaggcaaaauaaauaguuuccccucuuaaguuguuuucuccaguauuuuaaacuagguuuguagcucagcguuagaaugcuugcccagcgugcuugaggcccuagguuugauauuaguacagaaacggguaggaaucggaaagaguucuugccuacagcaacauaacacaugucggaagacagacuaaguuugaaguuaaagucucuggcuggucagcugguaguaguuuuauaguuuuaaacuuguucuuucugggaaaaugagucaagauuuuacagauucuuugucaaggagaauacuaagauuguaauuggcacaacuagguaugaugcacaaaacaagcuucucuuuggguuuucauaaguauucagacacagacccagaguuuuggauaugcuaggcaaacauucaaccacugagcuaugggacauauuuuuacuuuaaaaucauauggacacaugucuuuacucucaguacuugagaggcagaagcagguagauggaucucugugaguuggaggcuagccuacuuuacauagaguuacauaauauguaacuguuucuaaauaaauaaauaaauaaauaaauaauaaaauagcuaaaugaaaauaauauagaaguguaaauuuauuuaaauauuuacuggguauccuguauauguguagggaacacauaauuugagauguacuaaggaagaaauaaagaaauauuuccuuauucuuauagacuuuauguaacuguuucuaaaugaauaaauaauaaaauagcuaaaugaaaauaauauagaaguuuaaauuuauuuaaauauuuacuggguauccuguauauguguagggaacacauaauuugagauguacuaaggaagaaauaaagaaauauuuccuuauucuuguagacuuucugggcuccggcauuggcuaguuacaaagcauggagcaugaacuaauaggcugcuuaucaagaacugaccugaggaacaggucuguugauuuccuaaaaccuccuggaacauuuuuccuuauuguuucuacaucugauuccauuuauccagacuuuuguauguaagucuuuccucuauauaaaccaguauuucuuuucuuuuuuugauugcuugcucugaguuaagaucuugucaugcugcccagagcggccucucauuuguaauccuuuuacuugggcauucaaacugcugguuuacccucuaccuggcugcaccucucucuaccagaugaaagcuugguuuguuuuuguugcuuuauucccugggaagaucaaggccaaguacuguuucauuguucugacagugcugccuaauccuuaauuauggauuauuaaaaacacucuaggacuugguguaauccuuguaaccauacauacuauuguauuaauuucuaaagguucuugaagacuaugaaauguuuucugguccuuuuggauuaagaaucuuugcuuuuuaauuauuguacagcuaauuuagcuauucugcacauagaaauuuauucaaccuuuuugauccuauagaauuaaucucuguaaauuaugcuucccccgccuuuuuuuaaguacugggcaccaaccaguuggucuucauuuauuugacagcuaagacuuuggggauggagaggcagcccccugacaugcuagacaagugcuguaucacuuaacuguauccugaugggaauuacuuauuugguaguggugguggugguugguuuuucugagacagaguuucccuguguaacaguccuauuguccugaaacucacuguguagaccagccuagucucaaacuugcagacauccgccuaucccugcuuccugaguacugagauuuaaggccacuaccaccugacaguaauccccgcucccccccccccccaagaguguuuuggcccucaaaauaauaaaacagauuggcuaauauagauggcuauugauucuuauuugaucauuuuuagaagagcaacuuggagcuuugguaaccuuacuuuaucuauaaauaccacagucaaagaauggaauuaugcuccaagcacaauuguaaugacugugcaguguaguucauccuuaaccgugauucguuuuguacauucucccuguucuucuagguaaaggcucuugaaauuuguaaaaaaggcauugagaauuguuucugcaguuuuaaaauaugguuccuaugaaaacgaugagucacuaggcuuugccauuaaaguuguucacaggugcuccuaaaugcugauuucuugcagauuccuuugaggccguaggcuuuguuggcagacuggguuggggccauagagggcauaauucaugggcuucccagguuaagauucuucauacuugccuucgagauguuuugcugucuuagauagugaagggagguuaaagauuugcauacacauuuuucuaaaacaacuggggagaggaaggucacacuugaauggggaaagcuguuuagaauaguuacacgcugcauccuuuucuccucuuccucuguaaagauaauuugugguauauuuuguccaaggagagacuuccaccugguuggucagacacauuuuuauaaaagggugggaaccacuuuaaauacccuugauagaaauaccuucucuguauugcaaugggaacuugaaaauucuguaguuaugucuuaaaacaacugauagagaagucagguauaacuacauggggauuuuaagauuauaagagaauuauauuuauaaacuguauuuuuuagcuccauaaaguauggagauuugcuccuuuuguaaaauguaaaaucaccauuacugaugguagcuagugucagcacaguuauucuucgcaguuauucuugauauaaaagugugugugcguuguguuuccuuccucuacccucaguaauuacugaguuucugccaugagaacucauagccucugauggggaagaaucacugacuguuggaaaggagagguguguacacauauguggagggguccauacuucaguagugguauacaaggugaugcagaggcacgcgcacaugugcgcgcaaacacacacacacacacacacacacacacacacacacacacacacacacacacacacaccagaagaggcugugguuguccuuuucugucacucugccuuuaacuucuuugggggacguggggcgguuauuccugaaccuaaugguuuguggcuaggacagccagcaagccccagugauccuaucucuucccacuucuggguuggaguuacagguguuuaagauacuuauugcaugcauauaacaugcuuggcuuguuuuguggaugcugggauccaaacuccucaaguccuaguggaugucaucucugucagccuuagggcuggagaagcaggagguucacacaagaacugugaucauucauggcaguugguaccuagaaggcaagguaguuucugccuuacagagccuaggcauagcauucugucugaguagguauucaagccaaacagaauacaccaguaaaacaaucuuuccuuuccucauccguaccuauugagccaguaucugggguacagugagccuuacaguccuaacaugguuaguaccuacagacuucaggagugauaaugcaagaugauccuggcaucuguccacugaaguagaggccaagugccuguuuauuaaguccagguuucaucuguuucagguugggguaauguauuguacgugaagaauugagaguagcaaccaaccccagggcuuaugagcccuacuuucuacccaguuguuaaggcuuggcugcuggcuuuagugugguuuguuguguguguugugcguacccccuuccccuuccuucauagauaggaugauuagcugcccuuuugucagcaaacacauuugacacugaaaagcagcauggucaugacagcuguucauuugacuucugucacaaaugccuauuuggguuucuccugucagcacuugcagguuucaggagaaaauuauaaacaaaggagacauucggguuuuuuuuacaguauacacaauuuuaauaacaaaacuuuucuguacacuguacuauagucccaccaacccaauuccuuguauaauaguauuuucuuccuaucccccaacaacccuccccccauggcucuaaaagguaauugaacaaauguguuuggacuguucuuugaguuugcagucucaguguucacagguucaccaaauauuccauguaucauacugauuuuaaaacugaaggaagaaaagauuaguucaagaaguuggagauguuuccaaaugucugcaauggcagaaugaaagggugaauggucguuuucugguuuuggccuuauucgggcgcuaugaguuugccccaggauagccaaagaaaugcuuaucuauagauggcccauauuaucauuuuaaaaacaucuuuucugauucaagcauuuuaacugagaauauaugaaaauuauguccaaaacauacuugagauagugcuguuacuggauugcuguauuaggaaaauuaucauguaauuuaacuguuaaaauaguccuaaaaauuaucuauuuauuuauauauauauauauaauagagagaggggaaauuuuuagcuccacccuuacauagcuauguguagaaaguaugacuuaagaaaauaauaaaacuuugauaucucagaauucagacuagugcuacauagagcuugcuuuuacuggaaagauggaguuuagcuuuuggugacuagcauuauaauaagcagauggguuuuaauaauuaguguggaauuaggaaguuuagucaauuccauucauugaauuaguacagaaauuaacuuugacucauuaagaaauuacaugugguaauacaauuuuuuuuggcuuaaaaauaguguuuguuuuuugaugccaguaauaugaguuuugugugauuuuuuuuuuuuuauuuaaagauuuaccagcccacucuuuuuagaaagguaagcuugaauucccuguaggcuacaaaaauaaguaacuguaguugcaaacuaauuuuaaauuccuagcuacauuucauuuuucugagaaauuauuuucugauuuuucacuagauuuuaaaaugggggagagggaaaguugagugguaaugcuuaagagauaaaaccccacccaaagcccucacuuuuaugacuaggaaccauauaugguuuugcuacucuggccaguugguagcacagauacugcaauacaaauacauaucaacuaaaugcagccuuguuuucuguaggcaguuagaaauggcaaucugugcuuuaacugagaaaggaaaauaccugguuggcacuaccauuaccaaaaauguaggaggaaaaaauaugccccuccccccucccuaguaguuugccuugauggcucuuggcacuguucucccucggaugcuaaguggcuugcucugcuacuuacaguccacuuuacuaauucuuuaggauuaauuggagcuccuaguuacuauuucuuacuuuuuaauucacaguuuaaauuaauuuugcuugugauuugaaaugaugaaaaccacucaucguuuagggccgauggagucuucuugcaugcucaaaacugaauugugaacaagcuguccaucaccuggcaaacggcaguggucaccaugauaaaugaguuguuaaauccuagaccacggagcucauuuguaauagggcuucugaugcagcuccucgguggggaagcagugugcugugcucugugcuggaaagccagcaucugucucagcucagacgaaccgagcuucugcuguaucaggagagggaaugcuugccacucaagaucagccgaaccgggaugcucugaggcuuugcuagacugaucacccagcauaagaaauacaaagagcauauuucacugaagccugacuauuaucuucuuuuuguuaagagauuugaaauguggguauauuuuucagugcuaaaggaaaacaauuaugauugaaucuaggucuauaguaacguuuucaguccaaucauggggagagaauaagucuugaaugcaggauacuguguuagaguagugacuuucguuauggacuuacauauuuuuccacauaaaaaugcuucuuuucuuuuccuuucugaaaucaaaguaaugauuuucuguuuucuccuauauguggagccaucuuuguagaaaaaaaauucuaugugaauugguaacuugagucuaauuccccaguaugccaucauuugccuuaaagaagucagaauugaacacuugugguucuucaugaaaaauguggcaucauuaucaauuguuacugugauuagaguguucguauuuacacuguagagucuccuuccacaccauacagaucccugagcaucacuuauuuggugcaaauuguacaugaucacguuugcugccuaguuacuuccacuaaccugagagccacacucaaagucuuucccugggcuuaaccccucacacucacucugccuucacuugcugcugugugacggcagggcaaugccaggaguucugccuuaagguuugccucggaaauugguccugucucagaaggagcuacucauauaaaugcguaucuuuauuaaagggcaagcuuuaccaucauauuuugaaaguaauuuuuuuguguuuuuuauaauauaacaagaaucaggguuaggcaccuuuaguagccaauuauuuuuaauuuggaucuuugaaguuuaaagaucagaaaaaggcagaaggaagaggcuuaaacaguuugucaaggcaucuuuaaucaugagaggggauguauuuucaaacuggauggaguauaucaggauuguuaaguugacucaguuuuucucuuucccaaaugcaaauuuuuacauaauagaggauuuaguaaguuaauuaguaaaauggaauuuaauacuaguuuaaaauaauaggcuaaaugccacaaaaaucagcauguccauuauaagucaaacuagaguuguauaagaagucagcauaguuauuuaguauugauuuauuauaaugagaucuuuuuauaauugcuuggauuuauuguugaaauauauuaaagagucacccaguuuuauuagaguuauauaaaaggugcugguuucaugauguaacuuagauaauguuuauuaagccaagccaaacugaaagaauaacguuuaauauuuaccagucuuaagcacacauguaagucuacuucuuauacuggcaguaaauuauaauuugaguaaauaccacauuaucuuacaagagaacuuugcugucuccuucuuaaguaggaagccaguugugguccauaggauggagaauaauaaucaaacagguuuuugucccuaccuauauuuguuuaguagcaucuuuuggaacuguuuucaguaaaaaaaaaaaccaaaaaacauauggagaccuuagcgcaaauguuuacauacaguuguauauaauuacauacaugaaauguuuuauauugaaguaagcauuuagacuuuccaacaagagugcaaauuaaugugagcauugcuucacuuaacacuuaaaauauguuuucauuaaaaaauuaaaaauacuuuaacacuucaaaaacucaagucuccacuugguuuggaaaauuaggcuuaaugucaccauugguaaaaauuagauauguauuuagccccuacuauguaaaauagguuacuuaucugaugugauuuuugaugauggguagauauuauacuucacauucuuuguauggcagcugcugacacuugcacuguccauaaccauuaaugaugaugaaagguccuucauggguggguucauacucauuauacgguccuuggucugacauguuugacauauggagucguguuugggaucggagcugccugugguucugaaucauugagcacugccuaauucuucucaaagugggagggcagcacuuccuggaaaugaacacuauaaaaauaauaaaaaagaaagaaaacaauaaagccauuguuccuguaauuacucucugaguaaagauggcauugucagguucaggaaaguguuccucuguagugacugcuaugccugcaguaguuggaauuucuuugucuccuacaugguaacucgacgagcuuauuuuuguauauucagugguuggaucucuauaaguuguagccauggcagugacagugguugauaaauuccagcagagcugaaacccguggacugcaucuagaauauccucuccuuggguguggucagggcuguggcauaggauggagugcucccaccgaccuuggaaacugcccagccaggaggcaagagcacacacucuggggcugcauucccacagauugccagagaggccaacggucgugagggauuucagggaguuuaagauuuuggaaucaagacuguuuaacuuguuguuauccaugagaaguauuuuaagauuaggcauggucucgaacacugucaagucgauggcuuugauuucauuuccaguuaggucuagcuuuucuaaagugcuccagguccaguccaucccacacgucaaguugcugauuuuguuccauuguaagaagagugugugcagacugcuuagccggaggaagugagcaaaauuaaucuucgucagcugauugugcucuagaugaagcucucucaguuugauuaauccugcaaauccauuucgagccaaacuucgcaaacgguuugugcucagauccagaaacucuagacuacgacagucccagaacaggcguacugggauaguccgcagggaguuggaacguaaaugcaaggucugcagcuuccgaaggccauagaagagcucaggaugcagagaugacagcugauuaaaagacagguccaaauuuugcagauuaaucaguuggguaaaaguuguguuuggcaaguagaauauuuuguuggaacuuaagauuaacuccuuuaguuuauacaguccuuggaaagcgucuucuuuuacuguggaaauuugauugugaucuaaguggagccaggugaguugacugaagcuggcaaauugaucucuuucaagcgcugugaugugauugugccucagggacagacccaaagaacccuugucuguggcguuuggcacugaguggaagcccugagagucgcaguagaauagcagcuucucacagcggcauuuagguggacacgccauacccagggcaggcagcauuuuuaauaccacacucauugcauauauugcugccagcauaggggccccuaauggccacuugaaauguaagccugcagaauauaauuuaagaaaaacaagaagauaggauauguuucagcaggacacaggggcuauauuaaaaacaacaacaaaauguaacaucauaaugaaagauuucacugcauauaacauuuuucauuuacugcagaaaauuaaccuuguuuguagacuggaacacaacuuaaaccauguauaagagagauuaaaacaugucccuuuuaaaaauguuauaugcauuuacauaaaucuuaaaaucccgaaccaagugauuugcaucauaagaugggaauucacuggcuuauuuuuauaaaagcgugauuccucuuugauugaacaagccauagaaaugcauggacuuacccauucuucugagcacauuggaggcugcauucagucgagguugucagacucaacgcagugagucuguaaaaggcucuaacaugcaggagccuuugaccaguuuccuguuuucugugccccaggcuuuucaaguaaaauucaagucuaucagggugaauuguuuuuucccuuaggauauuccucuggaaagcacuggugucauuuucccugugcucugauccccuaaaccggcuuugauuauaaguuaauaauuuccuccuccugauuacugccgaucgucagagcucccggcuuuccuucccgcagcuguuaguucucucagccuuaacuuguugauggcagaugggcggcuuguugcagagaagagcuucuggagcagcaugagugcauuuacugaaaagcuuuuccgagaaacggcacaagaauggauuugcuuaugugcugcgaccacacagcacuguauauaggcugacgucaccgggugacgugucuuuuguuuggguuuuccagaagcuuuacuguuaaaagcacugugcuuuguaacagugucaggggcguuacaagacccccuguuuacaagagaugagaaagaagaacuccugauuugagaauuugguauuccuucaguguaggaagcaacaaugagguuguaauaaaugcugcauucaagaagacccaucugaacagugaguuggacuagcagagugaugauuucuaaugcgugugagagcuaguguuagacugccgauucugcauagagaucaucuaaaugggcacgauugauuuaugaagugcugauuuaaugccagccuauacaagguacgccucugcucugguaguuuggaaagcuacucaauugccuuguugucaugcuugguaaaaagcaaagugugacugacuguguugguaaacucagugggcuuaguuacuuugucauuaagaacuuaacauuauaaaacacaacaaagaugaauagcuuccaaaagaaacaauuuuggcuuuuuuuccccccuccauugagaauuucaagggaccucgaauccuuuucugcuuauuauauaacaaugcuuuauuaccacacugauuggaaaacggugcuagaucuuuggauguccuaccagaggagaggagcagacugacagaaaccgugauguuuauacacgugacccagaugguaacagugggacagagacaauucuggacaaguauugcagugugccuggauuuugacagucuucaggauuucuacuucagcaucucaccuacuccuuggcuaaaagccacaguuacuguugagauuggggugucguaacaucaaaauagcauuugcacacuaucucuuacuggcacauuuaugaacugacugacucucauaucagcucuuguugaauucucaugaauaugaaaggacauuaauauuggaguaggauuuuguuuugguuguuuuugcuugacaacucuugcuucccuguuagauaacuuuucagacaugaauguuuaugguuaguguuauauaaaugcaugugucuagcaugaaucagggcuauauuuucaggccagccuaaggaauugccuuuuauaaacauauuugucucgugaacugacuacaugaacuuauuuuccccguacuauuaccacuuacucuuagugagccugguuucaaaucugagagcagaaaucucaaagcuauugaugagaucugugagacaagcacagcacuggccugugaucuucugaggaguccaucccacaggugaauuuuaagaagucauuauacaaagagauauaauuucugcauuggaauauggcuacucugauaaugacuagaagucucuaagguccuuuagagucaaguguaaaaauuuucuggaaaaucuaguaauguaaauaugcauuucuuuaguucuucuaaagugaccccaagauguguucaaaguguaagggguuuguugaaggcaaugaaugccuagacaggaugguagagaagccagcagcgaugcuuugaugggucagcacagucuucggaucacacugcacacgugauaccuucgaaggguggagagagggaaggcuguacagacuuugucagacuacagugcgcuuccauucgccagccaaguuaaaguuacgccuacucucaggaaugagcucucaauugaucuuaaguuuuagaaaaaucuuuuguuuuucuuacuagcaaacaugauugauuaaaacagaaagaaauacugguuacacuaaguagugucagcauucuguuauuuuauaacuucuaguucgggacauguauacuuuggaauuuguucuuggguggcaggaucaugugacacccuacuuuucuucaugcuagaguuauuuucugcccugagccauaauuuagcgauaaauuuuggcuugaugcaccugaaucuuccauagauuuuuggggcagaaggauacuuaaacuuagcaugaggggcuuuucuuucuguacuacaaaggucaaaacaaaaauagugaaaacuguccuuaagucucauugacacacagacugaaaguuauguggccuacauuuuuaaauuuuuucccucugcugauggcuguucccuaguaccacccuaguacacucauuccuuuucuguauagcagaccuuguuucuuuugacacagccaucuuugggguugcccuuacuguuuucucccuuucuauuuugaauaacauuugauuuaaacacauuuuucucuuaugugggcuauacagagccauuuuacacagacuagaauuagggauagauacucacuaaucucauaguuagcaucucuuuuaguuuuaguggagucugacccaguuggcuaaauuuaaaggggcuagcauguauugguuucagaagcuuagaaacaacauucucugggaauuuuuuuuaaguuaaauuaaguaauuuacuuaacuuuuguaguaccaaggaucaaaacagagcaaaugaguguaccuagugcccacugugguuagaagagggugucuaauccucuaaaauuguacagaugguuauuauccacuauguggaugcuaagaacuaaaccuggguucucgucuggaacagcaaguaacagaugguugugagccaccaagugguugcugggaaucaaacucaggaccucuggaagagcaguccaugcucuuaacugcugagccaccuuuccagccccagcaaguacucuuuaacuccuuaaucucuaacuuucaucaagcuuaguguucagauaguaagugguagagaugaauguguguuauauucucauuacauuuuacaugaugacuggaacccuaaacuugcuuguuauaccaaaaaugaacaaacaaacaaaaacaacaacaaagaaacacugacuuaagcacucugucuagaacuuucuagaagagucagauaggguauuuguuuguuugguuuugguuuuguugcuguagcucuggcagcccuggaacucugucucucuguagaccaggcuggcuucuaucucacagaggucuuucugccucugccuccugagugcugaguggcaaugccacccccgcccgccccguccuggccugaccaacccuccuugacugaggcauacauagacuuuguuccuacaggaacaagacaaauugguuuuggggauagauuagcaaagagagaauugacaaaguguguggugcuauuguaccuuagaauggguguccugugucagcguaaucucggaaaucacgucacgggugcaauuuuacacagcauugugguaaaucuuucuacccaauuugagaacauucuuggguacugagguuugauuaaacugucaugaggucaaugagcccaaccuuugaguuucagcuuggggaaaaaauucugaaagaaauguauaugaacaccucccaguuguggcuagaaacaaugauggauuuuuaggucauuuacuuuaaagagacuuuuuuuuuuuuaaaagagucaguacuugaauaucugaggaguauucugagacugaaauuauuaggucaguuugauuuggauguaauuuuuggacaucugucuuaguuacuguuucuguugcugugaugaaacaucaugaccaaaaagcaaguugaggaggaaaggguuuaguuaaggguuuaguuacugacuuaaauuucuauaucacuguucaucauugaaggaagucaggacagaaacucuuuaaaaacagggcaggaauaugaaggcaagagcuaaugcagaggccaugaggagugcugcuuacgguuugcuacuuaacagcuugcucagucugcuuucuuaaagaacccaggaccgccaggcuaaggauggccccacuuacagucacuaauuaagaaaguuucuucugggccugucuaugaucugaucuuaaggaggcauuuuuaaaauuagguucccuccucucagauggcuuuagcuuguguugagucaaaauaaaacuaucuagcacagcaccuuugucuuagauccuggugguuucucuuaagguuaccagugaguaauuaggcuuaagcggaggucuuuucugauugauagcucugagcaaaccuacacaauaauucucauaucugcauccauguuguuaaugguucccccacucuggcguuaauguuaguagacugcuuaauguuauuagagguacaggaggacuuggggauugggcaagaaugagaccccgggccuucagggugguucaucugcuugaaaguccuugcuguguaagcccagcagcccaaguuuaaucacuggaucucaagaugaaaggagagaaccaaguuguaaaaguuggccucugaccucuacauaugauauggcuuaugagugcuuguucauaaguaauguacauaauaaauaaaauaaauaauaaaacucuaauaacccauagaaauaagaugaauacagaaaggugacagcauucucauuuaacaggugauaagagcagaauaugaaauuacauaaaugggaugucauauacacacagcuagauguucgucugccugcuggcuugugugcugacgucacacccauacccgaguguuuucagagcacucagaaagauaauguugggcuaaaguccuucuucauuuguuucucuccagcuauuaguagcauguuacagaaagaggcacauuugucuugugaaaaaacuuuuaauauauuuccuauuaauaguuuaauacacagaugucuucucguauuuccagugauacagcuggcuaugcuuagggccuuuauuccuuugcuuuugauugaucucuuuguuucugguuaguucuuacuacuuggucaaauuccaaccccugaucugaagagaugcugauguagucauuucuaagugucaaaugugugugugugugugugugugugugugugugugugugugugugugugguuuuuuuuuucuuuccuauucaguacaauuauauuaagcuuagcauagaaggucuaaaaaacauuuuacaaaccauucucauuugagccauauaauguuauuaacaauacaucuuacuuuaaaacuugaaauuuuuuauuuucugugaauggguguuuugccuacauauaccucuguacuacuuguauacucggugcccuuguagaccagaaaaugguguggaacuagaauuacauaaagccacgaaguggguucugggauuugaacuaggguccucuggaagagcagcuagugcucuuauuuaucuauugagccaucucuccaaacccacaucucacuuuucaaauguauuguuuuagagcuugggaaacggccuaaggaccuggaucucaggcugauucccagaaugcaugaauaaacccagaugugaugguacacuuucauugucuuagaacugaggagauggagacaggagaaucccugaggcuggcuuuucuaaaucuagccagccuggauaaaucagugaugacucaguggugaagagcacuugcugcucagguuaguucccagcacccacauuacaauugacaaccaccauuaacuucaguucuagauaaucugaugccuccucuggccuuuguggguaccagacacucauauugcauacagcaugcauucagacaaaacacucauauagauaaaauaaaaauaaguaaaaucuuaaaaaagaaucuuagaagcaaacaaaccaagguggcuggcuugugaagauuggcccccuugucccaugucuauguguuccucaccucccuccucugccuucucucaucuuuuuuuuuuuuuuuuuuuuuuuuugcuuugagcguguuucacuguguagcuauaaguggaccacucacagagaucugccugcuucuguccugagaguaaaggcauaugcucucauaacuuguucuaauuuuuuuuuuuaauucaagaaauaaaaccuguuugccauuuaguaucaagagccaucuuuugcuucuuuacauuucacuuuuuacuuaaauuuugaauguguaacauacgugugucuguuuguacauguacauauaacagcaagaggucagccucaggagucacccaccauguuuugggggacaaaauuucucaugggaaccuaccugugcuuaccaguuaggcuaggcuggcuggucauaaagacccagaucuaccucuccguaccucuucagugcugggauuaccggggugccacugcuacgcuagauuauuuguuucugaagauuguaugcaagcacuguauauacuuagcuauuuccucagcagcuuuguucugaaagcaucuaguuacugucagcaucagguguaacguauucuuguuugugcacuagaagaacugguacugguuguaugcugaacuuugaauugagauguuuauuggagaugggaucucacuaugaauuccaaacuugcuaaacccuuccaugcuccucaaguaucuuuugucucuuuuagaaaaacuuguagauucagugaucagccagaugaaugagucuaagugguacaagaucacauuuuaggugaagucacauauaaacacucccauuguauguuuuccaacuuugaauuaaaaauuguuuuggggguuggggauuuagcucagugguagaguguuugccuagcaagagcaaggcccuggguucgguccucagcucugggggggggggggggguuguuuuguuuguguuugccaaggggggcuagagagauggcucagcggugaggagcaguggcugcucuauaggaccuggcuuuaguuccuaacacccacaaggaggcucaaaauccaguuccaggagacucaacucucucuucugauauccaugggcagcagcgcacacaggaugcacagucauauucagacacccuauauauagaaaucaaauaauaaaaaaaaaauuaacgcccauuuuacuuguuuuuucuuuuauucaacauaguuuuaacacuaaauauagacugucauuagguuccuuguaaaguacucacaugagcaucuguuucuucaggcuggacguaaagaaagaagugaugcacucaacucugcaauagauaaaaugaccaagaagaccagggacuugcguagacagguaagcugaaaaauagggggcggggguuaauuguauuuccuaaguucucagcuuuaguuuugauuaaaaaucuaauaaacauaggcuuauauuuuuaauuaagggagaggguaaaucuucacagaaaagugacucuuucuguucuauugcuaauaagcuuauuaaugucuaaaaaaaaaaucucagagggauguagacuauuacauucccuuggggguggacugaaugaauuagcuccagugagaaaaggauguauaggcaggaaaaucaauuuaagaugacuuggggcucuguggaaguaaccucaaaggaucuugucuugacuuccauacacuagauuccagcuccucaugggucugcccauucuguuacauguugucaguuuguuuccacugguagaagugucuuuuuaucuaagugcaguaaugauggagauacugaauuuuucagguuacuaaauuuaaaaaucuguuccuuuaaugauauauaaucucauuaacauuuuaaaauuauauuuuguuaaagguccuuuuuuuuuuuucuuuuuuucuuuuuuuuugguuuuucgagacaggguuucucuguguagcccuggcuguccuggaucucacucuguagaccaggcuggccucgaacucagaaaucugccugccucugccucccaagugcugggacuaaaggcgugcgcuaccacugcccagcuuguuaaaguuuuuaaaguaauauagaguugacuaaauauguacuuuaauacauaacauauuaagauuuaaguuauggugagaauuuagauaguuuucaagaauuaguagaaauguuuauugcucauagcagauauaaaaaucuauggugggucaaaugucaacagugauuggaaagauaaaauuuaaacguuuauagugugguaacuuuuauagauaaaccagaaacuugcuccuuuuuuucauugaauuuuaacuaauuaggccaauuacauguauuccaaagcuaugugccaacucaauugagaauaguauuauaauccuguuuaauuuuguaagauccaaggaaagaaauagguaaugucuugaaaacuggacuucugcugcugaagugcugacuguggugugaagcauggucuugcaguccuguguugaagcuugucucacuggagugcucacauggggcgcuuggcugucuaaguucugccugucuuucacaggcuuucacuaaauauauuauaucacaccuuaacuucuuaguagaaauaaaaucaaauuaugcaauuucauuauuagcuucgcaaagcugucauggaccacguaucagauucuuuccuggagaccaaugucccucuauuaguacugauugaagcugcaaagaauggaaaugagaaagaaguuaaggaauaugcccaaguuuuucgugaacaugccaacaaacugauugagguaaguguauuaguggucuaauuaacagagguaacuugugagucgucacuuuuaaucacgugauugaauaggcuguaggucuucaagggcucaucagugcacagcauuuauaaauagucauucucacgggggcucuagcauaacugcuguucugucaguuuauguugaccacauggauagcuuuugucuuagaaacucaauaccaucauuuacugguaguguagcuaaagcuagaccaugauauuagaacaggauugguacaguguaccaaguggaagcaucuacaaaccagucaucuucugacaagaugccuggaagugcaucucagcaaguuaccuaauucuugccaguucuuauguccuaccuguaaaaugaggucacuaaugagagucauguucugaggaccaaaggagugacagauaugguagguguuuuaccugaugguuaggcagacucggccuaggacuguuuuaagagugaacaagcccaacauccacuaaauuauacuugagcuuacacuagaaaucugugugaaaaugguuggcuugucaaauaauaauuagaaaggaugaauuaacauuuaauuuccagauaaguuagguuucuucuucauuuguuaaaugaauuuacauuguuuagaaaugagacacauacacacaaaacauaaccuuaguacagaaacauaauaauugauaaauaguucauaaacccauuaguaaguugucauuauguaaaagcagaaacugaccugaaauguaaaaugcaauuuauaauaacacagaccaaguuaauacuaaaauuauuucaaggcaaauaccaguaaucacauuaaacaccuuacuaauuuuauaccucauuuuguuugaauauugauugaaguauuuuucugaccagaauuaugcacagaaugcauaggucagccuguuauucaaguuaaugauucugaaguuuggagcuaaaauugggguguuucauuuguaucuccauuaagcauaaucugguucucaacagucacaugacaguguaagaugucauuucuaaguggacagaaauuguguucaggaaaccagucccuuauaaguggccuacuuacuaaaaaguuccuuugagugauaggcaucaaggccucauguaucaacagcuaaagagaggucaguuuuuaucugaacccucaugagacagccguuugggucauccucagccucucuaaccagcaccuacaguauacagcacuguguacucugauuccccccccccccccccccccagacaggguuucucuguguagcccuggcuguccuggaacucacuuuguagacuaggcuggccucgaacucagaaauccaccugccucugccucucaagugcugggauuaaaggcgagcaccaccacugcccagcacucuaauccuucuuaagugaacucaggcuugaagagcuucucccagcuuauguacugcaaaccuccaguagugaggcucacugagcucauggguucaguggacugacaccacugagaaacagugacugggcauaguggugcgugccuuuaaucccugcucuuaggaggcagaggaaguggaucucucugaguucaaggccagccuauucucuauaaugaguuauaggacaccgagcaguacauaguaagacccugucuugaaagaaaacccgacagacagacagacagacagaauuuaagucaaucucggacuaacgacuugagucauugaaaacuuuguuccagacuuacacaucucauuucauucugaacaucgaguccuuggagaugagaggaugaugcuccccaucuuagcucaguucuaacccuuuucucaccuuuccccucugcgugcccucuacaccuauugccuucuccuacggcuuacacagcuguauauuaaaguguaugggauucucaucucuugaggcauaaccccaagcugugcagugccauucuccaaaguuauauuuaugauaacugagacaguaagauguauaauuacuauguccaugaaaaggaaauuaauuucuaagugcuucagaagccuuagagauuccugacucaagguagaacuuuuccugucaugacaagacuucuccucuccguacagccuuuguauuauaguggcacaccuuggacuaaucagagauuugguuuuagcaaagauaaacugccucaccauguuuugugaauccccugacgucauuucuugccauuagcugccuucuagcugaaguaaaugucuacaggccagcuuuaauaugagggccuauuuucccuuggugggucagcagaacuaagaacaguacauaaaauauaugcaugacugguaggacaugaguauaaauggaaaggagagagucagauucuacaaccacuaagaauauuugcagguauguucggaaggagugaucuuucugaaacucugcugcagaguucuaaugcuauaugucaggaauuagcguagaccuaagauaagguuguaagcccaacaagaucuacauuucaaaugccaccuuagcgcugugaucagucaaaaauaaaaccagccgauuauguaguacacaguacuuuauagugcaguguacugugacgguauccgauauguaugaauuuuagaagguaucuugaguauacaaucugccuagguugcuacagauacagaccauacgacagguuaaggcgagugcuccauuuuaugauccuccuugaucacuuauuacuuuucuucccugguaagacuggcuuugagauuugcuuuuuccuuggaguuccuacuguuuuguuguugcucuguuguuuuuugguuuuugauuuuucaagguagggguucucuauguagccuuggauguaccagaauuugcucuauagaccuugaacucacagagauccaccugccucuuccucucaaaggugugugccuacuacugacuggcuaaguuccugccuuuuaacagucagauuuacucuucucuguaggaaucaacagaguauucaguuauuucuuuuaaagucauagguuuuuacuuaauggcgugaaucccuuucuguguagcuuuaugaagcaucauguauucuuagcguuguggcacgugccuuuaauucuagcacuugggaggcaaggucuaggaauccuaggucagccaggccuauguagugcauuccaggguagcuuggggcuacauagugagaaccuaaccauguaggguuucugggacuccuccagucuuuuagucauagaaaacucagucuucaaagacaguguaugccacguugcuguuaggagaaagaagccaucaucuacucugaaaccucuguccguauucuuguugcuacguacuuguaaguugggagugcuuccaguauaaacuauguccuuucaauauauaguauggaaaaaauaaaaauuuaguuuuuucauuuauuaaauguucaaaugguaacaguuuuaaaugaaauguuuuaccuuuuuaguuuuuaaaugucacaaaaaucuuguguaguucauguuauaucuguugggcagugcuagaugguuccuaggcuuugagaagcuuucuuuauuguagcucuucucuguguguccuccauuuaagugcagaucucagugagcaccagcuccaggggcagcaggcaggguagugcagcagccaaggccuucaucuucagggacugacucaucauuauuucucaggaggauuuuggggugggcaacagcaagauucugagauuuccauugaucucacagucagucagagcucagguuuucccuauagaggaccugcuucuuagugacaucagauccauuucuaccagugggcgcaaguggguauuuuguucuaugugugguuuagauaugcugucaauguaaacuuaggucugguauucuuuaucaacuuuucuuuccaaaguugucauuucuucuuauacuuuuuuuuuuaauauaucuuuucccccuuccauauaaucugauguuuuuacaaugcuaagauaaaacauaaaauagaaccuuuuaguuugccucuggaaauguccuguggaaugggugucguauguaacuggccuuacagccagucaaggauacuuuuauuuuuaucuugcuaagacauuuacauaggacagaucuaugcuaguacccucgucucccuuucaauaucaagcaugagauaauuauuuaaaaagaaagaaagaaagcauaguauguucuggcaguuuuucuuccuagaguagguuccccuacaguccuguccaguuuucgugucauuaaaaaucauuguagaaaaugagaaggagauuuguaauaaugguggagagcaacugcucugugaaaugcuagccugugauuggaauauuaucccucaguguugcucagaggcgaugauuccgguucuccuucauguuuagcaucauugguaugcugcacaaauguccugaccuauguuuaaaguuuaagcucuuugcuuugcuuucucaugaauacuugggugcuguuguuauauacaugcagucaacuguuccuggagucagaugauaacaccucauaccuaauuccugaggguuauagccugauuucuuagguuuuuaaagaaaugugccccagaccugacucaaugucucgauagguguguuaggguuucuauggcugugguaaaacaccaugaccaaauagcaacuugaagaggaaagacuuuauuucagcuuauaguuccaucucauagcccaccacugagggaggucaggacaggaaccugaaggcaggaacugaugaaugccaugaaggaauccugcuuacuggcacuagcccaggugucaccucccacaaugagcugugucuucucacaucaaucaaacaaaaugcaccauaggccaaucugaucgguccaucugaagauuuucuucccaagaaagacucuaaacuuuggucacguugacaugaaacuagucagcacaucuggaguucacuuuccagguacuauacugaaaggagggaaucaacuccugaaaguuguccucugaucucugaguggacaaaugucuuacuacugcacaacugcuuugugauuacugagcuguggggcccaggucaccaaccaggcaccuacacuuggcuguggcagucaguguucucagacauaucuucccugccccacaacguuuuguguuugaaaaaguacaagucucugucugaaagcuuguugauaaagccuugggauugaaagugccacuuuagauaaggugcaguuguaggacacuaauguuuuaaaauacaguuuuuauaaguuuguuuuuaggaacuggggaugagauuuugaagcaauguauuagaaagauucaaaccugauuaucuccaguauuuucuuuuuauuguuaaguauacaaaauugauaccaaaguuaguuguuugcuaaggcagaugaaaccaugcugugcugaaauguagcuugguuaccucguuucuguucuagcuguugcacauguucaggugcacauagcguacugguuuuuaacaauuaguaaugagacgucuguauaaccagacccugccaugaugcuuucuugugugcugcuguuugguuuguuuggugcucucacccacucggcuucucaaacccauccuccuucuuccccaagaucggaccaguaaacucccaucauuucuuuguauuuauuucugugauggaggccauaggauagccauuaucauacugguuuucugcagcagcuccuaauggcugucuagcuugcacuuugaauccugucuagcuucuucccuuccacggaagucagugugaucuccuuaagucagcucauaucauuccuuugcuucagaauuuuucucaccuacccuugcgugguuucaagggacagaugugauacagucugaaacuguaguugaccauauuaugaaguauccuguuugcauuuccagcugcuuuuagucccgugccuccaugcugacuggccccugucauccuucucucucauuuuccaggcccaaauguuacuuccacagaaaggccucccuugauccccucagcucucguacaacccucuagugguuauauuuguuuaucccuccucacucucugaaauuaguagauuugcuuaauaaucguauuuaucuagcccuacucacugaaauaaaauguucuuuugaauauaugcauagaaugauuccucgugcauacuggguucucagcagcuauuagccuagugacuguccucauucucagugcuaaauaaaugucuugcagaugcucauucuucagauucagcauccaaacccugauucaguuguguauagacgguugacaaacagaacuuugcauuguguguuauuuugaaguaaucuuuauauagaagguaccaugcacacuuguauguauguauguauauuuguguugugcacacacagaauuuauaggcauuccaggauggaugacuuauccguaguuccugagucugggucuuaugauuaugcaacaagcacugaucaucucuucagccugaucagaucuuuugggaugugaaguugagaaaaauacaguuuuuuuuuuugggggggggaauguuuagaugacagauuugagcaguauuucauucuacuuagcuagaauuaaucuuucaaaaaccuaagcaacuuuuuuuauagauuggaagagauaaaaauauauagaaagauuauaucagcaaacauuugugaacuccuaaacuaggagugguggcucacaccuuuaaucccaguacuugggguacagaggcagaguucaacacuacccuggucuacagaguaaguuucaggacagccagagcuacauagucagacccugucucaaacaaaacaaaacaaaacaaaacaaaacaaacgaaaucuagagaugaaguaauaaauaauaaauccucauuuguguggauauuaucuucuguuagagaauggggggaagaugaaaguaaauacagauuuuaugagagguguguauaagguucauauaaugaaauggaaugaaggaauauuugaaaauuuuuuuauccauuucauuaguguuugaaaugaauacaaaacuauuacuucaguacuuuuaauaaaugaccaacauaaauuugggacauagcagauguaccaaauugguuuuuaggaagugugugugcgcgcgcgcgcgcgcguguguguguguguguguugcuuuaauagaaauaauuucucuuuauagcauauaaaggauauaaaauagaguacaaaauucuuuagugugagagcgcccuguaaaaguugaccaaguaauaucaguccugauauuauggcugcauucacucaaaggugggaagguccuacagugccuacagaggaugaauuacguaugaacauaaaagaccaaguaugugugcaguguuggugacugugagugccugauggaucacauucaagcgcuuuugugacuuaaaguaguaguaaagaguuuuucugugaggucucuccacuguuauuucugagggucugcuuaggcucuaagacugacucuuggauuaugguugucauuaauaggacuuguugacuccccacaggacagucuguuugucugucuuaaauaaaaugugcauagauguuagauauccucgaggucauugauaggagggaggaggagcaggaacugcuguacugagugcuuuguguuuucucucaucugcuuauaaauagugagggaggcuucuaggcaaaaguaccuuguguaccuuacuuuuuccucucauaucaacuucaugaugucuuuauguuagucuuugauugaaaguauguuaagguggaaauuuguuugcugucggaaaccuuucugucacuaauguaauaucuguguguccuuuuggaugauuuccuuaccuuuguuccugcuuugcugugugcaucguaagagccaaggaacaaucaguguucuuuuuuacuuacccaggucucuucagacuuacagcucauaagaguaagacaaggaagauaacacguaucacuuaguauccuccucccuucauccucggguagugcauuaacauagccuuaagaugggaauuugcugcacucagguugcaucucauucgcugccuugugaauuaagaauuacaaagcggaagaaauccuuuaacuguugggcucucucccccaguuuccucauuaucuggaacuucaugggguaugacuuuauuaguuugaaauguguauuuugacuacaaauugaauguucugcauuguauauuuuauuuuugucaugaauuuguauguaauaacauguagcaaaguggccuugaaggcuccaugaagaacauuugaauuaaacacugaucuuauuacuggcuguguauuuucaguggguccaugugacuuggcaggcugaagcucuagcaaauaacaaucaguguacaugaggcuaaggagucgucuuuguucccagacuagucuuucuccucugccaacuuaucacuuugucaaauugacaaagcaaacccucccuuccuuccaccacaugggccccuuagcucaaacucccuuggguucggaggcagcaagugccuccacccacagagccaucuuacuacuccagaaacacuuuucuuaaggggccucagcagcaucuuuucucuuggauccugguaggaaggauugaggaacccucuacccagucuuggcuguguuagauuauaggccugccaggcaugguuauacgggccuuuaaucccaguacuuggaggcagaggcaggcagaucucuguuuaauaugacuuaaagaacuguaggagaggggcuggagagauggcucagugguuaagaacauuggcugcucuuccagagguccugaguucaauucccagcaaccguaggguggcucacaaccauaucuguaaugagaucugaugcccucuucugguguguaugaagacagcuacaguguacucauauacauaaaguaaauaaauaauuccuuuuuaaaaacaaaacaaaacuguaggagcuuccauuuucucaccaggaaaugggacugaggacugaugauaucucauguuuagugaggcacgauuucuagguuuacuuguaagauuaggcagcuagguagauuuagaaauagggaacuucuuuaaucccagcauuugagagguagaggcagguggauuuuggaguuugaggccagccuggucuacagagugaguuccaggacagccaggacuacacagagaaacccugucuuggggggagggggggugaauauauauauauauaauuuaaauaaauuaauuauuauaaauccuguuuuguauuuguuacuaguuaugcuuauuuauaccuugcuuuuuccuaaaauuagauuaucaugacuuauuuugaacaaaaauauauaugauaaugucauaugugaauagcuaggaccaagugaagaauagcaggcagugugaguuuguuauauggaguuuguauuacugaaguauugggauggaagugcuaaacagacauguaggcugaggaauucaugauuuuuccccaccuggggaauaagccccuccuaagaauaauuucagaaagaauucuucccugagauuuacauaugaggcauuugagugauuuuucaacacuuuaaaaauaaacguaggacaauuauuauucuuuaauggcaaggucauuugcuaccaccuaugaugugaggauuuauccaguacacgccuuuaugugaaagaagugaaagcacucaucacucguuucuccucucugcccuguuugucagccccucaccccauucccuguucuugacugugccauuaacugugucgguugaguucucuauuucccucuuguuuggcugucacauccuugcuguuuuaguagucugccucagguuuucugugggggcaggggugguggugauaaaugcuucuguccuuuuuguuuguuuuuauucagacuucagauucucuugcaacauacucauuauauacacacuccucaacauacucuauuggguguuagugcuacuacagagcugcugcccuccuccgcacacacacuuuguuucacuuuguaaaggguuaaaaccagggucuuacuaauuggccaagcuacuuuugagcuuaccuuccugccgaaaugggacugaaagcugcaucuucaggcacagugacuugaguccagguuuuauuguauagccuaggcuggccuagaaucacuaucuuccuacuuuagcgccccuuguugcuggagucacaagauaugcacuacugugccugucaagcuaaagacuucacacugauuuuauuauuuaaucgcaugucaggugugugcccacugcccguggaagccggaggaggaugucacauccucuagaacugaagauacagaccauuguaagcucccauguaggugcugggaaucaaauugagaccuugaagaacagccugcugaguugaacgauuucccccacagacuaauuuuuuuuuuuuaagucguauugacugcuguuccaaaucuaaaggugcagguuuuccucaguaagaggugugaagguuuuccuucccugucuucccuuucaagguagccaggucuggcacuaguauaugaggcuggccucucggagcuauagucuagaucuugcauuugcacauuugucaucgugagaagugaguagucucgucccuggaggguguguugaagcuuauucauccagaaaagacuguuagugacaagcaucgcuuccuccuccuuccaggccuaagacaagcagcauccucuucuagaguuaucagaaacaguuaggguaauguuuuaaaacaaagaauuuaagucuucuguagccuuuuucauaagauuuguaucaaggaaacaaaugacuuaaagaauguagccguuuuaccauacccacaccacccuguaucugaacaguauucuuuacuucuugauuuugaaaauauuuguaagguuuaagauucacagaauugagauaguauaaauaggaauaaauugaaauaaaauuguugggugguuagaaagcaaaaucccagugucuuuucguggucuuugucuuucguggucccugucugaaagcagcuuauagaggcaguaggcggggcuuguguugcuguuucaccucaccaggagcuuugugauguugucuaguuuuuuauuuguuuuccagaaugccccucccuuuuugugagguagcguuuuuaugguauagcuaauccuaaagagcaacauuuuuaggacagccagaacacuagcaagcuaaaacuaugguauaaccuguaaaaaucauuucuucuuaugucagcuguggcguggucaccugggagggaaggugaagguugacauugaaguagacucugccagacaaggaaguccaaccagcgcugccauucugagagccccugugggaguuucucauugcuuccauugucgucaccucccuucauugaugaggaggguggcauugucuguuguguuuuguuuaagacacaaucucacuccguagaccaggcuggcuuuacauucacagacuucacuggccucugcuucccaaguacugggauuaaaagcgcaugccacuacaccuggcucauuugguucacuucaguguuaccuuuaucaugucuuaaaaaucuuaauuuaccuguguucaaauaaacuuaacuugaauuuauacauaugacaaggagagcagcaguuuagaguuuugauuuccuccccucaagaacaacugcaaauuuuacuauuuguggguacugacaguuccuuccuugguguuccuuggguuuucuuauaauugccuuauugugacuguucaggcagauuagagcucucgaagccugugagccaccucuucugauaccagccuacaauguaacauugugaaguccuugcaggcugagaagugacgcuccuuccugcguuguaucuucuguuuucugggaaggccagagugaggcaugguuacugcccuguuuuccaggcaaaagaggaaaaugcucauaggcguuguuauguuccucccucgugcagguugccaaccuggccuguucaaucuccaacaaugaagaaggcgugaagcuuguccgaaugucugcaagccaguuagaagcgcuguguccucagguaaaguauacacugucuccaacauuggauuuaguaggguagauauaaauuuauuuugcuuucccuuccuucuuuccucccuccccucccuccaucccucccuuucuuccuuuuuuuuuucccuaaguauauauauuuuuuauuagguauuuuccucguuuauauuuucaaugcuaucccaaaggucccccauacccccccccccaauccccuacccacccacucccccuuuuuggcccugguguuccccuguacuggggcauauaaaguuugcaaguccaaugggccccuuucuuccuuuaaaaaagggggggggguuuaaauagaaguccugauacaaauaaaccauagauugggaaaauuuaaguauccuuuuuuuuuuuuuuuuuuuaaucauaugcuacugccuccuugccuuuaauuuaaaaugcauaggagagagucaucagauggcucaguucugccaagacugauggucuugguccacccccaggaccuacguggugguuaggagagagcugacuucaacaaguuccucuguucuccauguaugcauuguugugugcauguguuaugugugugguacacaggugucugaccaaucuaugcaguugugacgcucuugucacaaaguacuagucuuauacaaauaauaguaaccugguugaaccagccacugaagugaaggcugagaguuucuguuuuaauagugagugacacuuggaaagauggagaauugggcugggcuaaguguaugggaugcuagaaagacuagacuauaaguguauaaaacaacuaauucuuucuuucuuccuuccuuccuuucuuucuuucuuucuuucuuucuuucuuucuuucuuucuuucuuucuuucuuucuuucuccuacuuuauugguuugugcuuacacauguugcauguucucauggugugaggauagaggacagcuuguaagagagaauugugucugaucuaccccuaaaugggucgcagggacugaauucagauuaucaggcuuaucagcaagcaaccauuaucugcugagccaucucacuggccccggcuagugccuuugaauauucaguguauuugucuccugugugauauucucucugucacucagaucucuaagcaggcuuaagucaugcuuucuacuuucccugauagagaaugcuuacagcacagucugagaguuagguuaaccucucuguguguccugccaaccaggcuguagacauagaccagagggagcaagcagaggaacuguggggauugacucaggaugggcuuucuauguaaagucugaaccuuaagugccccgcccgugacaacuguccccuggcucuuuaaugugaaagcacucgagccuucuaugauggaccaaucacaaggcccugccaugugauaaacaucuugccaacuuuauaccaucauaagauuuuccagugacugauugcuaugagauaauacagugaauuggaugaccaaauuguaugaaauaaauuuagaguugauaucuaaagauuggacuuucuuccccucaaguuugccauuuuauccuuccagcacuuuaauaucuuugguucuccguuucauuuuaaaaugcuugaaaagcgacaaugcuuccacauaucugcagaaacagaugguaacauacgcugaucacaccuaccaagaguauuuauauaaaugaucuuaaagccuggggaaaggaaucacagggagaaucuagucgaugcuaaugaaaaugcuggagcugaugagccuccugaguuggccaugucguagcauggagcccaccacacaaagccucaguucucagcuucacaguuucacauaagauggaccucaggacugaguuuaagacacaggacccagaccauacuuggcauugggguugugcccugaguaaaagaucuuuucugggagugauucuucuuuauacgugcagagcugggcaucuucaguauuggaaaugcagacuggaccaugugggcuguucaucuuuguuuuccuaaguuaguucuguuaccuagauaaaagagaagaggccccauugccauguccacaugcggcuaagggugguaagguuuuuuuuuuuucauguacuuccucuccaugucugagcaucuuuuggagaaagaacucuucagauccuuuuacauccucacugauuacagugaacagugaauaguaugaaaacgaauguggagacagacaggagaaaacagugacgagaggugguuaaaaugcuuuauaaaggggaugggauggggcuaggaagauggcucagcaguuaagagcauggacuauacucaaaaggggacuggguuuguuucacagcacccauguuaacaaacuauuggcaauuguagaagagaagcaccucuugucucccuaggccauguuuagaaaaacucacucagugcgugugggcugucuguguagagugaaaguggguaguguguacgccauggcucacggcuagacuagugcuuucccuggagacaggaggagggcagugcucugcacccuugccgcguguuauuuuuggaguagggggaacagcuuagugguuacuaggagaugggauaaggagagaagaggaagauggggagugcugacuccucauuacuaauacauuuggagcuucuuaaaaaaugauugaauugaaugcauucucauugucacuauaguaauucuuauugaauuuacacaugauuuauaaauuguaucucaagaaaacguugggguguguguaugcugugcugcagcuggaauuuugagcccugcacauacuggucaagcuuucuaccaggggcuguguccccaguccuagguucuuacuuauauguagcagacuagauacuuuucuguggaauuuuauaugucagagauaccucuguuaaaaugacaaagggaaacgaguccuuggaauugaaauacaguaccuuuaucaugaaugaauuccgauaaguuuggcauuugguaccaggcauuaugcauuauugcuacuucuguaaugauguauaacugagaugagucaaaauauccccacaguaggagaguaauguaagauaccuguaaaauggaaauaauaauguuuuaauauauacuuaaugauguugaauauuuaaaagaaggaagcaggaugauuauauguggcauauaauuuuaauuauguaauuuuugaugguacauuucuaugaauguuuaaaaaaccuggaauuuaaugucaaaacuauagaauugggggcuggagagaugguucagugguuaauuaagagcacuggcugcucuuccagagguccuaaguucaauacccagcaacuacaugguggcucacaaccaucuguaauggaauucaaugcccucuucuggugugucagccacagaguacucauauacauaaaauaaauaagucuaagaagaaaaaaauuauagaauugccuuuacaaauuggcugaaauagagagagccuucacuuauuuuauaauugucuguuguuuucaaauaauauuuauagcuuugguguuaaaguuuaaggccugcuauucaguauuuccucuguacgaccugugguggagcacaugaugucauguuugaccaaagcaccccgugugauugguuugcaauggcugugauaggaugagcuaugugcauuuuuuuacugucuucugcagguuaucaaugcugcauuggcguuggcagcaaagccgcagaguaaacuggcccaagagaacauggaucuuuuuaaagagcaaugggaaaagcaaguccguguucucacagaugcuguugaugacauuacuuccaucgaugacuucuuggcugucucagguaaugaucugguucccuaaaguggcauguagaauuguuguccaggucauaguuacagacaaaacacucucacaucuggucaaggaaacucuuaucaguaacaugcugguucccacacuuguguccugagcagggggaguggaccuggagcucuuucccuccugguggggcugguguccacccugcaucauuaguuacugggcuagcagaacuuuucccugcuggugugaucugugugucauauaacaguccaccagucuugauacuucaguuuagaccuauguccuggugccacuggucacugguaacaagccugugaagcucaggggaggagccucucagcucucucagcuuuuauuguagagaauucccuuuaccuucuuggaaugcuucugucucaggagugaucauaguuuaacuacuuuuuuaaagacuaugucggcaugaugcacagauagaaaacagagaggaaauauuuaagugccauuuaauuaugaacuugcaaaaaauaaaucuggguaauucaccucacaaaaacaguugauuucauuauauaaauauaaacugguaauggcauaguaaauugcauucauauagaacaugucugucaaaugcaauucaguguuuagcucacagaaauaaauuuuaauccuaucuccuuagaguugaguaacacuaaaugcauuuuccauuuaacauggacuuuggugccccuggcuguguugucuucuuggaaaugccaggcuuccugaggcuaguggcugugggcagauuuagugacuggguucuuguagagcugaaacuaccugucaccccagggaaccacgggcuggaauguggaagaugugaguggcaauggggcuugaaagagaagcagacuuaaguacaugcacagcacaguccuccagcagugaccuauauaaaggggacacugugcucugcauaccaaugucccuggcauugcacguccucccugagaugguagcuuuggcuuaacuugagaaagccuggugcaggcuguuuagcugcaggaagaggugguaaacggugugguugcaggacugccaaauugcagaugcugcuacuuuaaaacaagaaaauucauuugcaagcacauuguugcaagugccaaaaaugcagcaaugggccuuuuugggaaucuuggccuucuguuguuuuucccaaugaaguauggaauuauucuuuuucauaggccuagggaaaaacauucuaccuucauagcacauuuuuaagcaaacaacaaauuuggaaaucuaaaugcaaaguucccucuggauaaauacuauauucuuacaguuuuguguuuuuucaaauuaaaguggguauguuuauugagcuuagacucaagggauuuucauuuuuucuuacaguaaaguaaaauauaaaguaaaaguguuccucauauaauauuuuuucaaaucagacaacaaaagggauuaaguaacagcauuuagugggaugcagacaggauuuuaaaagguuauuuaauauaaaauggaagaccaguaaagagaaauuaaauucuuuaguagauccacuuuuauuuagugaauggguccagcauuguuguaaguaaaugaguuuaagagagggcugacucagugcaaacagucgagccaguuucuauucagugaacucaaacguagacuuguucuccugaagagagcaccugaacgguguuaugucugccucuucugaguguuugauuguucugucauaagauugcuuaggaauacaagggauuagugaugcaggugaggauggugaagggccaagcaggugccuggguaaguccugguagacuaagcaguuaguuuguagugcucagaaauacaggacuucccuucuucuuaucaguagcugauaaugagccugugagccccuccccaccaugauugacuccugauaggcccagugcaggcaguugcuaccauugaguuccuguugaaaugacugucauaaccagaagauuucacaggcccuuuucuuuaucuucuggcuagugcauucuuugagccccuucuucaauccccaagcccuagaggaguuguaugaaugucccguuuagggcugagcacagaaccaucucuuauucucaccgucuugaaaaggccucugagguugaguaccguucuucugugaguauaaacaagugucaggggccacagugguaccuaccaguuuaacuaaaccuuagugaguuccucuaagguccagacguccccagcaguggcucugacuggguuagcauugccguuuccccuucugauuccgucuaagacccagccuguguguuggugcugcccaguuaggaugggucuucccaccucaguucaucuaaacuaaguaguuucucaaaggugugcccauaggcuagucugccuagaucccuuggugagucuagaucccuucaaguuggcagucaguauucacccucauuaaaauguuuauucccugcccugucugguuuucauacaaagggauuguuuucugccuuuuuaaaaaaaaaaguauaauaaaauuagcaaaacuguagaugagaauuuccuuuaaaggaaacuaaauuuaaaggaaggaaacaggacuugagagcuguuuggugacuagaaagaauaguggugguuugguuuuuguuguuguuuuucuguuuuguauuguauuuuuucuugcugauguaagaaguaacuuaggagugaaaggguucacaguugaauaguacagucugcuaugucagaaaagucguggcacuauauguguaaucaggaaacagggagaguaauuguacuugaccgccaucuacccacaacagguuuuuguguuuucauguaauccugaguguccuggaacucauauuguagaccagauccaucugccuccugaaugcugggguaaaaggcgugugccaccacugccuggcuccuuucuccaacccaggcaguggugcugcucacaguggguagacuuaccaccucaccggcaugcccagaggcucaucucacaugucagacuuccugagauaagucacagucagcuucuuuaaguggacuuccuuuguggcuucauaccuucuuuggaugugaccacagauggggaaagaguauguaugaauuuaauaaaauuggaguuuguuuuugaaaacagguaucuagaugcuguuuuuuauagaguacaucacugagucugauguauugacccccuccaaagugugaaccacccuaaaacagggaugagaucuaaaucauauaaaaaagaggguuguaggguuuuuauuuguuuuuaaaucagaaucguuucuucccuuuugacuuucccaccuuugggaaaauaugggguucaaaaaaaguaguuucaacauuaagaccuugaaugauggcaggcuuaguauacauuuguuuaguuaguauguagggaauuuggaugcuuaugaugauguugaagucuuccuucuuucucucccuucuucccucccuccuuucuccuccucuuccuucuuuguuuuguauacuccuggccgccauuccuagaacuccguguagacaaggcuagccuugaacuuccagagaccugccuaccucugccuccugaaugcugggauuaaaggugugcacucccaccuggccccagugugcuucuuaaaacagauugcauuugcucuguuuguucuagcucuucucuaagaacuagaccuucugcacuugcuaugccacauucuguuguuggcagaaguuaugucuuuaagugacauaacuucugagagcugucaugccuuccagaaaagaaguugauguugccaccuacugcagcccuucuugugcgcugucucucugcuucucgcccccugcugggucugcccuacugccauggugccugugugcaccuagcagcuugcuccucuuagcacgguuuccuuggcccuuugccuuguuucccuuucacgauuacagaugagauugggagaacuugcucugggguuucugaaaacagugucaggcuuugaaaggaaaugguuuggaguuuucaaauccagcugugugccuaguaggaguuuuuggucaauuuagcuggauucacugacagucaaugaaggaggaguucuugaagguagcguguguguuuguauuacauuauguauuugcuuauugaaggcgguguguuaguuuguauuacauuaugcauuuggcauuauagacugcucaugccaugagguaugucuggagggcagaggacacgcguaagaguugguucauacucuagauucacgccccacccuucugagugcuagcaugccaaugugugccacugugccuagcuccuucauguaaaacuuggaacaugcuguguuaccaugccaccuuccaguagaccugauucuucauucaucuuuuuguccucagagaaccacauuuuagaagaugugaacaaguguguuauugcucuccaagagaaagacguggaugggcuggaucgcacugccggugccauccgaggccgggcagcccgagucauucauguagucaccucagagauggacaacuacgagccaggaguuuacacagagaagguucuggaagccaccaagcuccucuccaacacaggucugaggacuguuucccacccacccacccccacaggcaccuaggguuucucugguccccaccauggcuggcucugacaggcuguccuuucauuccaaauacuggggauugcacacacacaacuuuugcacacauggauuggcucagugugcuaggaggaaguuggcucuugggcagcucaccagcacauuccuuuuauguaugugagauaaacuugugcguugucuccugcuaguggggucaaaccccuccuccgcaguguuagggauugaaccuagagccucuuacaugguagggaagcacuucaccaguaaacuacuaccccagccugcuguaguucccauucguaaggccucaaagucaucagcaucauuccaaguucucagccccacaguccuaguucacagagucugccgagaagaugcuuggguccuugagaagcagaggcucuuugucaugaccgugacuguccguccaaggauucagggaagguugguggagugcaucugugcagugcgaccuguccuccuugucucugcagucaugccgcgcuucacugagcagguggaagcagcuguggaagcccucagcucggacccggcccagcccauggaugagaaugaguucaucgacgccucccgucugguguacgacggcauccgggacauccggaaagcagugcugaugaucagggugaagaaccauguucugcacauuuuauguuuuauauauuuauauauaugaguccacuguugcugucuucagacacaccagaagaggacaucagaucccauuacagaugcuugugagccaccaugugguugcugggaaucgaacucaggacucuggaagagcagucaguguucuggacugcugagccaucuccccagcccuuccagacauuuuaacagcuucuuuuuuuaucauuugcuaacuuaaucauuguguuauucuggaacucaguagauacaguggcaguauauuaaauccaugaaucuaagagcuuuuagaaugagaacccaaacauggaccaaagaaaggaaucuaacaugaguugggcuugaugaauuaauuuagggaauuuaguuggauaaucauagaauaguuagaguuacagggaaacuacagaaaaugaugucuuaaguuucagagaacuuuuucuuuuuuuuuuuuuuccauuuuuuauuagguauuuagcucauuuacauuuccaaugcuauaccaaaagucccccauagccacccauccccacuccccuacccacccacuccccuuuuuuuuggcccuggcguuccccuguacuggggcauauaaaguuugcguguccaaugggccucucuuuccagugauggccgccuaggccaucuuuugauacauaugcagcuagagucaagagcuccgggguacugguuaguucauaauguuguuccaccuauaggguugcagaucccuuuagcuucuuggguacuuucucuagcuccuucauugggggccaugugauccauccaauagccgacugugagcauccacuucuauguuugcuaggcccaggcauaacucugacaagagacagcuauaucaggguccuuucagcauaaucuugcuaguguaugcaauggugucagcauuuggaagcugauuaugggauggauccccggauauggcagucucuacaugguccaucuuuuuaucucagcuccaaacuuugucucuguaccuccuuccaaggguguuuuguucccacuucuaaggaggggcauaguguccacacuucagucuucauuuuucuugaguuucauguguuuaggaaauuguaucuuauaucuuggauauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguuccuuccagcuucuggcuauuauaaauaaggcugcuaugaacauaguggagcauguguccuucuuaccaguuggggcaucuucuggauauaugccccagagaacuuuuucuuaagguagguaaaguuacagugcuucugccaaaaggaacgcuccccuccuagaagggaaacccaggcagguuagaaucucugcucaggauaaagaguccggcaauuggcagcccucaggaugucccacggcucauggccaaguggaaguucuaccacuagggcuuaugugacccaccccagagaaagcagcacaaagugcuugaccuccaugugaacaaggggguucugagucugcagguuccuccaucaaacagguccugagccugagucucacaaacugccauuuuagcccuaucuaucuagccagcagaagcuaaccacguugucauuugggaacauguugcuccacagauauaagacauggccuaccugaguccuacgccaccccuucccccauucauugcaggccccucagaacaggcauuuggaauacgauucccaccuccuacauugcuugaguuuugcccgcuguugugugguuuggucagucaauugaguuucauuuauaccuucuuuguuuucuagucaaaccuccaaggugguaggcagggacuccaucccauuuuuuuaacccugucuaccuagccagcaaaaguguuaguuagaaacguguuaaaggccuauugcuuccacuuuguaugaggcauuggaaacucaggaaagaccaccauucucugggugaggcaggaaagcugcccaucugccuaagcacacuggaaagaggaauaguugugggugugguuggaggauagcaaagacuuccaggcuuuccagggcuagcuaaugaagaacccuaguggaccaaagauccuuuaguggguaaaggugucugcuauccaacuuugugaccugaaugaucccuaggacccacauggcuagagaagacuaaguccuacaaguuguccucagaguuccaagcuacagcagaaguacuuuaucucuaauaaagucugguuagcaguaucaauggcagcuaguggcuauaauaugguauuaaugggugccaaggcuacauauacuccagcgaugcacauaguucuacuucucuggcugggugccauugggagcagagcuguauaguuuuuucuaggaggugaucaggcuaagagcaccauucugaagaagcagucugggcacuaucucucugauguguguccccaccgcccccccaauggcguuacuggggagcuggagugaaggcucagugacuaaaagcgcuggcuguuuuuugagcgguugaacacucaccuggugucucagaaccgucuguaacucagucccgggcaucccaaggcucuucuagccuucagggauaccaaccaugcaggaaagcagaacucccauacacagaaaguaaauguuuaaaacauuaauggcuucauuggaugaaauaaauaaacaggcaguguuuccagcacaggccugacacauaaauggcugcuacuuacuauauuuaguucugugcuggaaugaagaauggcaggccuuuccucuccuccugggccuccagguuguguauagugauagacucucagggaaggcagccuucagugcucaagugggcuuggcagggaaccggcagaagugaagcuuugaagauggugguguaguuuagcacgugcauagggcucacugacgaugaugguggugguuagcauuagguuagcguuagcauguacgcacgccaucacugacccaucacagucaucuugguuuucuugggaaaugagucucagugauaaagccaaguauucauuaaccugagccaggaauccauccucagcaugcacaugugugcacagggcacauguacguauguguacaugguacaugcauacagaguucuucucacuaguccucuaggcugccaugucuuugauuggccccacaugcuacuuuucacucagccccucaggucuugguuuucuuuuuaaaguacauuauuuucaugugcacauguauggagaccagaggacaccuuguggaagucaguccucuccuucuaccaugugggccccagggauugaacucagguucucgggcuuggcaacacaugccuugaccuacucaggcaucccgcccugguguaaggcucggcauaucaucccucugccugaagucucuuagcccagggcauccacaccagccccagccucagucacugaacagcucuuccacacucucuuagcucagccagcaagcuaaguuguucuuuuaccucaguuuacccacacucuccaccugcauguucccacugucucacaaaaccguugccuguuuccagucacuaugacggcuguuuauugugcugaccacuuuguaguaagccauauaguuuacucguucuuugcccauuacuucuguucacuguuagaauaggugagugagugagugagugagugagugagugagugagugagugagugagugaguggagaaaagagaagagcucccuuucuuggcaagaacgauucuuaggacccagcuaggcucugggaaggaagcaauguuggcugcugcucuggaaagcuccuuggaccuagcacacagcagucuguggcugagcucagagucacacacugacaggaucucugugacucuguaguaccugugaucuuccccaguaccaggcucacuucucucgggcagacccaaccuucacccgucagacccaugccauuuccucagugcuucucauaagaccccagagaugaggccucgcugccccgugacacaggccagccaucugggccaacgccaaccccagcuguucuucaugccugccgguucuuccugauaacuguuucaagucagaggcuaagcaggaggcuggucaccugugccaaauaggauuuuuaccuaauaacugcugcaggggacuacagcugccagccccuuuggucuuugauauguacugaagucuccucugcuauauucucuuguccuuugauaaaaauaaaauuagacuuuagggauaacacauuguuuuuuuauuccucaaaauagccuuuggcacccaaagagaaagcccagcauuaauuuaugucauguucuuguugucauaaaguaagcauuuauggaauugcuugauguuggguaaaaacaucucuucuuuaaaaacuuuuguccaaggaugguuuuuaccuucaugugcauuuguagauucguuggggaauuguauuaaaacugaaaucuucguuaugauugauucagaggucagccugaacccuaaguccuaugugaagagcuuucuuuacagagagggugaggaggcugacacacugcucuggugaccagaggcugcacccuggccucuguacugcaggcuaagggcucucccucagccggaagcgugggcugacugauucauggucuuuguuuggcugcagacccccgaggaguuggacgacucugacuucgagacugaagacuuugaugucagaagcaggaccaguguccagacagaagaugaccagcugauagcuggccagagcgcccggguaaggacauggcccuugguccucugacuuguuugggaaaggcucuguggcacuuaggccuggcucuuuucuaggguguucagaaugccauuuucugauccuuuuuuuccuguggaguacagcuaaaauccucagucauggcagcugcuaguaacuuguggcuuccuacaaaacagcccucagcuaggccuaggugagagcccagguccacagcuguacgcugggcugcgguuuauggugcccccugagucaggaaagagugagggucuagucaggguuacguuugcuaaaaaugauuuugcaaugcuucugcuuguugcccugauaacuguaggaaugugcucuuaaauucaugggccuuuaaaccuacaacaacaacagacccacaagugcauccaagaagaccauucaccacugucacauuguggucauuacaucuucaauucaccaauucaauccgugcuggaaggaugccgagaugucucuagggagucuauuuucucacuccauggagaucuaucucagagcguguuccugcuguagaccuuccuggguccugagcacugggagaguuaggauggagccugugggcuugaauugcugcugucuccagugugcugcuugguaguuagaggaggugauggccucagcagaugcucugaccaccuuugcuggacauuccaaacuuggaaaugucuguugagggccccaacaggaaucccacccauucauccucuccuguugucacagacagcagcaaacuugaaacuuuuaaaggagugggucagacccacacagcuguggcaaugaagcugcaaguuagccuccauacuguucccgccacauucagacaugauuuugaaaaugggucuggaauucaggcugcaguaaacuccuacaaaaugagaaaauagcccuuugggcaaaaugaagccauuaaaguauuauccaccuguguuguagaucgcugcuagaaggcuuccuggcuaaugcacugugagaaccucauaguugguguggcuugugauuguaggcgaucauggcucagcuuccucaggagcaaaaagcaaagauugcagaacagguggccaguuuccaggaagagaagagcaagcuggaugcugaaguguccaagugggaugacaguggcaaugacaucauugugcuggccaagcagaugugcaugaucaugauggagaugaccgacuucacccggugagcagagcccaccccugcagccugcagagagaggcugaggacuugcccagggcccugaugcuuuguaguccucuuuucuccacuuaccuccaaccaagaaaggauucauagacagggacccuguucucuuuucagaggcaaagguccacucaaaaacaccucugacgugaucagugcugccaagaaaauugcggaggcgggauccaggauggacaagcucggccggaccaucgcagaccaugugagugacacucuguguggccuguggcugaggaagcuguucaugagcauucucacgggcuguggcucacuuugaaaacugcucuaaccuacuugauuaaucccagcauaacguuccuaaggauuucucaacuccuauuugacaagucucuggaguugggucuguuuauccuaaacuuuacaucauuucauccuuaagaccaaccccuucuggguuuguuuguaguuuugggcagaagcagacucugucgucccugccccucgggaacggauguaucagagccucuugcuggggcuucugugggauugggagcucugggcgagguuacacgcaaaugcgucuagcuggggacagcuucucucuuccuaccuccaggaagccucgcagcacuuuccuguggcuuuuuucuggaguuguguguuuugcaaguuauccaagcuuacugugucauccaggcugcaggaugggugacaucugucccucauuacucaaaccaacauuuggcagucauucuugaccacccaguaaaaagccauguggacaguguauuuugacaacaccuguucuuccugucugaaauuaguagcuccauugaucucuuaccugcuuggaccucuguggccuauucuuuccucuauucugcacacagccaucaguacugucaucaucaaaugcaaaucagacuggaaucuguccugcuucagugccagcuuagaaaaaaugcaaagccuucagcacggaguaucuaggcccuauuuuauaccagggugcuucucccuccccuccaccucauuggaagcaaguaucuguuguaaacacuggagaguaggagccugaacacccggccacagagcagucuugggaaucacaugugaccaaagcgagcgucuguuauccagguuuauccugugugugcaccugccugagcagacagcgccuuaggcgaugaauuacuggcuuaguuuacauagcucagagcauugucuuucuguaugaccaggcccuugcucacugaugcuuucucuuacacuauggggccacgagcuucuccccugggguggaaaccuaggccuuagugcaguaguugcugaguggcccugaguuacugaguggaaggcucagaaauuguucgcugcauacgccaugcagugcugcaggagggggcucuaugaggccugggguauaguaaccuagaaaauggacaucuccccgcucucugccugcugcuccugggggguggggggagcaugcucuacccagagggagccuuugagaaacaacccugggagcagggauugucucuggggcugggaguacucagugcugagcuuccugucccaucagugcccagacucggcaugcaagcaggaccugcuggccuaccuucagcgcaucgcucucuacugccaccagcucaacaucugcagcaaagucaaggcugaaguacagaaccuugguggagagcuggucgucucugggguaagugucaguaaugaggcgcacuggccagucggggugugcugagccaugucuguagcagaaguagacuuuugucccuacacauuguccacuuucuccagacgugggaaguguuggaagcagaagcuacaaggcccgucuugguuccuggagcccaccagccacacaccaucucugcuaaacuaugccucuuuagcauggcaugguugaugugguccggugacagcuggaacuauuaccaagccuaaucucuuucuuuugcuagcuguucuuuggaaaaggguguuuuuauaccaccccuaccccacaaagaguaauuaacucuacucagcaauuaccaacuagagcuaugcccgcugcuuucucgguuucugcccacagagcuggguuggagcagaucaucaggucguaguuccugaggaggagacauuucucuaggucuguggagaguaugucuccauacuucccaaugggaccaagaccucaaaccugaaguccacagaguugggaguucuuucuguauugccaggaagugaccugaugucaagucuucccugccacuguccacggugccagugcuacccagccuuagcugcucggccccaucaagaaaucucccacucugaggacauggggguggugaggggauuuuauguguugucaccaugucuuuucaaaagcaaguauuuucagcuacauggauaagaguugcccuugucugagcaguacggggcuccacccagugcuauggcaaccccuugcucuuaaggagaugaggcucugguugguggggccaggccugcaugcaugcaggggucuaacccagcuugucacuacucaucuguuccuuguagguggacagcgccaugucccugauccaggcggccaagaacuugaugaaugcuguugugcagacagugaaggcguccuacguggcuuccaccaaauaccagaagucacaggggauggcuuccuugaaccuuccugcugugucauggaagaugaaggccccugagaagaagccguuggugaagagagagaagcaggaugagacgcagaccaagauuaaacgagcuucucagaagaaacacgugaacccagugcaggcccugagcgaguucaaagccauggacagcaucugagccugcacagcccaugggguucugaaaaaaaccagucacaugcuucacucaaauguauuugcuaaguagagaacacugucuuauuccacagggagguagcagauuucagacucaaccagguggugaauuuugcaaggacauguuuguguuaaagcugguuagaaaaaaaaagcuuuuagaauucaaaaauauauuucuagcuauauuuuuauaaguuuaaugaaaauaacaguucuguaaccaaagaguaccacauuaacuucuuggucacauuucugaguaggcugaagugccugcuuucuagguaggggugagcgccugaggggagagguugcuuuuuagcccuacuguugggcagauggaauuaaaugaccaaggguggcccaguguaaaucacagggcaccuuagacggucuggagaaggaagguaccagaaaccucuucugaggaauaaacuauaggagacaauaaaauauaacacaguacccaggaaguugauugcuuucuuuaugaagcagaaggggaauuaugacgcauggcuacaguuacuaauggacucugcugcagaacauuaauggaguugcuuuauucgggcucguguguugugaugcuguaaucagaacaugcuucccuguuauuccagcuugaaaugcaaauucaccaucgggcucauuucuaaucgucgcaguguuuccugcuuugggccagcaaagaagccugaugacugcauaggguuugcuuaggcaauacuuagacgcaccguguuugugacuacuacagcaaucaccauagcuacgagaugagauuuuacugucuuauuuaaauuuuaugaaucugucuguuuuuuacacuaauuuucccaauaaaguccauuaagaaccaagucuaagaagcagaagucguucuuugccuucaagaaggagcagacuugugcucuaugccccucugccaggacgguugccuagggagggaaggagggagggacagugacugugucucuaaggaggaccuuucaggcucuugccacccaggaagggucaggucccguucaguaccccagucccagcagcgugagcauggcggguuccauuccguagccucaucuccugggccuuccuacuagaaaugcccucucggaacucccuagaaagauggcuguggcccuugucaccucccuagauucuguucugccauuucagucagcucuucucuugccccuugucaaggcgccugccuuccacaggcuuucagugacugucgcugguuuguuauuggc

SEQ ID NO: 8869 - RNA, 4015 nt, Mus musculus
caaguccauauggcagugagaguuguaaaagaacugcagugguaguagaggaggagguggggaguuucuaccuggccuccuccaaagaggcucaacuuggcuuuguuuuucacugucucuguuccagaccuuggacucugagguguuuugauuuaccaucugcuccucuggugccuugugugcugucuuuucacagcugagccuguguuccuagacugaacaguggaaucucuggguagguagugccugagauuuagguuacuuuucaugcccacagggaaauggggaggggccugucucugaggucugcuccccggccaugaggcuggccgaggaguuugguuguuacaucuguugauggucaguucuccucaucacugacaaauaaguagcacaguuggugaagcgaccuucacauguggccacuucucucuuggccaguccaugccccugcugccuuguacguuaaagaguucuagaaacagaaaggagaaccugagaugcacgcaaaagguauugauuuuaauuuaauaaguauauauauauacacgucuuguaguccauauuggccuugaacuuaguauguagugagauuguccuugaucuuccuaccucugauucugauaagguuacagguauaugucacugugccuggcuuaauuuuaauuuuauauuugguugucaggaucuugcuauuaagcuuaagcuuaagcuagccuguaguuaguucaagcugaccucaaacuucugauuuuauuguuucagccuucuaugugcuggaauuauaggcaugugccucaacuaagugaacauuucuuuacuucuggauacugucucaggcuuaaauuuuuacagccaauuaaacuguaugugugacugaucaaugcugauccuguggacugaagccuguuaguuuucuagaauuuggucagauagcuccucucguggagaucucacagaaauuaaagacauuuaagcuugagacaguucucagagguuaagaauuccuacugcaucagggaccaguuccuaagcaagguauuuaaagguaaccuuggucuuacagucaguaggaaguugacuuugauuguguuugugauguaaagucuccauccugagaccuuuuugcucauggugcuuuguccuggaggacaucacugaagaagauguuucucaguucuccccucccuuguaaacaugguuccuauacagaguguagcuauugaucauaguuauuuuauuuagaugagccucauguagcccaggaugaccuauaacucauuuaauaguugaagaugaccuugagguuauugaaacuguuuuuuugauucucuuaccucuaccuuuaaagugugucacagggguugauguagugcugggaccaaacccaggucuuugaauaucuaagcaaaugcucuaccagcugagcuacaucuguagccccuguuuguuuucauuuguuugguuuugggggucuacagccaggagauaccucucuaguuuuuuaaugcaucaguuuugcgauugauaaguucuuuuauugaugauaaaagugagcucuaagcaaauuaagugggccacauaacuucuuuaaaacuacuuacauuacugggauucuggugauagugagagccaggauauaagccugcggggcuaacagagggugaccagagaaauuauuaggauuguugaaaacaucauagaggggcuggagagauggcucagugguuaagagcuccgacugcucuucugaagguccugacuucaaaucccagcagccacaugguggcucacaaccaucuguaaugagaucugacgcccucuucuggugugucugaagacagcuacaguguacuuacauauaauaauaaauaaaucuuuaaaaaaaaagaaaacaucauagagaggcaagaugcuuuugugauuaaacaucuuugguaauaggaaacaagaaaucuguagggaaggagaaagccccgcuucaucuacugucucacaucugagggcuuccuaaugugugccuuuguuuucuuuuuuuuuuuuauuggauauuuucuuuauuuacauuucuaauguuaucccuuuccugguuuccucccacucccagaagccuccuauccuauccucccucccccugcuucuaugaggguguuucucuacccacccauccacucccaccuuccccuacacugggguaucuauugagccuucauaggaccaagggccucuccuuccauuggugcaugacaaggccauccucugcuacauaugcagcuggagccauguguacgccuuuguugauagcuuagucccugggaguucugggggcaucugguugguugauauuguuguucuuccugugggguugcaguccccuucagcuccuacagucccuucuuuaacuccucuauuagguaccucgcuccuuuguuuucugcucacacagaagugucuuccgucuugccccuuccucagaagaaauaagauuugagucuuucucugaaucagaaauaguacucuggccagacugcuuuguugucugugaggaauaggacuguagacaccaguggacuguaucuggugaccuaagcaacccuugaauaccucucucuaaaagagaaagaaagggaaaaacaaagaguacaugugaaaacagucuaaaacaggcuuauuugggcauguggugcuaugcuaucuguuugcuagcuaccagauuucuuuucuguaagccuuaguauugggucuauaggaagggaauaacaccuccuccuccuguagcugugcugagaggauagauauggaaagugcugccucugguagaguguaacugcucugcugucaauuucuauaggauggagauuuucugggcucgggcuggcugguucagagccuguguggaggaggucucuugcuuuccgaucuucagccagaugugaagcagugaucguauaaagggguccuggaccucagucaaagcuuuccccugauuucucugcucauuucuggccuuugguacaggucuaggaaagcacagcuuugugcugaaguugacuauuuuucuauugaagaguuauagcugaugagcugggucuggugguacauaccuuuaaucccagcacuuggaccucugcguuuuaggccagucugguauacaaaagcuaguuccaggacagcaagggcugcacggagagaccuuaccucagucuucucuccccauuaaaaaaaaaauauuuauagcugaauugggugugauggcaaaugcuuguaaucccagcacuugggaggugcaacaggagaaucagaaguuuaaggacaucuuuauauaauaaauuugaagcuagcuugggcuacaugagacacuguuuuaucaaaccaaaacaggucugauugguuagcugaguuauuuagaaugugauucuauugaaaccaaaacaaauuauuuauaaagucuuuauaacugauacaaugggaauagauaaaaugccccgaagccauuucaccacacuaaucucaaaccaguuuauuuuacuuuuuaaaauugagcacuguaacucuagugccuaugccuuguucuuuggaaugaaucagggugaaaccucauuauucugugggaagccagucugacuugguuuaaaaaaaaaaaggaauuagagaauuuugaagaaaaugcccuuguuuuaaacuucucggcaagccucugcagucuccuucuuagcuugucuauugcucuguuucccauuacugugcuucucagucauuacagaaaccaccuccuauuucagacuuccuacaugcaguguugcacagugaacacagaccuggacaccuuccauggcacccauugcaguaaguugucgugguguuccaagccuaugaccauguauuccugucugacaacuggaauuacacucugaauuguuacucaccugugcccucuguuccugauagaccaggcaugugcugcauuaagugugccgugugcuugugucccugccggcucucuugccagagcauu

SEQ ID NO: 8870 - RNA, 1462 nt, Mus musculus
aauggccaaccacggcagaguauguacaaggaacaagggaggaaaucugaagcaugagcuagcuuucauuucugacugcaucgagcauuuuauuaaaagacaggaucuuccuaugcugcccaaguuugucuauaacccaaagcaaacaucccuuacaggcauaacuaggcauaaguaaauaugcaacuccacccuucgcuuuuaccuuagcgaaaauacugaaccucaauuucuucuuuaauaaaacagaacgaugcccaccuuacaagguuaguuuaagauagaugcgaugagccaggugaugguaguguaugccuuuaaugccagcauaaucccugcacucaggaggcagaggcaggcagaucucuggaguucaaggaaauuuucuuaauuagguuaacugauguggcaagauccacucuaaauauggacaacuacagggaucuuugugaccuccacagccagcagagugacgaucuccaggagacaaggaggcaguuugguucaacacaacucaguagccaguguugguucaaacuucuggagucagaucgaguaguuuauuuuaggcauguuuuagcacaacacaauuuggagacugagcuccacagagacagcaucgaggcaagcaagagccggacaggcacugggugacucagugccucacggaggaaaaucaacuaaacaugggcaaaggauccuaagaagccaagaggcagccaggcagugguggcacacaacucuaauuccagcacuugggaggcagaggcaggcggauuucugaguucaaggccagccuggucaacaaagugaguuccaggacagccagggcuauacagagaaaaaaaaaaaaaaaaaaggagccgagaggcaaaauguccacaugugcauucuuugugcaaaccugcugggaggagcacaagaagaggcacccggaugcuucugucaacuucucagaguucuccaagaagugcuuagagaggugaaagaccaugucugcuaaagaaaaggggaaauuugaagauauggcaaaggcugacaaggcucguuaugaaagagaaaugaaaaccuacaucccuccccaaaggggagaccaaaaagaaguucaaggaccccaaugcacccaagaggccuccuucggccuucuuguucuguucugaguacugccccaaaaucaaaggcgagcauccuggcuuauccauugaugauguugcaaagaaacuaggagagacguggaacaacacuguagcggaugacaagcagcccugugagaagaaggcugccaagcugaagaaguaugagaagaauauugcggcuacagagcuaaaggaaaaccugaugcagcgaaaaagggggguggucaaggcugaaaggagcaagaaaaagaaggaagaggaagaugaggaggaggaagaggaggaagaggaagaugaggaagaggaggaaaaggaagaugaauaag

SEQ ID NO: 8871 - RNA, 499 nt, Mus musculus
guuuuuuuuuuguuuguuuuuuuuguuuguuuuguuuuuuuuuacugcuccagucgauggaaggggacuuuauuuggucccggggucccagguaugaccccaacuuuauuugaccuucuucuuggggcgcagguuguugguauggccgcacuucuucuugcagcaguugacugcaugaggaugcaggcgugcguagcacuugcggcagaucaucuugucacaguuguacuucugggcaagcugacgaagggauggcagaugcagcaccaggugcaagguggacucuuucuggauguuguagucggacagggugcggccauccuccagcuguuugcccgugaauaucagccucugcuggucaggugggaugccuuccuugucuuggaucuuggccuugacauucucgauggugucacugggcuugaccucaagagugauggucuugcccgucagggucuucaugaagaucugcauguuggcauuugccaaucggcugccu

SEQ ID NO: 8872 - RNA, 13328 nt, Mus musculus
uaagauuuauuuauuuuauguauaugaguacauuguagaugucuucagacacaccagaagagggcaucagauucaguuacagaugguugugagccaccaugugguuacugagauuugaacucaggaccucuggaagagcaguuggugcuuuuaaccauugagccaucucuccagccccagggaaucuuuuuacuaaaauuaagauaaaagauuuuuuuugcuugauguaguugguggguaguugaaacagaguuucacucuaguucaaaccugcaacucaaugccuugauuagccucaaucaugagcaauccucuuccccacacugcugagaccuagaauucguagcuucuguuuauuauggauuaguuuacuaagcuguucaucauaaucaccuaaacuugaauacucaguuuaagcaucccaaaguauacuuuacaguucuccuccacaucaagcuuuugaaaaacauucugcugcuaaaaaacaauacagaaaacaccagaauccacauuguggcagacccuuugcaguaaaugacugugacugaacugaauaggugucugaucuggucucuugggacauauuugccuacugcuacuuuagucauuucacauacuacuagugcuuugaauaaaggcuuaauguauagacuagauuugcauaaauccauaacacagaaacugaauugcuugacucaaacuuuucgagauuacuuuaauucauuuuuagacuucucuaguuuccagaagauuacauauucaagaauucugcccuuuuuuuguuuuugauuguuuuuauuuuuauuuuuuuauuuuuuuuaaagauuuauuuauuuauuauauguaaguacacccaccguagcuguccucagacacaccagacgagggcaucagaucucauuucgggugguugugagucaccaugugguugcugggauuugaacucuggaccuucggaagagcagucgggugcucuuacccacugagccaucucaccagcccuguuuuuauuuuuuuaacaauuaaaccaugcuugcuuuucuuacuuuuugguuuuuuugagacaggauuucucuguguagcccuggcuguccuggaacucacucuguagaccaggauggccucaaacucagaaauccaccugccucugccucugccuccacagagugccaggagccaccacugcccggcacuuuuucuuucuuuuaaggguuuuuauuucuguauauuuaauguugaaggucaagcccaggccuagaacauucuaaauagacauuuuaaucacugagcuagucugaaaguauagauuuauuuccccuaugugaagggagaacacuuaucuaaacuuuuuuaaauuauugguccaguaugucauuuaauauuauguuuuggucuuaaaauacauggcauuggaauucagggguguguuuguuuguuugguuugguuuugguuuuuuguuuuuuaaucuuccugucuucaucuaccccuggaauaucuccagguuucuuuuuuaucaacacucagcauagaggaucuucaguucuucuucuuuauauugacuucauguuuagggaaguggaaaugagacagaggaaugcaguccaggucucuuagaguacuuggagacuugggcugacauggaaacagagucacagagagggugaucuguucaagcuuccaugggaauuuugaauagguagagcugagaucuccaacucaggucuucugucuccuauguaguuuucuuuuccuguuacacacagugccuccuaugggaauuagaaaacagcaguuguagagagauaacccccaaguuuucagugaaaaucuuaaauaaaauucccuaauagccaacaaugccccaguuaaucagacugagaacauguauuuaacauguuuggaaguauuuucagagcaucaggcacacuuggaaaaagaaaauaccuuauuucaugcuauuucuuauagcuuaagugagguuagugcguuucuuguuauacuuaauaggauguagaggcuaggaggugcagaccuucagucccagcacuuaggaggcacauuggcuggugggucuccgugaguuuguggccagccagaugacauucuuucucugccaugaguuuggggguaggaagaaccuuagauagaguucaaccuuuuguauuuuucugggagauaauuuuuacauaaaggucuagguugaauacuucugagaaaucacagucaucuguaaugaacuugcuuuuucuuuucuuuuucuuuuaauauaugauuuuucaggucaagagcaaucugaaucccaaugcaaaggaguuuguuccuggggugaaguacugacaugucugagcagccggccgcuuuugguggauguagcacaguuuccacacugggaaggcaguguuagaagacuccauuguaaaagcucucgucacuguguuacacuuacgcauugccaaaguuuuuguuagucuugcaugcuuaauaaaagugcugagacuguuacuaaguaaggagcugucacacaauuacugaaaguagaauuggccacguggcuuaauguaaagacagcaaugggagaagcaccagucaacugugacaaagaaccaaauuaaaucaccuccaaaucucauugaauugucugucuuugaggcuaaacuggucccuuaaggguuaguugacacguuuuaaugucuacacuuuguauaaauuuaaauuagguucugauuguuaaacagauuucucaguugcauuuguccaucaaaaauaaccucuucuggagaaaaucuguuaaauuuugaaguaaguaauuucacaagaaugucuuugagguuacaaggugauggucagauaggagcuagucuggcuuuugccugguguauuaucauguuaggaauacugaguucucccaguguuaaucuugaggaaauacaguuugaggcuugcaucuucugaagauugauugcaucaucgccaucaugugugaagucuaacacaggacccacaccagcccauaauccaacugaagcacucaaaagacgguagcaugacucuggugcucuuccuugcuuuguuaaccaucaugacuauagucugcagcacaacuuuucuuuuaacaaagcuagaacaguuuuggcuucuuaaacuucauauuugaguagguuaagcugccauacguguucagugugaauaguguuuaaguugaaaauauuguaaaaaaauuauauuuuuucaaaaauauuuaaaaaaaaauaaaugauaguagaaccgagcuggugcuuguguuauuggugcagacaacagacuccagcguuggugcucgccuagugugggcacugggcagcccugugugugaggugugcugacaggaagguguacuccaguccacaguagccaagcaggugucugucaaguguuugacuugcccuugcccaagacugcacugucagcaaucuuagccagccaugguagaaagcugugguuggucuggggauaucuguuaauggcggagcacuugcuuaguaugugcagcagcauaaauguuucuugaugugcuagagcugcaggccauguagccauuuauuguauuugagaacaguguauugcuaaauagccaaggccagcuuugaacuuaggauccuccuaccucaaguuccugggugcugggacugccuugcucuuuuguaugguuauuucuggcucauucuuucugaaaagcuuuuaagguguucauuugguuuggcuugguuuuuguccguggugcuagagguugaacuucagcuauuuucugcaugcuaaccaaccacuguucuggucaacuucauccaggaagggucuuuuguuuguuuuguuucguuuuuccaaguccagguuuuucuauguacuucucacgguccuggaacuuguucuauaguccaggcuggccuugauuauaugccucugcugggauuaugccaccaugugcugccaaaagucuuuuuacuuuuuaaaaacaguuaccuuaaacuaaugaagaagcaaguguuuucauuuucuuuuuuuauuauuagauaagugacuauugucugcagguaugucuguguaucccuuucaagccugguagccagagaggccagaacaggauaucggagccccuaggauuggaguuucagacaacugugagcugccacauaggugccgggaauugaaccaagguccucuggaagguccuguuccugguuuuugguuugguuugguuuuugaaacaaggucuccauagcacuggcuguccuggagcuuacuguguagggcgggcuggcuucacaucacagaaaucugccugccucugccucccaaguccugggauuaaaugugugccacuacaccuggccacaggcaaguuuuuuaagaaacucuagaaaagacaggcaugcuuggcacuuggggguugggagauaacacuuucaguccuuuuguucucuaacugcucaguaucaagugugcaagggguacuacucaagcuagcuucgaucucaugccugacuccuuagagcaggcauuaacaggguuaagccaccacucacaacuuucacuagaauguuucuuguuugagagggaaaauauuugaauuaacuagagccaagugucuccauuauaggcaaaacuaggauuuagagcugcccacauguuuugaagcuuaaagauaaaugauuacccccuuauaggcuuguauuagcagguuucugguaacugaacuguaagugauugaaauuuuaugacuacuaacauugaaacaaaauaacauguagaaggaucucuccuguuuauggcacugcugguguuuccaaccuuuccagucucaaagauauuacuuagguaugguaaugguaauacacaccuauaauuccuucguuugaagggcuggagagauggcucaguagauaagagcacuuguugcucuggcaaagggcucggguuugguuuucuaauacccacauggugguucacagccauccagaggauccugugcuuuccugugaccucugugggcaccagacaagcacaugaugugcacuaauguacauagaauacauacuuuuuaguuccuucacuuugagagagucuaugaauagaaggaucaugaauuggcgaagggugagcugauugugcuaaugccaguacuugagaagcaugcaugcaugcauacacagagagaucaggcuggcagugacugcucuuagacucuaguuggucuagauguugccuguaucugguaggauugauaaucccgcuuacuugugaccaucuauggcucucacuguaacauggcuaagaaauucuacccagauccaaaggacuuuuuacccugccuaaucuccccuugaagaaacuuguaaccgauuacaaaaaugcuaguuugauuuuuuuuuuuucuuuuuguuuaaacagauguuugauuauucaaccucccacaagaaccauaucauguccuaccuuucauugagguggcuucagaccuugguacacacagacccaguuucuauauugucuggagugucuucuagaacuggaggcugauuuugugucuuuuuagaaaauccucugaagacugggcagauggggauguaucugaaaaaggugguccuuuuuaccaugcccaucccaaaggggaaaucguagcucuugagacuggcugacgucucacuguuggcgugggcuccagccuuccacuguaucaggccucuuuccucugggcucccugcaagaggacagugaggucaucuaggaggauaaaacccuguuaucuuuccugcacauagccaguccuaaggcauguuucuagaaucaaguaugaauuugccuagucagaauggagcccagggcaguuuugccugcuagauaagcacucuaccacucugcaugccuuacuugccagagcucugagaaaccuuaaaagauuaauacuacuuaacuguagcaucaaguccugugcuaaauaauuucauuauuucugaacaccccugggaggugcauaggcacaaaauuuuaaggugaagaaacaagcuaagucauuuuacacugucugucugaauauggggcuagugugugguugcuucaugggaccuagauagugcccaggcuguaccucugaauaggguacguuuuuaaauuuuuuuuaucacauuuauuguuuauguagaauuuauggaaccaugagagugaggaggucuuaggauaagcacaggaaguagguucucuugcuccaucauaugggcccugggcauugaacuccgaccagguucagcaaguaccuuuuccugccgaguuauccgaccugccugaggacauagaccuugaaauacuuuaucaguguuaggauucauuauuacaguucuaaauuuggggcauaaaccauuuuuauagcauggaugaaagccaggcuaagcaagagaucuuuggugggguagggauguaccucuggagaggagucccagagauuguggguuuucagaagugcuggagcugacaaagacagaaaucauucaccuagcgggagggcagccagagcuaagaguagcccagauugcugcagcucaaugagacacaagcucucauggaggaaggcaagaaacaucagaagaggcugccuggagauguuggaacaggaccaggaaucagguggccagaguagaaagggaaaagagcuauuggcauguggucaacacuucugcacauccuccucaaugugguucagggccaagcuggucaauuccaccagcuugucccaaacugcauuugacucuucucugaggugugaggcagguguaaugucaacacugagcagauaaagacaagagaaugagagguucaaaccagucugaacuugccaugucgugguuaauggcuguucuuuucauugaguuuugcccacccaguuuccccaaacccaucugcagaggcauuguaguaugauggcuaggauacaugcuauuucagauuggcaguuaaauguuacuuuacgacuuugugggucacuuuuuuguuacuuuguuucaccaugggauuaagucuagcaccucggaacugggcaacaacuuugcuugucagguuuaaggaugauaugagacacucuucuacugacucagaucugauggcuaucaagguuuuguuuguuuguuuguuuguuuguuuguuuguuuguuuguuuuuaaagauuuauucauuauuauaucuaaguacacuguagcugucuucagaugcaccagaagagggugucagaucucauuacgggugcuugugagccacuaugugguugcugggauuugaacucgggaccuuuagaagagcagucaguguucuuaaccgccaagccaucucuccaguccuggauaucaguuuuuaaaauauauauacugagcauaugcauacuggacugucacauuuccacaauccuugcaaaaaaacaaaaccugggcauccaagguucauuugggaggcucuucuauuugugcagcaggcugcucccauucuugauagauuucucccacaaaccaaugcugcauuuuuaccuauccagcucugugaagauaaagguauucucagccugguggugcuaaagaguuggugaggcuaggacuccuaaaaccagagcgcucucuugaccucacccuuuucaagaccuaggagauagguugugugccucagucucccccaccagccagcggacacuccagcagcccauuucuacugcacucuggccugcacggcaucaggccuggccacaucucaggaaccaaaccaucaugagcauauacauuaaugauaguauagccuggcucucugcuucccucccagagcugaccacugcaguaccuggcacuguguuguccaguaugaaagcaaggcacccgccaacaaacaucucuguggucagcagcacaguuaggaucugauccacuucaggaaugccuguggaauaagucaggggccaaugggcuaguggccuauacuggaaggcaaagcucaagggacuuccuaccugugugguccccugacuucuuacaaacugucauggcucuggaauauuccaaagccugaccuucaagccugucuguaccucugucucucccaucuuuggggagaaacuucugacagcuguuaguuguugacuuaagacaagucacuuagccucugugaacucauguccucuggaaaacagaggucauaauagaaucucgugggacuguuaggaaaauuaaaugagcauauuaaaaacucaauagguagguucuugcuuauaaucucagccucacugagggugcuagggaagugcugucgcugguuuccaacccacauucccucaucucuggagauaguagagaauaaaagguaccuguguugauagcaccuggguuggaauccagguaguuggguagugugaggccaaagaacauggagaaucccaauacaaagagguugcgagaagaguucauguccacaaacugcagauuggacagucccacagcagugaucauaccugccacagcagaacugcuagaggcucggccuggcuagaccagguccugccacacccccuggggaggcaucagacacucaccaaaaagagugcagaacauuccucccaggauggggucuggcagugaggcaaagagagcugugaauuugccaauggcacccaggauuagcaugauaccugcaccguacugcacgacucuucggcugcccaccugcaggaagccaaggacuggguaggcccagaggcagggcuaguuccagggggcaggguauuaggugaauaaauggacuccagcaguaggaggggguaggauaaaggugggaugcucucaaagacgggauggggcuaggccaaagccaagauggcuuagaacagggcccguaacacaugaacaggaguacacugcucuggcaaguggcuuguggcaccuugguaaucccuaggaccccaauguugggacuggaugagguggacccguugccugugcccaguagcccagcgauaaugcagcagaugccuucagugaaaauuccccuguaaagaaauggugagugggguguuggccccuccucuucaccagucuaucaucaccuucguccaucugcuacauaccccccugaagcuguacagacagacugguaccaucuagagccuggaagccaggugucaggaccggcacuuagugcuccacugcuuacucccuggggcaauucugagcuuuaguucccccucuguaccaugaagaugaugaggggcccgaccucacagaauggcuagccauugaaugcaaguuugcacgaauaguuacacagauaguugucaguaacugguuuccuugggacuggcauccuccacgguucccagcauuuacagaacaaguaaucuccauuccaggcuccagggaaaugaggugagggugacuuucaugccuaagccuccuaagugugggacccagcccuguccacacacuugcugucagaguagcuagcuccuugggaucagacauugaggugggcauaccuguugauggcauguacuggaggggguggugcuccagccaaccgggcacaggcauaguaaucaccgauggacucaaugaugcccgccaguguggcacugaacauccccagaacugcagccacagucacuguggguaggccccacugaccuguuggagggaacaugacagguucuggaggaggcuguaauggcuugggaauagauggggucauuugaagggguggggugcugcuggagggauggcucagcaguugagaacacuggugguguuuccauaugauccugacuucaauucccagcaaccauaugcuggcucauggccaucuauaaaggaaccugaugcccucuucuggcauggagguguacaugcagacagagaacucuuacauuuaaaaaaaaagaauauauaaauaaaauuuacaaagaaaagaaagggagaggagcugguggggagucucacugauacaccaguccaggauaagauuuagacguaaacccaccacucaggggcauccacaaacagggcuaaugcgauggauguugucagcugaacccagagucaucagaagucucauaggaauuucaguuggaagcagaagggaccaagcagacuugcuuacauggauaggggauucggauccagggagagauagccaugauguccccucgggcaucaguucgagccuggaagccauagacuguggggucugcgggcagcacaucugucagggucaacacguagcagagcagccacacggucaugauggccagcacaaucuggaguagguggggugauggggugacagggcacugcaggcacuggagaccuuggugcagacuggccugcuucugcgucagccccagagcccuggcugacuccuagcuucuggugggaacaccccccuuccccccccccccccccgcccuugcccugacucaggucucgcccuuuuucgcagcaccugcgagcuccucaccggaaacaucuuaaagaucuggacucggaagagagugagacccuugccccaucgguaaacagguaacaggaaggugagguugcgcagauacugggagaacaagacuaucaggagaauggagcuggaggcagagacacaagaagaaaauagcuggugggccagguuggggcccagaaacagaugagaggauaagaaugaaggggaugugggguagcgccuaggacugggcaaaaauaguccuguugccugcucaccaagccgaaauaccccaaugagagccagcucggucaccagcagcuuggaaaacagagagcccaauaagggagacagugggggugacggugagaggcccaauguagcugagcagggccccaggcagccccaucagcccaaucaccaccuccaccauacuggacaccaugauugcacccuggaccuaaaaaggcaaaaugagcuauagucacuuugaccuggcauuaucaauauguaaguuccucagccaccuccuugcauacagcuuagcaguggccugcccacccagcccuuccuucaaacccaaucucuucacccaccucccggauacgaggaugccagauaugggagguguugagaggcauacuccaguuaccguagaucucuucugcagacagauggagagaacacacugccaugaacaaacacacccuggugccuagacucugggaagcugcccagaccuucacgaccucuccaccagugcagaugggcaaacugaacccaccuucugaaggacacuuccaccucuccaaggccaggauugacuuggcuggaaccagaaaggcaaaggcacuggccuggaacaacggcagccuggaaggcggggcacauagcagugguggaguggguugaggaaaagggauaaagggaagucccuaagaccccacauggagucccgcccccacauuuucagggauccuccaguucaaacccugcaucuugccuucagcucccccaccucagugccaagaagagacaugugcuccaaagcagacugcuccauuucugaaucugagggcugccugcgauuguucccagcuaccaccacugaacccaacagacuuguucauccaagacuaggaauccccaagucuacauauggaugcugaaaaggccugcucacaggaauggacagugggcaaggaagcaguccuucuaaaccuuuggagcagagugagaggagggaaccgcagggcuccuaggaacccagcuaccuagcccucgggcuaggcaggcagacagggcagccagacaggguagaagccagcuggucacagcccaccuguucugccguaugcucgcaugcgaguaugugugcuugggagccggggaggagccgcucaccggaugcccacuguagucuggaugagaguggugauacccacacaggugaagaugguaccaaugagcugacugaccaugugcuggucacggcccacacacagcgccucagccaggaggaagggcacggcgauggugccacugaagcacgucagguaaugcuggggugagagacggucgagaggugaccccauagcacucucauggccaugggcacccgggucuguguccugaaccuggaccauacugacagggugcuuacuugaaaugacauuacccaccacacccgacaagggauucccagagaacuacugcucacccaccacucggggcccagucucccccagguuagcccuaccuaccguuccugucuaucauaugcuacccacaauccucccaggccacuuaaccuucuuuggcacagcuguuuggugacagugacugugcugaccuugucucuuucucuagccugaaaugaccuuccugaucagagguggcucgggaucccgggggaguagcucauguagagcuggggaggucuugugaaaacccaccuggaagcccagcaggaugcacagguaccaugguggcacauccucaaucuuguacaacaugucaaacuugggcuccgugggcaaaggugccugccggucccugguggaagucccugcugaauccacgaccucaugcugcucagggaaguagggagccacggccgcucaaggcagagcgaugaaccaaccggcaaagcccgcgcugccuagacuaagggagcuacagccgucucccagcaacucagugagggcaggaugcggcagcagcuacccuccccagcugguucccagugguccuucccacuucccacgcccugcuguggggaugaaagcaguguccuggcuuccagagcccuuaagggcuuucuagugaggccccuaagucaagagacugggaagguaucagaccagagugggaucagacugggcaggucuagacuguggagaagcccccuccugucccaccucuaucuccuagagguucuugaaggugccacaaggugagaagaaggcccagccccuaacugaccuccaagcccaagucagccaggcccuaaaccuaagguucccucaccccuucccuccaccccguuccccgagugccacucgaggcucaagacugucacuuuuugucauuuggcaauguugucucugccuucccagaaagaucaguccagccccagccccagcccccacccgccgugccccucgcccaggucacagcuucgcuaugcccccagcaccugcuuugggcucccgggguccuccggaguuuucaucucugaggcacaaguuugagaaaccucugaggagaaaagaagagggcuuucccaaggccaaggaggacuuuacuccacucaucagacauuguucgaagucaaucugua

SEQ ID NO: 8873 - RNA, 5507 nt, Mus musculus
cggcgacggaugaggcgcgcagcaggaggccauuuccaacgagccagcgggggcaaaagauggcgacgccccuuggguggucgcaggggggcucuggaucagugugucucgccuucgaucaacugcgggacgugauugaaucucaggaggaacuuauccaccagcugaggaaugugguaggcagccagggcuuggggaaaggccgcgcuggacgccucaccggugggggcagggccaggcgcucguggauguaggggccguggcuaguauacaccgugaagggggucaucccagaggcugggcucaccuagccaggggcagaaccaagaagacggcugcuuuccugaacguuaccaaaucgggcaauauuccccacucugccugguuggugaagggacugacagauaaccagugaacuucagugucuccacguuuagcgguagagaccucaccgacuccccaaggcaaccugcgcaccgaaaccagaucauuccuuaagccgcacaccuuuccagugucaaaagcagugcgaauacaagcuuggccuuucacggugcagauuuaagggccuccaaacuuuccugugccuuuguuucuaaccucaguuaguuagugggugccacgcuaauggcgucauaguuacaucagugccggguccgcuggaggucaugggcuuugugguuguuguuucucuuuugguaacaauguuggaaugcaucucucucucucaaaacaaacaaaaacaaaacaaaacaaaaaauugguuucacaucuauuuuccacucuaaugauuuuuagacagugucaucccuucugagcaguuagauucgagggggauuauuacuauaugucaacaaaguguaugccaacaugggcgcugaauugccuucaagucccagaggauccccagaucuuucucuuggcagcucacuccuacuaucuggaacgguuuuuuucucucuccucauccuauuuagcaguccgaucucaggauuaauguuauuuucucagagagcaguccugauccuuacuaaugcugggcccaggggucccucuguguaccacagcccccuuuguccuuuugccuaggacauacaguguaaagagaggacugguuuuguguagucuccaugaggcuaguuggucuuuguaggcagcacuuugagccaggccucaguagaucugugagacuaaauucuccuguccuaaggccugucaggaccugugugccuuugacauggcuccauuacccauccuuuauucugguccuuagagggcgucccccucccaccccagccccugucccuuccugagccaggcucuguugcagaugguucuccaggaugagaauuuugucaguaaagaagaauuccaugaaauagagaagaaacugguggugaguagccuccucugcucacuccucccacuucccgaguucccuguggcugggcagaauccuugagucuuggccuuucagaacuucagcccuccuagcgaggcugcaucuuccugcauccuagcugcagcaugcaccucugaaaaggggguuaguuaagagauccuaagagacccaggguggcuugggauaaagcgagccaucaccucccuggcaggaggagaaagcugcucaugccaaaaccaaagcccuccuggccaaggaagaagagaaguuacaguuugcucugggagagguggaggugcuguccaagcagcuggagaaagagaagauggccuuugaaaaagcgugagagagugggccucaggagggggcuuggagcuuggggggcucaccugccugcugccugcccacccuuucggucuaacuuuccccuaggcucuccagugucaagagcagaguccugcaggaguccagcaagaaggaccagcucaucaccaagugcaaugguaggcgggaggcccgugcugccccccaaguuaacauacacgggcucuuuaccaacagcccaaugacggugccaaaagcagggcucuaccccaacuucugcccccggcugaggauacaggcaaguccaguccuucgaaagugccuucagggaccaggcaggucacggaaaugauggacaugaucagaucagcgugcgguauucuucacagccauaaaggaacgggcucgcucccauuuuucuugaaacauacaaccuucuuaguccaccuuuuguuuuaucccauuuuugauaaguguuagaaauaguauauucuauuuguaaccuugcuucaagaggagccguagagcaaacacaauccuacaaggggucuuaagacucagaaucaaaggacucucucggguucgagacugggguuaccagagccaugccccuccucugggaauagagccuaggauugucagaucuuuuuuuuuuuuuuuuuaaagauuuauuuauuuauuauauguaaguacacuguagcugucuucagacacuccagaagagggagucagaucucguuacggaugguugugagccaccaugugguugcugggauuugaacuccggaccuucggaagaauagucgggugcucuuacccacugagccaucucaccagccccgucagaucuuuaaaaaaaaaaaaaauaauaaucuagaggccagauguuguggcacaugcuuuuaauuccagcauucaggagauagaggcagaaagauugggaguuugaggccauugugggcuguguaagaccuugucucaaaagcaaaacaaaacaaaagaaucuagaagucaauuuuaauggaaacuucugaauuguuaguguaggcaacuaacuuaggcaguuuaaaagcaguguauucacugagugaacuaugucugggccacugaauuucaacucugcuaaaggcaugcucauggcagaguugaaaccaaccugagcccaagagagugacgaucccuccucauaaggcucccacuuggggcucugggcagcuuucacccacccacagccuucugucacuccuggugaacauucccugagaauugccaucaggcuagucucuugaugagggcaagcaggcugacaggcaucauggcuguuugagcaaggcuuccugaagccuaaucgguagucgcugucucauacccagugucccuacaccucucgguccuaucugccuuugcacuuccccucucuggaaaacccagagaacuggaguuauauccugguauagccagagacaccuuaccuuaggguaucuccuucuaccagaaucagcccaggcuggugagaagccgggucugaaaaggcagcuagcccagcuugcuaacacugccgcaacgcgagccuuccuccagugcagccuuauccuuccuucucugaucauuuccucuucugucugucuuuuguuuuuauuuuccucucuucuugcuuuggugcaggaaaucaaauucaagacccucacuaggcaagaguuuuaguaacaagccacaucaucagccuucaacucuucagcauuuauuuauuuauuuguucacucacucauuccuuccuucauuuacucauucugcugagaugggggucucagguagcccagacuguccuuaacuugguaaggugaccuuggacuucccauacucuucccagugcugggauuaguagcaugugccuccacucucaguucaguuuaaguuuuguuuuuaagguuuaugagugugacuguuuugcuugcauauauguguguccaccaugugugugccuagagccuguggagaugagaagagggugccagauccccaggagcuagaguuagcauguuuacaaacuaccauaggauacugggaaccaauucaggguucccuggaagagcagugugagccgucuuaacugcugagccaucuguccagccucuaguuccugaguccgacuccuccuuuugaaaaguuaggcacaugucuggcauaaucaaggaccucccaccagaggcccuguauaacacaagccugggcauccgucugcucuugauaggucuggcuuaaccgaaauggccaaacuugcuuuuuuguuuuguuuuucaaacuugguacuuugaagcccaaagcucuuagggacaucuuguucacaguauacagaucuaugagcuaggcucuguuagguguaaagguuaacagugacaaaggcaauagucccugaccccguggaccuuauguccuaauuguagaaaaggccaacaauugauggaugagacacuuuggacauuggcacaaggaaaacagggacaggagaugggaauagaacauacugggaagggcugcaguuucuagaccaagggucuaaccauggaaguguaaaguccugagggccagccagagcuaugacaggguucucugcuucucuccagggaguuuugcccacccucaccugggugagguucauaauacagugguaaaguuacugacagaaucguuuucccuacucaggagacccccaaacauuugcugauguggcagggucuuguggugaacaccaaagccuagcuacucaggaagcugagguaacagaaccaaaaauuuaaggccugacaguauuacagagugaguuuaaggcuaguccggucaacuuaaugagccucuguuucaaaaccaagcagaaaguggagaugggugugguggugguguugggaggaggcugaggcagguggaucucuuacaguuggggccagccuguucuacauggcgagauccagaacagccagagcuaguauaauagacccugucucaaaaagaaagagagaaaggaaggaaggaaggaagaaagaagaaagaggguugaguauggguugggagguggcaugguagcacaccuuuaauccuaguacuugggaggcagagacaggaguuaucucugaguucaaggccagcauggucuacauagugaguucuaggacagccagggcuauauagaagaucccccccccccccccuggagcuccgugguggagcucuuacugaucaugcaugaggccuuggguucagucuccaauacagaaagccaggcuccuucauacuaagguacaggcauccguugaagaagaacucgugggcagggagagccagacaaaggaagaccucaacucagaagccugagggugggaaccaccccuccucccugccucucucccccacagaaauugaaucccacauuauaaagcaagaagauauacuuaauggcaaagagaaugagauuaaagaguugcagcagguuaucagccagcagaaacagaauuucaggugaggggcugggccaggcuggggguuguugauggaagccgggagccugacuccuggccccuacguagggcugugcagccuacgaccagcuggcuccauugcaggaaucacauaucugacuuccggauccaaaagcagcaggagaccuacauggcccaggugcuggaucagaagcguaagaaagccacaggaaugcgucgggcccguagccgucaguguuccagggagaaauaaacugcugguuaucuuccuguucucuagcuguaau

SEQ ID NO: 8874 - RNA, 6879 nt, Mus musculus
cugaaacuauuaaauuccuugcucagauuucaggaaguaaagugugcuguucaucucaaucucuccugucuaaccccuccccucccgauuuccgggggaucaaugauaguagagagcuuuggggccucuggaaauccuguggggcccugucacuuuugguccuuguauggaguccugcuagguguccacuggaguguguuacaucucgggaccuuuagaggaauucggagugcggggcuguggcugcuggugagugacuuuuugaacaccuucaguuuggggguuaggaaagaggaacagaggagggcgaucugaagcuucaccucccccacccuccccugcuauacucagaccugguuuauggaggcugguaggaaggggggggggugcuuuggcaggaaacaccaaaaagaauaaagagcuggccagauggcuagcuuccucccagagcacugaaaacugugcucuggcaagggccagggcugugguuuuacugaggaagcgagcugaguugcaguuguuuuuaacauuucguuuucagucuccccauucagaagccacuugcuaguagcuacugaaaggcucuucauugucucuucugcuccaggaacaccggucuaggaagcagaagguaggauuagaaauggggcaguauucuccugguacuucguggugggagaaacccugggcuggcagaacacucuaaggucuaggucuuggaucaguuucuuccuucuuucucacaccagugagcucaguggggcucacauguacacgcucuguuuacuaugaaccucuccuagacaggugcuguaggaugcuaugugcccagggcgucuccuugagguguauccaagaguagcccaugggacuagcugggcugggagacccaaggagauggaugacuagucaggaccuuaggcccugaaggacaggagaaccccagaagcauagcuguggauuucuugaugucuacagaugccauacuccaaccugcauccagccaucccacggcccagaggucaccgcuccaaauauguagcccucaucuuucugguggccagccugaugauccuuuggguggcaaaggauccaccaaaucacacucugaaguaccuagcacuucaccuagccucgcacgaacuuggacuacuguugaaaaaccucugcugucuggcugaagagcugugccauguccaguccagguaacccucuguggucuccacgaugacuugauacccagcaaguaucacacccuugacuccuaaccuuggccuucccugaacaucaucagcugaguugggcugggaucugaggcuaggcuguccccugcagguaccagggcagcuacuggaaggcugugcgcgccugccugggaugccccauccacuguauggcuaugauucuacuaucgucuuauuucuauuuccuccaaaacacugcugacauauaccucaguuggauguuuggccuucugguccucuauaagucccuaagcaugcuccugggccuucagguaugaagcagaagagguggguggugugggaagaggggacuauggcuagugcuggugugccugagcucagugcugagacucagacuaauuuaaagguuggagaccuggguguggagcuaugaaggcuugggaugauggguuuaauagcagugcugagagcaagcuggcagcagguugggaaaguuuucugcaagagaagggcuuuggacaucccccuugaaagucccucaggcccuucugcugucuucagagcuugacuccagcggaagucucugcagucugugaagaaaagaaguuaaauguugcccacgggcuggccuggucauacuacauuggguacuugcgguugaucuuaccagguagggcaccucuggauguugauguguggacaacaaaacacacagcuuugccguacuuauuuugcuaugcuuuucaaaguauuuccaugucugccauacaguuaaauuccuaaagcauuccugucugugugaagggugugaucuuugaggcaggagcccaggguacauaaaaucacccuauuuauuugagggugaccuugaauuucuuuuuuuuucuuuuuaaagacuuuauuuauauggauacacuguagcugucuucaugcacaccagaagagagcauuagaucccacuacagaugguugugagccaccaugugguugcugggaauugaacguaggaccucuggaagagcagucagugcucuuaaccacugagccaucucuccagccccugaccuugaauuucugauccuuuuucaucugccuuccagguccugggauuacaggugugagccaccacacuugucuuacuauuacuguuaucuuuguaauuaauucauuuguugucuugaggacugacucugggacuuaaacagacucaguaagcagccugcuaccugagcugccuuaccagcucgaggacagcacuacuacacuugguuuacauaaguaaggccaccgguguuaagagcuggucaucuuugcccaagauucaacuaugagugcuugccuuugucuccucucccuucacaguuuuuagugugugugcgcaugugcguguguaugugugcgugugugugagugugggucugucacagagucaguucucuccuucccccuuuuugaggcagggucucucuuuuuucugcugcugcauagcccguuccccugucauugccucccaccucuggauuagaaugcuaggaucacgacgcacuccacugccuucguucauaugguugcucuggggaucaaguucacagggucagcuuuuauuugcugacccaucuccccagccuguuuucccucacuuuuugaaagauguaucuaguuguugcaacagauaucugugaaugugccccugugugaauuguguguguuggucccuaaacuccuaacuucccccugccuuggucuucuaaaagcuaggauuacagguguaugucacugcgcuucuccugugauuccuauuccaucucuuucuuuugucuuuugaaacacgaacucaauagggaacccuggccggccuggaacucaucuguaaaccaggcuggccuugaauuugugguccuucugacuggaauuggagaaugugccaucacaccugguuuuucaugaauacuucuuuaaaacaacuuugcuucuauagguaucucgcaugcaugucugucugugcaccaugugaguuaucagugccugcagaggccagaaaaaggcuuuggauccccuggaacuagaguaauagaugauuagccaccaugaacccagguccucuagaaaagcagcaggugcucuuuaccgcugagccaucucuccagcccccagacccccacagggucucaauauguaacccaagcuaaccuagaacucucuauggagaucaggcuggccucaaacucaagagaaccacuuguuucugccucucaagugcugggacuaaaagcaugugccaccaaagauuuauuuuuuuccuuauguguaugcaugcaugucugucugucugucugucuguagaugugugcaccugaguccaggugagcacggaagccagacgaggaugucagauccccuggggcugaagcuggugguuguaagccauccaauauugcuucugggaacugaacuugguuccucuggaagagcagcagaugcuccuacccacugugcuaucugccuagcccccauuauucauugguuagauaagaacacuguggcuuugagagaaaagugaccuaacuggucaugaguaagagaggagauagauuuggaguccagggcugcccagagccagcacaguuggccacucugcuggggaacucaugcggcagcuccuugacuuucaaucccaggcuaugacucuccugaaucucuuggaugccaggaaggcuuuagagccagacgucuaucauacaaugaugacacugucuaucauacaaugaggagaaugccacuagccagggaucugccaaucucucagaacccagacuacugugguaguggugguagggacugacacagacauucaguguccaggaaugguggcacaacccuuugauuccaucaguuggguggcagaggaaagcagaccuucacauguucaugcucugcuuugucuaauagagggaauuccaggacagccugggcuacaccuacacacacacacacacacacacacacacacacacacacacacacacacgggaaaacagaauaagggguggaaaggggagaucccugaauauucucuucuucccccaaaucuccuuccuguacgaugagagagauuagacacccccccccaauucucuugugcucacacugagaaggcuaacgagcugagugucaguucuagauugagugggagacaaaguaaugagaugauuucuugggcuucccuacugcagggcuccaggcccggauccgaauguucaaucagcuacauaacaacaugcucaguggugcagggagccgaagacuguacauccucuuuccauuggacuguggggugccugacaaccugaguguaguugaccccaacauucgauuccgagauaugcugccccagcaaaacaucgaccgugcuggcaucaagaaucggguuuauuccaacagcgucuacgagauucuggagaacggacagccaguaaguauacagagcucaguuuggggaaaagguccagcucccaagaacucugaaucccuagccacaggcugacaagaauucaugucuucucuaagccugucugcauggccagucccaggacaaggcaagauucaguuccaaacgacacugaggaguaacauuuauggagcagaagcuauuccguguauaccauaaggccacuucauuaaaccuuaccaccaaucugugagacaggcgugaucccuguucuaugguggagaagagugaggcucggggacgcgauagugaaggcuaugagagcauugagggauuugguguggguguugaagagccccaagcaaagcaaaauccuagaaccuucccaagacuccauuuccagucaugaugccacgcuccaggaccaugggagaaggaucugugaaguguuuagcccagcccaggccuaaaguuaggaagcgggcaucagaggcccuagcagggcaguuacaucccagggcuuuuguucugcagacugaggggguagggccacugcccauggcaccaccuaucaggcuguggcucagucuaaccuuguucucaccuccaucaggcaggcgucuguauccuggaguacgccacccccuugcagacccuguuugccaugucacaggaugccaaagcuggcuucagucgggaggaucggcuugagcaggcuaaacucuucugccggacacuugaggaaauccuggaagauguccccgagucucgaaauaacugccgccucauugucuaccaagguaagaagagacugauacagcuggagggcaggaaucaggaauagcagcaucucacagaggugccagagaacacggaagcagccuuuucugggcuuuccuaaguggucagagggauuauacccugcccuuuccuccacuggaagacgccucuugucacccgaauguggccaaccuugacucuaaugugccuugguugugugaccucaggcaggucuuugcccuuuucugaacaucaucucuaaagcaggagggugggcuuccaugacuuugauaacuauuucuuuaucugggauucccucagaggcuguguguuagguggcaagaggggaaggaggcuggaggaucaucccagcagcucccaagggugccugcaucuugcugaccaccccccaucucuauuccagaacccacagacggaaacaguuucucacugucucaggaggugcuccggcacauucgucaggaagaaaaggaggagguuaccaugaaugcccccaugaccucaguggcaccuccucccuccguacugucccaagagccaagacuccucaucagugguauggaucagccucucccacuccgcacugaccucaucugaggcaugggacagccuugucugggcucuagugauccuuuagccuccugacugagccuuccuucaaugguugggggccucagagacuucacaucuccagaugagucccacauuccugggcaagccauuuauuucaccucucugagccucaaccaacccuacuaugaaaggaggucauaaugcguucccugcccagccaaaggauuuuauauauguagaaguuggugucaaugccugguaaacuugagagaaaggccaaguacuucccguggaugcugcagacauucccugcucucuguugaccuguguggaugguaccagcagacuuccaacccuccagcuucuggucacguguguucaaugggagcuuaaguagauggcgagagggagaaggaacauuuguucuguuagcuguauacaaucacagugggcuggccugucaacugccuucuuaauaaacauaucuauucucagauuucuagaauggccucuuccccuugucucuagcacugguauuugugugacacuggaguacuuucugucuggucucuuuauaucaugucccuugcacaugguguuggcaucaggacgucccaaacucaugacaucacauaggcgacagcaugaccugcaaccugcagaccgguugccaagacaacaggcaccauauucccaccuuccacuuggcucaccucccaccuuuaccuguguuacgucaucuuccauaucuuccauacgucuuccaucuuccauacgucucucuccccugcuucucuuucugcugcuaccuugucucucccuuccaauaaaaccucuuccaugcggaacugc

SEQ ID NO: 8875 - RNA, 1571 nt, Mus musculus
auuuuucgggaccacuuggcaaacacuguguuaagcaauuaaacguacuucgaaaguacuuaaaccuuacaggaccauuuugcugaugagcaagcagaggcacagaaaggcugggacccuaagucagauaggcaggccuaggcucugacuccagaacuggccuuuuuaguuacaggaggucucuucuuggcagggccuguggaguuguggaccaaauauaggucgauuccccagggcauccguuaagugcggagagccccucggcaagagcggcacauguucccuagcuugguuauaggcacguguuacauggcgcagucccgcgugccaaagcggggagugggcggcgggggggugggaggggacagcauagcugagcgcacuggcgcccaggugcgacauucccgguugggacgcggcagagcccuguggaggggccugagcuguaggcagggcggagcgggggcggagagcucggagcugaguccacgcgggccacggcgccugggaggccgcaaucccggcgccugcagccggcgaggcgcggggugacgcgcgggggcccagcuaccgugaccuccuccgcgguugccauggugaccgugcacuauaaauaaaaaaaaaaaaaaaaagaggaggaauuucaaacccguuuucuacggagcuuggcgggaggggugggggaggucucuuugaaucgaguuucccauuucaccuucccaggcggcaggagcgcuucccccgcagcccagccgggaaauugccgccccucacgccgcguggcgcccccggaggaagcuaauuagcgcagcccggggagcuggagacaggggaccuagccccuuggggggggagcagggcccgccuuuuguggggaggggaaagcgccuacaaauugccccccuuccaucucucuaaggcgcgcgcucagcccagcgcggaccggggcacagggcgcaggcgggaggucgcaucugcagcuuuggcgcaaugaaucaggcacggccgccgccgccgagcgcgucuggcauccggagucucccgggaucgaaaauaauuugggcaaagcggugggaggugugugcgcgcgcguuccgaggggagggcggggaagcaggccgggcggggugugcggggcggggggaggugccauccgacagccccgcuguggugagaacggaguugacacuucuuuccuuuccacuuacugcggcaaguaccgugaggaagcuuaacccugucgcugcuuggagcacgagacgcacuguaagcgcccuccugagagcggugagggcuagggucaggugugcagagcccuuuggcaugggucacuguggccugcuaggucucagccucuccccgcuggcgcucccaccuggacauuccucaacgcuuaauuauuccuuucccagauccggcuagugucaacacccgcgaccucaguuuccccacuuuuccaagucagugguuuggagggggcagcuuucuugucaggaaccuucauuugaggacacucugccuugggcuuuugguaguuuagaaacugcaaucagaaccaacuuugccagucu

SEQ ID NO: 8876 - RNA, 179514 nt, Mus musculus
gaugcggcagguuugcugcucagcgcugccgccgccacuggagaaggcucggugcagcagcuacagcuacaguuacagcgacagcagcagcagcaccaccagcagcagcagaagcagcagcagcagcagcagcagaaacagcagcagcagcaacagcagcagcagcgagagcagcggcagcaacagcggcagcagcagcaucuuccgucccgcugcgcccccagagccgcggccgcagccacagccgcagccccgcagccccgcagcccggagagccgccgcccgcucgcgagccgcagccgccggcggcaugaggcgcgacccggcccccggcuucucgaugcugcucuucggugugucacucgccugcuacucgcccagccucaagucggugcaggaccaggcguacaaggcacccguggugguggagggcaagguacagggacuggccccggcaggcgguuccagcucuaacagcacccgagagccgcccgccucgggucggguggcgcuggugaaggugcuggacaaguggccgcuccggagcggggggcugcagcgcgagcaggugaucagcgugggcuccugugcgccgcucgaaaggaaccagcgcuacaucuuuuuccuggagcccaccgagcagcccuuaguuuuuaagacagccuuugccccggucgacccuaacggcaaaaacaucaagaaagaggugggcaagauccugugcacugacugcggugagucgcccccuccuucugcuggagaaaggggggggggggagguggugaaggauggggguggggcggagaggugccgcaggugcccaggccuggcagugcacggccgccgggggguggggccgccccugaacagggagccggucgcgggugggugagggugugggcuugguaagaacgagaaccaggcucaaagugugugcuaggggcgagagcugguggggaggcgcuggccugugccaacagagaucugcggcugauguauggcauguggggcuggaaagcugccaucauagcccaguagcggaagggaagacggugagguccgggaggcgcuggccugaggcucagugagucaggagugacccucggaggccucgcccgcucagcucccgggggccugccuugcccaggcuggcagggucuacaggagcagcugggcagacucccaggcugugaaggccuccgcuuacaaguucuccuagggaaugaucgcccccgcccccccccccuccucucccagcuccguugcucugcucauccacaccgcuggcgcaggcagaguuggacuuuuugugcuguuucccguucuccauguggcucugggcuguuuuuuccucccuugugcuucacaugucuuuguaaagcgaguagcucagcauucccuccuuaacacccagagcuagugagcagacacucuuuuagcaguuugugaaguaucucaccuggucuugguggugaugguggugguggugguggugguggugagaguaacuugcuuuugcugaauguuugaaguucaucucuaacaucaucccggcgggaugcguuggcugcaccugcauguaucuucacaauguuggguacugcacaggaauguaggagauaguaaacgaggcuugugugucuguacagagugaaggucucucauacgaaaguuaaagaaaugacacuuucaacagcccuuucuucuugucucugagucccacugauuucucaguaagaugguuuaaaaacaaaaaaaaacaaaaacugaaucugugguguuuaguguaacccuggacuguugaaucccuggauugggauagauguccugaacucucauagaagugggugguguauuuaccaguuuauagacuaaaccuggguaguguagaaaggcuugaguagcaaaaauaacguguaacagcuaguuggaaauuuuucugcuuucaucuuuuuagagcaaucaaugccuuugacuuuuggaagcuucccucuccacccccaacuccccucgucuaagaggcaaauuuuaggcaguuaguugugggaguguaucuaagcacuguacuaaaccucgaucauuuuaaugagaagaaucuuggaagaaucuuaccauggagagaaaaacuuacggaaugacagcaguuuaugguuuggauauuauucuaagcaacauuguugucugcuuuuuaauguguguuuuaugcucugaacuguuuuauguugacaaguugagaccugcuaaggauuucucucuucccuuuucuuuuuuauucuauuaaguauuuuaucugagaucccuuggggaauuggggaacuaacuguauuguucagggggaaguagauaguaaaaacacguauugaaccuuguccaaggacaguuucuguuuggguuguuggauaaucgcuccagaguaugcaugguacgugucuucacuggaucccuccucagggucacugaggacugauagcuauugucagucagccgcuaucugagcagacaucccugcccuuuguccccugcagugucuccuuccuugcaccuuugguuguuuccccuucacauuuaauaguuucaacaguugaauacagagcucaugaaagauuugaggucauagauagacucugcuuuuagacuaugggcaucucguauuauuuauguguagugugguucuugcagagauaaauuuaggacugcaaucacuuguaaagggaaggcccucacacaucauaaauuaucgaggagcagaaauguguauggcaguaaauacuuuggaauaaagaaaaaaggaugagaguauagagauagacaucagaagcuuuacaugagaggauuagaaacuaaagggcauuucugugagaggagacuuauggaauuggcgauaaugacagaauauaaauuauauuuucuuauuuucuacuaugugguuaaagaaaacaugugcuguaauggcauauuaaaugaggaaacacaaucggccuaacuaaccacaacaccuuccuuguguucagcaggaaacagcuaacacauucauuuucuguuuucuauucuaaagaaagcccugugggccacagggucauugggaacauucucuccuuggagcagauuugcccauugcaaaauagggaagcuggcacuuggaaacugucauuguagccguuauauugagcaacuugggguugaauuguuacuuuguucggccaguuucaggucugagcugucuggguuugagagguguguuuccuggggaggucuucuccgagcaguguuuggggagggggucuuagagauaaugugccauguggagggauauguuguacuuaaagcacacgccuuagccauaccaaaccaaggaucguacuggaccccuuccaaaagguccucauaguggcuuguugcagcuauaaaguguagccugagagugauagauaggcagggaucucucugcaagagcaaugccuaaccgaauggggcauauuuuauagauccaauguauagcauuuaaucaaaauaacuaccucuagugguaaagaguaaaaucuuugcauuucuaagcaauuugcauauguggagauguuuucugagcuuucugugggaaggagagguagagcuacaaaggccuuaaaaggaccgcgaaacucugugccaggcugcagguguguccuguucuucacccagugcucucucagaagaggugcucacacauaucugguguaacugcaccucaucuuguugcauucucagauacauguuuuuaagccauuuccuaauugaauagaugcgggagacagugggaaagaaggccgugucuucuuuugggacuugcugacuggugguucuccaguguguggugugcuccuguggacuuugaaaucaaucugccacccagauugucauauuaggggaaggugguucgcaggacuuaguauagcaaaaguggccaaauauuuuuaaaacgcuuuucauuugcagaaucuuuucuuucccagccagcugggaagccagcugugcugcagcuugaagcugggagagugaaaccagauuagaaaccggccugucccaggggcuuggugauagguuugggggcucaguuaccacccuaugccauuauuccuuggguggcugcuuuccucugcacaauggaauuugugggacagaaauaacaucuuaucucugagaucccuuuuguccuuauccuugccccuggcaguguuugguauugugucuagaugagacacucuuuugaauggaugaagucaagugaaguucaaaaaaggagcuuccaaauucauguugaaacacacucaacuuccugaucugugauacgggguuugugcuccagggugggggugagggugcuggggguggggaggcugagucugaugguagccuuuacuuaucacuauggaaacccacuuuucuuuucucccccccaccccuccaaaugaacccuuaucaauuagacuacuuggccacgaagugcuuaaucaguguggugauugguugcuaaugggaucugagagguaggagagauugcuggagaggaugcuuucucggggugaaggugggaggagguggguuacuaucccccaauuuuaaauguaaagagaagaacuauuaauuugauuagcaaauguuuugggauccuggaagccugguuaacaguuuaaaugacuaaccuccucuuagcuccuaaucaaggcauuuguacuucuuaccauccuuuauuauccagagcuuuuacaucuuauucucugauagcagcuuaguuuuaaaaugaaacgccacuuauguuuaauauaagaaacacauugcuauugcucaaaacucagcaaguccauccgcauauagauugcaugguuuccucuugucugcccucagcuaccugcucuaaaacaauuguaaaauuguuuaguuuugaaauaugucuuuuucuaaaagggauuuccccaaaguaguguuuuauuuuauuuuauuuuauuuuauuuuauuuuauuuguggauggaguauaucaacuuugccauuaagacaauucuaugguaguuuuuucauguuacaauccaagaucuuaacuacuuggguucuguuucuucugaguccuuuucugugucaaguuaucuagucaaagccuuucuuuuuccacuucacccacauuuuaccucacaaauauaauccuaggauuagaaucuaaaaucucaacuuaguuuuuagaugcugugacauggaaacauauuccauggccacacacgguggugcaugccuucagugccagcacugugagcuccagagagucaggggcuaccuggggaaaccaugccguaguguguguguguguguguguguguguguguguguguguguguguguguguauacacacauauuacacacgcauauacauauauauacauauauacacacacagagguaagugguuagagucuuugagagaaucagggaagugcuuuuuggguaaguagaggagaaaauaaauauaaaauaucuaaacagugggucucuucacccccuccauugacuuaguugcauccagugcuuuaaauacugauuugggaaagggacuagugauaucaguaucagucugcagcguccuuucuuuuuuuauuuuaauuuaauuaauuuuuuuuuuuuuuugaguaauggucuuacuauguauccuugguuacaugcccggaacccuguggaguuuuaaacaacauauuccucgguuuuucuuuucaaagguugaaaugguguuaguauaaauuuuacuaaagcuaugcucccgcccaguuuugaauuugggugugcaaugggcaucacuuucuagcauucucagcccauugacucuuuagaauuuguacacagagguaaaucuaguuuaugaguuuuaagucggcaacuccagagcaauguggcugaguugacugugaaagagcaaacucacgacaaaguugaaaauguuuccuuuucaucuuuacaauuuguuuuggugacaaagcaacuggaauacauaaaauuuaaaaccaaacagcaccuuuuuuucuuuuccagugagaaaaaaaaauaagauuacaaaagagauugccaauuucaaauaaaauccuuacacaaucugcugauuuuuuucccuugaguggcaggguccaagucauuacugggagagaauuuuguuuugaaagugucaucucaaacugcaaggaugucuguuaaacaucauaauuaagcacgcuaaaggagaagccacauugucaaaaugcccagcuaauccacccaaacaucucaaacccacucuuugcugaaauguuuagccuuuuuaugaaauuagacucuuagcaguacacaggccuagccagcaagauggccgagagggcagauaagcucacugucaaggcugaccaccuggguuagagucuacacuguggaagaagaggauugaugucuacaaauuguccuccgacuuccauacacacaguaacaggugcacacacacacaccaaugaacaaacaaacaaauaaauguaaaagagaacaaugcacccagauugaucaggcugagcuagugugccaugcaaggcuguaagaaguugggcagacauggaggacaagcagaggucauucggaugacaugaagaagaugugcuagaaugcaggcaaagaacugggaagcuuuugccaaucuggggucaaaagacaaauuauacugauugaacucaguugcugccaaucagcugugaugcuucugguaauuaugaaaucaaguugaauccaggacucuuuccccagcuagucacuucaaggagaguguggcauaugagcucaaucuacagucacauucccucccacuuuguauaugcagcgagagccaaacaccucuccagggaccuuuucugggacagagguagagcgccuccaaagccgguacuucugggagccucugcucagcaaacaguugugcugcuggccucccaggguggguaaaagugguugauguugagguuuggucuguuguuauguguuguaauacuaaguucagggguggggacaaggcuugguugccccagagacaagagagucauugucacuuagauggcaagugaugcuaugugaccuugcacccaaguuauuucugauugguggauaaagaugauagcuacagucgauagcugagcagaauugagauaggcagggauugggguucaaaggccugaagacaccacgagggaagagagaaaggggugaagaguggagaaagauuccauagguuaggagucaagaaaguauggccaugagggcuggccuauuggaguuaagagcagcccagaugaacauuguaacuaauaacucaggguuauugauaggaaauagauuuuaauaguauggagcguagauaucugacuaguauuaguguuaauaaaggcuuauuauaaauauaaaggucacgugugucuuuuauccaggaaugaaauggucaaaggugggguagaaauuccagacugggauuaaauauuuucagccacagguugacauucacuuccccuugcagauguuuccagaagggcagaggcacagguauccugaugguuucugugucucagaccccugccaagauaugacagucagguuccucucuaugcuuuuucuggaugaagaauccuuuaugucucucuuuuuuuuuuuuuuuuuaaaucgcucauggauucccuacccuguucuaagggcacuggcuccccaccccuuuccucuuugucugcuuuaugaagacugagaauggacuguccuugcccauuaggcugagauguuuugcuuggccuugaucuugguauuggcccaucuaacaaaaaccaaaaugaacucacucaguuguaugaaaggaaggucaccacaaggcugaauaccgagcccagacuguucaauacucuggguagcaguaauucucuuuugacagccaugugaucuguaucccaaagcuuuuguuauuuaaagggauuuuuaaaaaauuguuuauccuuuagauguuauuucaacaaauuggcuguaggucccguuagccgugaauuuacaauucugaacuacacugauguaacagcagugcaacuuagacucuaugaaaugcuguaaguuaugacaacacagcacuagagggaggugugugaggcugucauaaagccguaucucuuggagaguuuaagaaaccucuuggaguaguuuugagaugugauuccagugagagauggauggggugagaauaguuugaggauaaagagagacgaauccauuaauuaaaaucaauucauugggcaugugguaaaugccuuuaaucccagcacuugggaggcagaggcaaguggaucucugaguuccaggacagccaggguuacacagagaaauccugucucgaaaaacaaaaacaaaaacaaaaacaaaaacaaaaacaaaaacaaaacaaacugauucuaugcagagagcaacauucucaguaguagagggccaugagcucagggcuagggugacagugccuuucaucucaacgcuaggcugaugaguuuguccuuagcugugcaagcagcauuugaagucuuaguuuaaaagaauaguuugcuggguuggagggauggcucagcugucaggaguaccgacugcucuuccacaggauacagguucgauucccaggaccuacaugguggcucacuacccacuauaacuccaaucccaguagcugugacuaccucuucuggccuacauggguaccagacacaccagguguacaggcaaacaugccggcaaaacauccacacaaacacacaaauuaauaagacaaaauaaaaaacaaaacaaagccagucauggugguucaugccuuuaauccuagcacuuugagggcaaaggcaagcagaucucugugaguucaagcccagcuuggccuauauagugaacuccaggauauacaggaaauguagacagacuguguaaaacaaagaaaaaacaucuuguuaauauuugguuauccaugaacauggcuuguauguaguuuguccauuuugagguguuucaugguuugggaugguauuguaaaugguaucauuaacuugauuucauuuuccaguuucuauugcucauacaguugucucucaguauccaagggacaccagcuccaugaaccuccauuaauauccaaaucuguagguacucaaaucccuuauggaugcuacaguguuuguauauaaccuacacauccuccuagaguuguuuauagaugaugugcaaugccucugaggucaaagccguauuguuauugacgugcuuugcuuaggagauaaugacaaggugaaagcccgugugcauuccacacagaaguaccuagugcaggcacagcuauacaguacaguuuguugaugcagaaaccacauauacagaaggcugacaauauuaaaagcaauuccuucugaguauggugauggaagguaaaggccacgucuucaugaugcuaaacaagcugagcuguaacccccacucuuccauuuucaauguugauuuuauauccugugacccuaauaaauucgcuuuuuuuuuuuuggugccaguaacgcuuuuccuuuuuggauuuguugggacuuucuaugcacaugauuauguugucagcaaaaaaguuaaauuuuuccuuucuguuugccauuucuuucuuuuucuuuccuuauugcaccggcuggggcugccaaguacaauguugaauaggagugcugagagcagccagccuuguucuauucauggaggaaaacauccagacuuucauuauuaauuaugauguuagaugagguuucugaaaauaugcccuugcuguaaaacacaaaaaaauccuacuaaauacaagaauaaugaccaagggcuucagucuucuggucagguggacuuggccuuggaaaucaucuuuuguguuuucuagaugggagcuacuggguaaauuacuuucugugucuuaguuuucuauaaaaugggaaugguggccauuuaauaggcuugcuaugaauauagcaauaugaaauggaacuuaucacuccccuuuucuucuucacugggucucacuauguggcccuggccaacuaagaucucccuauacaacuugaucuacagauccaaguugguuuugagcucacagagaucagucugccucugaaauccaaguguugggguuaaaggcaugugcuaccaagccugaccaaauguuucuucuuauuaaccuagaccaauguaagcaggaagacuuauuaaccuagaccaauguaagcaggaagaguggguaaauaaaaaugucaaguagaaguguacugaguacagaaaaucauacucagagcuaucuucuucacccagauguuucuacuaagcugagucugagaguuacuggugugugugugugugugugugugugugugugugugugugugugugugugugugugugugguuuagugagaggaagauggguuuuguaagagcagucuuauuuuaggauagcccaugggagucccugggccuggaugcugaccuuguggagggcccaaauaugcuucagaucuugauuggcuugugaggauguuguggucacuuugggaggacaucugugguaaauacuguuuucucauuuucacaaacacgaagucuaagguccagacuugucaguguuucuucaaacaucgcauuacgcucacggggugagugaacuguugaaguccugcugggucccugcucugacuucaacagauugcagcuuacauuuuacagcugucgggggugggggggggugggguugagggugggggggguggcugaaagauccugggacagggcugaaagcuucuguauuuucaaagcaggcuucucaacucacccugauuugauuuggggguuucaaaaucuaggggugggcuccuuuaugccuaaguugggacagaucugauaguggcccacagucagagaaguauugaggucauaucacaggugacaguuuuagaguuugugcauuuaauuuuauucuaauuaauuuguugauugcuguguaguaucugaaauacuuugcuucuuagaugcuuacagaaaaagacaucuugcuuuggguucuuucucucuguggguaccauuaaccuguaggcccuugguuggccauagauccugaagaauuauuuggguuuuauccuuccagucuuaauauucaucaccaguaucacugacugacaugucucugcccguuuacuuuuuggcuuagacacauuuugaaaucacucaaacaacagcccaggccaaggggccugaacugcuuuggaaagcaucucuucgggcauccuucaguucaguguuuguuuggagggcccauagucuucucacagaaucaucaccacuauuguuuauuugaugcagguuuucacaguguguagcucugucuagccugagauucacuaaagguaccaggcuagccucauauucgcaucaguucuccuucugccucccaagugcugggacugcaggcaugcaaccaccaugccuggguaguguccucuguaucccugcaagcagcuccccucuuucccugaacuuuagaauucucuguucgcaguuuucuucaccuauggcaauauuuuuggcaugacuuuccuuucugauuggucaguuggcauucugagauaucuagcacuuucuccugccaccugagcuuuccaaauauucuccauuuugacucccauaggagugucaagugguacuuuucuauccccauugcucaugcgucaggacgagcgccucaagaggcggguccagguaccauuuuuguaguacgcuaagagccuaaguucagaauuuacccuuuuuacuuagugggcagaucggggacuucuggaagcauaguuucuuagagccaucuuuugauguuaaagagggcacauuaacccauucaagcuauuguaugucuauuucccagaauccuuucucuuccugccagugucccaccuauuuccugccucagcucauuggccaucaguuuuuuauugacagguaaugcuuauaagagauucucucuacacuauuccuucuccauuuccuaggaauuaggcacuuucuauguuugcuugguugaaguauucggugagaaauauggagguuuguguaguuucuccgcaaggaacuaacucucuuccagcuuagcaccuaguccugagggccacuggucguggccucacaggaggcucugacauucagccuucuuugagccauaagucucuuucccuggugccuggggcugugggcauagucuccuuguguggcuuccccggcuugcuuacaccagcagguuaaguggguaagcauaagcauccugucagaauuccucccugggagagagcaaacaguaaggccuggaguggagcaucucucucaacucugcugucgguugaugcagcugaagggaaagauaacgcagaguugauuuguuuuuuuuguuuuugcuuuuuuuuuuaaagagggagggguaagucuuagaccaagacauaauccacuaaucagagugaacccaaggcucauaaaugaagauuuuucugugaaaggguacaagauauugcuguagaaggcagccuguguggcuguuacauaguuggucucuucguuucucuuucucucugcuuacaucuuuagcuacuuuuuaguuuuggguaucuuuuugucugucugucugucugucuuuuugugacccugucuuccuaaguagcuuaagcaggucuagaauugucacuccuccaaccuccacagcccgccuguuuaguuuaguugugugcugguuuccugguuuccuauauccagccucuucucauggauuuuauugacugccuuaccugaugcuucccucacccuccuuccugcucagucccucugaucugcugcucacucuuaaccuaaaggaagcagccauuccucagccucauuaccccaaacaucaggaaaaaaauccagaaaguuugacaaugaaacccccaauccuucuuugaacuuuagaucucucagucucuauuggaaggugggaguaagaccugggauaggaggaacauggaacuguaacagauaggccagcaucuccagugagguucaucugacucuuaguaacaugcauauuaaacuguccuggccagagacugacauugaucccguccagauggccucugcaggaccugggugguucagaccaacacugagaagaccuuaagcuguggaucuggacacaccucgguccuuaaagcuuuaaaugaccucuucacugagauacucuaaagccaaugucuuuuucccuugcaagcucagucagggcuuaaggacaaccauuugccaggaacucugcuugccuuacuugucaaucuaaagaagcugauuccucugaagugggaccuagaaguaugggggaggcauucuuggagaagucucacaugucauccacgcuagccgcaccugagacgauugcaugcggauccggaagcugugcuucccgcuucuacucaggguagcgcaagacaucacccguuguugcugguuggaggaggcacaugagugaccccaggaggagauggugcugcagucuccacucucauaaauggccugagugguucccaucaugcaugucguguacucacucagcagagaguacgguggaugagaauuguagggaaaaggaauacgguuuccgcuucagccaacgucaucgccacucacaucuuuguucccucuccauuucuuuggggugguagcauugggcuggggggggggucggucucuggugagugauuuucuuuaggggcagagccugugagacagaaguaaacguugaaagcaucaguuuuagaggcgcuuuguggaggagucacuuaaaacuucagcuucuuguaaaggaaaccaucuggucuggaagagcuccagugaguucagcgcucacugagccaaccaaggucacaaaccacauucuuaaguaagagaauuuuagcuggggauguggcucgguggguagagugcgugcuugucuagcaucacugaggcuguggauucaaucccccuggcauggcggugcucaccuuuaaucccagcacuugagaagcagaggcagguggaucucagaauuugaggccagacuguuuauacauaguuccaggccagccagagcuacauagugaaacccugucugaaaacaaacaaaaaaacuaaaaaaacaaaacaaaacaaaaaaaaaaccccaacccacaaaggugggggguggggaggagacagcuuguuuguuucaucugcaaagucaaaagguagccugauaauuccagaaaagagaugagcccggugauugcaagaggaagacagagaagggaugguguuagagagggcaacccaauagaccugacucugauccuacgguccagagaugacuugucuugagaaugguuuguuacucacaauuauaaguuugggggcaguguuccaugcuggcuuacagcugauccgggugcccuuaaaaguugaaguuaguuuguggauccugccgugaauauccaauaacuggugcugguuucaucaccacagugacagacaaccuaagcaguaguuuagcuucugguuuuucagaugcuuccaugcuuucucucccucuccugccugggcccuccuuccgucguuguccaucuuguaaaggcuugacggcuugcucaggggcuguccuuacuucucuccuccauguaugucaccugucgugaaggucucuccuaucccuaguguggaccaacuguuuacuuuacagcugacuccucagccaauugagcgcaucuuacucugugacuccauacucuaucaccuggggcauauugauuaaucucaggucccuuccuuguaaaauagagccaauaauagcagcuauaucaaggauuugugauagauucuggugaauuacuccaugggaaguaauucccaugaacaccugcucaaagacaauauccaucgcagggaaagucuucaugguuugauucagguucaaacuacucccgacuacugcuuagguugucugucacuguggugaugaaaccagcaccaguuauugguuauagauacugucacucaguuguggggcuugagcagcucuguaggagggaccuugccucaguuuccuaacugcauggcaagcagagcagugugaucacacaaucauacccgcaagaugcagcuuauuggaaaaggguuacuaaccuccucuggauucaaggguaggaaacauacacucucucuagacagaaagaguuucaagggguguguggacauuauagccuaccaucaggcauagacagcauacccggaaugcacaaaaauugucaccuccacccaagaucaucccaucgaaaucccauuuauucucuggcugcaggucucauuauacaaaggucuaaguguagaugggacuccuuuaaugugacuucucugcauugguggcuaaauuuaguccugccuuucucagucugaaggcuuggaaguaaaaagacaaaucugaauucuguacccaaguucagcacucagauagguagaagauaaccgcaguucacgacucucuagaaacaaggagcaaugcuuguauuuucaagucccucuuccucacuauccuccugccucaguuugccgagugcugagauggcaggggcacaacaccacucccaggccuaaaaugacuucuuuugccauucuaaguuuugaaauaauuucagacuuauaagaaaguugcaaacacaguagaauauccacaaauauccuucgcccggcuucccaaaacuauacaauguguaacaugauuggaccaagaaguuguaguacugauauaguauugucacuguuacuuaacccaugagguucauucugauuugccaauuguccagcuaauggauuuuuuugcuaguucagguuccaacuuagcccccacaucaccugcaguggcugugucuuuaccuucucuaggguaauuguucccagaaagcaguaucugucuuuaguccagagcaguucugaugugcaguuggccaccuuagcacagcagugccucucagaaugauucccagugucuugguucuaucccaugggcuccuggcucuguccuuacccuuauuuccccacagauauaacuuuuauuugccacuaagucauuucggcagucagcccauuucaguccauggugagugguggcgucauuccugcuggugcagcucuuuccuaauacgggagcccucucacuguuucuugcuguggaucacucuaucagaggaaauccacaaccacaagccuuaccaagagaagccauuuccuucacugagcagccggggagccugcuggguggcugggugagguggaaugaacuacguucuucagguuacugcgauuccuauucugggaagaaguggaacacauccugaaaaccuggaaggggcuuuugucucucucuagaguucuggggacacugcccuugaucuuccuugggucuucaguugaguucagugguuucuuaucauguccuacuaagcuuaggguacucucuccuucuauaacaauuuccuuccagccccuuaaacuacuacaaauaucagaaucaucuguggcuuguuuuuguuuuuguuuuggucuuuggguuuuuguuguuguuguuuuggcuuuugagacaggguucucuguauaacagcccuggccguccuagaauuugcuuuguaguucaggcuggccuugaacucagagauccagcugcuucugcuucccaagugaugggcuuaaaggugugcaccaccgccuggcaucuguggcuucuuuuucacaucuaucccccgaaugcaauccacugacaacuuaugacaguuuuuagugcugugauguccccuaaguacagcuguuauucaagaugcuugcucgcgccgggugccauagcucacccagccugccucuagagcugcaagcagagugccuucucucuccucucccagcuacuaccuauuguuagaacuugcuuucuaaaauaagaucucucuuuccaacccagaaaucuuaaauaaccucuuuacacuaccuauggaauaaaguaaaucuucucuauagggcauguggggcuuccacgauuuagcuccccccucuuuaagccuuuagcucacucuucacccuugcucuguuagagccagaacguacugcuugagaauucugaaucaugcauugguugcuccgucuguuuuccuucucucccucccucucucccuuccucccucccuucuuaccuuuuucccuuccuuccuuccuuccuuccuuccuuccuuccuuccuuccuuccuuccuuccuuuccuccuuuccuuccuuuccuccuuuccuucuuuccuucuuuccuucuuucuggauucggugcuucugcucuguuugugugacuugcuucaacuuucccuguucagucaguuccuagcuuccacacccaugaccagcauuuccaagucucuguaccaguucauggcuucucaauaccaucagggcaggaggucagcauguguucucugugcagugggcaccuuaggugcaugauggagcugcagcuaugggugcguuguauuuugcuuuugugugugugugccuuaagaugucuuaacaacuaacugcuugguaacuugaagagacaccuuauaacuuuaccuuaggauuaaaacuggccaucagggauacgccucaugcauauggaaggaggugguuguagaggugauaugugguguuaguagaucuaugucaguugagauagucacuucagaugaaggccaggaguuagcuauacagugcuaugcuggauuuccuuuuuccauuguuguagcugcuguuuauauuauuacuaaacacuacaucucugauacauguuuuagguccuuucuucuauggggcagcaucuuagcuuuauucaggggcaauaagagcuuucugguuuuguauaucgcuguguucccuaguagcuucauggcaaugcuaugcgcuggagcucauuaaguaugaguugaggugaaaauggaagaagaauggguuucuuucccuuugugccuuuaugaggcaccuaccaaggaacacagccaaggcagcuguuucaaaucagcacggcuggguaccuggcaaucccugugguccuagcuacucagggcacugaacaggaagauugcuuggggcuaggaagagcaauacagccgagaccuugcagguggaggagggagagagagaacagugcuaucaguccaaggugagagaagacucauucugcacaagugauuuauccaggguccucucgagacucugcacuuccagcuucgccacagaggugggggacaugcacagagagggacugguagguagcaaauggauggcagaucugcagucuggaucaggccaucagaaguggaggccccuuacuuuagggcaccaggccuuaguugagggaauaggagacuccucagacccugacaguuguuuggauuuguuuucaagcggugacaguccuuccuggacaucugccuccccggcccagucucagccaccucauuccgggugaccuuguucagggugugcucaacacuccaggcuuuguuuucagcagacaaaucgugguuccuucuucagcugugagaacuguggaagagaguguuuuaagccaauuagguaaguggcaugguaccaaaauagagcccacaugggcuuauuguuuuucuuugaaaauuuuagcaaaaucuuaggcugggagauacccugcauagcuggaaugcugcauuucuuccugauuccaggcuuccccuuauuccauucugaguaucaaacacagagacugugagacugugauugugguaauuggaugggagggguuggggcaauuuaggaagaugacgggggccugaccuccuccugccuucaaaauccaccaagggagaacggggaaaugaugaauaguugaucaaaaaaguggggacagucccuccuaaauugggacagccagcuccaggauuaaacuguucuacuguuugcagcccucaggaccagacaccacgaaaacaggaauuaaacucugacuuuggcagcucucucucucucucucucucucucucucucucucuccccacguggugaggguaucguaccccucucuguccuugccugcucuggaucaucuuggggagucucaagagugugaagggagggcauucgcgggguccaggaggcuggauuuuagagaagagguagaugcuggagacauaaguuucagagacugcuggauaugcgucugguuggccuuuggcucguccuuggagauuguguuucuuuucgagggccagcucaaggugaccuccuuguacucuguagacaggagaguuagccugcuucaucucucccauguuccugagaaacugauuuugcuacagggcugagcguaccauauggcagcuacagagacuguuggcgcucaucacagaaagcacaggaguuuuggcuauagcaaaucccuccagguagaggugcuaugccaucuguggucacagcauauaggaacagcuagguagguuccgcucucauccacuuccugccugcccccaaagggaagggagaggcaaguucuaauucaaauacugcuuaacggaagaggguuuuguuuuguuuuucuccucugauuguuauuucuuugaaggauacuggggaggugguggucuagaauuugcauuucucaguuuugagagguuuaaaguccacuuggggauaucagaccaguaaaguaacaaaaucaccugguacgugugguaggggcacgaagcugaaauagacucucuaggauucuagaggcugaagugcuaauacagcugugaggucuguagcauggaguuaggacuagcgguuagccuuaggacagggcuagccuuggagaaugaacagacuggauuugaguggguacagaggauaaagacacuacuaggcugaaaaaaaaaaccaguaagaacagaaguggaggcaagcaagauaccuuacaggaccacaagauuaauguaguuuaaguaaagauacaaggagaaaagaccaagaaaguggcaugggaccagauuaaagaagguuuuuaggggcagacaaagggacuuagacuugacucugaaggugauaggguaccauugcagguauuauauggguaugauacagaaaaagggauguuugcugaugcuuuguacauacaauucugagcagauugcagcgauguccuggagauuaaacaguaaguuauaaaguucuugaagccaugaggaagagauggguaaauuagauauucucuuucuuuccuauuuguuuguuuguuuauaaaaaccagaucucuggacguauauguagcccuggcugucuuggaauucccuauguagaccagguugaccucagcgguacagaaaucugccugugucugccuucugaguaccacccuuaaaagcaagcaccaccacucuugggagauauuuccuuuccagaaccugggagauuugagcaugagccgagcaucaggcaggaaggcgaugaaaaggucagaguucugauuuuggaaaguuggaaguaauaauagcgucauuaacagaaauggaauaguuauaggaaagguaguuuuauggggagaaugaugagucuggcaaugacuuuauuuacuuaauaaauacuuaugugacauuuguuauguucuugguaccauucaaaucacguuacaaaugauaacucauuuaguucucauaauaaccgugaggaauaaauaguguuauuaucuucuucauuacaaagguagaaacucaagcauagagaugucaguaauuuuccgagaccaguguacacuggcagaggcaggauccugaagccaugccaccuauacuaguuucccuccauucgaugggagacuuagguggaagaagaaauccgugaagguuauaguugucaccugaauguuuccucugugcacagcccuucgcaggaagugaacaggauggcauuugucaaguccugcucaaacauucugaguugcgucucaaacauucugaguugcgucgugaagaggggagcaguugaaagacgggagggcagauccagauccagcugggguugucagaaaaggcuuaaagagggagaggggauagagauaagccccgauagauggguccaggugaauuuggacaguagaugguagggggagaacauucccguagauacaaaaucccgaauaaaaucauggcgugugugggaguucagaacguauuuugagacuagggcuuagcauagcucccugaucugcuggugugaacuaggaugggacuugguuuuaguuaggcugcaggaggaagcuugaguuggagaugcagaagagggagaugcaggagaaggaggucugagggccccuccccccccccauggagaugcaggagccccuagugaaggaguuugacuggacacaaagauucagagaaacaagaagaggcucuugaagguauuaggguagaggacuccuggagggauggaggagggaaagcugagagaggaagggaggagccuucccauuguaugaaugcaaauauauaauaauacuauucuuauucaccacgaaucugcugucccuaaaguaaggccuguggcuucuggguugacguuuggucaccuaccauacugguaggccacuucugccucucagcuuuuccuuuuuagggguccccagccuucuggggguacaugaagcucuuacugaccuugcugccucuauauuuaggaauccuggugcccuucugucuagacucaagaaggacuugacaaaacaccagggcacgcucaugcugucaguucagagucuguugacugucuucccugagagcguuuuucugacuguacaauagggcuaacaauauuugcuuugcuuuccuaacagggagcuugguggagaucagaggaggugaugacugaaggagcuagacaacugcaaagugcuguagcagagcacacccaggagcuguauagcagcugaccaggugcucacucuuacaagugagcacucuugaggguggcuuuuguguauccugcccacagucucucugucaagaccuucaagggcauggucuuagagcaggaaugaggcauagggcagaauacuauuuccuuguuucauuggcucuaagaugaacucaagcccuguucccccaccaucuccaaagccugucuaugugccuuucgaugacaguggguaccugagaaggacuaagaugccuuuguucugggaggcaaugggcuauacauggaaauuuucuuucuuccuuuccaucacugaaagcuauuuuacuucacacuuagcaagcagaaaucucacuaaagaaauacaucgggaggcuucugccaccuuaguucguauggaacucggucugccuuugagugucuugcaauaugucacagucacccuuuuucacugaacuggcaacagaacguuggcuuguacauugcauguccugauugagggacauacucuguuuauugauuuuuacagucucuauuggcaacguuagugucguuuucucugcccuucuagaaguggaaggcauuaugcguuaggaugaacagguaacuucguuacccuggguuugacgauucgcagcucuggguguaauuggggaacaagaucccuuauccugcccugcacccugacagccauccacacagcuuauuuuaaagaauucuguuccuguguuuugguuuugguuuuuccuuuuaaaagcucucagaugccaaucuaaauucagagccuucuacugggggccagcucuuacagguuagguuucccagugacugucuggguguagucuccccauucuagauggcuugccaguguccacuugccugucuccuggucuucucgcugcugucuaggaaacauagacaaagaauuuauaauuaagaauguuaagccgccgggcauggaaagccaccaggcaugguggcccacgccuuuaaucccagcacuugggaggcagaggcaggcagauuucugauuuugaggccagccuagucuacaaugugaguuccaggacagccagggcuacacagagaaacccugucucgaaaaacaaaaacaaaaacaaaagaauguuaagccauguccaguguggucacacacuccugaauccuagaauuuauucagaaggcagaggacaagaggauuauugcaaauuccaagccagcauggaccacaaagugaguucuaggccaaggagauggcucuggguaaaggcacuugccaccaagccuggugaccuauaccaagaaaccacaugguggaaggagugaaaggacuccagcaaguuccccuuugaccugcaugcaacauggcuuccuguagguucaccugcccugcaccaaacaaguaaguuucaagguagccagggauacauggugagacuaacuuaaaagcuccucccagcaaaagugaucgugagcccuuaggucaugggguggugcucaaaggggcacuaucaaauaccauacaugcacccacccccaagacaggguugcucuuuucauguucuuugcuaucauggaacucacucuguagaucaggcuggccucaaacucacagagauacccacccuuuccaccuccccaguuugugccaccacugcugagcugaacacacacuuuuacgaugcuaauucauuugauucuccuaacaacagggagguaggcuugcccuucucuguugugccucuaggaacuucagcuuagaaugggugauuuccuggaugguuuuacuaguuauaagugauggagugguccuggagccccacuuucuaggaagagugagaaaacagagaaguuguaaauggacacuauuagcucuuucugagcacagggcaauuuccugcuauaacauggauggcuggaugugguuuucuaaaggguucuaugguuucuuucuuugcccuguccaagucugggaacugaauggcuguuggagggagcugugcuguguuuugcagacucugggccuucuaguggcuccugauucaggucagaugcagcauggugcccuagaaauaacgggguuucuagcccagcgugacucccuugagccccugagccugcgagggcagcguuggcagcaccucuccccagagcuguguuuauuucuauuaugucauuugcuuauuauaggcagccugcuaaguguugcuuaucuccucccuguggugcccugcccuucccucuccuucugucuucccugaugcuuuggggauuugggaggauagggacccgggaggcagcguucauucuccaugggcuccuucucccuucugcauuuggaauucagcuucucugcugagagucccugcagaaugagacuuuguuaggaacacugguccugugagugagaggaucacuccuccgugggcugaggaaggagugccucuuuccugguggauggaaaagagaucaggcaagggagaugagcugggauguuggucuggaucugcaggagucaagcgcuuggauuuggcaggcuuuguguucugauguucugcuuccugucaccuuggcauguacuugucccucuuaaaucuuuauauacaagggcuguuuuugcaggucaggcuaggagaugcuuauggagucugguccaagagucacugucuaugagacagccaguuggagacauggcccuagaugccagucauugggagcugugggguagggggcugggcagugagaggcugucacuuccuucuguuaggcagccucugucugucuguccucccuuaauuucaccaugagaaggaccagggcuguucuuuccauuaacauagcugccucugcugcaugucagugcauugugccucccacuuaaauggcauuucaaccacuuuuucaguuugaccugguuauacuggaaccaccucccagagauccuguggcauccccauggagagagcuuagaugacucaggagcaaugaagagaagggagugccaucuugaacuaguguugagaugggucuggagaaggcuguuggcuucccuagacccuucugcucaccaagaaugcuggguuuugagacguauucugaaaaacauaauagaaguguuaccuucucuguuuugcaagaugaauguaaacugaccuuugugcucagcauccucuccuucauuggggugguuugaaagagaaugacaccuauaggcucauaucugugaaugcuuggucuccaguugguggaguuguuuggaaggauuaggagguguggcuuuguuggaggagccaugucacuggggguuagacuuuggguuuuuuuaaucuuuuuuuuuuuuuuaagauuuauuuauuuauuauauguaagugcacuguagcugcccucagacacuccagaagagggagucaaaucucguuauggaugguugugagccaccaugugguugcugggauuugaacuccugaccuucggaagagcagucgggugcucuuacccacugagccaucucaccagcccgacuuuggguuuuuuaaagcccaaacauuuccaaugagcucucucugucuucuucuuuuggauaaggauguaugcucucaguuacugcucuagcaccaugccuacuugccugcugccauguucccuaccagaugaccauagacucacccuccggaauuguaagccccaaugaauucuauaaauugucuuggccaugguuucuguucacagacacaguagauggucuuugcuacuuugugguuuuaucuuuucccccacucuuuguccccucccccuuucaccccuuaucacuagauaguagguaaagaagaauagagagauagagggauagagagcucugaaucuaauuucuucuuauuucuucuuugagcaugacuacuaacaaacagcaaccaacaccucugaaugaccaauaaccuuagcauuuacauacccucugaaaaguucccagaauuccaaacaucacacaaucgcaggaaugaucuacaucuggcaaaaccaugcuuguucuagagcacaaggcaaaucauagucaccugcugugaaacaaccccauaucccauaccugggacuaaaacauauucuuauauuucuguccuuuuuuaaaaaagaaaccaaaauuucagaauucucacuacauucccccucuugcaaucacccuucucugaggucagaucuucaucccucuucggaaggcagcuccuccauuccuuucuccucagcaucugacgucauuggcuuccucucucuguugucaugccccucuauuucuguccaguccuuuucaaccugcucaugccuaccccucuugaauuuuuccucuccuuaacaaccuucucaaaagaacagcacacauaccuggucccuucuucacaacuccagcuucaucaauacugaccaccuuaaaugaacucccagaccauaauccaauggacauguucuguucccaaucuaucggggcuguugacuauucuggcuuuugaaaaaauguauucuuccuucgauuuccauuuugcacacucucagucugcccuugcaaguuuauuaucagugaccauuauucaaaaugcuugggaucaggaaugcuuuauauuuuauauaaauuauauauauaccaaaugcugcugggauuaagggugugucacuauguccuggaaaguuuauuuauuuuuguaugcuagaguguuuuguccuaguguaugucugugcaugccuggugcccacaaaggccugaugacugcguugguguguuggacccccgagaguuacagaggguugugagccaccauuuggaugcugggaauauaacauggauccuuuggaagagugacuagugcucuuaaccacugaguuccuguacagucuugauccaccuguguuuugacugugaccagccagugaggucagguguggaaugcucugcucgcucccgcucuuuugagacuuuugagcucagauuaaaacugacuuccuugcucaucucuacuugauugcucauggaugucuugaaguucacacagaucccaagcuaaacuaauaugaccccucucccagcuguucuccuaaaagaguccgcuaaccacuuagauucacuuucuuagggucuuuuccuuaccuacccaccacaucuuaccauggguacgccucacaucugucuugagucuacuugcuaaucugcugaaccauccaugguaaacaugguccuuuaccuuuucgucuaaagcugucugcugccucauucuccacccgaaagcuuuuaaaaacagaaacccaaaugcuuccuacucuguuauucccuggucuguuccaggcuccuuacuuauaugaagucaaaacuccucucacggccuccaaggccauggguggugcagcagcagcacucucugcuccuuguaagcuugcuguggucugacucccgaccugagaacagugaacucacuuagcuuucccugcaaggcugguccuuucccucaucugcagaacuagucuguccucagcucagcucuuuaaggaaugguuuuggggaucccagaguaggaaguaguucugcuacagggucaugaucccaacauccuucuagcaccaaagccuguuugauguaauuaccuacuuccugguagaugacgugcucccaaggauagaggaugcuucuguuacauacaccugcuguuugcacaaugucuggcacacaguuggcauagaauagguuuaauuuuaugaaugacuggcugcugagcuuuggaggaggcagucaagacagauuugcaaggagauauacagagauaaugcuauacauaccccaucccacccccaccccagccuucagacaggguuucucuguguaacuguccugaaacucacucuguagaccaggcuagccuugaacucacagagaucugccugccucugccucccaaguacugggacuaaaaugugcgcaaccacugccuaucucaaugcuguacucaaacugucauuuuaaagaagucaguaauagaguuggagcuaaucaguuaagagcacuugcugcucuucuaugggauccgaguuuaguucccagcacccauaucaagaggcucacaaccaccuauaucucuaccuccaggggauucagugucucuggacucucagggcaccuacucaugugcucacacacacacacaaacuaacauaguuuaaaauaauaaaaauugcuggguguggcggcacaugccuucaauuucagcaaggcagaagcauaggcagaaggcagagggcagagggcagaagcagagguagaggugagaucucugaguuugaggcuagccugaucuucauaaugaguuucaggacaguuagagcuacauaguaagacuuugucucaaauaaacaaacaaacaaacaaacaaaauaauaaaaacuuuaaaaagagaaaucaguaauaguucaguucuauaagaauuguucaguugcauuaucugauccggaauuuuauuuauuuauuuauuuauuuauuuauuuauggacagggucuuacuacauaguccaggcuagccuuaaauucacaauccuguugcuucagacuuucaauaggcuuucaggcuauuccaccaugcguagaagcaaaaguuuaauuuuaaauaugagaaacuaagagcugcugcguggcaaucaccugcccaaagguacagaaugccagaggaagagagugugacuccucucacuggagauccagggcucauacaagcugccugcucugcucagcagcucugccuguccuucagguacagcucuguguucuccaguugaaagcaaagcucuggagucaaaagacugaugcugucucccugcugaguacggaacaagccuguccuacaggggcagccuaaggaccuacugcacuccccucccccacggagggaugaacgacaggcuguaaaaccgucugagccuuaccuauugagccgugcacccuugaagggaggaaaacaagggccauguuuguugaaguaacuugcuuuucuaguuucuggguuaucaaaauuugggacuuggaaaucugacaugaaaguuaccuggcucgcauccauuccuuccaagauccugguguccuugcuccuggaaacccccucccugugccgucugaaggugaagccuuggcccuuggccaaggcuggccaggaagcccuccuucaggggguaauccuucucuauugcacacacccguccucuucauuacaacacucaagacuuacauccugaaagggucagagaugccugugcaggaaccucgggauucuggcaccucacauuuccagucuccucucaguuuuucucaauuuagcuaacauuuauugaaucccaauuaauguccuugguauugggauuguggaagugaguaagucacacccccgccugugagacacucaaagccuagaccccccuccuuuauucaauccacccguucauaaaacacgugggggauguuggauaugcgcuaggcauuuaccacuagaauuauuuaucacuucagcaauauuugagguucucuucgaauaugcauucaggugcuuagaauuaugaacagacuguaugccucauggaaauuuucuuucuggugaggggagaccagugacguacaaaaaucauaauaaauacauaaauuagauacuguuuggaaagauuuaaugguuaugagggggaaauaaggaccagaagaaagcauuagaaguguggagggcgugauuuucaguauaguggucugguugcaccuguugauacagauuacugcagaggcuggcaggaggugaggacguuaggcauguagguaucuuagugaaaggaauuucuggcaggggaagucucaaggcagaaguaugcuuggcaugcuggggucacagcaaaaacgccccuauggcugauguggaacacgcugagauuagaggagcaguggagggagucuccucgaggauuuagcuuuugcauuuagugaaagaaaaagaaccaguaguguuuugagucuccgaggaaacuacucugguucauuggacagggaacauaaaagugugauuuuuuuugagacuagucuuuagagagggaggccaggugauuagacuuuagaaacagaagugagacaggaugguagcucacugacugggagaaaacaaaagagauuggauuuggguuguguuuaaaagacagaguucaaauauuucuuguuagauaaaaugcagaguagggagugaaaaaugaucugaacaacuggaaacucugaggugacugaagauucauaaauacugagucaggccuuggcucugggggaggguuuucaugcugaguggagaacaagauauaggcuuggcuuggaaaaaccaccagguugauaggaucaaccaaucagagaguguagguugaugagaucaaccaaucagugcguguagcugguagaagaaaaagaagugcaggaacugagaaugggugcugagagccuggagagggucugggagggguugagaggggagggguugaggggugggggagaggugggaagguaggguaggggcugagggggugagggaggguuugggagggguggggggaggaggugggaggggaggggcuggggaagugagggagggguugagaggguaagggaccggagggccagagaaaagacaagacuuagcaggugaggccaggagaaaaccaacugucuggugagcugaaaucaagugaagaauuugcccugaaaaggagggagaggugaacaggccccaggguugcugaauugcccaggaagacgagcaguagcugcacuaaccacuggcuaggcaauguugaugucucuggagaucugauaggagcaguuucaagguggugguguuaguagagccuuaaucgaguggcuuuagcagaaaauaaagaaaagugauuuauggaaaaccugcuguaaaggggagcaaagugaggcugaaggccauaagggaaguggaauugggagacuuuauuacuuuuuaguguaguaacgugcacacgauaccaaacuucucauuuaaccaaccaauuuccuacuuaaccauauucuuccagcuugcuucucuguugcugagacaaaacauugaccagaagcgacuuaggggagggaagggguuauuuaguuuauaccuuguaguccaucauggagggaaaucaaggcaggaacugaagaagagacagaggaggaaggcugccuacuggcuugcucugucagguuuucucugcugacuuuuacaucuaguccagaucuacuuucuuaggaaugguauugcccacugugggcugggcccucccaugucaguuaacaaucggaaaaaaacaagcuacugauaugccacaggccaaucugauggagccaguuccucaacugagguuccucauuuccaagugugucaagguggccauugcagucgcuuuagguggaaaguucagagaccuuccaugaacucaccuuaugguauagcucuuguagucauucaaccccaggaugguuucaucuuucuaaucugaaacucugauuauucuuuucccaugugggagauggaaccgcugauagccuggugggaaugacccaucuaagaggaagacauuagugaugugggagagggcaggggaccgcuguggugcuuucccuugcuaagggagggcaaacucugguucauggaucauggaccauuuaucucaauuacaggaggguaguggacuggauggaugcugcaagggugaacguuguggugggagucuauggaaauucucuucugacuguggcaguuuucacugaaguaggcaacaaggucacugauaaaaauauggaggagguguuauuuuuacuuggaggggaaagggggugugagaaaagucccucuggagaguaggaaggcaaauacacuagagaggacagaauuauuaucagguccacugauggcucaucuuuggcucauggccauuaauguaaagugagaccagucuacugcuugccuggugcuuuguucccaucucuauucaacgguuuuaacuaagauccucauugacccaaacgaaaaaagauaauuuuuuuugaaaauuguuccaaaauucugggucuuacuauguuggccagggaagucucaaaucuuuuuucuuuucuuuucuuuucuuuucuuuucuuuucuuuucuuuucuuuucuuuucuuuucuuuucuuuucuuuucuuucuuuucuuuucucucucucucucucucucucucucucucucucucucucuuucuuucuuucuuucuuucuuuuuuaccauagucucccuagaagcuaggauuacagacaugggccacugugccuagcuaagacaggagaugauuuuaaagauuggucaagcuuaucaauuaggagaacagagaagagacggcaucgcauucauugugagaacuagcaaaaagaugguacugucagaggaccagaucuuaucuggaugaaagucuuucuggaguccaaucucaagggguaaagcuagaggaacaaagaagugugcuacagagaguguuacagaaaugggguccucucaggggauugcaaagauacaguuuagguuaugggagcccuugacagacguuggagaggaaggguucaugggaugaguguaauuaaccauuuguaacuuaggaaacaauuaacuuguuuagauaucugaaugauagguauguccugugcucagaauuauaguuuaagccaggagaaaaaaaggauugauaguauaacguagaaaaugcuacaguuagggugcuacaaggaagggcccccucaauccaauccagggaacuggggaaucuuccaguaggaaagagauuugaguugggacuuugaagaagaaauccagguuagugagauuuaaaaaaaaggaggaaauaucucaaaccauggggacagaaugugcaaaggaugaaggugaaccuucacauuuccaaaggccuccacuuggauugcuggaugcuugggcuagaacugaaggcgccuaacaaggcauggauaagaucuuguccccauggaugggaagaaaagucacauauaugugaaugugaauucaaggcaaauguucccaguuaugguugcugacaagaaagaaguuucucuuucuugaagaaagaaguuacauuuuuuuucuguguugguuuuuuuaaaaaaaacuuuauuguuguucuuauuguuuuccaaaaaucuauguaaaccaggcuggccucagacucacaguccuccugaugcaggcauuauaaaccuaugccaccacacuuagaaagacuaguuuuacacauaugaacacacguacaaacauacaaacacucaugcauacacauacacacaugcacacauauacauauacacauauguguaugcauacauacauguaugcacaugucucacaugaugcauauaugcauacaccacauaugugugaugugugugugccacagggcacauguggacagcauaugggaaucaauuuucuucuuucacuguguggguucugguauugaacacagcuccuccggcuagcaagcacccuuagacacugagcuacgacaacuagccagacuuuauccuugagagcaguuuuaggcucacagcaaaccugagagaaggggcaaaaauaucccauaugacuccuguucucacacugcaaagccuuccaauuaacaaaccucaccagagaaguacauuugugaucauagcuaaaccuaccucaaaacauuguuccgucuggagguguacauucuguggauuuagacaagcccaaguaaaugagcgcugugaaguggacuaagccaaucuaaaaagguuuuagagugaaugauuccaacuguacagcauccuggaaaauacacagccaagcaugcuuucauugcuaccuuaagauucuuuuguuguucuaaaaaacccucuuuguccuacauguuaccucuucucuucucccuccccuccccugaccuguguuccccuccccucccacucccuaccaaccucuggcaaccauuaaucuuuuuuacugccuuucugguuuggucuuuuccagauuguuguuguuguuguuuuauaauaaaauacuugaggcaggauacuuaacaaagaagucuaugacucauaguucuauagggggggucuuugggccacacuugauguggccuucuuauugacagaguuccaaggugucaagaagcagagagugccaggagguaugugugcccauccacucggugucucuccuuuaucucccaaccucugcuuauaaagccaccaagauucagucaugagaacuguccuauugaucuuaccuaacccuaaucacuucuccaaauucccauuucuaaacaaauuaauacuucaggcugagggcugaguguaccauguguaccaagacaauccuggaggacauuuaaaccauaucuaagccauaaugauauuuucuugcuugagaacuacuucuucuuaugccgaauaauaaguaucuccuuguccagaugcaucacaacuuauuaacacagcugaauggcuuaucacuuguuuccaaguuuuuggcaaugcuggauaaacacugauaacaccaaauguggcuggggacggggaggcaggaaccagaacucucagucacugccagugggaauacaaaauggcgccaauacuuugaaaggcaagacagcuugaugguaucuuauaaaacuaaugauuuugaccauacacuccagcaauuguggucuuuaguauuuacccaaagaaacuaaacacuuaugucuacacaaaaccugcguugggauaucgaggcagauuuguugaacgugucuucuguagguagagaccgcucaggaugcuuggggaauguaagcacacagcccacccuugaagaguuuucagcuuaguucuggccaggaagagauauaguucuuagaccaaggacacuuuuguucugagacaaaggugaagagacucccugaggcccagcucugcagcugcugccaucuuggaggccagugguuucuccucaugacuuugaagagcagugaaucuucagagaacacucguguucuccuucuacuggucuucugcuuaaauacuucacacagccuucuagaauuaauaugaccucaggaggguuuggaggcuccaagcugcacuagucuagggugucaaggggaggggacagugggggagggggagggggugggggguaucucucugccugagagucugcagaggauacagcagguggaucucuuguaaugagacacacagcccaaggaagucuguggugccuuuugucuaggaguuccugggaaaguguaaggucagauugaagggugagaccuugacuagcuccuaagugccagaagagugggcacugaacauacacaugcaaacgcaugcacacgcacacgugcacacugcauacacagugugacagucuugccucagccacuucauucaggccauguaacaacuccggaagguugguacccugcuguuaucguuaucccauuucauaugagaacuugccucaggccacacaguuaguaaaaggcagagacagaccuugaggcccccauucugaucacaauccugugugcuaauuccuuuccuauuacuagccuuacauuaucauuauuauuaucauuuuaaucugucagcauugucucugauuauaccauuugucagaagguuguuuuccuucuacugaaagguaacuaggccaaucucuuucuaguuuuuagcuucacauuucgugcugacccaucuggaauucauuguauguaguguauguauacauuucauuugguuuuacuuauguccucuucuuuucuucuuauguucuuuuggucacaagccaauauuacagucucccaagguagcucauguaaaaaugaauccacagcaaugaaacagaauagaaaggaaagaaggauuucgaagcaaucccaggagaggguguggacaguaggguggccagaucacacccaaaucaccguugucaggcuccauuuucuccacacaacugauuuuucauaaauauuuguugaaucaaugaagcaagcaaugguauggucuauuauccaguaaaggaggccaaaacaagccuuuuguuuggcugauagauguuugcuagaaacuagaaugacauggcaguagccaccccuaggguuccauguuugugagcuaggugucacacacacacccaagucccuaagcuacccccugcucugauucagaguucuuccucaaugguugugaccaaagggccauacaaacaucaguguguccacaugcacauauuccugggugguccuauacaucuguucuuaugaaaugucacuaaagaguauccaguaccucugacaggccuggaggguugugggucucacagaauuggccucccuugugacagaggugccauuaaggaauagccagaacggaagaucuggguucagauacuggcucugcuggagcugugugguuuaggacagauucuuagcuucucugcuauucagucucgugcucuguaaagggaagggauuugggccaagguucuuuccugcuauggaguccugcaaguggcuaaguuugucccaaggucacaaagggaauuacuggaaucacauucuuugcccccagauaaguccagguugggccuuuugauggagacauuucagaaaagaggaagccauucucaggcugcaggaggggucuuccuuuuguguuauccuggaaguaaaaucuaccauccacacccaggaagccugagagugagaauacagaggaaaaacagacaaacaggcuuccugcucacugcaggccccaucuaaggcucuuucugcuaaagccuucaguccugagcccuguucucucugcgcuguuuguugcucuuaagcaaaacgagcaguuuauuuuccuccaguuggaagcggaagguugcuuaauguaagcaauaaaguccucagcgcucuccacccuggggcccauuaacugucaagucagauccugucugaagcccaagaugcuguagcuggcucaggaugugagauagcuuggagcuuccugguaggccuucaauugcuugagcucuucgaugguccaggagucagggugagacucaugguucucacuccuuagcacgggagcgguccgugcugguacacucacauggggagcuaauuagucuucccagucuucacuguggggcucuguuugggcacugaggguuuaucagcauuccuggcuucucccagaugccaggagccucuuccuaccccagugaccacaacugguaagugucucaagaugugccaagugucccuggggacagcaucaccccaguuaagaaccacaaucuaggaguugccccuuugcgcacaggcagcuugugagcuaagagugccuuuuugaugacaauggccuuugcuucugucuuuauuuuugauucauaauaccuuagggcaugucacugggacucuguguaaccaggggcaggggacccucauuguuuguuuuccauauuagaaaauagcauaugguuguuuggagaaacuuuagaagcaacagaaaaauaaaaaucaagcguauaaaagaucucucaauuucucaaugaccuggaaaugaucacuuuucacagcagauugucuuccuaaauuuuugacuugcacaucucuucuaccccacuacacacacacacacacacacacacacacacacacacacaugcacacacauacacacacacacacacacacacacacacacacuaacccaagguuauaccuuacuaaaugauaaagugaucuuggagaguguaauuuuauuuuauguugucagugcagggguuagaacccagggccuuccauauaugaggcagucauacuacugagcuacagucccgacccuuggagaauguguuuuuuucuuuuuuucuuuuuuaaaaauuaauggagacuaauaggccaucuaagaauucgaacugugccuuguuuagucaucuggugucaguucagaaauucuuccaagcucuucuaaagacaaacugaggugacacguggugcgguaauuuuuguauacaacucugaucuuauugguauaauucuuagagaaacagaauugcugggucuaaggcuuggaacauuuucacggcaucugacacauucucaagcugccuuccagaaugguugugccauuucccacccgcagcgaauucgagccagagugggggcaaucuguacuucaaagcuuucuuugagagugaacacuucugcagaagccgaacaauuuucacauuauuuguaacacugcacaagagcacuacaaagccagguggucggcucuugcgguacagaugagucgaguguguacugacgagggaagaaggggcaaguguguuuuaguauuuuauuaucaguugauugugguaccugggguggaacccagugccucccaugcugggcagauuuucuaccacugauccauacuccuugcccacauuucaguaucagugagagaagacccaaagauaaaggcaucuauuaggucauaggaugugauagcccuuuccuguuggcuugcuuucucugaugcagacugaauaagguaugcuaacugcccuucucuaucuggucuucuggagggaccauugauuuuuuucagagacuuuguccuagacaucuuagguaucuaguuaccuacaguaggacucuaguggcccuaccgaagacuaagaaggcugcagcugagguggaguuguuuaggaguucucgcuaagucauugugucuuuccuguguccugaguuugaaugccuguggcauacccugggcaguggaguggguacaugugauacuagagaggcugugacugugcagguauaaggcaugccuuugaugucuauccagagaauguuguagcuugguauacuccucaaaugucugucucucaggaguguggucaccaggaggcuaacaaggcagguaaggaugcagcuagagaggcggguucuaagaccagaagcuuacugccuucuugucaaggaugacaaugccagguaaaaaucauagcucuagagguggauauaagagcagccuauccucacaguguuggaaggagaauggggguugccaugacagugacaggggacaauauuggagggaccauuagcuucuaacccccaguaccuuucucugguuaggggaacuaaguagcaccaucagugacaauuucagaucuaucguuggguccuuugaugcucccaguugagagaaagagguauuuagcacuuuaggguuugugcuuucaaaacuucaggaagucaagaccugaucaacauuaucuccaggggcaggagggaguccacggaguuccacaccgccugagaggauguuggggacacugugcuuugcaguuaaaggcgagggaaagcuuccuggcugcucuguggauaguagaucuggaccguuucuuuccuuuucaacuuuccauuuugaacuaauuuuagacucacaggaagguuaaaaaauaguacagagaguucuugcacacacaccccaccuacguuuccuaguauuaacaccuuacacacccauaguacacuuaucaaagcucuaagacagugguucugcaccuuccuagugcuguggcccuuuaauacaguuccucaugguguggugacccccaaccauaaaauuauuuugugguuagguuauaacuguaauuuugcuacucuucugaauugcaaugugaauaucuguguauuccaauggucuuaggcaauccccaaaggggucacaaccaacaaguugagaaccacuacucgaaggcauuaccgaggacacaauacuauuaacuaagcauggaugccuuuacagguagccauuguucuuucuggcucuccuuuguauguguuuuggucugucuuuguuuuccguggucuugcccuuuuggaagagguugaucagcuauuuggaaauaggcacgucuguuuuaggauuucuuaaugguuaugccucuuuaaaagaugaacagaaaugauuuuggguuucucgggauauuguacaaccuugaugacaaccuuggucacguggucaaucaguggcugcugccuuucuguacaguaaagugacuaucccuuuauaguuaaaaauaucuuggaggacauacuuuaaaacugugaaaauccuuuuuaucuucugacuucaggccacuaauuuuagcauccacuggugaauccugucugcaggaguuguuuucugugucugccugauugugaucuuucauugccaugggccuuccacguguacucauuguauagaaugcugugugcucucagcugugaagccaagccaaagagcucauuuuuucugaggauauuuauucauuucgugaucaagucuuacauacaugugugugugugugugugugugugugugugugcauaugugagcacauguguauggaggucagaagucaaccuuuggcaucacuccucaagagguuucuaccuuuguuuuugcuguuguuguuguguuuguuuguuuguuuguuugacagaguugcauguuggggaccuaugacucaccaauuaggauagacugucuggcuagugagcccauagauucugucuuucugucuuuacagugcuagaaucacagguguaugcuaccaugcugggcuucuugcccagguguuaaagaucaaacucagguccuuagguguguguggcaaacacuuuauggacugagcugucucuccaguccuuccgucccuccccccucccuuccucccuuccucccucccucccucccucccuccuuccuuccuuccuuccuuccuuccuuccuuccuuccuuccuuccuuccuucuucuuucuuagggccauugugaucauugugggcacacucagauaaucuaaaaucuuaauuuaaucacaucugcaaaaucuuuuuugucugguagauaaacuacucuagagguucugagaauuaggauguggacauccucauuuccuuguucuggucuccuaguuuaccgcauucugggucucuccuuauucuuuaucccacugaauuuuacucugacuguguuucuuaagucaggcuaccacaaaguagccaugugccuugagcaguggcaucugcucauuuaugaagaggcacauuuaccaccucuuauguugccacacucuguagcuagaacgggaaguuugccaguucauggugaaacugccuggaugucuccugucaucugccccaacucaaaaaaaaaaaaaaaagcgagaccaguaguucaaauaaaccugucaaacauccuggcuggacagcacucuucucuuaguccauauccaguccacucccacauccucagagugcucccuccagaauccaagcgcuucucuccaccucccccauuuugcccauggcaccgagauugcccgccugccuugcuuuaauagcaucagauugguuucugugauucuguggucuauucugaacgcagcagccagacugaccgaacaaucaaaaauaaaugagcugguggauccuucugcucugagccucacguggcuuucucucucacagagugggaugacugaaggcucacuggcgucuucuagucuguuuccucucugcucccagauacacucuucucucgagucuccuacugcaucucugugacccuccuuguuauuuucuggaucugccggacacaucuaucucaggaccuuggucuuggcuguucacucucagaaaauacuugaccuagaaaucuauauggcuugcuuccuucuuuuuuccuuuaccuuuuccguugccucccuccacgugggugauaaauuccaggucauccugucugaaacugcagcccugugccaggucuucucccucugcuucaguuucuuauuaggucuuaucaucauaaaacagcaacagaucgugugucuuauaaaucucucucuccuuuucccaggauuauaggcuccaaaagggcaaagauguuuccccugucacagcuccacuauuugaauacagcagguccuccgcaguaucugccuucauaauugagcaauauacugcccauagcuuccugagacacagucaugugcucaaugccauauacuauauauuuagguagauuaaaaagaaauucuggacaugaccuauaucuucaagcugcuuaauuuuugacuggaauuuuuuguccuuuugugugacgauaacuaguauuagcaucauaacuauaaauauguuauaaagaguauaaaguguugggaagagagguagauauuaggaacaaaugauucagacaucauuucuuauuccaagcucuuuaaagcuaguugggaugacacagaggaaaacagagguccugaauggcugaaccaaaugccacaugcgugaugcaguugcugacaggcgaccuaaggaccagaucguccacagggacgacagcuucaguguccuguucaaggucacauuuaaacuagggcaucucagaggugugguguaguuagaauaugaggugugaacgugggggaaggcaggggaugacacuagcaaagaaaguccccgaaagacggugaaggacuuuggaguuuggacuucacuguguugguagugacgagccucugaacaguauccaaagaugccguugaaugguugaaaugaucaagcucaauuuuggugaugacucaggaaggaaugaaggauggagagugguuaggacaaggcuguaggccuccaggagaaagacaauggagaucugaaguccaacagaaccuauaaggagagguagcggacugucaagcuaccuguggagugagaaguaugcuugcuuguucgagaaucauacugagguuucugacuuagggacuggaugguucccagggcauaggagggaggguagggcagguuuuggggugacaggagccauaggaugaaggaugccagguacaguaaggaugcaggagcuguaugauccugccuuugaacucugaggucucugguauugagucuauguuguuuguguagcugcgugacugucaguggcugagucuguccuuggggcugacuucugguguuccagucuagccucuccccagugcccucggcuuccacagaggugcccucagcuuccacugacaaagccaaucccgguggcagcaggaggagguguggcaccugaggaggaccuccagggcucggaagagagccagcagagagcaggaaggaggcuuugcagugccugggagccaaguucagcucagcucuauuuugggugacaacauuuacaauguuccuucacccagaaucauuccgccugccugcccgccuucgguguuuccagcugauggauucucacgccuacuuaacaacuggcuugguucaggggcuccccagcucacugauugcugcccuucagccucccuugugguucagcaggaugcccaugucccuggguagccaggaugggaaguuugcuccuuaaguguucuugggcucuucugcuugaaggaggaacucagcagcagagaaaggggguuggcgacagcgagcgaaugucagaguucaggcgcagaggugugugggcaauugacucggauuucugugcuucacuucccccagaaagaccgagcuaccgagggagaaaaugcuugauaugauaauauguuguguuuccacaucucuugucuaagaaccuccaggcucacgaucuugucccagauuacccuguucacuugauuguugggcauuucuaggucauguuuaaagcucuguagauagaaagcaugggagagacaaaugccauucuuuucuaauuaaaaacuuaagaucauuauacacucgcuguagacaauacaugagagcacaagggaaaaagggaaaaauggucccuagugccauugcuuggcgagaacuggggcuggugguuccacuucucuugccacucucuuucccauuuugggggguauguguauucuucugggcacauaggcauuuaugcggcuuguauacaugucagcuuuccccggguucccuggggauguguauagcucucgaagcucagcacaggggccgggcuuggccuuuaaucccagcacucgggaggcagaggcaggcggauuucugaguucaaggucagccuggucuacaaagugaguuccaggacagcuagggcuauacagagaaacccugucucaaaauccaaagaagaagaaggaggaggaggaggaggaggaggaggaggaggaggaggaggaggaggaggaggaggaggaggaggaaggagaaggagaaggagaaggaaaaggaggagaaggagaaggagaaggagaaggagaagaagaagaagaagcagcucagcacagguguguuuuccccaugaaaucugagugaucaccccccagugcccuccuccuccuguuucaagaggggacuuacacuccaggagggcuugaggcugggaggaggucaguguagguugagugcgguugagggagacaguuuucccuccuagacuauggccucaaaaaaacagcagagggcuagcaaagaguuagcaaagagggcuaagggugugguucagugggagagugcuuucccagaauuccauugggggagcaaggggcuagggaaagagggggggagggaagggagaggugggagcauuuuuuagucacuguuggauagggaaacaugggugagguuugccacugacuugagugaagagccaggaaguaauuggagagucaaaggcaauccuuaccuagacguuccaaagcaacuuaguauccauugggggaaaaaaugccaagucaccaucaagcuuucgggccagugccuaaggaacagauucuuuacugaugguuugauuugaguuuggcugaaaagcaagauugauacaauguuugagacaguuuaagaaaguccaggaagaaggaugagggagcagugugugugcaugggagcaaaacagagaagggggacucaccacucucuuaagcuuccuacuaugcacgcuguucacuccgaacuucuggaagccaugugacaggcaggcuguguggcauugucugccucucucucugaaagcaggcuagaccccucucauucauacugcacacuguccuggagugucacagaagccuacagguacuaggcuggguaugugugacccucaaaaaggagcugagucugcacucacacaggcggccuugcuggaggagaagacggaccagaggaugugcagcugagggcagagauuucugcucucccuuagagcuucuaagcccuuccuugcauuuacugguuugagcaagcuguugucauugucucuguugcuccucuccauucccuguuccuguaucucacuggucuuauccauguuuuacauaacagucucuuuaucugccuccgcaugguaggugguccauguuuuccaccaaaucuaaaacuccaacacaauucuuaucucaggaugcuuuuguugucaugaaccaguaccccaccccuuugggcugggagccucucccucugugaacucccaaguccugcugcucuggucacgucagaaguagaagccagacuuguagagucagagaggaugagagacaggggugaggcaggcugcuggaauagucuuuaguuuggagauaaaacagauucugugugacuccagguuguguuugcucucagaauacccugaugcagguuucccaaguccccaagguagacagauggcugucccucaggggcuuucuuucuuggcuuugacuuugguguggauagguaagcacaacaggggcauuuuuguagcccucuggcauuuucagaaucauguucuuaccuaguagcuuuucuguaggcaguaaugagaccgggucucucgguuuucuaggauagagaccucaggcuccaagagggcaggugcuuaauccaauauacgccaucuuccacaggugacagagagugagacucucggccuccucacuuucagauuaggguucuugucuugugacuccacacuuuuucccugcucauaccacaggaauagaguaccuuguucugccccgaccugggauguacagccagaugaagguccuguggagggaauguaacgucauccugcuguuucucucugugucaaagggagcaccugacucacagacucaugcuuuacccagagggacaguccucaaaccacugagggcugaccuugucccgcucaccugguggagcccaggaaccacugagcgagggaaacaucuauccugaguccacaggcugagggcaggaggcuugggagcucugcuaagccaagcucucgugcucguuuuccugggaacgggcugcauacccagccuggugagguucuacaugaggguaucuucacugacuacugagccuuggcucugggggccgcuucuaucuauuucugugcuuuggcagaugaugccccauauggcagagucagcccugccacgucugucuuagccuggcauuaggcaaugguaucuucccuucaccugccaggaaggccuguuuuguugaccuuuguucucugcuccccuuucaugaaaaagcaugugaacuauuguuuggagacgaaggcagcuuccugcaagccuuagauagagccugcguuggcagacaugugucagaugucuucauaagaucaacuguucauuccugcugcucucuuaguauuacucagagcuuugaugguuuagaccaaggagacaaggccagggcaaaggcacagugcugggguguaguaaagccacgggacaggcaaaggaaaguugcuguguuuccuuuucuuuagucccagagacuaucauuaaauccuaaaguuagaaccuccccaccacuaccacaaacuugccauuaagcuuuuaaaugaaauaauuuaggcuauuuguugagugcuaaucaaaugugccauagaacccaauguguucucuaacauagaguaucuuaugguguagcuggagaggaaggggcugaugauggggaaggcaaguuuaagcgcuagagggaggcgcacauuuuaucaagcaggaugucaguacauuuggacuugagggaacacacuuuggaucagucuggucuagagaagcuucagggaaaaaaaugguacaucagccaugccccuguagggaugugaacuuucuucaugguaggugccauagguugcugccacagagugggaaauuaaugaacacaugccagcagcaagagcauuaggggacaggguuaucagggugcuagggacaggguuacuagggugcugggaacaggguuacuagcguacuggggacaggguuauuuggcucuuaguagucaucacaguauuguucaucaugcuaauauugcccaaauagcaguguugggacauugaucaaguagacuguggcucucuggcuuccucucauugugaaauggcacguggccaccacauaccacuuucaugacaucugaaaauagucauaagaaauuuuuuguuagaaaaaaaaaucagguccccaaaacaguauguacugucugaguguguuuguauuuguuaaugugguccugugcuggguccugggcuggaaagaugagcaucaguuaagagcacuuguugaucuugcagaggaccucgguuuaguucucagcacucacaugcaguucacaaauaucuauaacuucaguucuagggggucugcccuccuucucucauccucaggcaccagcaugcacuugucauacacacauucauguggacaaaacacuuggauauauaaucuaaaauaaauaagucuaaaaaauuaauuuuuuucuuucuguuuucugauuuuuucuacauuucacuaacuuguaaguaauugacuuuugaugauuucuugucuuucuaauaaaaaggauuagaacgauuuaguggaacacuccaguggaaacacaaggcuccuuacucaccuuggucuuuggcaaugggaauauuggguagucugcuuacuccucaucugaggaccgggcugggggcagcuucuaagagaacacuccucauugucagaagcugcacacaucccaggcaauggcagaggggguggauuguccugucuacacaaggaaaaccccauuucuugauauuuuucauuucaguugggaacucgcugcugcccacuuucugcuacagugccggacagacagaggugucuauccagccugagccucucuggaagguuaggagagugacagaguccaucuuucacauuagugggggugagggcaggcucucuguucccugaaaagcuuucagaugaccacuuggucuagacucugucugccugggagucacugucaucugaaugucacaucgggacauuugggugcuuccuuuucugucccuuucagcagggcugagauuaauguguacuauguucuaauuugaaugcucauuaguauuuuuagacuacccccuuuaucacacauuuccaaaaucuaaaaccgcucaucucuccucauugcuucuaggcucauguccagacagccugcaucugagguuguucacuuuccgauggucucuuucccacccuguucagacacuugccuccugcagcucauucaugccaacccacuaggcuuacugcucccugaaaacaucugccuccugaugcuugggcaccccuccagccacccccauacugccuuuauucccuguaugaaacccaguugcucuugcuggccaucuggagucuuuucucccagggucccccugaaccucucuuuuccccccaagagaucucacaggggucagccucuguagacuaacaucuguuccauucuauccuuuaguuuugcauuuaaaaaugauagggguguagaggguugacucaguugauguaguguuuacugcauaagcauaagggcccgaguuuggaucuccagcaccaguguagggugggguacaaaaacgucaaucagcacuggaggggacagagacagguagagaucccuggaucucacggccagccagccuagaugaaugggcaagcuccagguucagugagagaaaagcauaaagaagagagcagcuguagaugacacugacuucaaccucuggccucugggcauacuuacucacucacacacacacaugaacacauaugccacacacacacugaaaauauuguguuucuguaucauguugaccaagaaccacuuuuaggcaucauucaguaguguucagucuaugcaucugucagacacuacaucucuaggacucucaucuugugaaaaugaugcucuguaccccugagaucacagcucucuauuuugcuuuauuugguguuuugucagggauuguguugugauauugcuuggguugagcuguucucuacagucagcguucagugagccccaguguucuggggagguuguagguagauccuaggggagugugaagaaagccaccaaacaagugauaauuguuaucaguaagaguuuuccuuuucaucugggugugcugauaugugcguguaaucccaucacuuggaggcugagacaggaggcucaugaauugaaggccagccuaagcuacauagcgagaccauaucucaaaaaaacugaauccccaaguaccccuucucccggugaucccuuuucguuuguguauguuucaugucccuacauagaugacguaacagugaccuucuuaugaaccacaaugccuuuuuuggaacaaggcagaguaaagugacuacguacaggcagauuuagaccuuggcuuccugguuauaccagcuaggggugagcaugcucccuguguguuacuggauaauuacaugugcugcuguaaaugagcacuugggcuauuuggggagucugaguucuuucaacuagauaauaccuuuagaaaagggaagaccaauuuuucaccaugguaagguuaauucccuuuuauuuucuuacaauauaacaugugucuauucaaaaaggaaauauguauagguauauguaaauguauauguaucaauccaaagcagaaaacagaaaagaccuaauguagauaugaguguuuuguuucguuuguuuuguuuuuagagacaggguuucucuguauaguccuggcuguccuggaacucacuuuguagaccaggcuggccucaaacucagaaauccgccugccucugccucgaggugcugggauuaaaggcaugcaccaacacgaccagcugaguguuuuguuuuugcaauagggucucacuauauagcccuggcuggcuuaaaacucuucuacaugaccaggcuggcuucaacucacagagaucugccugucucugcuuccagaguacugggauugaaagcaucggccaccaugccuauuagaguuguuuguuuuguuuuuuauuuguuuugcuuuauuuugagucagggucuugcucuguaguccagguuggcccugaacuugauauauaguccaggcuggccugcuucaacuccugacccuccuguagcagccaguccccagagaggcacuacagauauguuuuuagaaauacaaucauaucauggauguacacuuauuuuauuggguuacuaugaccugacuguauuuacuuaucaauagagauauuccuauaauaucauuuugagagaacaaagauuuaucaaggggcugugacugugccaggcaccaauuucagaauggagaauaaaucaaugaaaaggacuugcauaauacuuaccuuguggauucagguaagauaauaggucaauaugcagacucuugauaaggguuauuaaaaacagaugguaugagacuaacuaggguacauuuuagaaguucuguuagaagacagaaacuuuuuguuuguuuuuguauuuuuggagauacggucuuacugugguaagccaggcuggccucaaacuugcaauuauccugucuccaccucucgagugccaggauucuugaaguguaccaccuaacucugcaaggaaggaaaauucaaccucccaucauucaggccuuaaugaugggacaaagaccagagggacagauguuccagcaggaggcaaccagcaguggcugcacagcccggagcuugcacacaagcuugacaagacugaggaaauaagacagccacugugacuaagauugagagagagagagaagaccaucagaagccaucgcaaaggaacauguagguaggaccuuugauggaguccugugagaacucucguaaugcguucaaagcuugggagguuuauuacuacuacuauuauuauuauuauuaaauuuuuauuaacuuuauguccuucucacugcccccucccugucacccaccucccacaacacuuccccugcccccuucucuugagugggugggcacccccuugguaucccccccaccauggcacuuaaagucucugugaggcuaggcucuucuacucccauugaggccagacaaggcaguucaacuagaagaacauaucccacauacagcuuuugagauggccccauucuaguuguuugggaccuacaugaagaccaagcugcacaucugcuacauauaugugcggaggccuagauccugcccauguauguauuuugguuggugguuuagacucugagagccucaagguccagguuaguuaacucuguuggucuuucuguggaguuucuauccucuuuggggccagcuauccuuccuccuauucuuuuguaagaguccccaaacuucauccacuguuugucuguggguauuuguuucugucugagucagcugcuggguggagcuucuuagaggacgacaugcuccuguaugcaagcauaacagaauaucauuauuaauuagggauugguuccugcccaugggauaguucuuaaguugggcuaguuauugguugaccauucccucggucucugcuccauaaccuguauuucuuguagacaggauaaauuucggguugaaaguucgguggguaguuuggugucucuacugcuccacugggguucuugccuggcuccaagagguguccucuucagguuccauauccccaauguagugaguuacaucuaaggucauccccauugauucuuggucaccuaaagcuugggaguuuuauccuaagucucugagaaggcacuagaggagaauggcaugaucugguguguuuuaggaagauuguccuucauaagugucacuuauacuacuaauaaauuaaaagaggaacauaccccuauguacauaaucaccucauuaguuuuaaaagaaagucaacaccugugaugauggcuauucuuaguugucaacuugacuacauguggaaauaacuaaaacccaaguggcugggcgcaccuguguaggaugcuuuuuuaguuaauuggaucauuugaggucagaagacucacccuauauuggggccacacaugcugccggcugccuauauaaggacaugggagaaagacaccuuugcucuuugcuugcuuacccuccaucucaauggccuguucacuccuucacugguauuagagccuacuucuuuggcaguaugacuauacuaaaccauauguugggauucugacauauacugagacauccagccucacggacugaacaacuaagagauucuugaauuuucuacuggaagauagcugugguuuggugaacuggauaagacucuguaagcuacuuuuaaaaaaauguccuuuuauauauagagagaguuaucaguucuguuccuuuagagaacccugacuaauacaauauccuaauaagagaaauaucacaggauuucaugaaacagauugcuagaggaggaaaaaugaagauuggugguggggugcggcuggcugacagaucagaaaagcaaaaauguauaugaagaauuugcuaaguugggucauaguguuaagccaggaaaucuggugagcagggacuaugcauggggaagggcgggguuugaggcuugcuuuguggcugauuuuaucuccuuuuguggcugcuggcaccaggauaauaacuuuauaaaaaugauguugcuuucuauauuucugucauuugguuugugaaaaacuuuaaaaaucaacaaccauuuaugacaaagcagggcauauaggaacuuccuaaccaaguaagagugacuguaaaugccagagcugggcuggguuagaucgcugggagagcacuugccuagcacgugugaagcccuaccuuucauuuccagcaccacaagagcaaugaaccaaauccacuggguuagauaucuucucagacggggauacuggaggugacaggagagaagcagggaugccccgucaucugcuucaaucccgcaucaccggaaccacucuccuugaguuggaguuuugcuuucauagcuuuagcuacucagucaauaaucaugcaaaaauauuaaagggagaauuccagaagugaauaucucauuuuuagauuacucucuguguacuguuauaauuguuccauuuuauucuuaguuacuucucggugccugguuuauaacuuaaacaugaucauagaaauguauaugcaugggagaaaacacagaaugugcaugcauauauguauauuuuauuuauaaaauaaauauauauguggcuuggcacugcuauuuguaguuuuaggcaucuguugggguucuuggaacacagccuccacagagagagagaauggcuacauuuucacaggaaaaccgcaaacaacauaaaauuauucaaaaauaaaaggagacucuggcuacuuaacuugaaauaacauggguauuuuaaaaguauuuuucauucuagauaccuauugcuaguggcuucucuaaaauggggggguguuacagaaagcuuaaagaaaggcacaugcaaaauauugaggaaaugaaacauuugagcucaaucccaacagcacaugcacaagucuuuuaugcagagagaagcugcacguucauuaggguauuuagaaaaaaaauaagaaacaggcagagacaacucauuaagaagaagaauauuuuaguuuguaaaugaauacacauucuauaauuggcccauuuuaacauagaguuucuaccgaucuaguguuuuguggaaccugacuggaauuucuaaaguuccgagaaagcaaaaaaaaacaagccuagagggacaggccuugccuacugagcucgagggcuguuagccuggaggacaggagacuacagcaggugacacaaucgggauaucaaaccagcaaggagaugauaaauggaacugggaaaaguuacacucaacaaaugugaaauuggaugccugcguaccuucugucuggauagcaaccccagauggcuuaaguauuaaaauauuuuuuuuaaucccacaacuuugaaacucacuaauagaaaauaugguguuaucuuccaagaauuugagaagggaacuauuuuuaaauaagauucagaaauauuaacuacaaaaacaaaaaaaccugacaagcuuggccacauuaauaguaagaacuucuauaaauccaaagauagcuuuacaaaaaauaaaaggaagcuggacugcgguggcacgugccuuucaccccagcacucuggagggagggacaggcagcucugugaguucaaggacaaccagagccacauagaaagacccuguuucaaaacacugagggagagagagagagagagagagagagauuaccuauagacuaggacaaaagcuuucuuugggucuuuuucuucuguuuguuuuugucugugcggugcagugcauuuuugucuucuaaacagagacagaaaggguguggaucuggauggcggcgagaaggacgugggaggaguuggggugaggggaaaccauagucagaauauaucguaucaaaaaccuauuucuaguucaaaaaaaaaaauacauaagaaacaacauuggcaaauaagaaaagcaugaacaaucuaauugaaaaaaguuugagauuaauuuuuuaaaauguggggccagugggauagcccagugugugaagggacugcuaccaaacuugcugacuugauuuaaucugcugggaucuacgaagcagaaagggaaaacuaacuccccaaagcuauccucuggccuucaugcuuccuaaccuauaguaagaauuaaauaaaauaaaaaggguuuuaaaaauuaaaaaaauacagccaggcgugguggcucacgucuuuaaucccagcacucgggaggcagaggcagaagaauuucugcguucgaggccagcuuggucuacaagugaguuucaggacagccaggacuauacagggaaacccugucucgaaaaacaacaaaaauaauaaaauauuaagaggcauucagcaccauguuucuagcuagcaagagucacaguuaaugggacuuucaguaccguuugagaggcagaacuuaaaacagcuuaauaaaaugaaacguuuguaagaaaguggaacucugcaacaaugcuuagaagagcuacaaacugggagcgaucagaaacaaggucaagcaugaacaacauaaacaccuucccuuccuaugugaggagcacacacagccaugucccaagcccuaacuguaugugagagcugcuggcuagauuagaucugcaacacaguaucacggcauggacugugacaacgacaaugggacaucauggcaguucuuguuuauuauuuuauuuuaugugcauuggugugaggaugucagauccccuggagcuggaguuacagacagcugugaacugucguguggguaccaggaauugaaccuggguccguugggagagcagccagugcucuuaaccucugagacaccucuacagggucugggcuauuauggcaguuuaaaugaaguaugguuuuauucagugacauccacacaucuuaguaaauacugagcucaaaaauacuccacaacacacuguauacucuuaucauauucagacaacuuacauagacaaaauaggaauacuucagaauuuguauauaugaaauaauugcauuuaaaagaaaugaguguuccuaaugaugguggccugccaugggaggaaguaagauuacgaggaagaggaggcuaaaggguggcugcauaugcauuuaaaacaaguagcuagcuagcccugccagccagcuaaguagacaguucuggcugcuaugggaaagauggauagaagguguaaaagcaaagcagguugagcaguggggagguuguucuguaauccaggggaggggguggugccuuauacccagaggguggcugcugagggaggaguaauggacggagucaggaugcaugcuggaggcaguagagaacuuguucugauagcuuggaugugggagguaagaaauguucuauuuugugaaacugccagaauuuauuuaacaauaugcuccaauuguauauccagauuguuuacgauauuuucugcuccauaagaaggucuaaaaugaacauuccugcagcuuaaucuucaugccgccugaauuaauuucgcuccuguuuugugguaugaguuuggcuuuuacuuucuuuuauuuugcuuugugugugugugugugugugugugugugugugugugcgcgcgcgcgcguguguguacgcacgugugcaugcgugcgugcgcgugugugauguguuuuagagaagguucagguuuauugcuaacucuaagguucgaggaaggugcggagaccuggccccccccaccccucuccccuuguguagacucucuccccuuguguagacucucuccucuuguguagacucucuccccuuuucaaccucuccccagcacugcagaguguuuauuacacagaugaacccacacugaucaacaccaccccaaguucauaguuuacauccagauucacguguuuaacgucuacagguaaaguccagcacuugugucgggcacagccucguaugaucgauugcauggccuugcaaagcaucagugcaccgcugcucaccccuucccccaacccuugucucuauagguugccuuucucaggccaccacauaguuagaauuguagugcagaaccuuuccagaucggcuucuuuuacuuaggagcuaauguguguuuguguuuucccuauuucuuuccuugauaguuuuuuuuuucuuuuuugauagucaugcuacguagcucuugauggccucacuauauagaucaggauagccuugaacuugaacuuguugugaucuuuccugccucugcuuucaugucacuuuagcacuggauacuguaccgagguccagcuguuccauggcuccguuauccauucacuauugaugguugugcaagcuuacaacuucacagagccucuaguaugauagccaccgaccuuggaggggaaccauuuaaguucaucaagaacaaguaaaacuaaggacugggaagauggcucagaggguaaagcacuuugcuuccaggcccgaaggaccugaguuugaucucugggacccaugugguggaaggacagaaggacugacucccacaaguuguccucuggccucugcacacacaccaugagugugcaugcacucgaauguguagaauguuuaaauggagacgucugaccaucaguucacgucgcuucucaaccuaugccacugcagcuuucccacaauccacuguuccagcagugggaccaugaagucacuuguacacccuacaugcacacagugcgaggcuuugccuggguuagcagugguccugaggaagaaugcugaccugcagcaagauguucaaauucuccaucuuuaguuacuucccauggccuguuucuucuuguguaucauaaggauaagcgauucuuuugucuuuauguuuucagauaagagggugcacacgggugucaaagcucuggauucuguauucucucugcuaacuuggaucuggggucagcaaccuccuauguuuucaucccaccuggguccagacccugcugugagaagccaugacuuaaauaauagugccuggagccccaaaugaguuccagucuuggcuuguacugugacucaugggaugagucccugaaagucauuucccuucuccucccaaugggucaucagaaguagaagaaggauaauggcccugagucaccucucaaaaaggagcuaauuagggcucacugaggcagaggugugagccgaaaagacaaaggaagaaaguagucuacguaggaccuggggaaccucuggaauuuugcacuguaggaggguccaaaguuaucuccacauucuggggaguauaguuauucccaaaacuucugaaucacugccuccgaaguuuuaauucuuugguccuuuggguucugagggaaaggggaauuaacagccuuccuguuacugaagguaaaggaggcugggaguguuccccaagaagccagaaguccuagagugagggccuggucuguuaaugaucgucuuccauugcccaguacucucaggcucuggaggcugaggugaaaggcuuucugccuccugcaugccucucauugcuuggccccaagucggcuccuucagcugugugugguuggugucagugugguacauccuggaacaugagguggguguacaggcacuaugucggguccaaguuuccagguucaaagggaucaugacuaaggcaaaggggaacuguuauucaugaaugcucuaugagagcacauagaccgugugccuauaugcuuauaggcugcaucucagaacaccuggaccucauccgaaugacacccuaagucacuucaugaccuugguugucaccucaccucucugugcuuauuguaucaucuauaaaguggaccuucccuaaauuccaacaguggcuauugugagaaauaagaauaaauuucacaaaauuuaugugcauuucuuguuuuguuuugucuugggacagggucuuucuauguagaccaggcuggccuaaaacucacagagaucuuccugcccuugccuuuugagugcugggauuaaaggugugagccaucauguccaacuguguauuuaaaaguaaguauucuuuguaggaaacaagaaauagggagaugacuuacaauuucaccgggucuaaguuuagucucuuuauguuuuuguaacuuaccuucccgaucauuccuccacaccucuucgcucuuucugcuagaccccgacauucuuuuuuguucuuuaaaaaaaaaaaagaguuauuuauuuauuuauuuauuauauguaaguacacuguagcugucuucagacaccccagaagagggcaucagaucucauuacggaugguugugagccaccaugugguugcugggauuugaacucaugaccuucaggagaacagucagugcucuuaaccgcugagccaucucuccagcucuugacauucuuauuguuuuacuuucucaucuuguaucacagucacacacacucaugaagcugauuguucuuaagcaaauucauuuaaccacuaaugaugucucaucauuuaaaggaaccaaaauuuauuuaauaaauccccaagaguaugccauuuguguguugcucccaaauauuuuauugguguaaauaaugcuauguugaaaaccuuagauucauugcucucacuuuauaauaaacacuuagagcugagguuacaggaccagagugcaaagguaauauugucaaauacuuuaauacacacgguugccuuggggcaggacacugcugagagucacaacacauacuugcccauucucugggaguguaaacccuuacaggccugcgguaguuguggcaugucuguuugucugagguacuuguggccuugauccugggacaaguagugagaauaugaacucugccagugcaauggaauuagugucagcuucccuguuggugccuggaaaaccaaucacuuauggcaagaaaauuuuggugagggaggucagggaguuuaguuugguaaagcauuacuuuuaaagacgaagggcugaagguauagcucaagggaagagcguauguuuagcauguuugaagggccuggguuugguuccuaucagacauggacacauaugcgcgcgcacacacacacacacacacacacacacacacacacacgagacuagagaaaugauucgguaauuaagagcaguaacuguucuaacagaggucccuaguccaauucccaacacuuacauaguggcucacaaccaucuguaauggggucuucugcccucuucuggugugcagauauacuugcagacaaagcaccaaauacauaaauaaauauuggggggagaguggcucauuugugaguugacaaguucaucuggccucacucuccaaaauuauucuaaaacauacauauaugugugugugcauguauauguauauaucuguauauaugcauguauacauguguguacauauauaugcauguacacacauacauacauacauacacaggaaugguauugaaugccuuggaucaauccucacauauuucuuccaaauccagggcuguggaaaugaggaagagacuauuuggaaccaugugcuugcccccaagggugugaccaacacaagacucaagaaggaaugccuuuaagaguggcuccucccuaucuacagcacauucuguuuaugacacccagugucauaaacagugugcuacugagcugccagggagggcuaauccccuagugaacugggcuuggccuggcagcaaugggagccaacucacuaaagcgaugugggagaggcaagagggagaagcacugggaagggcacggacccuuguguggucagugucucuuggaggcaaaucauucucuggccuugggcaagauuccuccuucaccagcuaugacuacauugacgaugugaaugucugguuuucagagccuagcauuugcccacuggaccaaggaaccacaaaguacauggagggguggaaguggaaguauaauguaauacuaccuggaaguuguaaagcaguaauuacuuggaaagaaauaaagaauuacugacauuuuaugaucucuccucugagccagaacagaaaggacuccaaucuggucccaguucuccaagcacugagaauucacaauacgggacuuccugguaccucuguggcugucuaagcauucacgaucugguugacgagacuuaauaaugugcccaguguacagcacgagcugcuccaggaacgcuggguggugugguacaggccaggcugcuggggaacuaagaaaagacagagguugguguaggcugagugaaugcagcagacagugaacugggccccgagccccuggaggcucagauguauccuaggaaacgggcaggaguggaagacagcaucuaccuuuaguagaugggaacucgguguguggcuggaccagggcacagagggaaggcagacacacuggagccugccuucagucccaugcagaggaguuaguuaguccugacuguggagcgaagggcuuuggaagcagccgagcuguggggaaguuugaggagcaggcuucauuggcaacucuaauuggauucugaauucuuuccuucugccuuccgaggaagccuccuuaagccugccaggccucagcugagaguugagcuucagggucccaagcaaacucaggggcauaugcagccuugggguuacugucaaccacauccuucucccgaaaccuuuuuaaauacccacucuccccguuuagguuaacaggcuaggaggaccaggacuacagucauugagagcuugcuuccugcuggacacuaggaugaacaagacuccagcucacagccuggaagggccagauuaaaggggucaaacagcucuuucccuagcagagagcccuuaacaauguacaggugcgggcgcagggggagauagcucccaaucccuggaugucugaagcucuaaguggaauugaccucuuccuuuuaaaauuaagugugcauguaugcuuguguguguguauacgugagugaaugagugugugugugugugugugugugugugugugugugugugugugugugugugugucagagaacagccugcgggagcugguucuccccuuccacuauguggguccuaugacucaaacgcagguugucaggcuugguggcaaguggcuuuaucugcagagccaucucaucaucccacacucccuuauucuggagagaauccagguguuugugucuaggauagaaccagaacuucagccacgcuauucgaagccagcuggacacuuaacaccacuccucccccacucucgccuucuuccaugaagauaaggagaaagacagggccagaagaccaggaguuacagauccuaagagcuccaugggagagauggaggcggggagggcaauggcuacugggaaaacccucccucccaaauggcugugagagugagcaggcuccguucuucugauuucuagcuuuaggucuaagcuucaucuguggagaaugcaugaagagauggcauggugggagcacccacuuuuguccuccuggucuguagaucucucagcagcagcucugugcguggcuccaaagcuggcucuguccacccugacuccugcugacgguguucuucaucagucacaccacaggaagcccuuccuggagagcuguugcuacuguagacaccuuuccugcucuucacagcuacacuacaccccaggagcccaggcuuagcaucuccaccugcuugcggccuuccccucucaauugcagaaaccuuucucuguacagccaggcucucuguauggaguacugaagucaaaggaagcugggguuucaacuauuugggacccagaaguggaagcggggagaguccccaggguaaaggaaccacucagugaguguagaggaguggggguuggguuaacgcuagaaggaaggaacagagaaagaaacugaguggaacauuccauguuggggucaaacuguagaguugucugcacagacauuauuauucuauucuuuuguccagggcucagugggcuuggagaugcuguguggugagugacagguugauucucuugccuuuaccccacucccuuacuagggacuagugggugugggguagagugucuguccuggggggggggcacaagccagacuuggguguugaacugaauguauuugucugcucauucuuaaugccaagguuugagguccaaucacaagaaguucugaaagucagccucagaaagaacagcacagggugcagaauagaugccuaugcugaugcagcaaacauccuggggacuaggaccaacucccucagagagcuaggccuggaagcucucuugauuggaagcaggccaccugugcugacaagagccagggaaggccgggagugccccauuugaaugucccuagcccccagggcugccauggucuccccagggaggaagacaguguuguagcugucaucacuaaacccauucuccugcgaugaugagagaguuugaggaaggaagaggcaucaagaaacagaaaugucaggagauguggcuuucuauggaaucucaagggccagaauuuguuucuggcuuucccaauuuucuuaacuuuccaaaauauuuucacaaucuguucuauauuacuaauaaaaaaucaccuugaagucuagugacuuaaaccuucgcugucucgcacucucagugcaucuggaaugcaggugcaacuuagcuggguacuuuggcuccagggucacuguggacacagucacacuuaucaccuggaacugcaguccucugggccaaaggcacugcuuuccagagcauccaugcauuguuggcaaacuucagaagacccacuucuagccaggacaguucccuugagccucuucccagaccuuccuuaaaguauaaugacuagcauuccugggacaacugcucuaagauggaggcuuguuggcuuguccaucuaaacuuuagacaugacaucccaucagcucuccuccaagaggaggugauuacacaagaacauagauuaucccagcuuaucuuagagacugccuacuuaccccauacuuugacuacacaauaaucugugcucuaggcuggaagaauugauuccaagaauauuguuuuccauuacuauagcaaaauaccugagacuggguaugcuauaaagcaaugagguuuacuugguucaugguuuaagagccaaacauaaaaaaauagcauagcgccaguucugacuuccuggcagcauuccaauauggugaguugcaggcaucauggcaaaaccauguggaaacgagggaagaacacaagaggggacaggaaguaggcuucuuaacaucaccauucuggggaccaaauuuccuugggguggcaguggcacaugaaaguuaaaggggaaagguguuguagaaaggugaggggcugagcucaggaccacaaagcaaaccacggugccuggcugcagguuuaguaguuucugagaugucuccguguagucuaaccuaugaucuguugauauuugugcuuguaaacuauugcugauugaagaucaggagcuuugaugcaggcugacucccugugugaugcuuucuggguaguuccagauccccaggaacaaggcuuagaaccauuucugcauaugacaaggacugauuuacucucauaauuugggguucaggcuggcuucugauccucuagcagccagggaugaccuugaacccuugauccuucugucuccauuuuccaaaugcugggaucauaggugugugacacagcgccuggucuuucaacucuuuuuuuuuuccuuuuuuuuaaauuagguauuuuccucguuuacauuuccaaugcuaucccaaaagucccccauacccaccacccucaacucauuuuuaaauaaacgucucauuucauuuauuuauuuacuuaguuauuuugguuugucuauuuuuguuuguuuguuugcuugcuugcuuauuuauuuauguauuuugaggcaaggucucacuguguagcgcuagcuggccuggaacuuccuauguaguccaggcuggccuugaacuaauagagauucgucugccucuucuucccaagugcugagaucaaagguguguagcaccaugcccagggaaacuuauuucuaaagcuucagguuuacagauaaauugcaagaaaaaaguucaaagaguuuucauuuaucccaaccuacuuuucucuggugugagcacuuuaccugagugugguccauuuguuacaauuaacaaaccaauauugguguugcuaggaacagaagccuagucucaaaucagauuucccuauucguccuguguaaaaacaaaucaaagugaacuccauguuguuugaugugcuuguuguuguuguuguuguuguuacuuuuuugguuuuguuugacagagaaagaacuugaaguuagguggauagggagguggaaaaggaccuaggaggacuugagggagguggggaggacuuguguagacuuggaggagggaaaagaauauaaucaaaauauauauauuguguguguauauauauauauauauauauacacacaaacaguccugucuuuuaggguuggccuuaguagugucucccuuuuacagaagaggagagggaggcagagggggauuaaguaacuuaucaagaucacagaagcaaagacagugaccugugccccgggcagcccgcugaaccagucuccuccucgcuucugcucugagcccggcuuauggugugcacacaggcaccaagccaauuguggcucugugcuuccuccuccuucaaccccaugcuucucugagaagcugcacgguuggauugaugccuuugugucucuccuaacucugucuuucugucuguuccacugcccuguccagagacucugggggcuguucugaggaaaguuguuuccuucuagaaagugguaacaaggcuucggagaccucaggugauuguccagagcauugggcagaggugacuagcccagaacaguacccaguauaccugggauccuggacaccagggauggguaauugaaccugccccuccauuaaaggaagaguaugggggugggacguccaggcuucucaugauggcacccugggugccugucaggauguucucugggucuuucucuuuguuugauucacuuacccuuguucccacuagaagguacagcaucagaggaagaggauuugauuuggguuacaaauccuuugcuggucaauugaccaagugauucccaaagaguugagaauaaggaggugcagggacuggaugugacugggggugacaugggcauucauauucaugauagacauuuacaacacacaugugagugagagagugcacaugucugcguguguacacacacacacacacacacacacacacacacacacacacagaggccgcuugugcacugguguugaagaacccucuuuuccagagguggguuggcuguaagcccacacaguggccgacggcccacauacaggccaggaaauggguuuuccauauccagggaacauugauugccucugaauagccauucuguggucuuccuccuguggguuuagggaggaaguggccuacaucuguggacuggaaacagagguuccuaaaguaagagagcauugcacgagccacagaaagcugcugucccuaacccuggugcugagaacaguuggugcugaggccaggaugcaggaacacaugguuucugagucugcauuucaugugaagagcagaaugaaggccugguaccagucuagaggaagucaggaugcugaaauuuuaauucaaugaguucugacuuguaggaaaauaacuuauaaaaucuuacuaucaaaauaugcugucgggcggugguggcacaggccuuuaaccccagcauuugugaggcagaggcagguggauuucugaguucgaggccagccuggucuacaaagugaguuccaggacagccagggcuacacagagaaaccuugucuugaaaaaaaaaaaaaaacaacaacaacaacaaaaugcuauagagacccugucucaaacaaacaaacaaaugauuuaaaaaaaaaaaaaagcugggcagugguggcacacaccuuuauucccagcacucaggaagcagagacucucugaguucaaagccagccuguacacggugaguuccaggacagccagaucuguuauauagccugucucaaaaaaacaacaaauaaauauaauauaauauaauauaauauaauauaauauaauauaauaugcaauuuaggggccagugagauggaucagugguuaauucugguaaccugaguuugcucucuuaagcccacauaaagguggaaggagggaacccauucuauaugguugcucugugaccucccugugcuugacauaucauccauaccccuccacacauacauuguacauacacacucauauuaauuaauuaauuagguaaguaaacuuguauuuaaagauauaauuuugacuuuaguugaauaucuaucuuuuuucuacucucaguccacgggcucccuaccauuuaauggcccacauggccguugaugauauauucaugugcugguaacuuauuuaaauuccuaucuuugcuggucuaguagcuucuccucuucuucuaacuugaaguggcccauuuguuuugcacuguaaguacuucuuguguaauucuuaaaguguuuaaaagcaaaaucuaggagcuguuugcaggaccuagauaucccaagucgagggucuuuuuuuucccccauaacaagauaaccugaggcuggauacccuauaaagaagagagguuuauuuagcccagugugagauuuccccugagcauagcacaggcacguccuugguuaggcugccgcagcaguauggcaggugaugucauggucagaucauaugcaagauagagcuaucagcuaucgaaacaggaagcagggagugaggugaagccaguccugaacuuuccuaacuuuuucucucaggaacuauuaaaggccccuugagaagcacguuauucucuucuaacagcaacacccucaaugaccucauaccccugagacaggggcucacucuuuagcccagcucaguguggacucucagucuugcugcucagccuuggauggugcugggauuguaagugugagcuaccucgaccaguuucaccuccccaccccaugaugacauugcagaccaagguauccaaaacaaauauuugggggacacccuguucacugcucucaaggcacagcuuucccuucuugcuagguagggauccuuccauuagggagggagggagggagggagggagggggagagagagagagagagagagagagagagagaggugcaagaagggauguuagaucuguuaacguuuuucugaugauuauuguggaugagagacaagaagccaagcaauugaagugagacuauuuggaagugugugugugugugugugugugugugugugugugugugugugugucugucugucugucugucugucugucugucuaaacuauaagauuauuucuccuuaaugaggccuuuaauccacuagagcaaacagagcugaggaggcuuggaugucuaggaauccauuccuauuuuuucucccccauucaccccaacacugagacgggguuuuucuguguagcccuagcuauccuggaacuugucaaggcuagccucaaacucaagaaauccaccugccucuccucccaagcaccggaauuaaaggugugugucacaugccuggcuauacuuuguuaagaaguauuuuuucaagaacuuuuaauuacacacaaaaaaauacuuaauauagaguaguuagagauaugggcuggagagagagaugguugguugguuaagagccucucacagccaaccuguaacucuaguuuuagggaugugucacccucuucuggcccuuauaggcauugcacacacauggugcaaaaacauaaacacagacaaaacaugcauauacaauaaaaauuuaaaaauaauuuuucaaaaguauaugggaaacacuuucuaugacaauagcugugucuuuaugccaucauuuaaaaggcaacacgguguuucauugaauacagguguaacauuucaaugguuuguuacuagaaauuugguuuccuggcuugugucgugcugguuuuacuccuagauaaagcucuuagcacacaguauuaccuagagggugacuuccagggugggacugaagacgcuaaagacaagcacauucuaagcuuugacaccugcugcucagcacacuugagaaagccuguggauuggagcuuucccgcuggucugugagcgcuuaauucacuuuuacgagucggucgcacaaaaugcgcuccuuuuucguucucuuugauuaucucucagguggaacaugcucacgagcuuucuccuuggcacuuuguguuucugucuugucucugcccauuuugcuauugaaggauuucuuugucucauugucauuuggcacauuuccuaacacgccagagccguuaaccuuuauuuugcagaacguugaguacaguccuggcuuacugucugggcucaguuuugugacgucccguaacagugaggcucuguauaaauuccacguaguaaacaguucaauguuuccuuuccguuucccuuuugagcuguauuuagaaagacuuuucuauucuuauguuaugcaaacauuucaacagaacguucuggcacuugauuuaacauuuacgucguuuaaccacccacgguucguuuaacggcuccauagguauggugucucaaacauugcuuguuaugucugugcaauuguuggguacauuuuuuuuuucuuaaugugaaaugucacuuaccaucuuguguaugugcaguaggugacguugcuguagguucuggagcucugagugugccuuuuguuaaacauuucacuugucucuugguucugcauuauguuccauccaugcguuuacucugccgccagccucacacuuuguuucuagugcggugcugcugggcugcucaggucagccucgagcuggucucaucgugucccccccccccccuugcccaagucucccacauaucuaggacuguuagguuuuguuuguuuguuuguuuuuuuccuuuuuggcaucacugugacuggaacccaaagccuuuuacacagugggcaagugcucugccacugagcucugaguauaccuucaucuggaacgucucuucgucaauauuuuucuuggcuauuuccuuaaauuuacucuucccagauggcugugagacuuagugacucucgugguuuuucguuuguuuguuuguuuguuuguuuguuuguuuuagagguuucccucauuaacacucaguucucuuuucauucacacuccuccuccacauucauuuuuuuauuuacuuauuuauugucuguaugugugcauguggcuucggucgguucucucuuacagccauguggguccugaggacaaagccuuuacuguccgggcugccucagugucuuagccacucaugucuuucucuuuguuucuucuaacauauuucuaaugguagcgccuacauacuucauacugacuuuauuucuacccuucuguuucuuuugauaguguuaauagucgcuguguuuucauuacuucuuauugucuguuguucacauacauggaagcuuuggggacauuuacguuucauuuuguaacccaagagcaaaaugcugucuucuguuuuuuuuuuuuuuuuuuuuuuuuccuccuucugugguuugugccaaaggcauguuugaccuaauuugaggcuguucaauuuucuucuggguuugggccacggcuccuccccgucauugccugucauuguagcaaggagguuggaaaaagaaugacaccucagccagcuccgugucagcugcuucuggagggcagacaugauguggaucaaaccucaaguccugcugcuuagguaacaggggagggaccuaccgccuugugaaaauggguacacgaaucaaagcggacgcaggcaggguuauaauagaggaggucaggcguucagaugaagcucauacgaaaaggaaccuuaaggaagugcuugaaggucucaaaagccaccagguuggucucuggguugguucuguagacaggacuaaauaacuccccucucccauguagaagaaacugaaguugaagaaauagacuccuggacaguggccucuucuaaaagcagaaggguugauuaauuuucaaagcuuacaagagaaacaaacaaacaaacaaacaaaaaggggaagaaacguugcuuauagggaccggauauaucuagucuaaagcaggugcacuuuggcaaagccuuauggguaaugcaaaguaggacucaccgucaggcuuaugcauucgacuuuggcugaguguaaagcuuagcgcccgcacuugucacugagcuccagcccugguggacguccccacaugagcgcccucugcaccccucuucuccccagugcuuccugugacagcaccaucucucccuucuuugcuuucuaaucuuucaugugcaggcuccaugcuugaaagcagauagccccagaggagagaauccaccugccagcagacacaggauccgaauaguuagggaaaagcauggacagauggaagaauggacaugggaugcuagucucauagaaugugagccaagugagccucaccugcgugcugcggugcuuggcccugguacccauccuguggcaguuggggcaucgcucugggcuugcuaaucauaugaaggucaccuccuggaguuuuauugauauggcuucaaaaguccggccaugagcccagaccuuacccgguguccacaccgguggauuuccacuguucccucccuuucaucacuaaaccacauggacaucuacucuguuuugaagccuuccauagaaggaaacaccccagccuugcuugguguuuuauucccauguuuuggaccaucguguucccagaacauucuauuuuauaguuggccuacucuucuugcaauauaaagcuauuaucuucuggcauggacuagagguuguggagcaguaagacaccucuuuuuguguagcccuucaggaaguugaaaggguauuaagaucgccuuugaacuuuugccagcacaauuagguuaaaaauaauacuuguaaagugagggguacgguaccuggcacauaguaaaaagagcuuguuuuuuuuuuucuuaacuacuguuauuuauauuauuauuccuugaucgugguaacacacauacacugcaaucucacuuaacaucauauacugagucgagguauggaauuguucaaaggaguguaagaaaggcauacaaaacucacccuauucuuauuggagagaaugugcaaucuaaauuaaaggcguucggggaugggcuaggggcuggagaugagcuacuaaccucugaaagcuuugagggugagagucauaucuugcucguccaguugccugccuaccacagggucgauugaaucacuguuuguaacgguaaguaugcuguugcggcaucucaucauuggauggggcauggauccuugcguagacauugacucuauagcaucucugauaaccaggaaccuuccugggaugcaccgguuacucagcagccaucuccucucaaaagcugucagagggucuaaguaggaugcucuuuccauggagacagauguucucucccuccggucacuucggucuucugucuuccccuuugagccaugccuagugaauuuaguccuucuuuuguacacagccuccagaguuguaguaugcccacccccaagcucauguguuagaaacuugccccugauauaagaguguaacugucacaggcuaacaaccucaccgauguguuaccaagcaaguuccgucuccucucaucucagacacucuuucauauuucugccuucugccaugcaguuuaggcacgggcagcacucaggacccucagucuuggguugucuguauuccaaaacgacaagaaaucagcaccugcucuuuauaaaucacccacuacugccauccuguaauaacaacauaaaaugguccaagacagcccuucagaccuuuaaggccucuggcauucccuucuucuuccugccaaagucagaauuugcuucuggaacacuauagaaaacguugucaggacccaaacagauuuguaaaauucuguguguuggcccuaaucuuggaagguguaaauuagagccagccuuucccaguacagcagaagagcaaaguauacuuugugggaccacaagaagcuagcgcagucucugaaccucugaucaguuguuccuccuccucaguguaagccaguccagcagugagcccuucccaggucccagucacuugcugcugucuuuggacagugcaguauaguguucaagggucuagcuuggagcuugaccacugggauuuguaucuuagcucugcugguuaaaaucuuccugauuccauuucuuccccugcaaaaugguuuuaacaccacuaccuuugaagggcuuaaauuaguugguucauauaaacaugcagcacucgcauguaaaaaaaaacaauaaauauuaacuaucguugcaaauauuaccaguauuagaaucgaaucugugcuuacuccugcuaugaggacuuuuauagaaauuucugccucgacuccucugugaccccccuguguaaugauuuguguucaugucugucacucagcagacugggggcaauccuugggaaagggucauuucucauucuuuuuuuuuuauuacauauuuuccucaauuacauuuccaaugcuaucccaaaagucccccauacccuccccccacuccccuacccacccauucccacuuuuuggcccuggcguuccccuguacuggggcauauaaaguuugcaaguccaaugggccucucuuuccagugauagccaacuaggccaucuuuugauacauaugcagcuagagucaagagcuccgggguacugguuaguucauaauguuguuccaccuauaggguugcagaucucuuuagcuccuugguuacuuucucuagcuccuccauugggggcccugugauccauccaauagcugacugugagcauccacuuauguguuugcuaggccccucauuucucauucuuauuuuggcuuucucaccuagcaggcuuggggcaaguaauuucacuucugcauguucucaugugcaaggcaagaggaauaacauguaccucucugaguuauguaaggguuaaaggagaugacauacacgaaugauuugguaaagaugagagagagagagagagagagagagagagagagagcgagagagagagagaacuucucuagcuaaaccaaccucuguaacauauucuccucaugacagucacacugccuugaauacauagcaaguguuucugaguauuugguuagguggaggcauggacauugaguggguuacccuaugcuuagaaugcacacuguaucacacgaauaggcuuuguuuuccucaugaacuagagucacaaccuugcacauuacaaccuuccuacuauaauguagaguaggaagccuccuagagguuguugaggagcuaagccuggcuccucacucgcuauuggagagcuacaaaccccucugcccugaauuuccaccagguggcaggauauuaccuacuugucucugagagcaccucuugcaucuucauucuucuuccaccagguggcgcugcaagcugcaguucagauccugcucagccuccuccuccccccccccccaagcccccaauacaugcgccccuagcugaaggcgaagggaaagccccuucagcucuaggagcuucuggaggcuggggguggggugggguggggugggguguccaguuuacccuaagagcacuuugugcuucugcugccccgggacagugacagagcuugauucucgguggcccugcgggcuguggucuguguaaauaauuauaguguagcucuuaagaguguuauacagacauccugagagcaucacucuguggaaagucucccaaugcacauggcugacugaugcucagcccuccugcccuucuaggguccugcauuuccaaacccaacuuuugcugccuuuccugcugcucacuucagcagggaucugccagguuccucccuuugugggaucaagccaguucagggaaggcuggaagaggagaacaaaguucuaguuccuccagucucuucucaguggggaugauguucaaauucugcaccacuccacacaagguuuucccaacucagagccccucucccagagucagcgucugucucuucuucaucuuaguccugagaaucucuuuugugcagugaccccuuucuuccuauaauuuacuuuagcugcucacauucuuccuucuaaucugacagauacaugacucuggagccagaagaagucccaguuagcaaaaggugaucaggccaaaccugaaugcuuacuagcaagucagaagucauuccuuguggggccucaggguuaacaaaaccuccuccauuggggcaaaguccuggaagggaccugagcgauccuggggccccauucauuuuguuuuggggugggagucagggagaaaucagggcccagauugaaggcauucccaaagcuacccaguuggucagcacacagaugugggugaaaugucuccacgucucuggugaccagccuugcauucuaagugucucucugccucucaucgucccaccuggacgccagcugcccuccucuggucccacaccgcaguagcaucugcaucagcuuuugcugugugaccuuugcccaccuguggccauccuuaggcugcagaagaguggagaaagaaaagcaagcuuuguacuacauuugggugacucuuggggggcagcauguguguauacugagggcacuugucaaggcucuccauucuucugugggcucaggaggagcccaggucugagcaacauagagagugugauagauuaucccuggagugaagguacugagaacccaggaaagaggcuagcauccuuggcucagcaucacucuaaucuccucucgggcacacccacugaccggaccucuauggcugugcucuggggcucgcacaugacugucaucccaggucucugucauccccugggugcacuugaaggcaaagugugggcagccaucuguugauugaacucacuuagacaggcugagggccugccuggcuccacccggaccuccuuuggaguagcacccauauccuuccucuaugcuagggauggaaggacucaucaccgugcucccaagcagagugcucuggcuucucuuaagcaccaagggaaguucuagcuuacaaacuuagucccuuaacuuucugacuagaagaccuucaagaacccagaacagcauuccagacuaucuagguccucugugcucuuucccagucccccccccacuccgggcccucuggacgcucucuccugcuguacucgagccacaugcucucucacuucuggaaacgacuuccuuuuuuuacagaacccucuuuucucccccuaucuuagcuggcuaauucauucucuuccucggggcucaucuugggugguaguggugguggugucccucuucugggaaggguucucacucucuaaguccagccaggucuucuguucaugccucugugguaguacuaguuguuagcauuucccaaaacuuccuucucgaggggacaucuggaaggaaggggccaacaauccgcuuauuuuaggguagcauccucaguuuccugucauguaauugggugccaggagacuugcagguuguggggugagaagaagguguguccacacuguugaagagcuuccugcccucgcucaucugggucaucugggucuucagguuccucacuccuccuguguuugcagcauuguaucaguucuguggugagggaccacucauaucucaaccagcaaauguuacugagucauucauacaugccgaaggcuaugguggcacuggagauccaagacuuggucccugaauucauggugcuuccaggcuaaccauugaaauaaauaagcaagcaaaucugaaagcaaugucuuauguuuuaugcugugugcccagaaaggaagagaaugagcugcuguagagcgaucuacaacuuugccccuauguuccucuuuucugguggcuagcucaccucuuucccugcgugggccuuuagccacuacauucacaucuccaaugucuuuaucucaguuccuguucugaucucagcaaaaguggcauccugagagccuugcuuaucauggcaucuguccaccugaggcaaggggcucuccuaccuggucuggagaagccuggguggagacguaguucuugcuucucuguaccaaugaagaccuucagcagggccaggggucaucaucgacacaucacaguccuucugucugggauccuggcuaugugaauguucagcccccguuuuacacauuggcccuccgcaguucuagucugaaggggucugcgagcuaccgggaacugacacugccaucacugucaaguacaacugggacacucugcccuuuggccuggucugaggcuggagaauuccagcuuccagcuguacuggcaguucugccuucuacuccuggcaacuauggucuucauggaaaaucuguggcuucuguuaggagaccaugacguggagggagcggguguugggugaacucggacagggguucucuuccaugacagccugggccaugcuaccuguucuuacccaccccuggcacagugucccuucggcacuuacacaggcucuuagagggaucaagggaggcaugugcuaaccugugcccagggcuuggggagguugugguggcuccaggugguaaguuuagagggccagccugaccaugagagguuccuaucgugauggcaagauuccuguccuagggcagugcugaugugcugacgugucuacugccaucagcuauccugguaccugaguaucaaggcaccuuuguucccccuucaguugggacaggauaccagcagcaggcuccugguggccuaaggccagccacucuccucuuucucagggcaguucaguggugucuccugacaguugacacaaaccaucccuguuggcacaguguggcuucuuuugacucagggcuaaaugggcugagcuucagaacgaaguccacaggaagaguugagaaaggccuccccgagcucguggacuagacaggacucgccaauucauuagugccagaaagaggguggagcuggggguucugaaguugcucccgcuccccacaccccagccacaugagccuggagacccucugauucaggaugguaauaucagcauccuuuguuccccgagccuguucauagaugcuuguucccagaguccuagcgccccaccccacccccaaagcgugcaugugauaauguuugugccuagggaaaagggcauguuuacggcccuuuuuggaaaugugugauuugagugcaugugcuugugauuaugugucugagcuucagggaguuuguguccuggaggucucugugagggcuggcaggcugcgacgugggcuuaaugaugcuguggugcuaaagugguuaccugugugugaguguguccggcuguguugcugcaugugaccagucucuccagggcuaccucuguauggagaggaagaacacaccagagacugcguuaggagaauccaccaucaccucccagccaccucccuugaccucuuccucucgcuccuccuccuucucccaaccuagccuugaccuggaggugcauggaggaaagaagacccuaacaaggcuuugugaucagugauccugccagaucuggggaaugggcaugaccgggcuugucagaggagcgaucaccuggguagaacacagacaggccagcuccuggagcagagccccucuuuacuccuuguucuuuuuguccuggcuuggaaauaauagguuuuucaaucugagauuaggagaaaagggaacagccagaaaagugaccgguuugaacaaaggcaagcugcuggacuggacaaccuccccucucccccauacucucacccccggggccaucaaguguccucagcuguggagagacaacauguggggugggggcacaguggggaauauucaaggccaccaggccuagggagaagggaaugaauguaguaagagcagguaggaggguggucuuuacagugagccagugcagacagacuccacaccugcuugugguauuucccagccaggcuacaccucuuggaggcucgcucuccucccuggaaccuacagggugguuguaaggaccagguaccaggggaaaaaugcgcacgaagcauuuggcuuggugccuggcacaugcugugcagaaaugaugcccaagugggcagggcucggcuccuuuccuguauguggacaugggaaugaugauaagcaggaauuccagggggaggggggaugagccuuagcuggcugcagaauccacccucuuuaaccagagaaccuggcagugaugccagucugguuagcaggggcuuccugaugccugccugcccuuuaugugcgcuuuguguagacgugaauuuuuuguguggaagguuacuugaggaaagaagagacuguuuguuuguuuguuugugacagaguuucucuguguaucccuggcuguucuggaacucgcucuacagacuucucucguacucacagagcuccaacugccuuugccucccaagugcugggauuaaaaguguggucuugagucccauguuuuuaaaguaagaauuuggccuaagaguaucucugggcugaacuggacaguggcuacuaccaugucuacuuggcuaaaugaagucagugguguuagggucuucuguuggaucaguuuugcagaggccagugacggcgugucuagaaaucacacauuugguuuuucaucugucauguauggaacacccaguagguguuaccauucuuacucuggaggacugggaccuggagagaaaggaacuggugagaauguuucugaaggagaggagucaaagcgggcagcugaggugaccucaagguacagcgagggcguucccaggacacgaggauggacgggagcuucuuaggaacucagaaggagggguucuggcuagaucagaaucauaaauauuuggcaguagaagacagcagggaagaaaggagggagagaaggaggaaggaggagaaaauaaaauaagaaaagacaaaagagagggaccgcagcaggaggcaggcuuccugccuugguuggacauagucagaaccugucaggcagagguggggcagaugaccgcacaaggaccccuccacgccuggcgucuggaaaacuccacuggcuuggcugcugcugacuuacucuauggccuugggcagaugacuaagcacuaaugagccucaguuucccucccuguuaaacaggguugcuuacaugcuuuaacuucggggagcucuggggauguggugugcugacuucuggccuucaccuccacuccugccaggugugcucuccuuugcacagggucucaaagcacagccugccaucaugccgccauugcuccccaccucuuacacucugugggagcugaucugagaugccaacuucuugcuucuuccauguucuuguuccuauuaacucccuuucuagaauguucucucuggguuucuccaagggaaacaugaugaguuccaugaugacccugggacagcuccucucuugcugcaguuuugguuuuuuccuccuccuuucuuucccaucauccagugucugucuccaggacugcuuucuacuuucuacgugucucuauacuauuccuaauucuuuaguuuaaagcacucggugucugccauagguucugacacaggggguuagcaacauugguggaaggacuaauagaggcugaauuuggggagcuggaggcuagggaagaaacaugcuaagaucaagggcuaguucuuggaaccagaaaaaaagucaacacgcuaaggauauaguucagugauagagugugcuuagcuuaguguauccgaggcuauggaugagaggaagaugugccaugcgucuuaccagccagcucuccucccuaccccauggccuguucuuuguaccagucaggaaaacaagaguacuugguagaggagauauugugagaagccagggggcauuugacuagggcugccuuggcuugugucacacugggaucuaagauggauuaguuugugugucccuaagccagugccaaggucaggacagacaccguuacaggucuggucuggccugagcugccaaggagagagcucuucuacaaccuggggacagacugguaucagguauacuuugcuucuccuucugcuuccuguccccaccagggcacaggggccucugcccuucucaucguacgcagcagggauggcccagcaagcccuucuggaguagggcuuauguguaaaauccucccuucucuggucggccucccauuagaugcuccccagggaggagagaccugaagccucugagcagauguggaggucacagaaggguccagccccaugcuggccagcccuuucugguugcuguccuuaggcugagagggaggaagggccuggcuuggggggcaguguuuauucuucuguucuaagacuauggcugcuacauguuuacaacaggcuugacuguccucuggagugguaugucacaugacagggcuggagucuggauccuuacaggaggccgagcauggagcaagagguagagaacuucccaggagcuccucacagggagaagaaaguugcuggagccuaggccaugguagaugcacccauguguggucacagggcagaugagggcaccaccgggcccuucucccuugaccacaaacccauucagcaccuucacuccccagaccagggccuagaacuguaaacagccugagucagagcuaggcagugcuuacgagcgugcuccuucuguccucacugcuaauagcagcagcuugucuggcugcugggaccuuucauccaggccccucaaagagcuuaaaggagcagcccaggguucuauuaucuuccuauuacuaauggagaaaucaagccccaggcgagcuuggcgacuguuucagggcucacagaggaggcagcacaaacaaggcuuggaauggacaugucacaggaucuggggccacuugaacucuccugugucccugaccauacuacuugcaaggagagagucuagcccagaauuggugcggggaaguucuguccaacucaggucaugccugagcuuuuagguggccacuugcuuaaucuuucccacuuaaguugccaguacugaacacauaauaacaaguagccccugcuccaggauacgcagcacuuacuauggguccagagacaugggcugcuauauuucacuuaccaacgaaggaacugagauggugagagugugaguccagacucaaacccacaagucugaugcuguaguuuguucuauuuugagacaggccuuuucuguguacuucaagcuggccacaacucacacuccccugccucagcuuucugaguacugggauuaaggcacucauggcugugccuggcuacugguauaguuauauucugaaccaaacccagcacagacuccuuguacuauagacagagcuccccugauaccuugacccucucccuuguaggagcugauccgaggagugaggccccagaaguuauggcccuaaccucggucaucauggcagauucaugagacagucucuggugcuuccaagacugggauucaaagccagaguacaacauccaacccuaagcagcaacggcccaagagcguugucuggaggaccuaggagcaggguuaggauggaaaauauguugcuugcugagagacugcuaccucugcuuccgagacagggaugagaccucuguggucugguuugucuccuguacaaguccacauccucucacccacagugcccagagaccccgcccuacccagauacacuagaguuggagaugauaaccugcuaggagccaggucaggggucuggcaaugcugaagcuuguugcaggacccagggaaagucacccaggccacagguuagucuguuuccccuguggaagaugagaaugcuaauccaucgcuaacaucucugguguucagcucugugcucgguuccuggacccuggauuccugaacgaagcauccucugagagaugccauggaacaucaugaacaggaagggggcagguagcucggauagugcaaacugaucagaggagggucaacggccauuucuguuacauauuucagcuguuuguaacuuuuagcaaaguucaugguuuggagauuauuauuuuuggucauuuuuuccauauuuggcuguggccuagagcaaugaguuuuggaaagauagaggcaaaaaucccuucagcuguuaguaagcacuacaacacccacacacacucacacacaaaauucuuuccaguuagaagaaauaacaacauaguuauguuuucuuuuucagcucaaaugacucccaaacaacuccaaagacuucaaacuuggcuaguaauuagugcuuaauaaaggaggccggacaguaugugcucugcacuuugagaaucaaaagguuucaaauucgaaaacuuacugaugcaugaaaaaaaccuccaaggccacagccccuagcagccccuuccuggggacgcuggagcugaccccacccuguucuguccagagucauucaagagcaaggugacuacagcuuugcagaccggcucugucuuuccuuccccacucuagaauacucugcuggauccucagcuggaggccgaggcuagccagagauggagacaggcuuggugugucugaggugaauuaaacugcacuuucagaagcuuggguuggugucccugucccagagaacuucaggaggcaccuuaaaguccuagacuagaggaauucuuuuauagucuauagaguguagaaggacuccaucucucagaccaguccuuggggccugucuucuguugucuaacccuugaaagcccuucuuggauuguuucuuuggugauauuuuaccugcuuuccccaggagaccccugaggaggaugggccaucucuccacuacucuucugcuuuuaccuaggaaagaggccucuucacucagagucucaaggcagggaugaccgggguaacuuuggcgggggauuuggaaugggauagagcauugguucucaaccucuggguugugacucccuugggggccaaugacccuuucaggggccgaauaucagauaugcugcauaucagauauuuacauuaugauuuguaacuguagcaagauuacagugaugauguaagaacaaaaauaguuuuaugguugaggggucaccacaacaugaggagcuguauuuaaaggucacagcauuaggaagguugagaaccacuggaauagaaagaguauucugaauggucacaacacuagagcccugcugccuaauaucuauguuggagguccaggguccuuccuccaugacccuggcagaccucuccugggcugacugaauacaagaccagggaucugacuugccuucugcucucaggaccuuguguauguguaggugcacacauacacacaaaccuacacaaacacccacucuagauauuugacaggggggauuagugaccugcucauuuccauaucuucugaacaagaaaauauacugauugugggguggaucaaaaccagguacaagaaagcauuuagucaacauuaagaauccugcagccuggggcuguguagccagagagaggugugcagguaagaagaccaacagaaagagacagacaagacccugccagcuaagagggcugaggauggaccccaggcuuguccaucaggcaaugccaagaugucauuuucucacaucugguuccacaucuggaaacagccaggaugcuuauuucaaagugcugaugaggccaugccccgauugccucaaggagaaauccauuuggugacacugucucccaggccaaucaucuccuccagaugguggcccgguuuccagcuucccucccugggcgcacccacuguacaggaggcuagagagagcuagagggcagcugguuggagggacgccuuguccagacccuuugucaggcucuagaagcuuugaucuauuugcaguucuugcugaucaguggcuggccuccccuccugucuuggaacuuguauggucuguugggauuguggcacuugcuguccagaugccgcagucuuugcaucugauggcuacguggccccuguuccuggccuaagcccuuggcuggugaaucugagauaguacaucaagagaggccaauccucucccaccucccaucacuaagaauuagccacguucuaucuugugggcugacaugcccuccucacaccucacagcagauggaaccagcaauccaacacccagggagagaugugcuggcggccauggaggaugcuagagaggcagcaacucugcccuugaggaguuuagcauugcgaggcugggaggggcucuagggucugaggaugccugagucauacacuucacaaaugguacugucuggaaaugcaaugucagagggaggagaggcuacagucaggacucaggacaguuucccuggagagaugcuucuggacagggcaggaggggcuugaaaccuccugaggugcuucaguuccuaucguaugcaauguguucauaccagggcuggauaucacaggcugccaguagagcuuccugcaugaugugaguggauggagcgaggaugcugcugagaaucccacguuuccuuuucuuucugcuuaacucuuuacuagcucccuccggagucagcucucaugggcccugccuuucucucccugcccuagggucaauuuccucuuugacgacagcccaccucggcaaggcagcuccaguguuguagguaggagacaggguaccccaucguuucucuacagagcaaggcuuggagugagcaguucauucccacuguguguguggcuggaagauggccaggcucccauccuccacacgguacagagaacucuucugacaccucaaaggcccuccugcucugcucucaccuccucuuccuaagaugugugcagugucaugucaucaggcagguaguuagcugcucauuugcuuucuaccucgaugaaagagguacgagaaaaggcucaggguuacuaucuccugcuugucaaggcugacagcgugaaaguuagugacccaagguacgcauaguacaugucaacguugagugccauggcuccucacgacucccuaauacccugcccaaugucuugauccaaauuacaaagccaauggggguccuuccaagccugccugagcgucccucuuccucucagucuauuccugaucuacuuggucuuaugaggguuugcacauccaaacccugcccuucuguccggaccuuggcucccgcugaucucccaccccaccccugccuugcucuguuuuccucagccuccagguccccacuugucugucaccucuuccaagaacucuucccugcccuucaguguugacuugccucugcacuuuaagaccaauacuugcaaaaccccucuggcagccauccuugauugcgucuccauccugauuguaagcccucugaggggaauaccccuccuuccuccucucuccccugcucucuagcagagggccuggcaucacgugagugcccgacagagacguuggaauuaaagugagacgagcuggcaaaggcaggcaggggggcaaugugugguggacgacacucaugaugggcagcaggugaaggguagggaauagaacaguaacaaccccaaagucucagguccaugguguucuaggcuccguuccaagcaguucucauuuuguccuuacaaaaauccuacguggcggucacuauuccuguccaguuuuacaggugagugaaauguaagagaaaaaucacaaugaguugagagagacaaaagacauucuggguuguuuuuuuauugguuuuuuuuuuuuuaaaguucaugagcaaugauguggaaggacuuggcaggauaucuguggggagaguagcuggacauggggauggcuuggguuagagaaccaugggaggaggacgugaugauguccagcuugcaaagccacagaggacguuuacacugagcccagaagugcaauucaguugagauguggaaaagucauggccaguuccugagcaggaaguugguaggauggauggaauccagccauaucgugauagaugaauuaggagagagagcaggcagaacugccaggagggugugggcaucgucuccccgcccccacugguccucaggcuauuugaauucuucuuccuccgaugccuucugugggugcugacacgggugacccugggaccccagagcuggacugcaacugcaggucuccuggggccucagcugcaucuuucuggcuuggcugaggaugguugcucauggcugugaccaugaccugggcugggcuggauuucucccucucggccacuuuaaugaaaagcaguuguauuuaccaggaacuuguaagaggagaggggagaaaaucaguugagucccuggccccauguaggucucucaucccucucugggucucuuucuuccccugcucccaaguccuccaucuuucuuccugguuaucagccuuacugcccuccauucugauggauucuuccaggcucugugggcuuuuagagcagggaagcugccuggguagggauggggccacaggcaccucaaugccucuggcugggcuccuuagcacagcuucucacucccucccuucuuuaugcuagcagaugagagacuugggcuguauaugcuuugagguacuugugguccccaugugauauaucugucuuucucugucucuguuucugucucucucugucuaucaccaucucuaucucugacucugucucuguuuuucugucucucugucucugucuguuucugucucuaucucucuccaucaccaucucucucuaccuuugacucugucuuucugucucugccucucugucugucucucuguuuccucuuagccccagcuuuucagggaccagggacguucuuaugccgaacagagcuucauugcccuuucuuuucucauuaucuaggcaaacucuugcccaucuuuugagacuggacauccuccagggggccuccugugacaacccugccuaucaguguugcugagaagguuggcuugccagcccuuccuccccgaaauauacaugcauccacuguccucaggcaguaagacagacaccuucaagguccuuguuuggggccucuggguuuucucuggcugguugucuccagauggggguggacauagcuuggaagagaaggaacagucuagugcuuucccagcuggaagcauccagaguaccugguuggcuuggagccuugagcagcucacuccacagugcaggggcuacacucccaguuaaaccuugacucuucaggagcacauaggcuucuggcacccaccaucaagugcuauaccggacuccccucgacagcccaccccuauuccagaaagcacaucagucagaggccacugacaaccucaucagggguuguuuucuucucuccacacugaggcuuuuuuuuuuuuaaugacaauguugauggugcacauauuccagaguaauauguuuaggauuaggccacacaaugggguuaugacucccuccugugcagcccucacccaggggagcuugcccuccaucuggccaauacacaucuggaucaggcucacagcugaccagauguugcaucccucuaaacuuaguuaggcuugcagccucuucaccuagagggcuggagcugcaugcaugcacuugcacacgugcacacacacacacacacacacacacacacacagagagagagagagagagagagagagagagagagagagagagagagaucacuccauuggagcacugaagcacugaggucaucuggcccuuggagggggaggggaggggagcuagcuuggccuugaccacuauuccuccuccaccaugguagggcaagcaggcuguugggacacuucugcggagguauguaaauaucagguucccugcuuccagcccagacaggcuaaugggaaggacuugcuugaaaccaggcuccaaaucuggagccugucccuaccucauccaggggccagcugcaagaaucagcaaauuccuuguauacucauuugggggaugcucugaggcccugggccaccccaguucucccugcucacgcugaguccuucucugcaaccaccuuuuuccccacgcugccucauuuucuucccucccuuugcccaccuuccacagaguugugugguuuaaaggauauacaguauggagccugggcucuggacccucaaauaauugagacaugaucugccaaguuuguuugcccauuggugcuggcaagaagccgggcagggaguguggaggaggaaaaggaagccacauuuauugggugccaacuaugugucaagcacugcgcaaggugcuuuaaauauguuaucuuggcuaauccuuggaaccacccugcaagguagauauuauucucuuuguuuuacgcacgccacaaguguggcucagcacggucgcccugguguaccaugguugggagggggcagaacuagcaucucaaacgaaguucacuuggcuccaacugucaugcucuugugauaugccaccuccccuggugacugcuacaagcuacccaucagguccucuuuccuggccacuggcugugagcuuugucuugcuccuucaagcugggcagggaagaacggccuggcaagguccaaacugguaggcaagggacaacaagaggacugaaguugugguguuguaaccaacugaguuuuccgcauggcuguuuggagggccuggggacuugaagccgcagaaacacauuaggaguugagaaagcagggcggcuucggugaaaggcaggcagacgagccuuggaggcaaucuguggggaacuugggaguuuuccaugggucugggacacaaggaaccucauuaggaaaggaagaagggagccacagagcccagcugcuauuguucccuuaucuugccaucagcccucccagcauauggaacauuccaaggacccucuaggggccccucuucugacuauagaaugugguacccccagagaggcauugggggguagaaagguaccuuccggccuggccaugacugaccagguccccacggcagcuccagaaugugguugcuuugcaggggaggacagugagagccuuacucccaguuccaauuacagagcccagaugcacacagacacauggacccacacaaacccaugccaacaccuugcccauauccauacaaacacugguguguaucugucugcuucaaucaaagcuguucucuuagagacgacaugcaaacacaagacuuuccuagucccacaaaaccagcaggaaucugucuucuucuucugcacccggagcuuagcacagaccagaaagguggcaggagacagacacaguauagaccuggaagucagcuuggauagacugaaagccagcucugccccugcaguguggcauuaccuuggagccaugcucuucucuucaagaacuaugagcuggccaugaagacuagagacagugggcaggaugcuggcuagcaugguggcuaggaaaagggccaggaaguagguaggaacagugauagcgauaaccaaaaugaugucacaauuaccuguggaggaggcauuccggaugacuauucuguccagguuagguauuccuggaaguccagagcugaacuucuuucccacugccaaagaaggguugguugacaucagaaacccugaagugggauaugaccacaugucagagugagauuguguggaccauagccagcucuggcacacagagacaguuggccccaggaaggaggcaacuguggguacaagaaucugcaggagggaaugaucaccuagggauggcccccugaaaaaaaauggcucacaaggccuaucuuucccccaauuuuggguguaugauacccagcagggacucacauguaugugugcauguguacauaugugagguaggccugaguucagugucaaguauuauucucuauagcucuucugccuuauuuuacucauagacagggucucucauucaaauccagaguucccagauacccugaaucuuccugaccagcuuuuucucagaacugucuaucugucuccuucuucugaagcuggaaucacagacacgaugucacagccaccugagauuucauauggguucugagauucugaggcccguuccucaugcuuuagccgcugagcugucugucuccuuaguucaugagggauauguggagaugcuccuaagacucccagcaccugggagguuucugcuucacgagaagcuaggacucggaugcaucugggcagagagcucuugcuuagccuauggaagacaguguguucuguccccagccacauccucacgcacgcacacacagagcacagcuuaucguccuccagaguucgaaugcccagcaucccguggccgcuucgagagacuggcagauccucuaacacucuacugaggugcauuuaagcggaucugccaaggaagaagccagcguuggcuguguguguucccugguguugggaguuuguucuggugcauggcucacuccagcugaccuuucaggagauauauuagaaguguugaaaucaagccuggcuccagugcagcgcuacccgagggagcccggaauucuguuucuccuaaucuacuaaugacucuuugaaguaguucuuuuuagucagauucccuuaggaagagucuggaacaccauucucucgacagauuuucccaucucuuccuuacagacacuuugcucccagcugcuuauugcuacuuagacagaaacaggagccacggacaaauggagcaauucuagcugcccauggggugaccucguuucuugagcagucccuaguccaggccucaagggcguguguaacuucuugcguguuuugcucuaaaacccaacgugagcagagcuguuaugauggaagucagugccuguaaacacuugaauguggucagauaccccacaaggucuguguguguguaugugugugugugugugugugugugugugugugugugugugugugugugugugagaaggagauugaauccagggccucaagcaugccagacaacuacucugccaaugaacuauauuccuagcccuccuuuuuuauuuuuauuuuuauuuuuauuuuugcuuuugcuuuuacauuuaagagagggaauuucucaggcuagucuugaacuugugauccuucugucucagcuucccauuaaggucugagccauuaggcucagccaaguguggcuuuuggaggagguauggucuccauguugcacagcagucauauggguccauucuuuagcauaagaugcuacucuaagucaucuguuauuaaaauagaagcagagaagggaaaaaugacauuuagguaagauggaccagaaugugggcaggcuuaaaaaauuuuauauucauuuaguguauaugagugugaguguguacauguauauguauguauguguauauguauguauauauguauguauguauauacaugugcauggacauucuccaguguauguguauacaugaagaagucagaggacaacuuucagaguccauucucuccuucuacaacaguggcuuaugaaaauugaacucaguugucaggcuuggcagcaaugccaccccagagccccacccccacccccagacccagcccccacccccagacccaggaugaucacacacauuaccacaccauuccuuugucucucagcaaaaaauaguucugggucuucuccagcaguuugauagagggaagagaaugggcucugagcucuuuacccagaacugugaggucaaacuggcuacccagcgguaugggguuaacugacagguugugaagggcugauggggagauggaaauugauacaaaugaaggaaagucugggccccuggggauccuuuaauauauggcuuccucuuccuuuaagcagacgagaagaaaaauggguuuuucuuauuagcugugcccuaaaccaaaaugucuacauuauggaucucuagacagggauuugaaugaucuggggguuucaggaccuccuagacucaaagaccucaccagugacugagaggcuguugccugugaugcccgaaccuccuuuugcugaggacaucuggacaccacuuccuacccuggccccaaugucccaucugaaaucacuuacauggccugccccaccuaaacgccucucagauuagaccaguuuccaccagccuaacacuuagcagacugcccucaagccuguuaccuggccuuuccaaugucaccauccuuccaugcuccaugcugccaucagaagaaaccguuagugugaaaguacaaccuuaggguuggacauacguuugaaacuguuuguuaguccucucauggcucacacuuggaauaaagguguucucuguuugcagcuggugugguccauaaagauacauuuuucuguuacaggguuucacugagacauauucacauaugauucacacauauauaggguaugcccccacagguuuuuuuuuuuuuuuuuuuuuuuuuuaguauauucacacacacugaaaacagaacaucuaaaucaaccaucacagccaauuugagaacauuuccaucuaccguugggcauagaggcaacgccuguaauucuagcacucaggagacagaggccagccugggaagauccuauggaggauagggaagaggcacuacacaaugacuaaucaacuugcugucccuauagguuugccuuuucuggacaugacauauuccugacguuauagaauguuuguggucuuucguaccuggcuucuuucacuuagcaugcaugguuuucaggcccuucccuccuguggcauuucugucuagugccagaucaugugccauggaccagaugugccagauuucguuugcugagucaucaucuuaaaguuccuucuacuuggcuauuacgcacaauggcuguauggguauuuuugugcaagacuuuguaaggacagguuuuuguuucucuuagguauggaagcccuugggaggaguaccacuuggucaaauggcgguuucaucucuuagggaacuccaggcugguuccuaaggcaacugaaccaucuuaacgauuuuuuuaucagcagugugugaggguucccaucacuccuaccucuucagccucuggaaacuauuuuucuuuucuauuccagccaaacuaguggcugugaaguaacuucucacuguaccuuggccauguauuuuccuaaugucuacugauguugggcgucuucccaugugcuuucuggacauuuguguaacuucuuugaagaaauggcuaucaaauccuauacccauucacuucccccaaauaguuaucauaguaagauauaugugccguaaaacuuaccacuguaauugucuuaagaauauagcugagugguaucgagaauaugcacgcugaagaaaggccuuuucaaguccuauaaagaauuaaaccuacuuguuuacuauuuuuaaaaugugugugugugugugcacgugcaugccacaugugugcagaugccuguggugcccagaagaggguguuacauccccuggagcuggaguuacaggugguugugaaccacccaaucugggaggugagaacuaagcuugcgucugauggaagaguggcccugacccaucucugcagccccuaaauagaucuuguaagccagacugguuguuguauaguugaacagccuuuguauaucauagauacaaauucauuuuuauucucccaccccucuguguguguggugccgagguucaaagugaggcccucacgccagacaagaaugccaccagugaaauccaccccggcucacucuucucucuuuucccagacauuucucuuggcaucuagcucucuauccuccugcuucagcuuccuaagugcuaugauuacaaauaugugucagcaugcccaacuuuguagugucccuugaagaacacugaacccauacagaugaucgucugugaacugugagcauuccagcacuaguacuuuuuauuuaacuucguugucuauauagguuaaacagugaaaaaagaaaaaagaaagaaaaagaaaaaagaaaaaaagaaaagaauauuugugaugugaaaaaaauuuauaaaacgcaaaauucaugucuauaaaucaaauguuaccagccuagccgguuauuggguuauucguugcuuuucugagccuggcuuugugcuacaguggcaugguggguggcuacuguaaagaccaccuacugugcuauguacagcaaauaacaauguaccuggcggugcugucaaugacugcaugucuccugagacaggcaccacugugcuggugcacuucccuggccaaugucaaaaccacagaagaagaaaagaguggacuucgaaugucacacuuuugaaguauaaaggacuguagaucauuuuguuauugaauggggugacaauuauauuuauuacaugaugacauaacuauaccaauagaacucaguauauaucaauauuuaccaaauuaaaaauucaucacaauauuuccaauucauagaaaagcacuaauuggaaaagcuagaaaauuuaaaauuuaauauuucauugaagcauaauuuccccagaaaaaggaaaaaaaaaguaaagaaaagaaaguauauggaaagaaaaucaggcggcaaccaaaguaacuuuccaauuggcuuuuuuuguuagcagagcaaagaaagcuguuuauaagugguaaguuaauuaaauugugcuugacugcagcggcagaagaauucauccugagaaaaucaacucacuuaagauuauuagccuuucaccaagaaugguuguucaaagggccuaggacaucgagaacaacauaaauaguacauuuaaagacaagacaaaugauuccaaaggcuuuucuuuggcuuuggaugagccaacagcuguuaauaauauuggucaguuuuuaagcauuugaggaggugauggcaaauuugaagugaauaaagaccuggucuccacgggggucccacccggagccuccacagggucccacccugagugcucaaggucccacacagagccuccacgggguccgacacggagcacacaaggucccacccacccugagugcauggggucccacacagagccuccaccgggucccacccugagcgcacggggucccacacagagccuccacggagucccacccugaacgcacagaguucuacucggagcuuccaccgcucccacccagagccuccacgggggucucacacggaaccuccacgggggucccacccagagcuaacacgggugaggcgacuccagaggauauucacucagugcugccugagcagauccugcuagcacguuuuacaaacaacuauggcaaaaauauagguagaacagacuaaaaaggguuaguugggagaaucugcaaaacguggaaaagacggaagagaugucaaacucgugcuuauuccuuguguuauucaucugcagagaugcuggggaaaguguuucgauggcgcugcaaucaucuuucauuucugagaacauaacaguugacuguccugugacuuuuuguuagaaaagaucuaaagcauuagcgugugugggucuauguaucacuucggugacuuaacaguaacaaauuuuuauugugauuuuuuuuuuugcucagagaugagaugaaauuuuucccaaaugagaaaaaacugcccuuaaucacugcuuuuagauacuaaacagcuuuauaaauuuguucauuuuuccuguagacgauauuucuuuuuaguuuuuaauugugugugguguaugugucucugugugugugaggcugcggccucagccuggguuagcgugauaaagacaaaaggaaucuugguauuagccaugacucacacauuaauacugaaugucacaagcaagcagucuucuguuucauuaagaaauagcaagucaggacuggaaagaugauagcuggaggguuaagagcacuuccuguucuuuuagccgacuggacuucaguucucagcaaccauauugugggguucacaacuaccugugucucuaugggguccccgcagccgagagccccacucacacacuggcuccuaggaacauagucucuggguucaaacaugauuccagccauauuuucuucagguacugaugcaaauguaagggaaacucauccuucaaaacuuauuaaacagcauuucaagugucuccuaaccuucagcaggaauugauuuaucugcaauguaaggaugcaaauucgaagagaauaaucagacaagucuauaaagaccuccaagugaugaacaggauuaauggaaucaugugcucaaaggcugauagcaauagcuagcagcucucaacuuuaugaaaacaauauuuuugaagguaaaauguuagucucucaguacagaucagaauuaacaaaugaacauuuauuauugauuuuuuuuguaauaaaacaauuaacauuacaccccagcuaggcaaaaugcuauucuccaaaccaaaagaaaaagccaugauucucguucauuuauauugcaaaaaauuaugcuuacuuuuaaauuuugucaauggaaguguuagaaacuuacuuuuuguuuaauguaaauaccugccaacaaaacaaauaaucaaaaaacuaauuuugucucuuaacucaaaaucuauuaucuuuccacuggccauucacaaaaaagccaccggcucccagcucacagaauggaagccuagccccaggcauucccaaagcccaucugucuagauccuugguucagcuccauagaagccuuggcagugcgcgcgaucucugcuaguguucuuccucuuguguguaacgcccuccuuucccgccucaccuccccuggcugacuccuuauucuuuccaucuuggcugagacaacuucuuccaagagguauuugcugacacuucccaccacgaugagcgagaugacucuccuaugaacuuccacaacaccccugacuucuuuaucagugauuuuaaaaaaagauaucuuuauuuauuauauguaaguacacuguagcugucuucauaccccccagaagagggcaucagauuucauuauggacgguugugagccaccaugugguugcugggauuugaacucgggaacuuucggaagaggggucaaugcucuuaaccgcugauccaucucuccagucuuuuaucagugauuuuuuuaucaguuuuuuuuaauguacuuaacucuaagguacaugauacaaauaaaguccuccagcuaucugaggaccagagacacugauuuugucuuccuaaagaaacagauaagcauacaaaauuucucucugaucuguggggacucauuccagugagugccacaaagccuuagacauuaauuaccaagucauauguguguauguauauacauauauauguauuuauagaaauauauauaguauagugaauaguauauaauacauacauaguauuguauauaguauauguuuacuguuuuuccuuuugacagcuuacucuauaaauuaagcacaauaagagauuaauaagcauuaauaaauugguauguuauaacaauguacuauuaacagcauauaauaaaaguuaucuggaugugguuucucaaaauuucuuauuuuucuguauaucuacuuccucuugugacaguguaugauaauguaguaucuuuaggaagggaacuaucuauauaugccaugagcaacagaagcgugguaauguugcguaagggcuguacaaggguuaugaacgcaagcaugcaauucaugacagcugguccgauaacugaccuggcuaucugagaacuaaugggcaaguagugucuacacugugaauacucugacaagagggugacuccagcccuggcugauggaguggggugcuacaagaauuuuaguguacuacucagaacagugcuuaauuuaaaacuucauuguuucugaaaucuuucauuugauauuuuuggacuacaguugaccauaaguaguaaaaucauggaaauuaaaaccacagauaaagggacuacugcagccauuccaaguccuguauguagaguuguuuuucuuuuacggaaccaaaaacuuuagacuuuacuucauauguaccuuacaaagcagccucgguuuguuuuuuguuuuuguuuuuguuuuuuuauugauacagaaucaauauaauauacuucauaauucuaaaggaguaauucagugaguuuggucaaaguccacaaucaagucauaaaacauuucuauuacgccccucaccaaauccucauguucuaagcaaucacugcuuuuuuucacucugccuuccuagaauuucauuuaaauaagacuacacagcacauauucaaauguguuuuuauuuauguugcuaaacauauuucugauaucccuccucauuauuguaugaaucaauagugccuuuuucuuuauugcuaaauaguauuccccuugauucauuugucugucugucugucugucaucuagucauucaucuauccaucuccauuugauugacuagcauuuggauuauuucuacuggggcacagugcuuaccuacccucugcacugggggauagagcuuuugcggacauuugcgggcagcacuucuguguggacguaucauuucucuuagaggagugauugagaacagagcaggggcacaauguggugcucugugcuuuacagcuuagcaagcuucgagcucaccauccacucucccggcagcagcugguagccuccccagcacuccgcaucccuccuaaccuugucacaauggggcucauuucauugguucuggugugugugcauggugaauccugugguuuucauuugcauuuuccugaugacgaaugcugccguguuucucuccauguguuuaguggccauuaguauuucuuuuuuugguaaaaauguguguuuauaacuuugcccauuuuugauugccuuguuggucuuuauauugcuguuaugagugcucuguguauuccagauauaauucuucugucagaucugucuuguacauuucucccaaaccugcgguuuucauuuucauagcacugucguuugaagaacagaaguuuuucauugugguagcuaauuuauuuauuucuuuaauauugcauacauuuggaguccuauugaagaaaucacugccaaacccaagaucauuaagaauucuccugcuuaguccccaaagguuuuccaguuucagcucuuguauuucagucugugauccauuuaauguuuagugugccuuuugagggggcaggaagagaguguacauauauacagaaacuagaauacaacaucagggucccaccucaggaugccaucuaucuuguuuuugagacagguucucucauuggccuuggacucucugacucaccuaagcuucgcuggucagagacuccagggagccacuuacgucagccagggauaggguuguaugaaggcaccacugcacagugcucauuacuagggaccaaacucagguccucauaauugcucggcaaguacucugugagcugagccaucucccugacucugcagucagcccauucugacuuacuuguauauggugugacuuaaagguucuucuucuucuucuucuucuucuucuucuucuucuucuucuucuucuucuucuucuucuucuucuucuucuucuucuuuucucucucucucucucuuucucucucucucucucucccucucccccucccccucccccucucccucucccucucccuuccccucucccucucccucucccucucccucuccccccucccuuccuuuccucucuuccucccuccuucucuuccuucuuuuuuaaauguggugaugcaguuguucuggaacugucgagaggaacugccucgauguaguuuaggucugcuccuuaaccucuuuccugcuuggccacauucuugcucaucgcaguuuuguacugugucuuaaaccagacaacagagacuccagcauuuuuucuucuucccaaaacuucuuuggccauuuuggauccauugcauuuccauaugcauuuuagaaucagcucauuguguuuuacuaaaccagucugcugggauugugguuguauuucauugaauccauagaccaauuuagaaagauuucauuuuauuauuuggaugaaugaauacacaauagugcucuauuucucuaaauuguuccuuuuguacuuaccagcauguacuuuuacacauuucuguuagauuuuuccuagguuuuuccuaguuucaacgcuacaaaauugugguauuuaacuuuugguuacaauguagucuguuucauuauccccaaauugccucaugcccucaguacauagaaauacaucauuucuauauaaugcaauauguccuauugaucuuacuuuguggauaaauauguuaucuguauugaacuuuccuugcauacuuuuuaaaauauuuuugcauacacccuuuguaagcaacauaaauuagcuuaaggcgguaaguacugucauucauuucuuuuauguuacuuacuggguaaucuauugguugucuguagaauauuuugauaucucuagcuauuguggauuuuuuucuaccuuuucauuuagaucuuuaaguaaucccaucauauauuuugauacguguguauguaauuucuucacaauuaaguaucacccuuugcuuuuaauuucuugcucgcucucucugugucugucugucucucugcgucuguacauguaugugugugcugugcauacaugugaauguguaggcaugccauugcauauacauucaaagaacaaagcaaaugacuucuuuuuguagcucucugguucauuaccuugagguaggaugucucucugaacugaaaguucaccauuuuggcuaggcuaacuggccagcauacucuugaucuacccgucuuuguuccauaaugcugggauuacaggcauguacagccuugcuaagcauuuagcaugggugcuggcauucaaacucagguccuuacacuugcaaagcaaauucuccugcucacugagcuaucuucccggugcuguguugcuuuuauuaaagucuguugguuuuauauuaagagagccaugcaguuuucuuauccuacagaucuguagaauuuucagccuucuccuuuuacuucuuacuuuuguuguuuccauaauuuugcaaugucuuauuuuuagucuacuugugucuuuguacuuaaaaauaagccucuuauaaacuguguguaguuugccguagguuuuuaaucuggucugacaaucucugacuuuugauaagacuuuuuccuauuuauauuuaguacuauuauugacguaaugucuucucuuuuucuauuaauuuuauuuuucucauuugguuuuuauguuuucuuucauccuuccuuggacucuuuguuaacuauauauuuugaauagcaguuagaaaaugucuuucuccauuacuucuagagauuaaaauauauaacuuaugaggcuggagagacggcucagcaguuaagagcauuuacugcuugcagagaaccuaguuccaggggauccggugccucuucugaccuccuugaacuccagcaugcauguggugcacauacauguacucagacauacacacaaaauuauacacacacacucacacagauagacagauagacaaaaauuagauagauagacagacagacuguuucaugguuccauaaaaggcauugcacaagcauacauacacacacacacacacacacacacacacgcgcgcacacacacacauguauacacuaaaguccaacucagucuauuucaaaguaauaggacuacuucaaguaagauauagaauccuaauaaaaguauauguguccauauacugcuaaacaguccuccaggucacagugcaguuggagucagacauauuacaucuauaaccauuaaaaccauuggcauaacauuauauuuuugcuuuaaauauucuuagauguuuucaagaaauuagaaggauaugugugcuuuucuuuuauagguugacuuggucauagugucuuaucuaucacagcaucagagaauaaggaaggcauugucacguugucacagaaacaggacaauaaaagaaaaguaaaaugaagcaaggcccgguuuauacuuggccuuugaaugccacacauuuaacauggccgcagccauggucuacagauggaggaggccuuccucugcuuuuucucuucacauacuauuauucaguacccccacucauaucccauaaucuugugcugaauuguguccuguuguuugcuaauuuuuauauaauucacacuccuaacuauauaauuaguguuguccugguuuggaaacuguuuuucccccuggaauguaguaagcugagugccuucaguaugacaguuuuuuuuacuaagcauuuugagacauuuuaccuaaucuuugguaacaguuuauaagguagguauagugcuuaucuuacaugugaaggguucaagaugaucaaagaauaauuuuuuuuggagagagggggguggggguggggggagucugucuuucuggcuauccuggaacucucuguagaccaagcugucuucaaacugagagauccuccugccucugccucccaagugcugggaauaaaugugugugccauucaccucccagcaaucagagagugauucuaaaguuaccauccacagagauaauggcuagaccgcagaucccugaacaccugccuuuguuuuaccucugcugauuuucccccagcccuguuugccagcuguggccaugggcagggagaacagcagggaguaucugaaagccaaggagcuugagucucauccuuggaggcagaagugcacucugcagacaugggaagcagaccugccuggagagacacaacccuaagggaaccuaauggaaaguuugaacagauuuuguccccccuucucucugucucucucucccucucucucucucucucucucucucucucucucucucucucauauuuuacaaacauaccugcucauaacuaacacaacguaaacacucuccuguguggccacuccuuaggacauuucuggcuuccugugucaagccaaugcuugugguuacaccagcaucuacaggcaggaacagaaccccucuugccuuugugcuuugauguaucauuuguuuaauucacuuucauuaccucaaggagauguguggaaagaaguucuccaucggcugcuucuuugcuuaggucuugagggggucaacccaguccacacuaagagacggagggaagggagagagugcuauggaaaaacucucuaaucuugguuugucccacaaacccacaaagcaccaugcugaauuauugguuuagaagccuucucuaacgcugaaaggaaugccuuggguuaaggauuguguugaaauggcucauacuaaauaucauuauaaauucagacaaauucacucuguuugagcgaagcuguccuauuuggugauuuccccccauuuuuuacccaaggcagagugaaaauugauugaaauagcaagaugacucuucucacugacaggguggcauaacaguugaugggaggauggccuuuguggagagccugggugguaccaagucccuaguagaagagccacuguuggauacuucuugacugguuuauuguuugugguggccccuaguccucaaggaguguuuccagcccuuaguuggccgugguauuugcuucuuuuguuuuuugagacaaagucucacuuuguggcccaaguuagccuugaacucaugacccucuagcuucugccucggaagagcagggauuauacagcugagccuccaaguggagcaucuugucccuuuguucauuuuaguuuguuuguuugcuuguuucagaaauaacuuucccguguugcucagguuguauccagacuuuugagcaaggacagaaaucauccuguuguaaaagcuuuuagagaaaagccuacagguagccagcuggcggguuggggucagugcuggaguggugcugauggaacugugucucugggcuuggagacauccuucucacugcgcucauguguucuccuaacuucagcugcuuucauucaucugacaagcacuauggacacccacuaagugcuaggaagcaaauggacaaagcagccaucgguuaauagucuagucuagugagggccugcgaagcuagaggagccuuuucaguagaagguguggcgugauuauugaaggagucacuggagggaagcagcaucuggcucuguucuguagggaggauguugauguucuuuaggaaccauggcucuccccuaucaaugccuagguguccccaaagaaagggacuguggccaaaacaagcaauguugaaaagcauguuuggaaaugaaguggcuggagaagagacaugugagguaggcaggcguaagaccagacccccaauauggacuccuugagaggcaagccaggaaauucggacacucugacaacugauagagagaucaacaaggauuucgagcagaagagugguaagauaaaaacuggguugggagcuucauccugcagcuuuauguggggcuuuaagggagauguuaaaauagcuggaugaaggaggaaagucuagacagcuuauuugugauguugccaaugagaaugaagacgaggaaagagauacaucagacaaaaccgugcccaaacagaugcuccccugcauauaaaaggcaagucuucaaaaacaaaacaaagaaacaaaacccaaaacaaaacaacaacaacaacaaaaucaaggcuaaugauggaagucaaaaaucaagaacuagaggaacaaacuuagaggaaguuaaauucuaccuguagugucugagagcggucuuggagcacccaagggaccaucaagauggcuggcuacauugcucucaacugggucggucccaagugauggacuuggucuguagacauuuggcuuauuuguuuucuuccuugcuuugccaucgugguuauaaggcauugaacagaaaggacacaagguauaugauuuaaaagggaauauauugggcuggugagauggcucaguggguaagagcacccgacugcucuuccaaagguccgaaguucaaaucccagcaaccacaugguggcucacaaccauccguaaugagaucugaugcccucuucuggugcgucugaagacagcuacaguguacuuacauauaauaaauaaauaaaucuuaaaaaaaaaaaauaaaaaaaauaaaagggaauauauuauaguaauggaauagcugguaacaggggaguaucugguagugaguguguagcugauaaaaagggaguaucugauagcaggggaauagcuggcagcaagaugaguaucugauaacaacagaauaguugguacugagggaauaucugauaagaagggaguagcugguaucaaggaaccuccuuuugccuuccgccuguguuugaggguuguaaauacaaacucaggacuggcaugagcaagugaugauuggggugacuauuguguuuuugaagacaaaggcuuuuuuucuauagcaagggacauaguaaaguaacccagaugugaagaugacauuuuggccucugaagagagagugacaaagcuaugagaguccgucuaucacaucuaaucucagcgguccggggucagggagggggcuuccuuuagaaguggacgauggagaaaguagagccagaggguguucaaagcccaucccacaggugugccaacuuccuguuucaacuuccuacuuuuccuguccauguguucuuugaguggauauuaguaacuugacuuguugcugugacaaaacaccggacacagaaaugucuguaaggaagggguguuuguuuguuuguuuguuuguuuguuugacuggcaguucaaagguacaauccaucaugauggaggagucauggguguggaagcuugagccagcuggccacauuguaucugcagccaagaaacagagagaugaauguggagcucaguguaauuucuccucaagagcauaggagaauauauacauauuauauuauauuauauuauauuauauuauauuauauuauauuauuacacuguagcuagcugccuucacacacaccagaagaggacaucagaccccauuacagauggcugugagccaccaugugguugcugggaauugaacucaggaccucugggagagcagucagggcucugaaccacggagccaucucuccagccuuuguuuucuccuuuuaauucagcagugaggugggucuucccaccucagcuaaccuaaucuugcagacaugccuagagaauagucuccaaggugauucuagauccuggcacaugcacaacccacguaaagccuggcugggugcuaucccuucaccucugagcggggaaggagaguagggcagaggcuaccugggagaaggauggagagaggaagggagggauuaaggagcugccaggaacucacugcagaggagguuccaggauggggcaauaggguaggggugagauaucugggcccugagcacacuaaguauaacacagcagguguucaaggcagcuguuccuucuuccaacgcagucucagagagaggcagcuguggcccuugccaggugccacauccuuucccuuggcuuuucuuggccucaagagcauaugagaauauugacucugcagggaaaugaaaguuggguugcaguagugacagcuuaccaguugggucuugagaguaggugguuggcacaaagcccugggcuccaaucccucuggaaccaggguggcuuuuucuuccucucguggucacagauuauguguguuaacugccuggcagaucgucugguuggaaugggcuugguagguaaguucagagguugcccgcccucucuggauggggccuaucacacccucuuuugaaugaaaagaguguuguacgaaucuguccaauuucccaaaggaguuagcauggggauucugucucuggaaagguuucccgggcauucucagcccccuugggcuaggguuagucuccuaagcucaccuucacuugcaguugauggcagcuuugccuguguccuuugggcugaccacggagccggagucuaggccacugaggacaucaacaaaacacugcaacucacugcacuguugagaaucgaggacuggccuccauggcaccccaaugagaccauauguaacugagcauaugugucccggggcucccaccaugguacuuccuccuuguagauuccacagugucguggucacuggugagcacucacacaucaaauauuaaugcaggaagucaagauggcccagggagccuggcagaacagccauggcaugcuuaauaagagcaggaccccuuauucuuaggaaccugaaggagaaaagcugcuuugggugacaaagguccuccuguccccuucccuugucagaggcuagucuuggcagccuccacauccugcuggcauggagggacagugaggcaaccgaggggcugcaauggcuauaguagcucugccugcugggcacaaguggcuggaugaaauagaaagaaauaaagcaaggcugccccgccuagccagcaugggccuagacagcuggcaggagcuggcuucugauagccaagcaugggcuccuaggaagacccuuuagguaaacaggcauggugguguguugugccaacuaggcaguagacagaaggugggcuagagcuggacccagccaucuuccacaagccuuaggucucuacagagcuuucauaccugaccccaagagcuguacaggucgcucgcugacugacaccccugcgaccucagagagauuucucuuggcugauuggguuuuuaggucucugcuuuuccuucagcuugguugguucaaaggcuugagcuguuguucuaggacaaaacccccagggacuacacuggagggccucuagguuagcugauagcaaaagucauguucacagggaaggaguaccuuugccugccacuuagcugcauguuccccucccugugacauucaggauagacacagucaacauacauccuuagggccugggucuguuggugcuuugggagguaccaccaguaugggacucuuuagggauggaacuaggguccccaguccagaugauaccugcauagcgaaggaagagaagggccuacugugugcaggucacacagucacacaguaggucuucagugcagugacacuuugagcacuaauggacacucccagcucuacuuucccugaauaccuucccuaacuacacgucuuccuugaucucagauccacuucugcuccuccugcccuucuuguacacuguuccuggucuuaaccaguucccaccugccuaaaaccugggcaagaagcucuucucaacauccugaagccaguguucacucuacucuucuaccccaaaagacauuagcaacaccaggcccuuguguuccccgggaagccugugccaagccuugucagccuggggaagccacacagggauucuuccuggagaagggagauuagcuaaacauccuuaaagaagacagggaaagagaacacagaaauguuuccuuuaaagggaaggagagcagauggaaagaggguuuauauuuaugaaaucuccggauauuacggaugaaauggauaacagggaagguuauuaucauuucauuagggcacaaaggaagaaacaaacacguuauuaugugaaaccaagaaguuaugaacaagggaauccagcagggaaguuauuagcuggguuaauuaaaacagagcaagcugguugaguaauuccucuguagaacacaacaaggagggcauaauucacuacccuuaagaaaaauacucaggguuuguccuuuuuuuuuuucucguuuaccagaaagucugcacuuuugauauugucuucacaaaccaaaaagauuuauucuugucagaaucuaauugauuuagucagcaccaagauguuuugcuaaagcuuguccaauccugaucugaagaaagggaaacccacuagagacuccugagcagagacagccaggguggcuccccuucccaggauggggccccucaaagauccacugggaacccagcccacagcauuaugggagcuggcaacagaggguaggauggacgaggcuucauuuggccuuguagugucccuguggaaugcuggacccugcagcuaucucuguuggcaacuagcuugaaaggcaaaugaccauccagaaugcugucccaccaccaagccacccgaccccagggcacagcacccucucuauugggcagaucuuacauaucugagcugcagcucccuuagaaagccaaggggacccaaggaugagaguccucagaaagccaaggcgaucccaucagcacucgggauuuuacugucugcuuuaccuuaugaauuacaacaggagcucugaguuugcccaugugguuuucagggguuacuugucaaguuuggggaccagagagccagaguuuccaaguucugggucccagagcacaggcccagaggcaagcgcugccagggugcuugcugagggcauaaggccuccaagccauucgugggcaugaggaacauagacccuuacaguuagagggaaaacuaugaccugccugaggccaaaggacuagcuaaugggauggcaccaucccaagcagggauggugccaagcaguguaucaagucuucuagccuauuucugcuccagcuuagcaugucucuguguuuccagguugucuugucuagccauaggcauccuagacaugcuggaguccuuggguuacacuucaguaaggcuuagagucuguguugcagccuuggcuccauacucaucaauugccuguuuucuuucauuuaaaagcuguauuuggaaggaguggauagaggacucagaggcuaagagcacuugcugcucuuucagaggaccugguuucaguucuugcacuuacaugacagcuuacaaccaucugugccucugguucuaugggauccagcacccucuucuggcuucuguagguauugcacucucacaugguacacauucauacaugcaagcaaaacacucauauacacaaaauaaaauaaauauuuuaauacuauuuuuagagcaauuuuagguucacaggaaaacaagaaagccccugugcacucucugcccccacacgugugugacuucuuucucuucuuggcauuccacaucacaguagugcuuuugugacaacucacauauugucauccagaggccagaguuuacacuagaguccacuuuugcuauguauucugcgaguuuagacaaauguuuaaugacauauguucuccaucuuaccaugugcaacaguuuugguacucuaaaagcccugugcucuggaucuucccaaccucugacaacuguuauacuuguuacugucuccaaaauaccauaaauuagcaucauacuguauuucuuucauuuuauaauaugcaaugugagugaccucuaugucuuuucaugguucucucucucucucucucucucucucucucucucucucucucucucucucucucuguuuuuugagacaggguuucucuguguagcucugcuauccuggaacuugcuccauaaaccaggcuggcuucaaacucacagagaucugccugcuucugccucugcaaugcugggauuaaagacauguaccaccaccacccaacuuaguagcucauuuuuagcacugaaugguauaccauuaucugggugagccauauuuuauuuauacacauauugaagggcauugagagagcuucuaagucuugugauacaggaagcuguuacaaacaucuguguacaguuucuguguggauauguuuuugacucauuugaauaacuaacaaggaaaugaauguaauugcugguauaagggggaugaaugagcguuucuauugcuccauauucuugccaacauuugguggugucagaauuuuggagauuggccauucuaauagauguguagugauaucucauuaucauuugaauuugcaauugccucaugauacgugguucucucucccuccuuaucccucucccuuccacaguuuuguaggucaaauccaguacaugcuaugcaaaaucuaagccuagaacuaaacugagcuauguucuugguccuggaacaucuuuucaaaugcuucuuuguacccugcaugucuuccuucaugaaguaucucacccacuagccaauuauuugguuuuuuuucauuguugaaauuguagagguuuuguuuguuuguuuguuuguuuuguuuaucaguucuuucacuggcugugauuugccaacaccccccuuguguacagauuuuuuccuuguggucuuuuaaagauuuauuuauuuauuuauuuauuuauuuauuuauuuauuuaauguauauaugauuacacuguagcuuccuucagacacaccagaagagggcaucaguuccauuccagaugguugugagccaccaugugguugcugggaauuaaacuugggaccucuggagaacagucagugcucuuaaccacugagccaucucuccauccccucucguggucuuuuaaaaagcgaauguuuagugaagucuggcuuuucaaucaucucuuccuggaucaugcuuguaguguuauagcuggaaggucauugcuaaagcucaggucgucuguacuuucucccauguugccuucuggcagcugcguagcuuuuaauuuuacguuuaggucugaaguccacuuugagugaauuugugugaagucagucagauucaucauuuuggagguggcugugaacuugucccaacaugauuuacugaaggcucucuccacuccuuugcugcuagucgagugacugcaucugggucuccacucuguuccacugaccuguugaucuguucucacaccagugcugcugggccuugguuucuaucacugcucaguaagucuugaagucagacugugucaauccucuuugguuuucucccucaguaugggacagcuauccuaggagauauauagauauacauauacauauaucuccauccuuauauaaacuucagaaucaauuuguucauauccacagaaucaacuuccugagauuuucauugagauaccacugaaucuguauacaucaaguuacaaagaaccagcaugcugacaaucgugagcccaccuaugcuugaacacggcauagcucucuauauugaguucuuugauuuuauaguuuuacuaaugcagaucuugcacaccauuuguucgauuuauaccuaaguaguucaucuugggggcugggggugugcuaauacaaacuucagggugagugaugcacauacaucugcauguguacauguguagagaccagauaucaacagcacuuuuccauccuauuuguugagaccagaucucuuacuuaaaucuguugcucuccaggcuagguagccuggcuggccagccagcucuaugguccuucugucugccucccugcccugggcuuacaugugccacugcagacagcucuauuuuuuaauguguguacuggggauagaacucagguccucaagcuuacauggcaagccccuuaccuucugagccaucuucccauucccugaaaauguguuucuaguuccaauuuuacuuguucauuacugauacauauuaaagguuacauuaacucuugccuauugaucuuguaggguacaaccuugcugugugacagcuauaaucacuuugccauuugcuuucaaaauagacacccccucaggggauaguaauggaauuuauuuuagucacaacacccucuguuucuuuacggcuuuacuauacgcucuugccuuugucuggaacuuucuuucuuccuuucagccuccacuccagauauccccuucuuccccugauuaaucuucaaggacucagagaggucaugguuuacuuuggggaaccuucccugacccuagaagucuggguuagcugaacacuuccacuugccugcuucucuggaagaugucauucugucuguccucgcgacccucucggcuccuuugagaggcaaaccacagcaaugaugaugauaauaauaauaaacccugagcucugcugcaggaaguuaaccuggguuaauucauuugauccgcacagaugugaacaggaaugggaaucucugcccuggacuccccucagcauauaaaacaagacgcagacaccuagguuggccucuaagccaugggggauagaucuaaggcucccugcuguucagcugcaguccucacuggaccucaacacagaaaacacauccaugccucugaccccucaccugugcuguccucccuguuugggaugccccccuggggggucuuguuccucugcuaugacuuccacacugcugcuucgacacuuguuuucuagagaguccauuuuggucauaagccuaagcaaguuuauaaaaaggaaacuugaggaacucugaaccucgcaacccuccagcaucucugguuuuucgugagagucuugcuuggcuguuccucauaacgucccugccuuguucaguuauugcguuugauuugcacuccauauggugacgucagcggcguguuugucacuggagugguucccuaagaucucguggguaauauccacuguuucuccuuuagagccuuguguugguuuucuaauucaauuuuguuuucccaaauauuugugugccaaauacaaguaagagaccauaugucuggccuuucaaucuggcagcuggggacugccuucaacauaacuguuuuucuguaucccuagcuugcauguuagagcccugcucaguagaauuguacuaucacaaagcugaaugcuuagccuguaacucucuccccaccuccauccuaacacaaaccaaaccuuagaaccuaggacauggaagagggagggcucugcagcuuucuccaaagaugcuuaucagucuaacacugcaucucucauccugucaccuccaaggccccgccucucuccagaguaucauuuacugcagcgcuccaaggaacuccgcaggucauucucucuugcuuccaaugcacacaagacaaacauaggauggggucccuggcaaguacuuccugcuuuggaggccuaagugguagaaguggggagggcuaguaacacaacacuugauauguugacgauaagcacagacucagagcucugagggcugaggcuguauucuguggauagagugcccaccuagcaugcacaaagcccuaaguuugauccccagcaucuaauaaauccgggguugugguacacaccuggaaucccugcccuugggagggggaugcuggaggauucaaagcucaaggccaucuguggcuauauaaaaaguuagagggcagcccaggauacaugagauccugaagaggggggaauuuuuuagagagagagagagaggagagagggagagagagagaccaaccuaacagcguugccugcuugaccuaugcucagacugaagaaagcuggccugacucccuugcccugggaggcuacuaaugucagaagcaucuugggccugcuuccacaagcaagaacaguugcaucugcauaaaaccuaugugaacauucucucugucaggauagagaggcuauuugccguacaaaacaaagguugcuuccaaguguuccagucccucccuucagccacugaaguccaacccucgugggcaacucuucagaucugcaacacacacacacacacacacacacacacacacacacacacauacacaccuaaaucccugccgccucugguucccuccacccgcuggcuggccgccuuuuagacuuuccacuccccuggcuguacagccauguuacucacuggcucaccuaggucucggaaaugccccuccucugcuuuuucacauccacaguuuggcuccuuccuggucucuacggacaucuucccagguggcucugcuuggccuuccucuguguccuuuuucacuggcuguuuguuuguuuguuuguuuguuuguuuguuuuuucugcccuggugauguuaauggugcccucugaaagcucugccuuccacucugaccucuucggcuacauguucaggugucugcucaacauagccugcuggcagcucaacccaaccuuucugaagucuucaggcagccuuccccugcucgcccagcuccuaucagugucuagucacugaugcugaaaauugcaggcuuuguauggaugcuucccaggcucauguuggacccccaguuuccucucguucuacaaaaccagcaaugccuucucuacuuuccuaagggcccugaacagaacaaggaauguggaugcaaguuuucacuguaggugauauagaaaggauggcugcagucauugcucuguggaugcagguuuucacuguaggugacacagaaaggauggcugcagucauugcacagcagagcaucuucagccuuuuguggcuuagcacaucaauuucaucaccuggugugauggcuucaccuggugccacuuccuucaucucugagucucuugcagugaccacugggguguuuguuugguacagggucuuacuauguagcucuggcugaccugaagcucacuauguaguccaggcugccucugauucacaaaaaucuaccugcuucugccuccugaguacuguaccccaacacccagcaaucaacagaauuuaaccccuuucacccauuacacagccuaccuaccucuucuguagcucagugguucccagaacacaguccacacguaauuacuuggaggccauuguauuuuguaacucuaaucacuuuagcgguagggcuuagcuaaugcaauacccccuacaaaagaacaccuugcacuauuuacaaaacuaacuaugugacccaaagaccugacagagcuucaaaaugcaaagcucuugggaaaaaaaauaagccguagaucuucauaccgugaguuggaauucuuccaauuugaucauaaaaagauaaauggccugauuuuaaaaugggcauguacaauuuuuuuuaaauuuuacauauagauguaaaauaaugcacacauacauauauauagcauuauacccccaaagauaacagaauaaaacuaucagguaauagcauaucaaagauguggggaagucagaaagcuuaugagaauguaaauguccugacugcuguaggaagcccacagguuggcagguccucagccagguaaacagaguuaccacauagccagcuaucacacuaccagguggauuucagaauaagaacacaugccacuagaaaacgagacacaaguguuugcagaaggguuguauacugccaacaccaauguauagauaauauccaugcguggaauucuauuuagcaguaaaaagaaugaagugcuguuccacgccacgccacagaugagcccuggaagcauuauaccaaguggaagaugugaaccaaagaagggaauguguuuuuuauaaauuaucccaaccggggcaaaugcauagagaguugaucacugacugccuggagcaguugcuacaguauguaguguuucuuuuaggggugaagaaacugucugaagauuuauguagugaugacuacacaguucuauaaauaggcaagaauuuuugaauuauacacuuuacguggaacauuuguaugguauaugaauuauacugcaauuaguuuaaaauguaguaauacgaggagcauuguugauaggggcguguucuagagagcuuuaagugccaauuugaguugugaggacugaauucucuagggccaguucuuuuuuuuuuuuuucuuuuuuucaauuaauuaauuacuuuacuuauucacuuuacauccagcucacugcuagggccaguucuuuuucagaagauauuucauauacuaucugcaucaguagaaauaaauaccauguuccaaccucacccaagagacuguaauucagaacuuucuggaugggguuaauauuccacccauacagcaagcacuccaaguaaggcaguagcuuaugacugcaacucagcccccgugaugacacagucccccuguuuucuuaucaugagcuucacagauggccacccccuacccgcccccccacaccccacgucucacagccuuaucucccauggggcccuucacacgacuuuuauauuaaucaagauaaaaaucuuuauggucugaacuuaccccuuaguucccacucuugcuagguuaucccaugcuccaggagaaaguccccuauagcacggcaucuguguuugugaagcagaucucaccuccauccuuucauuuuaaccagcccauuaucuggagcugaccacccacgccuuucauaaucuaaaacgcuacguaucccugcugcuugcucaugagccagcgaggcucacacguguucgaagagcaugccugugggugagguggcccauccugguacgugucuacuguacaguaauugagugggucacacuucagcggggccuucagugcacaggguacaggguggcagucaguuucuucugaggaggucaggguccucccuggggacccgaagaucuggggccuacaucagauagcacuggaauucagacaggaccuggggggcccuggccaccacugagcuugucgugcccugacagugccacuggcgccagcucuucucggagccuugcaacugcugagcugaauccuuguuccaacuggugaccccggacagaaaggccuugaccaccucauuguccucgcucacuaaaucacccugacuccgcagcaggagaggaggcgagaaaggcauucacagccuauuuguuaaugagcucuuaaaaauuaaacgaugauugucagauaacuauuuuacaaugcagccagagccccucgcaacuacuucaguaauuacauuaagccauucuauuugcaagaggcuagcaggaaacaaaccauuaauuaguauuauguuuucccucccacugccccuuccuccccacaagcccuuggauuauggaagccacgcccugaagccagagagcuggggugcacucuggaagacugagugcuccauagagcuuacuggugaggagaguggagagugugagggaaaaaaucccgauuguggugggcccggugggcccugaggucuacuguggccuaaggucuccugaacagggacccagugcggccccguguucauuccuuugguucuggaguagaguaguugacaguuguggggcaagcugagcccaaugugggcauguucccaggggccucagagccaguggguggggcgggcaccugggcaaacagauuuaagaaacagucaggaaugaaucaaggacgguuuaaauaugcagaaaugcaguucauaccuuugggcaaaaauaaucccaaacaaaguuauguaaugggugggagggcucucauaggagggacgaggccucaagguacaaaggguuugaaugaaugggugagagagacugcaaaaggagugggagggaccaggagaaucuggccacaguugguccacgaagccauugcuggggaguaacugugccuguggagaugcaauguuccuugugggacccugaagggccguuagaggaaggcagcacgacauuccauuugugagguggccuuaauaucccugccaauguguggcuuucuuaguccugaagugguagggauagggaaaggcuggugggcaaaggaguggaguuugaggugccauagugucucuuguaaguuagcacaccucucuuagaccuccauauucucaucccuggcucacagccugaccccagcccuuucugacagguucuucccuguucuuccaccgaaaguucacaaugcucgugcccuuccuuaccuggucaagcuucccaggagcagcaacuuagaugacacccuauucccaacagaucugugcuucccuguguuaagugugguccucccuccguccuugaagacaagaccuuuuguauccugcaguucccugcacugacuaaacugguuauaaagcaggugcugggcaggugcuaucacacuggacacggaagcagcagaagggguggucggggagaggggaaugggucgugcacccugcaugcugcaaagcauaagaaagacuaccugaggagcccugggcccagggaugggacugguggcccuggagaugcagaaucuuuuagaggggagagcuguguauaaaguaugucagaaugcacucagcugcacaucagucagaaccccaaaaccaugcaaccaauuagacaggggcuugugguggccacacaaaggcugcugcuccagauuggcacagagggaaccacccuuaccaggagcuuggguggcagaaguaagguagagagaacagauuuugagaaacacugaagucagcuuugucaucuccuucucuuugucaugaggguggugauauugauuaaauguuguugcaagaauuucuaaagcacacaguggcccagugcaggaguucagaacuccuggagccauacauaguugcugcucccuguggacaguccuacagacacccauuagcaagccuuggaaacauagaggguuccagagaacuaaugugcaaccugccagaggcaaaagaggauugcuagagggcuggccgccaugcucaauggcaagggacaaaguuuccauagcuggggacauacauaccugagucucugagcucuacuuugguggcugauugcuggaaugauccugcugagcucuggguucacagggaaauaguugccagggcucaaaagaaaaauaugucuucuccaaggaccaaagggagggaggauagccuggcugaacugaaaagggacugugggucuccugcucguuucuguaucuggcuuggucuucauggaagcugcaggccauuuugggagccauagcuucagguuucuagugguguacaccuugugauucguguuggcacuuuucuaugaugcaaaugggugcucugggaguuccaggggugggaggggauuuggguaauaagaacaagacagucuuugagagcugccacagcuacucugaagcugugaggauguccauugggaauuccccaaacaagccaaagauggcauggguaccugcacccagaccaggcuugggaaguugggcuguggucccaggagaggcugagccuggggugacagggcugggcuggguagggcuaagcugggcagggcugagagagagaagagaaauguuggccuccaggcuccuggaugccuauacugggcaaggcuucuuguuuccuuggguggugaccaggaguuucucccauugugccagcugggccugaagugucuuccucugccucuucuagaggagccucugcuguucucucagggauggaagcuggcucgccugaccucccagagcugguggagauauauaagcagacacucugagaagcuggcucuucacaaccuccgcuaguccaggguguaagcagcagggcaguagacaguugcuucugggaaguaggguucuuccagguugcugauccacacacucauguguccccagggugagacugguaguagcuaagcccuuacaaauggugucucuggcccccaggccagcaaagaagucauuauguuguuacauaaauaaauuauguacuuacacgggaguugguguauaggugccgguuagcaugauugcuaugcaauuaugcacuuagcuugaagagggaggcaggcagaugggcugaaucacccccaucccggggggaggggggagagagcuggcucccaccccucaccucagugagaaccgugacccagaaccacagcaaaugaggugcuagaggcuugcuggagucucuguaagguucaggcaacaagccccaaggcuacacucuggcaguagccucuggagugcuuacucaccugaagcaggccugauucccugcugcaggcuuucagccaggcccugacugccuccuugaauugacaaggaagagcuuccgccaagccaagaagccacacaagaggcuauaggggagcauggcucugggagaagagcaguaacugcuccucucugcacgaacccuagaguccucagauggaaggaacccaauauaaucuaguacuccaacccuacuucuccagguugggaagcaagccagagaaggaaagugacucguccaagcagacgcagcaggccuuggggacucuggaagugaagccuggccugcuucuugccuccccacacacaugcaugcauuccacacacauacacacaccacacacaccacacacacaugcauaugcacacagacacacaggcacgcccacacauacacacacaggcacacacaccagaugcauguguauacacacacaccacagacaccacacacaccacacaugcaugugcacacacacacacacacacacacacacacacacacacaccaucacuggggcugcuccaguuucucacuuccucucagucuugcuucagcccugcccaggccugucuguagccucaccucuccccuccucugcucuccccuugcugccuggcuuuucuucgcccggccccuggagccaagggaggcuccgugcuggcuuuggccagugcuuuuccucuccuaugccagcuucuggggauccucaucagauggccuugccccuucucaucugccuucuucuuucuccaaagagggucuaaaaugaagaaaagacacuaaacuaaacaaggagcaugaguuauccucuuggucuaugaguggaugggcugaaccacaggagccucguaacauugggacagugauguccacccacagcagcccccauaaccaagagcccaccgaccuguguucuuuggaagcaaagggaagggaaugaggcuaaaggguaaggccagaggugaggcauuacacuuuagcucuaugggccugagcucugagcaccagaagcccuccucaggugcccuugauucucagagaucauagaugaauuuccucagucauucaguaauacaauccuggagaccccuacugaaagggagccagauguuguucagaguaucaugggcugccaagggcugggucuggagccucagagagcuaacuccagccccuacugaugccagaagacugugcauucucucucucucucucucucucucucucucucucucucucucucucucucucucucucucucucauguguguguguguguguguguguguguguguguguguguguguguguagcaccucagagugauaagcuaggguguggcuacagaaguaagcucacuaagccuugagcuuucuccaaaagcuugaguguccccaagucauugcagccacucacauuccuagaccaaggauuccaggacacauguccccacuaugugaccuagguccccaguagggaaaacaaaccaaacuuugggucagggcaaacugagcccaagcccagaugccugagcaucugccacagcccuucuccucaaaguccuuugcguaagggagaugaaugccagaauaccucugagcgacacaagaaaccuucuaucacuuacuagugcucaagcuucaggccaggguauaaauccgugaagaggagaggccuguuuuauccucucugauagagccuggacugccccugccuggggugggccagagcuggacucugcaugccccuugggauacaacuggcagcagccaggagccgcuacauucuggggcucuggaagagugaguuucucagacuuuauggaagcucugggguccaugagaauuucuguggcccuucagggaguaaagagaguagccuuuagcucugucccuccuuugauggccuccccagguagagagcagaaacaagaagaggaggcucaugacuuggagggguuaaauggggaugacugaggguaaggccagccucaucuuuucugagaacuuuucaauucuuuuggcagagcuuguggcucagcaauggcuugggggccaaggggagcaucuucuggugcaggggccuccaaaaaaagaccaauuaaugcuaccccucauuugaagcaaccgaggcaucucagaaacaauucccacgggcgaggcugcaggugagauggcuuagcagaaaaggcgcuugccaccaagccugacagccugaauuuggaccucaggaacccacguggugaaagaggagaacaaccagcuaccacaagcuguguucugaccuccgcguacacacaugcccacacacauacacgugaacacacacaaaucuaauaaauaaaacugcgaugcuuuuaaauaagacuccccguggaacagcaaauccaaggagaagaggcaaagucucgcucagucccuaagacuacuuugcuggagauguuuacagguaagaaucuugaaaccccagagucucagggcggaaagaaagguaguaugggguuauuguugguuuuuuuuuuccuccuuccucuuuuuacucaaagguauuuuugcacaugacucaaacaagucuaaacuuuccuaaacuucaaaguuugcucauggcacagccucaaaguggaagggaagauguuaaaaggggaaaagagaaaaaaaaaaaaaacaguuuguaagccagugaaguauugugugguuguugcucacaggaacggaacugacuuguguugcuuuuagaaucccauugugaaacaggcuuugcagggugcucucuccccgcuguccacaggcucacucacucagcagccugggguaagagaaaggcuuguggccacaggccugcucacaggucauuuucaagcucucagcaggagagggagcaugccugcaucaccaccuccuugcccccacagucccaccuucccuggagaaguuuugcauaguaggugagaggaaaagacacugcugacagcugacaugcuccccugcaccuuccagugacaggggugccacuuccagcgacugggccacaagauagggcccaugcccacucucuccuaccuucuccagccaagccguaggguugugaccauuagcacaggcuaugagagagcugcauggguuccuagcucuguccugccacuaaaccugucacuggcucagacagauguauucauuacccugugccauccuugucugcaaaaugcaaugauugcaggccuccuuuccagagagaacucaguuaauguaaaguuaacuccucuccuggcaucuguuuuuuuucugccaaaaccccucaucugcucccccaccccgaaaucucacccauccuuaaagaucuucaugacccccuuccccuccacucagggcuguguccgaaugcucucgcccccuggagagagcuugcaccccuggaauuuccauggcaugucugacuugcgucauucauaaacugccaugggcugccaggacagccgugccaggaauggcucucuuccacugcccccacugcuauccucagcuacucucuucuagcgggagagucacuuaguuguccaaaugaccggucucaacaacccuucaugugccagguaguagagucaacagccuuaaagaggucugagcuaauggggaaauggagaugggagccacagacagaaaguaaagcugcuucuauggacaaggaagaggcaucugggacacgcgcaggcucggcuaggacgcgcccuucgcccccucuccuccauagcacauuuagaaacagcucacagcucuuaaauaagcccaggguuccacugggcaggcaguguccugguugauuggacugcuacuuaccuucucuccuggcuuuucucagagcacguguaccgcucuccacccucauacauaaaugcacacacaugccacacacacacacacauaccuuggcacccugacugucuugauuuugcaaaagcaccaaagcuuccugccccagggcucuugcacacacuacugccuccuuuugucugcuugcuccacagacuccagaauaaauguugccuaugaaguccucccuugauacagcuuguuccguccauccucucguagaucagcauacagaagugguugcugaaugaacagaucuuaauauguagcacagacuuaauccauuauucguguaaucagcuguuuguccauccucaccgaggcuguaaccguggugguaaggucagcgcagaucugucugggacccagccacaucuuucacaccuagcaaugcgucuaaaacauaggaagccuucccacgucuccaucaaguagacagacuaagcaaugggucaggccaagaagggagagugccaccugaacaggaauguugguuuagagaaugcaaggguauggauaggagagcaagcguguguguagccugcagaucuguaaggcagagacacagacuuagagcuaugagcuaugaacuggggcccagcaggauaggauucagcugccugggccgaguuuggauuuaguggguaguaaugguggaugcagggguugggugugggucuuagaaagcuuacuuuggaugaacuuggaguguucaggcugagagaccaaagucaggggacaggaggagacagggagugaacugaagugauguccagucagaagggagggaccauaagaaugacaguuuggaagcugcaggagcaaaggcuuagagaagucuucuugggaucccuuagcaucuccuucacagagcaaagcuacagaaagcagggcaaguacucacugugccuuacugugguggagagaaaggggcuggcccuuucucugacuuagccuccccugaagucgccccugauaagacucacuugaggccccaggagcaccagagaucagcuugcuacgcggacaccaucucuuucugugcuucccccuaccaaguuuggccuacagcuaggggcaggcagccccccccccccaagucagccccggagccccaggauuccuggccuugacccagacagaguccuugccuucugcagacuguccugaggaggccucuguccugagaagcacugggacccucugcuaaggagacagaggacuggccaggaugaucuuugacugggauucuaguaaggauggcuguaaggggacaccucaggcagaacuaggcaggcaaaccgcaggcucaggcuuucugggagccaggagagggagagucuuugcuguguaacccuuucagcaccacacccagacaggaggcaggagcccggcgugcuugccgacagcccucaaccagcguuuugugggaugugugcuuagggcagggggcggugcagccgccucugaguucaccucgcaggccucccagaaaggagccagcuggagcugccugcuugccuggucugagguuugcaguucaugagugugggagggggcgccaagccaccuggagcacccgaacucccucaaguaggcugcaacccauauugucugggaggggcuccuucagccagucccaagugggaguguguaaagguaugccccuagaugauggucucucagcaaggcugagaccaaccccuugggaaugaggagacuuaagacaagugucaggaaaagcuguaaagaacaacuucgggaggcaagggugcuuccuucccucggagccagccggugggcuuccuuuugguccuuuccugggcucaacucuggcugucuccccacccccacacuguccuuacccuggcccucgcuggaggaaucccaucuccucuucccccuaguccugcuccccccaguucagcucaaaucccuucucuggugaggaggucugaggcacauuucuugggcgcacgaccuggcugucucggugggcccagggagggggcgcagggcccacagccgucgcucacgccccccaacacacacacucacggggggccugggugggugggaggugggcggagggcggcuggcgcgggaggggaagaguuaaggcucgccgcuccccucccccggagggugugaccgccuauaagaaaggcgccgcgcuagggcacuggggcugcaggcggcgggggcgcagcgcagcgcagcagcggagauccgagggcgucccuccgccuaggacccggggcagcaugucggagcccaggaggaggggccgcggccgcggcaagaaacaccgagagggaagaaagcgggagcgagagcccgaucccggggaaaaagguagggcaccucggcgcgcccagaaaccccguuucgcugagagaaaccugccgcccgcucacucgccccaggcgcugcgcgggugagucuggggcgcagcgagcagcgcuggggugacagcagccggggugcgcucucuugcgaucggcucgagcggauccgcacggcaggggcaggguaagcgaggaaugagcgcucagagccaggcaguggcagcgcgcgcgucucccuugguggcagagacccggguguccccccagcaagcgggcagcaugcgucggggacacggagggagacugcggucuagcacaccccgggccuagucuuccguguuuagggagcugucacugccuucccuuugcugggauccucagccagcugggcacuccgguucccucaaccacugugccacaccuccacccguucugcuccgccauuggagcuugggcagcacgcccgccaccucuggagaugaaggggaugcccugcccugggagcgaaccccaggcagcggguuacugcugcuucuguaacauaugugucccccagagggggaccaggcauggaaugauugucccaccuuggucuucuuggugauucccuugggcuuuugaguucugcagcccucccuuugagcgagcagagcucuugacaagaacccacguaggugcugaaccugggcagcugcaggguaaagggguaugcuggccuuggauuucccagcccagagccuaugacaugcacaucuugaggcccccuuuggggaagcccuggcuucucacuucuuuuuuuuuuuuuuuuuuuuuuuuuuuuucuuccuugggcaagcuuuuccuugccuguuuuguuaaaagucuacuuuguacuagccagcaggcuagacaaguucaaaugccccaucuccacuuaguccccauaagaucucugggcuauaggugaucucaucugcauucuacagaggaacugaagguuucugagggugaagucaaagagugagacuuuccaaaggugagacuuuggacuucaaaugccauccucuagacaagugugcccaacuugcuugguccacaccuaccuugggauucccaucgggaugcaacaaaaaugguuuccaacuaccacucacccgaggguuagaaaacuuccaugguggcugagauauaagccagucucuauguaauggugaaggggacaagacuccccggggagagucuuuaauggggagaaccuaagaguucaguuauuuccaguccuccaaagagaaguuuaggauuuaaaggccaagcugcuucuuuuggccauuucugugggucaggggucuuggagucuuccugagaacuguggucagcugagcaagagguguaagucaucuccugccaggcaccugucaugucaggcuggcaacugaccugugaccugggggaguagacuuucgccugcaggggucaaacccaaaccggcauggguuucacucagugaaucuuugcuaacacuccucucccugcuucccaccacauacauccugacuuggguaugauauccaagaugcaggaacgaaccugguacugugacaccagacaggcuccagccacugggcauccucugagccuggaaaaggagcauccugguguggaggauggaguacucacugaggggcgggguggaccgcagcccucagaacuaucuguccuagcaucuacccaaugugaaacguccucuuaauaaugccucucugugaacauucuuccugucuuuucuucuuccuugugcuuucucuuauucccuauucuccaguggccaucuggcucuucagaauaccuuuuuguagggaucugacugagaagcagaucccagacccaaggacagaucuagacaaauuuuggguacuuuagaacaaucuagaauguagaaggcauggcccaugggguaagauuacacucuaaaaugagauuauggagagaaaguaccauggcagugagaaacaacaguuuagaucucugguuuaugacugaaagagucugacucaaaccugauuggaagagcgauugggauagccauggcugagccgggcaguggugacgcaggcuuucaucucagcacuugggaugcaaaggcagguggaucucucuguuugaggccagccuggucuacaaaaugaguuccaggacagucagggcuacacagagaaacccugucucagaggucaggguagaagaaaaaagggaggaggaggaggaggaggaggaggaggaggaaaaagaagaagaaaaagaagaagaagaagaagaagaagaagaagaagaagaagaagaagaagaagaagaagaagaagaagaagaagaagaagaagaagaagaagaaagaugaccauggccuucagaacuacaagccauuauacuuuuccagggcacugugcagcuaccaggaccuuauagcauuccagagugccucucuggaaagacauaggcacagggccacuggaggggggccucagcugggauugggccacaucugacugcaagacuaagagguucagacauguaaagugagccuucuuaacugugagggggcucuauaaagcaggagagauacugacaaauuggugcccccagcagcacccaaguuccuccuuaacaaacgggaggggguguccuccacccaggcaguguggggcaaugggcaucuccccugccccagcauaggaggcuuggguggggcagagcugcaggugugagcccugugucgugacucauagaaaguucauggggccagucccuggcauccccucuggggcugccccuaacaauccguguuccucucuuccaaggcauagacuugccagccuuggcaacaguggggcuaagaacuuagacuaaguccacuuuggugugauggauaccacacgcagccaggcacuuggaacccgagccgugggcuuugugucccucucucucuggacuucuggcaguguauucugcuaucggcucucagccucuacaugcaaggggccgaguugcaccuuuugggucuucugaccuugagagccccaguggagaaggacugugaggcugcagucaauaggagggucuggcuacagagacaauaaugagccaguccuggucuagagacagacuccaugaucagauuuggagccacuggccuuuucugugugaccuuugagagaccagucaggauugaauggaaauguccuucugcugcagcuccucuguaaacugggaaucuucaucuuucuauagagggcauugggaggaccuaggucuccagcagguguccagggguaugaagguggaccagcauacuuaucgaagagcucuggccacauaucauuugaauucccuggacacaaagaaaucuuugcaaagucuucccaucuuuccuuucaccugcccaucgguaaagcaagcaccagaucucugaaaccaacucuggucuuccagauccaaggugguugugcucaugggcacgugucugaacggcaucaagggguuggcacacaccuccccccaucucggccccuggcugacccugcugagcuuggcaccugaagcaauccuccugacacucuggggugcagccugcacuucacgcucugcucuggcuccauggcaccucaggguucauaggaacaauaacaacaagcagggagugacuguacuucccaguagccuuucauccugagagcucaaagcaguuuacagaccaagacucauccuuccucaguguaggucccagggccucggcaggggugagaaggggacagagagcacuggucugucuagaucagggcagcagugggcuggauggggcagugagucacuugacaugaaguggccacaaagucugggacagaaggaaaaugggaccgugggcuuccgcuucaggcugcaaaugaagagugauggucucccuuuaaaaccauguaguccagaccauuuuuuccuccauguacaaccugggugcuuguacuagggacuguuccaggagcuccugaagcagcagugcgugagagcaagcagaguccugggcaccagaggcuuccaggccaagucaagcagcccaggccucagggcgguggcugauccaggaacacguggaggaaaggggcuggcggggccuggcucuaaccugacuuggcuucacuagccuccauuccacccccacccccaccccuuuccuagaacccuugcuguguagaccaggcuggccuugaacucagaaaucugccucugcugggauuaaaggcaugcaccaccauugcccggcuaccauacaaaccgaaagccuuuccaugugcuuuucuguauucgacucugugagaauuaauuuagcuucuguugaacaaauaaaccuucggauccuguccucgggaagcucagagaaagauccuucauagaucccuaagaucagaauggcauagagccauaaacaggcaaagcaugguaaggagaggcacgauguugggacaauguaagaaggacccuggggagaaggugguaccugagcucagucuagauggggcuagggauuuaccagggaaagaacaggaagcggggucguguccaugucugacugaaccuuuccuaccagagcugagcccacaaaguagacauuaucaccaccacuucacaggcaggaaaacggagacagggacacucacaacuuaucuggacaucagccaugagcugguaaaaggacaagcucuugagcugacguuugccccuguccugccuuccccagucacaucuacuuagccccagguucuucugcauucuguaccccucaagacaaaccagugauauccagaggagccuuguuggccaccugugggagcgagccuucucgauagauggauaagcaagacagguauuuuguuuccugggcucuacagagaugagacacgggggauucagagaugagcaguaagucccugccauuaccgggagcuuggaacaugacuguggcagucagguaugaguaggaacuguggacaccgauacagaagggcagccggaggcccugagccugcaccaacaggcaguaaguaguuccugggaagaugggagucauuaugguugaacagccuggccagaaaccaaacuaagaauccagaguccagccagaucuaguaccacacugggaaguuuucugguuugagaaagucccuugugcagaagauguuuaaauaggaaccugauucaaagcaugaacuaggagcuugguaaaaaugugugcucuuggagcuaggcagauggaugggucaguaaggugcucucuuacuauucaaggaagaaggcuguaacacccacauaaaaaagcuagcugugguagcacacacuugcaauccuagcauuggacagauggcgacgggagggucucuagagcuugcuggacaguuauucuugucaaauuggugagcuccagguucaaugagagauccugccucaaacaaacaaacaaacacauccgagaagaacaauugaggaagacaccugaucuugacuuuuggccuccauacucauucacacacacacacacacacacacacacacacacacacacacacacacaugcguaugaacauauacauacacacauauaauacacauauauauuacaaagaaaugcaaacuucugagacuugcccuuaauuuauugaaucagaagggcugucaauguguguguuagcuagcucuguaguggaucaggaguugggcuccaguuugguuucaucccacccuacaaaacagagcccuauugggaccagaaagagcaguccuucguuaaggcuccugauuucaucaucuacucugcugucucggagcacaggccuguuugggcugaaggaugagcuggagaggagugcugggugggaaaagcgcugggauuaagcacggggccccacccugcccagagugcuuguagccaucuccauggacugcuggaggagcccaucaaugacagcccagccuuccaucaccgguucguuuguucaacccaugcgcagugagcgcugccucuguucacauaccuagaacaucaugaagcccuguuacauccucucucucaagccucccaagucuagaagauaagaaucuagugugcuccaugcuaagaagccccaagaagggcagcgaaaagguucagggugucugacuggagcagaggcugcugauggcuggguggaucggugaagacagaggcaucugagauuuugagggauggagaugagcugccagguacuaagguaugucuguucugggcccuguuagaaguuccugacauguaucaucucugcucugagaggugaaagggauggucccugucucucagacaaggaaaugaaggcucagagagguuaaguaacaacugguuacacaagacacuggccagagccagcaugcacaccaaggccuguuuggccccagcuguaugguggauccugccauucuguuuccuguguggagaauguuguauggacgcaggacagacugcacacguuagugacuuguuuugcccggaacuugugugauuccuggaaggaaauguuaagggaaaggagaaaggagguagagaggaaaaauacagacuaaccagauagcagccccugaaggucccagcuuccaucagaggaaggcuggcaccucauuucugagguuucugaggaagucagcaagguggguagagguaagugugccagcaguacccugcugacacaguguccugggguagugggucccugcuggugcaguguccugggguaggaggaccaugugggcuaucccaggcccuguagacaaugggggaagguaacaaaagcaagaggguuggugcaaguugaaugaacucgaacuuuggggaaaggcaagagaggcacagguugucaccgaugccaagguuaucaaaagggcauccagugggaaggagcuggagauguaggcucuccacuugucaugucugagcucgugccugaggcgguuugcuuccagcccccuugcccacacuagccuggaccacaucaguuucccagccuugccccauccccagcacagaacaaaagccugcauaugucaaagagacuggugagccauggauguugccuuccugugugaagccugcugagacccuucccugaagcccaauaguguuccacacaccucugugcuuucuucuaucuuaaaaacccucagcauagggcuguuguuucaacacaaagcuacugauuugcuuaguaaugauccaggcagauccuccagaaagaggccuuuguagccuugcuagugcacccaccaccaccccuacccccauagaagucagcaacaugugggaggucaggugaccccugaauuccccaagcccaaacaacccucccaauucagacagagguacagagccaccccaaagaggacaaaggcuuuacgguccuuuccucugcccucugaguuccccaagccaaagcugcccuagcccuuccccaacagggagucuccauacuggcuucuccuggaccagaaccuaaguaagacgucgucuaaagacuuuccccagcaggcagguuaaaugggguuugggcagacuguaagggccuuccagggcugucaaauccacucugucucauaccuaggcucccagccauuaaagagguggggagaccggaaacaccucuccuucuguucccacgggagggagaaagagagagagagagagagagagagagagagagagagagagagagagagagagagagagagagagagagagagagagagagagaacaugguucacaaaugaguuaacugaagcccccaggagacuagacagcuuaucuaaggccuucagugcaaaacugggagagugggaccuuagccccugugacagccuguggcucuccuuccccagaagucugagucgaacccccuagcccucauaaccagcugagaggcccucaguaucgcucucccagcucugguggccaugccucaucuggaaggcacugggugucugagaaagcaugugagagucuguggggucugugcagcuggugacaugcuccagagguuugugccaucuucccagccacagcaacuccccucagaugcccaucucugccgcucacagaccuggggcccuaccugagcaaugucaacugccuggcugccaguaaaguccuggagagaccacuggugaucuugggaugcuggacuacuggcaugggggcuguguguguguguguguguguguguguguguguguguguguguguguaucacucggcugucuggguaucugagugugugagguuggcaauucuagcuaggcagaggcuaguuuaaggcagaaucauccuagcuggccauugugcuccccgaaaccuuccccuaugugaugggcucugccuccucucuucagcagcacacacagcaacccuggccugcuccgccuuauagccgggguacaggcuuucacuggugcagggagaguggcuugccuggagucuuuuacccuuuccagcucccauggaaacccuaaggaggagguugagcaauaaggaugguuggagguggggagggcgggguugucuugcacugucucccugacuggugccgguacaacacaggccuguuggcuaugaacaguuggauagaaauaggaagagggcaaaguaagcccagguaccagguugggccugcuugucuagggacacauggcccauaauaaaaccaaaacccaaguggguauccgaucuuucugcaaggguccucacaacccuucugcagguuauaaggacaaucaagugcccauuucacagagcagaucccgggugcccacuugaaccagcuauguuuugagcuuaagauuguuuuguuuuguuuuguuuuuuucuuuucucauuugaacuuggagucuguaauuaaccucgaauagguugcagucacuuuguaggugggacugggguggggagggggccagcccacagcccgucagcagcagggcagaaggagacuuugaugccaggcaagcuggccgcauugucuccaggugcuagcugcaaaggggagugcugagucuuagucauaaggggagggucauuaacccuuuuaagaguccagugucccugcccuugguucuggaagcggggagguggggccaggucuccccaacuggguuuccuggccucagccugucugucucacucucagaucuaugugcuccacacccaccgcccacugcggagaggaaugaggucaagcagcuagcagcagcaccuccuggccuccgggcugggauguggggaaggaucgggcuguuguucuggguugcuaucuuuaaugaggugcucucuggggauggccugucacaaagauacaggccagaugcucugguuggcacugggugguaagaagcagaggccaccagauacuccauggcccaacuuauaccacaugagauguguccugaugauuugggggaauguguuagccagggaaagcuuuuguuguaggccuugagagaccuuccucuuguccuuagaaggcuuccaaaggcuaucucuccacacccuccuguccccaucaggguacccugacccugcugguggaaggaccccugagcuccuccaacccaaggaguaugggacuucaucccagaggaaacagaggggaguacugcccaguauucaagagccuuccuagaccauccacuugccacugacaucaacugguaggguuggggucagggaagacuugaauguuacccucuguaacauucuucuacacacaauuccuuguauccagugucugucauuugucccaaccccugagcucugggcuucugcaagccuccuuucuuugagaggagauacacucaucccucaggaugcuguuacuccuccacuuggccacaaagcugaccugauaaagucuaccccacuguuguuaauaucagaacacuggaggugaccugacagauucauccaaacaauggacuauuagacauccauuaaaaugauuuauagaugcauugcuugaguuggaaagaaaugcuuuccaauguguugacugaaaagggaucugaggcauuuuagaggaaaauguuuuagaggcgauauuugaaaauaugaagacuggguuuucucucugaagauaauugaauugauuuuaauguguuuuuccccuuuucuuauuuggauuguguaauucuucuacagcaaaauguauuucuuauguaacaaaagagugacagaggggacaugcuaaacucagggggauuggucauuccacguaguguuacgucaugucuguuugagaccaaagccagagacccagcauucagcagaugcucaguagauaacaggggcaggacgggacugaaugcuagcccacaggauagcuuugacucuggucugaaacagaacccccucuaucccagggacuuaguucucugcuugguucagcuuugaccucaggacacucuugggacccaaugugauggucuccacacccacacaccagcacagcauaaaauaguuagagcuggggcaggugccgugcuggggcuguggcuggagcuagcuccgucaugucugaaacccuuugagggcugucucuaggugccugaggucugcugcgugaacaacuucugagccuugugccaagagaacccagaguauugguauuggaucugaugucuggcagccacaaagggaguagucucuguucagaucaagaaagaguuuuaaaacauaaacaccacugucagucauucccaguucucuaaugcuuuccucugacacugucagaacaaauccagggcuaucaauggggagguccccaguccuugccauagguucugggcucagggguggggcugcagagguuccccagccccccagcacuguuccaaaggucaacuggcacacacucuucuuuccuacaaucugagcugcugcaauaaacccaccgaggaacuuuccagaugcagacaacuaagccuacugaauacgcccagccuccccuuucaggagauucuugugaggaaauuccaaaagcuagaagagaaaacucugucaagagcaagacaugguucaagcuugcuguuguucucaggaugcacuuuagaccaguguugcccaaugcaagcacgauucaaauaugucacucagaauugccuggcugacacaugcgaaguuaaaacaagaaaaaaggcaagcccaguccaggcuucccauccugacuuuauagcccugucaccugggcccuuccucuucaccuucauaggcuguuaaggcccgugaacuugaacguuugcugucccuaccucaugcuuccuauugguugcugacugaaguugggcuccccaaguucagaguguccaguuuacuucccaaugaaugaacaguggucaggcaggcggcagcuugagucacucacaggaaaugaauugagugaaugagugagugaaugagugagugaaugagugagugagugagugagugagugaaugaauguggagugagugaacuaggcagaguuguucaagaguggcuaguggggcacgugaguucccaugggauggagagggacccuugggaucugaaauaaugggucauguuucaacaaaggcauagaguggcuuuggagcuccguuccuuggaucucugcuccugccugcucacugccucugucuggcgcacuccaagcccuucgcccacacaugaagccacggccccugauucacuguaccuccuuuggcugggacucaagucaagaaacaagguggcagagucaucauggcuuccuuccaccgugucacucccacccuucaguggcuggcuggaaucaaggcugggagcaaagaggccuggggucccaggggacgagacuccccuggugucagaacuacagggaaguugacacacuccauuaggaaaagccagcacuuuagaacccacaaagagcucuaucccagucacaagauggcacagcgcuuagacuagcuggaggucagcaccagaccaagguuagaggacuucuaccuguuaaucuuagaaugaagcuaggugugcagaugugcuguggguguggucagcacugggaugugcacugauugacacacuccagcaugugugaaagacaaaaaggagccagggaacccacacaacuggauggcuuucccggcccucgauguccaggcugugcgcagaccccugcccaggugguucccauuagcuuccaggguucagaacuaugagguguggcaggaacuauggagcuuaggaaagaguauggggcuugaggaaaagaaggaugcuaggcaucuuagagucaugaaguugcagaaggcuccacucugaugcagacuucucuuggaccaaaugaagaaggaagacaggaaaggagggauuggcagaccugccaaccaugcauuuuaaaauguaagaagcaaaugacugagggaaaacauuguaacagaagguuuguggccuuaauauuuuuguagcacucuugcaaauccauaagaugagcagucaauugaaaaacaggcggcagacaugaacgagcaauuccagaggacgaaacacaaugggccaacgcacuuauaagaacucuucagacucagcagccaucaaauaaaugcaaaucacaacaacaaagagacguuaucuauugcuuagcuaauugauagagauuaaaggagagauaaugcccaggauggugagggugugggaaaaaacuccuccugucauuuagaagagcaguaugaauugguauagcuuuucaauuuggcagaacaaaauuacuuuccugggugucauuacugagggagguuguauagccuuugacacagcaaugccacuuuuaggaagacugccuuaggaaacaguugugcauagcaauaaugaccucuauuaagugccuuacaugcauuauuauaucauaugacccucaccggcaucccgcaaaguagcggcugcucuuuaucuccuguaguguacaggcaagaaacaucgaagcagauaagaauuaggucaauggccucaggacacaaagcuuaacaaguggccagaccuaggcuagaagucaggcagucuugaguccccuggaugugugcaggaaccaagccagagauggcccucggggguugauuuguaaugggagcauggggggagagcaugcuaagugccucccgacagcaauaaguuacauaaauuaugauacgcccacacaggaauauuaugcaagugugaaaagugauucuguagaaaaauaugugugugacugccagggaaauuuuuucauacgcauaaaagaucucuaaaaggauagcaaagaaacugauaaaauuaguuacccacaugcuacacugagaagcaagagggagguuuguuuuauaaaauauaugcucuucuuacauuuagaucaugugacuacauucuauguuaaaauauguaucugugcgcauauacgcauguaaguuaugauauagagcuuuauuccccagaguaaaagauuccaaaaaacauguuugaaagcccguacucagucauacuucagaccaguaugaaggaaggaagggcuauccaucccuaugguccccaagccagcuucauuguggaacccuuuucuuaaacaucgaucugucuucaucucucaagacauuugcaaguuagguucugagaaugguggugguacugaacacccaggugaggggguuacauuauuucuuuaaaugaaaggaucacguuacugcacuggucccauuuucuuuaaagauuguguguguguguguguguguguguguguguguguguguguguguguguguauguguuuggggggugaguguguguuugggggggugaguguguguguaugugucugucugccugccugccugccugucugauuuccaacuauugaaauagugaacuguuuuguuugccuguguuuacucguuguuuugcccuguuuuaagcugaaccaaaugaccuccacagguguaugugcuugcucccagcccgacaaagcauugucuguuacuuuccuucuggucucugccccucgcucccauucucuccuaccugugagaagaccuggggauaaguugggaaggaaacucugccuuuagccagccccuucuccugccuucucccagagcugccucugccccacuguggggcugugacagaaaaagaaaugccuguuccauagacagggccagcagguuuccggacaguuccuaacccugcuaggccaucccuucuacugauggaagggcucaaacccaggcucugcuuuccucauugagagacaggguuccaaaagcaggcgcuagccugccaucugcccuacaugcugcaaauccaaacacccaggcuuuggccugagcccuguggcugccuggcuguguggucucaguuaaguuucugaaccucugagucaacucuaccuacaauggagugccacaaagagcugaggaaucaaacaggaguuugcuggacagcugcguguuccaggaagggccaucucaaggcagauuauuaugugacccaacagggagcccagcauguccuugcuuuccugggaaccaaguacuuuuguccccugugggguguguguguguguguguuauggugacagcaaguggccauaugggagucuaggaugugugggaacagccugggguuucagaaaacaggaaaaagcuuaagcuuagugucccagccugggccuaugcccaucagucuaacugcucugcaugacccuuugacagcccacugccguggcucacacuccgucagccuagggcuaucucagccugccucaccuccucacuuuccuccaaaucccaucuuuuagcucguagcugcuugagcccuggucccaggguuagaacuacgacuaccccucugggcucuaccacccuaaugucaccugccaugcugcagugacaaugccagguuacagugcccaugccagguugaccuuucugggagugauagcugagucuaccaucuugucuuccugugucgucugggcccagcauaagccugguggggggaggggaggcaaaggggagggaagacgggauagaucaugaguacugaggucaugaucugcauuugaaccucauguccauuacugacccucagggaagugacuucacucuucuaagccucaguuucccugucuauuaaauggguuuaaacacugccgugaagucauggaaguuauuaugaagguuuuacaagcagaugugaagcucuugguaccaacccgaggccagaggaguguccagagguagcaggaccuuguucccaccgcagacucuaaaugugggcugaguugggcuaaagacaaauggcagaagagauggcuucugcucuccccagcuccagccucaaaauggaggcuccuaaugcucgugacuggcacuguucucaccaccccgacacucacuuaccugccuugcacucugcagccacccggcccaagcugaagaagaugaagagccagacaggagaggugggugagaagcagucgcucaagugugaggcagcggcgggaaacccccagcccuccuaucgcugguucaaggauggcaaggaacucaaccggagucgugauauucgcaucaaguauggcaauggcaggugagccgucccaccuucccuccaucuccccagcugucaguccuagaagggagggccagagcagcguccccaaccauggaaccagccggguuccccucuaugcaucccugccuugccacaucccaaugcuccccugacuucagagucgcuugugccaggccugcccugagauugcacaccauggacaagaguuaaggaauucccagggcuggggauguaccucauagauaaagugcuugcuuagcaugcacaaagccuuggguucaaacccagcaccacauaaaaccagggguggugccggccacaugccuuugaucucugcacuuaggagguggagucaggcagaucagaaguucaaggucauccuuggcuagguagcaaguugaagccaguuugggcugaaugagacccugucucaccagaaaaaaaaaaaaaaagaaugaaugaagccauuuauguucaguccaguugauuccaagcugucuuuagcagcagaaauccugcuuaucaaaaaaaccuagcaucacaucuuagagaccccaaauuuggccauuugaggugaaagacccugucuccagaaagccuuugggaagucacauaagacaaagggcuggccuccugcucugguaagccgccaguuguaugaggguucaguaaguaggaagagaacgcugacugacuuugggggucugcggcugauacuuccccacugcgugaagagugucuucagcccuaaaugucucaggagcaugguauauacauucccugaagucucaggcuggcgagauacaaggcaucaccucucugccauuaaacacacuucuacccaaccucucugugggcucuggggucuagguagauauucuacucuuaggaacuccucaacccucaccccaaaaguagcuugcacaaagguguuuugcuuuuguuuguuuguuuguuuaggauuuauuauuauacauaaauacacuguagcugacuucuaggugaccagaagagggugucauaucucauuacaggugguugugauccaccaugugguugcugggauuugaacucaggaccuucggaagagcagucagugcucuuacccguugagccaucucuccagccucguuuuuuuguuuguuuuugagaucaccagccuaucccacaacagaaaauguuacauggauauccagguucagaccacccuaccucaccuuggaggccugcagccuaaggagagaaaugagagucaagaccucagcucugccuucacuuuccuuccaagacuugaaccaaagaccgugggccccacggaaagucauaagggaggcuuuagaugacaggccugugguuaugauaaggcuaauuccugagggagcuacaggaacggagaggugcggagguuuggaauauaugucccuugucuauaauacugacaagaaaugcagucuaacuacccagccccacacccccagcuccucccuaccaccuuagaaaaaaaauguagacaggacucuuggaccugggacuagaggggcuucugccccucagcuucuccauuauuuccccgggucugacuccagggaagggacuggcccucgucuucugcucugcucccaagcauggagcccaucuuccuaucaggccuugcaccacacugccucacacccucccuucuaauacucacacacucauacccucacacccucacacaacacacacacacacacacacacacacacacauacccucacacaacacacacacacacacucauacccucacacccucccuucuaauacucacacacucauacccucacacccucacacaacacacacacacacacacacacauacccucacacaacacacacacacacacucauacccucacaccauacacacacacacacacauucauacccucacaccauacacacacacacacacauucauacccucacaccauacacacacacacauucauacacacacacacauacccucacacaacacaccauacacacacauucauacccucacaccauacacacacacacauucauacccucacaccauacacacacacacacacacacacacacacacacacacacacauucauacccucacaccauucauacacacacucauacccucacacccucacacacacacacacacacacacacucacacccucacacacacacguuccacucugcugaggcaccuccagagugccuuucucugguaacuuuagccucucucccucuuccucccagcaaacuuuaucccauccaucccucuuccagaaugcuuucucggacugcuguguccucccugcuucugcugugguuucuuucaucaccucagccccuucauucacaccuuucaacuucaggccacacugccuucccaaggcagcuagaucagcacaaccucagccccccaccccaugaccucuggggucccaagccuaggcugccaaccagcacuuugguacagugacaggguuggccugucccugugaguucuccgcuggcccuccugugaggucgaucugagaucgcaguggugcugggcuaccccuuaggcuucccugcucucucccuccccagcagugauaccaccuuccuagggcuuuacaucucugagacuccaggccuccaccucuaggcuugguggcagugucacucaugcuacacugugaugccagcugaccaccaaacucuacuccugagaccugacaggagucucugacucaguauguccccagccagcccucccacccucgauaacccagcugcuccuugucauccuaucugcugugcacacauggcggcccccagcaacugccccuugccaucucugcagguagacacaaccucccugccuuaaauaguucucaucuggccuccccuccucccaaccucuuauucucaacccuggauuugcccccuagacugggaaaaucaccccucuuguucccagcaaaggcccagcuuaaauauuacggcucaggaauaucuaccuaagcccuccaaucagcccuuguccccucucaugguacuuuagacaucgcuucaucgcacccuugagaaacccaccacuccucucaggagaacccccaccucauccucccugcaggccuggaagcugacaagacucccagggccggccuuccucucuugggguugaggucaucauccuucgagaggacgagcaggggacacuauggagaguccaaacuucuaaacaacuaauuucuugguugaaccucagauucaucugacacaugggcaaccuaauccagagacaaggccuagucaggugguagccuaggugguagaucguuggaucugaaauaugcuaugaccccuuucccaugugcugccuucagaaaugucccuuguccccaccuguucuguucccugggcucccagcaauacauugggguuuuuuuuguuuguuuuuuuguuuuuucuuuuauuuauuauuagauuuuuuuaaagauuuauuuauuauaugaugaguacacuguagcuaucuucauacacaccagaagagggcaucggaucccauuacagaugguugugaaccaccaugugguugcugggaauugaacucaggaccgcuggaagagcagccagugcucuuaaccgcugagccaucucuccagcccuagauauuuucuuuauauacauuucaaaugcuaucccgaaauuucccuauacccucccuccgcccugcuccccuacccacccacucccgcuucuuggcccuggcauuccccuguauuggggcauauaaaguuugcaauaccaaggggccucucuucccacugauggccgacuaggccaucuucugcuacauaugcagcuagagauacgagcucuggggguacugguuaguucauauuguuguuccaccuauaggguugcagacuucuuuagcuccuugggugcuuucucuagguucucuauugggggcccuguguuccauccuacagaugacugugagcauccacuucuguauuugccaggcacugacauagccucauacgagacagcuauaacagggucccaguacauuguuaacugugaaggaauaggucaugauagggcgcuuuuaauuaucugugacuaagguccucucaaugugacuccaagagagcugccaccucuccauccuacccagucccccacuacccaaaccucaccagcacgggagccagagcacagagcaaggagccucuuuucugaugagccucucucuguccuuccuccauggguuccucgugcucugccugcccaggcuauauucagccuugguaucucugcuggcagagaccgacuucccgacaggggcugacugucugucucugcccgucaaauugcagugucacccaagccuuccugagccaggagaaaacuugcccccaccccacccccagcccagggcacaggcccuccccugcagaaccgcauguucccuuauuuaugaggggcaggcugggacaggccccucaggcaggcagaggagccaggcacugcggaaaguguggggcugcccagauccugucccugccagcagagaaccggcuagggagggugggacagcaccauuacaggggcagaccugggucagcacacagaugaagcagcaggaguguacauccugccugcuagccaggaagacugggagagaaccccgaagcccagggacuccagauagaucuaaggauggggagagugcggucccagcaacgccagccugagagaccuucaggguccagccucagucauagcucugauaaacuucccacuucccugagaccucugauaaaccagaugaaccagugaaccaagaugccuauuccugccacaccuaagaauuguuauuaccucuuucuuaucccaaaagggguccuuugccaagccccgucccacuugauccuggucuccuguacccuuagugggggagaccuuccuccaagucucauugcugcuccugagcugcucugccuuguccugcuacaaauaacacugcagcugugggugaccauggggagcuggcuggcucugggcccccuaacaugaacccuuuggcccucagcggacacaccccuucccugccuauccaguaugcaugaaagugagggaagcuuuggcccagggaagugggaaucuguaacaucuaauuaggcuucgaugaggagauguucacuuaggcagaggggccuccaggguucugcuuaaugaaggaaacuaguggauagaggagagcugugggcaggcacaagcccaaggagagaccuacccaggaaagauacaggcaagcaacucucaccacauuggcgaggccgucaucaacgcaguaaggucugucagucuguagcaaccucgugggaaugugggagggagaugugugggaagaggcagaggcaaagugaagagggggagccuccugcucaucucuccucccauucccucccugucccccauccccugucucccaauuccaguccuuaucccagcagugucauggcucuccuuugcauccuuggggcucaggcaggacaauggcagcuacaccugccguuacuccacccagcugugcaucugcaaggaaucugguuuuuuaaucugcuccuaaaaagaagaggagaucccagcauguaaagacaaugugaccuuuacuggagucccuggcuuuauccagagcacuuucugggccccaggaaacaucagaugcaggaaggguugggagcugugaacagagccuuggagagccaagaagccccagaguuggugcggggaagcuuugagaaggaagcagagauuuggucagggcuuuggaaagaaaccaaaccacugcucuggagucucuguaugcaggagggacggcuaggaccuggcuucaaacuacucaagagagaaaucagaggaaggggcagcccuagcuucugguguccucacugaccucaguuccuguaccaccucugcuuugcuuugcuguguccaucagccacucacauuguggaaggaauuaaaccaaagucucuuagucagagagacuacagagggccccucaaugguagggcugagcagauggacaguaggagagagucacauauguggacugguacccugacacaguugcagcugaagccaucaggcaggugcucucccagguaccugggguuagaguccaugcugcuguuauaauggcguacccagacagacucacuuauaaacaguggggauguauuuggaccacaguuguagagggugggaacuccaggaucgagggucugagggccuuuucaaugcuguguguccucaugaccugcuagcaccauugcagugggagaaguggggaccagcggaccuugggagacacauccaaaccauaauuccaaacagggacaaucugccacuucuagggauggcaaaggcagcugagaaggagagacauggccaugugacuuccuaaggggccuggccuucuuccccaagaaaaacaauauaaagaaagccagccacaggaaaagaguugugaagagucacagacuuagaacauguguacuguggcuauaugcacccuguguugcccugaagguucaaaucucugcccagcuccaggguucaucguaccaaccugcacuccagaaaagacuggccugagggaccuucuucucacccaaccuacacacacauuggugguucuguaaugugaccacucggugaccacugauaagcucuggcagcccuggcucacaccucucucccucuuuccucucccaacccagaaagaacucacggcuacaguucaacaaagugaggguggaggaugccggggaguacgucugugaggccgagaacauccuugggaaggacaccgugaggggccgacuccaugucaacagcgguaggugucccucaagaaagagaaggguucugggggacuuggcagaacagaucagcugccccucggcccagcacaugaucuauccugcacucacccccccccuuuccuguugcugcauaucaaacccaagaucucagcugaaucagagaaaugcagucaaagcauaaauguuuaguuuuguuaucugggccuggaagagccgccagcucucauuuuaaauacccugaaaacuaaauauuuugaaaucaagagguagggguugggggaaggauauuuuuagaaggcaauuaugagaggcugggcugucagaagcgagguugggggagagacaggccuggggugggugugagcugcaugccuguugccagcugcauugucagacaccugagccaggccugagggugggaggcuggagugcccaggacccgugggcagccuccauuuagggauaacagaccugucucacagacccuauucccucuuuugagacuuacaaaggagggccucaggauuguuuggcuuacugguucacaguguccaaugcaguaucagaacagauaacaccuuucugcugggcuguccucucgagcccugguuuagggccuagaaagccaccuuuccucucugccugagcugggcacucacagacugagcccuaccauguaggguuugcuguuaaaguccugucccuggcauaggcucugacccuguauauguugcccccugaguacacuaccacagcccaaccucgaaucuaaagaggaaccugcagcauucauuaccuaggccccagcaguacgcuaaugagagacaccucgucucccagccucaggcuucuugggcucucgagccacugugucacagaagucuaagucuagaucuuucucacaucugucccuucagucccaucccuaccucaagggcagccacagcucaggcuucacccucacuucacccuuuuauagugccuuuuugaaggcaaacccuuccuuuccauggagccccaacauaagcacuugguccuuucccaucugaccccacuccccuuuaccccccaccccaccauccagauccuuucaaaccacaggcagucuuggccuuuaacccucugcucauuccagugucacucuggauccaaacccaauccuggccuaucucuugacccaccauggucugguggcaucucuugaaugccuuaagccccacacuguugcuggguuuguucugugcuuugaccacccagugcaggagaagcaaagagaacagggucgaugcagucuccugggauuucuggucacaucuacuauuuacugagccagacucuguuuucucucauggauucuucuuuaggggaggcucagaaagguuguauauuuugcauaaacagcuuauuacugauugggcucuacaguguggaugucauuagugaacuuggucguggcacuccauggacuugauuacuacccuggccucaggggccuagcuagcacaaugccugccucacacuagguagcugcuaaaugucauauuaaagaaauuacaaccuacaguuaggaauguaguucagugguagaguucuugccuagcauaugcaaggccugaauuucacuaccuuuguuuguuugcuuguuuguuuuuugagacagggucucucuacuuaacccuggcugucugaaaacucacuguguagaccaggcuggccuugaacucacggagauacacuugccucugccucccaagugcugggauuaaaggcaugugcugauauacccagcuuucaauaugauuuuuuuuuaauuuaaaaagagaaagagcuaucccaaagccuuuguggccuccucgauuuccuagcuggagaagggugacagagggggauacuuggauggggcgacccuccagccaucccaaagugggguguaccuaggcuuagcaucugccaucucuguuguagugagcaggcagacucugcguuucccauuuuacuaaugaagacuuccuggguuagaauggacaaguauccaaccuaagccagucuuaaggacugcauuuauugucucgugaaacuagaaaguccagaggucaucuagcuccaggcagaacagaguucgggaacuggaagugguuugguuccugcuuucucccucuucuuccacacuguagagcccaaucagaaagagaaggcaccagccucagccagcccccaucccuguguccuccuggagcaggcacgagaauggcuucuuagucauccugccgaggucacgugcacacuuggccugguuacugugguggaggaguaccaucuuuaccagacuuaucugugugcaggacuauaaagaggcagaacacccugagaaauggcccuccaucucacuaugugaggcgaacagaacagggaaagguuccccaccauagcugugcccucucugaugcacaccgcccacaggcaucagugucuguugucucugcagccuggugugagaacagaggcccaggaguuagaaagagcucagagauauccagagacuccagcucugugcuccaaagcuuuccccucguaggcugagcucugcggucuuaaccuucuccuaaacuccugggauugugcauuugcugccgaggcugccaucugcaccucaccagcacacacacaggcauacacacacacacacacacacacacacacacacacacacacacaccgcacaccuuuucucuucccucuuuggagcauggcaggccaggcuccuccugauguggagaagugaucauguccauuuucccaggcagagaugcauggauuucuuguuuaccagugaaaugcagcagacuugcagcaaccacgcccugaggaggggguggagggcaggcagcaagcgggcagcucugccugcccccagugacucaucccaagguggguuggcauggcccgccuagccccaaggggagcagggccauggggauggggcaucaaagggcaucgucccacucuuggauagcuaccuaccucuccauuaggguggagcuguaguccuucccagaucagagcaggcccuccggaagugacaguucugggucucacaggagcuccuagggcugacauggaagaggaaugugcagacauaggcagagcuuguaacaaaacagucuucauggugcaauccccuuccaucuuacagaagccagaagcccaucccaacugaaagggaauuugggccugucccaggagacagagcacagggcaggcagguuugacaugagguguuacaagacugugggcaugugguagaggccucuggucaagggaucacugguggaacacaucuaugcaugcacacacaagcacacacccucacaucaguuguauucaguauggcccugcucuaagaucagagaggcacaaccacgguuaccagcauaggaccucagaugacagcaagguaaaguucuagaucuaugccucuuccaauaaacaaaguagggguucuggggauggacaccugagccaaauguaaaggagccauuugcacagcaaggcaagugcugaauagcucaaagcaauggaccuuaaagaggggaagaaguuugcccaugcucaaaagaggaaggcagcugcagccaggauagcagagaggaacucgguguucacucucagccucugucccauuucaucuuccuaugaaggucugggacagcuugcaccaagacacucacagcaacugcucccugaguuuuccccuucugggcaugguuuuaauuaauuuuuagauauaauuuucauaccauaaaauuugcccuuuuaaaguaugauucagugguuuuccguauagucaccaacuuauguaaccaucuccacuaauucuaagacguuuucauccccacaucaggaacuccucccuccaaugccacaaccauggcucuugcuuucugccccuacagauuagcuuucguagacaguuuauauaaauauaacguauaaguggccuccacauaccuuaaggcccauccauguuguagcauguaugagugcauuccuuuuaugguaaaaugauauuccggugugugaagguacuguauuuuauucacccauucaacggguuugaauuguugacucauuuggaucauugccacaguggggccgaugaauaacgcuucugcggacauucguguucagguguuuguaagcacacacauuuuuagucuugaggauacacccaagaguggaauuucuugaguacaugguaacucugaagauuuuaauucuuuauuuuaaagaacuccaugaccagaugccuaagcagccaggccacuguacauucccgcccacggugccccaggguucugugucuccacauccccuccacaaacugugauuuuccccgcuccaccauucuggcccucucaguaggugugaaguaguaucccacuguggcuuugaggagacagugucuuacagaaaagauauccgcggccaugcuaaggacacuaggcuaugcucagggaagcagcagagcacauuuccccucaagagucagauacgcacuugcucauucacucugucagcaaacauuaggcaccuauucugugucgagcgagcguuugucuggaugauggggguuagugacacgugauguggccacagcuuggguucuagugguggagcuagcgaugguauacaugguuccuuaaucagcuuaaaauaaauacuccuagcagaagccuguacagugaacagaaagauuguggggguugcagccaucuagagaaggccggggaggcuacccugagacggugauauuucaaagggcagcagggcagcagggcagcagggcaccugacuacaccugaagugagucuaguuaaauacguugaaagaacaggguaaaaaauaacagaaaggugaugagacccagauuagaccugacgagggguuggggccuuuguugugacuacacucauuuauagggacgccauggucauggggaggguugacacaauucacauauuuuaaagaccaccauggcagauuuucagcaaaaaggccagagugcaggcaaauguccaguaaguaaggucaccugaggaagaagugacaauaauaggcuggaccagguaaggaagccggaggugguagaaguggccaugccuggaggaauauauauagcagaaagaauaaagagagaauggaaaacgcgcucuaggaccuuggggcucacacacauagggaagacuagagaagagguugagacagguaacugggaggccaguuuggacauacuggauuugggguagcaaccagccauccugguggacaggucgagagagcaggcuucucccaccuuugcuucuccaacaacaagagaacagugacaaaguacugaugcauucacaaggggauuuaaaaccugcgagugccagaccagugugaggacaucauggccugacaccuucuguggggcacacaccucccugugcuguggcuucacuaccacuacaguuaugcuaaaguagguugggaaggccuugcccugucagaagagguggggagacuugugccacucuucccugacaucaguggcuaccucccucaccaugcucccuugucuuucuggggugcuaugguauuggcaacccagacucaguguaccacaacuagguggccuccaucccucuucuguggucccugacaccccagcauccucaccucuguccacugcuuccucaaccuagcagaauaacaauaaagaccggacagcaggaggucucugcuaccauggcugcaaaggagcccugcugggccugacugguccagaccaagauuccuuaggcuuagccaaggccccugggaagccccaggcugugguccacauucaucuccuugcauccagccuuggugcugacauguucucucacaagggacaggguaucuggcaagaauacacaacugcagcucuagacaggcacuccgccacugucucucuucacuccucccacgagguguaaccaaagggcaagacaaccucuaagcccucgacuccaggaucugcccaguguuggacuuuauaacuugcaggcauggucaccguacuccugucucuucuuugucccuuucuuaguuuccugggucucuaugacccagauuuggagcaaacaccaguaaaagcuuccuuugccuggcuagcaugugggucccagcuggguuugcaguggggcccuagaggagaccucagcagggguggggccugagaugccagcucugcaacaggcauggggcugagagaagggugggagcuggccugcugaguuuuaucugugagcuccucagacauauacagaggcagugcuguguguacacuccaguccuccacgcuccaucugucucccuacaugucuaaacacugagggugccaagcgccugccugcuccauccuccuccuccccucgccuccuccccacugcugaugggagcaguggaggcugccaccccaggggagauaaggguagccaauguggagugggacaccucaguccgaggaccaccgcugggcaggagugagagacccucagagccccagagcaggaauagggaauagggacuccuuuuugacagcgcauucuggaaagccaguguggggcauuggcuuacaaaagauggcuuugcauuuaaagccagcuuucuggacacuguccccugcuaagggagcagaucacucauuacucucacuguuucgggcaagccugaucaaucagaugcacagccuggguuagcagccagccuuucucccaccuggcuuucauaucccagcuguucccugacccuccacccccacccccacccccaccccaacccccaccccguuccucucccagcuccuucugaacuuuaugauguauagcuuaggcuggccaaggucugaaggcucccuccaccagcaacagcuaacaaggagagagcugucuaguguggggacaugaaggagacccugaacaauucuacagacaggccauagcagccuuucauaucaugacagcccuggaaacaagagaagagaguggaagccaagacccagcccccaacagacacugucccagagcucagaaaaaugacaguauccuaaagguguccuuuucucugaucccccugguucacauccaguccuauaguggacaccccuaagaggaaggccaaaguagugcaaaggucaggccuuccuccaguggaggaagcucuuucuggucucuuccaccccuucaagauaguggaaacccccuagcuuuuguagguuucccaagagaaccacacugggcagagggucuguuguggcuugcuguuuaccuugugguccaccaagagauacccacuagcccuuuccugcccaggcaucccugcagauucuagggaccuuccaguuuuaagauagaaacaugaaagaacacaaaggaaguggucccugugcccagagguggugucggugggucacuagcgccugucucucauaccuccagugagcaccacucugucauccuggucgggacaugcccggaagugcaaugagaccgccaaguccuacugugugaauggaggcgugugcuacuacaucgagggcaucaaccagcucuccugcaaguaagugaccggucggggugggcauggggccaagagcaggggaggagaugcugggacggaaguggaggguucuaggaaaaaagugagcuucaagcuacuuggaagugauuccccagggggcacagaaagggugguuugcccacuuucuagucuuuuccuggacucuaaagauauguaagcucuaagggauguguggauuccuauaggacccgguuugcuaggccccuaucacccuguguccugaugcccaccucuuaccaacacugcagggagguggagauaccagucuaaggcacuggguguucucucucucucucucucucucucucucucuuucucucucucucuccccuuuuucugucucuaucucugucugucucuauccgccccccauuuugucuuucuuccccaucucuaagcaacucuccaaauuuguccugagugaacauguccugacugauucuucucccauagugcuaagccuggaagcgcaggacacaagcuccagaucccucagcaccugguagucccacucuuguugucuagaggagaaauagggguuuagaaacugagggaagaccuuaggaaacaggagggacccagagcccagugcuggccuuagaucugauuguccuuccugcucugugaccaaaaguggccaguccuguccugagcauugcuugugccauuuuaaccccagccccucucuauggaagguggggacuccagcaaggauaccacuaugggaguggcccaguggaggagguggagguggccccagcaggaacuccaaggagcucagaacucaacugcccauucugcagcacucaggacuguguggaggaggccaccaggaagggcuuuuucagucccagcaggucugcugggcaguccuccugcaugugugugaggaguuugacacaaaccuaaggagcacaacucuggccagaccuuaaggaggaauaggaagggggucuagucagcaacuuggauuucucaaagcaacccaugccaagggugccccagacuagguaccaguacuguucuguucccaugauaucuggacaaaggcaacuaagaguugcuaguucagaaagagggucuugaccaggcuuuccugccucugccuccccccccccccccccaggucagaucuuacacccuuaucacugccuuggccuuucuagucaugugaaccagagaggagacuggggcuuuuaaagaauccuacacaagcugauagggucccaguguccauguguccucucacucacccacaagagagcuugguggcacagccaggcagaacuguggcucaggccccagcuggccuccuugauggcuuccuccauggucccacccuucaccugaugucaccccuuuccccacuccuccuuccuaaacccuucagggaaguucuaagagcaacaacagguacuccagagaaauucaaggccuggccucagcuucugagacacagccacaguagcaguucaggcccugagaaacauagccuugcagcugcucugagaucuucagaauagagaucccagcacaccucacagagauguccuagcccugacucuccuuccccucugccacaccaggccucuccuucucccuagucccuuggaccccugaccucccacccccaccccaaagaaucuagcguuaucacugaggucagcccuggcugcaggcaggaagacuuugcuccccaagacagguacaaggacaaagcagguccccagagccaagacuccaagauggagugcaguauaagaaagggaaggagaagacaauggcucccagggaaccugccaguaugacugugccccuaggagccaggggauaugccuugcuacauuugaaaggagcagggagacaggccugagcccuugugaacacgagggugcccuguuuccucccccccacccagggcaacucgguuucaaaugugaaauugguacccagagccaccacuugcccaucuuugccccccugggacagccccagucaaggcuccuuaaccugcuucccugaaccccuuugucacauacaagggagagggauauccccagcugggacugcaguccuuggagcugugcuggagaagggcaggggggagggggccgggcagagcccagaggccauucugagggugggaaacggggugggagguggggcaggccucuugggguuucugacgacaccugaauggagugaaaaggaaagaacuuaggaacgggacucacgucuaccauuugugcuguuuguuucuuuuuauuuugauuuuuuugcauuuccgcuuagcuuggauaaugaaacuacacuggucaguuucauuccaguuucuauaaaacucaguuucccuccugguuuucuuacacuuguugcuguguauugguucagagcccccccaggggguguuggaaagcaggcaggcacacucuguaacccucuuguuuuucuggaagucagugccaaaagaaagugucacugauacugaauuuuguuuuuguuuuuuguuuuuuguuuuuuuuuuuaaagaaaacuuaaggggacuugaaaauggggguccaaaccaaggugacugucuccugucugggccuccucuugccguuuucuccucuucucuccguguguuuguugagcacgguuggugcgugacucuuggggacugguucaggggaugaugacagaacaagacucuuuccagcccugugcauacaccaguggcaugccgcccucucccauccgcucaucuccuccauccccagcuucccccaccccaucccaccccaucugccugcucaucuucacuucaucuccaccugcccugugagcuccgagacccuggcucccuccagugccugggccacagccucauccuucauccuuccuucuccaggugagggcagcacacauggcauuauccccaggcuacuaaaaggagaaacugaggcccgggagguggguggggaacaggaacagcagagguccugaccucucugccaccccagauguagcccaugggcucucuucucugcccuucucucacccuguucuucuccagccccagguucagaccuucucagagucagaggugacgccuacaggaaggacuagaaaggcugcagccugcugccccuuccgacccagccccaauucccccgaaaaucuuagagucauccuguuugaaugggagccacagccaccagccagccacccacacccgaugcagacuccuuucauguugauaaaaggagacaucuggcuccuucuacgcuggucuggcuccaaggcagaaaggccaaaggcccugcuuacacuuagaaccuucucugaggaagccugagucuccacacacaggacuguagagagaacuaggaguauccaagagccccuaaaggaacuaacaccccacagcauagcacuggcuaucaguccuccugcccccucaccugacaaccuaucccccaagaccuuuucuuuauccauugagaaggagcaccccucucucagacaggugcaaggcuaacaccagaacacugcacugaucccaugaccccaccuagaacugugcaggacaguagcccugagcaggcaggcagacuaguucagguugagugugaggcagggacacaggggucuauuuauaguugucacuguucuucaagauucaugggacgacagcacuuaaucccuucuugccccuucacuugacuguucucucuuaaacacacacacacacacacacacacacacacacacacacacacacacacacuuauauacaugguuucccugccucuaagagccuagcuaguggcagacaauggacacagucaagccuguuccuuuccuguuacuuuguggaacccaagagucauuuccacuucugggucuuuauccucuacucccaaaggugcuucuguuugaaaaaagaaucacuucacucacuuuuaaucccccacaucagggcccaggagcaaaggaagaagagcugagccuggcuggagucaguugggaagccuuggcuacuuccuccaucuuccugggcuaaagugacuagggacaagggucagggaucagagauaguaaugaggggcucauccccuaagccacacuauucaaucgagugagcaugcauugcuauugcccaugcucaauaguuguacuucccagccagaccuccaaaugcgugugcaccugugcuccaccaccacaguguccaguucccuccuucccgaacccagggauaccacaggcccagagaaacaccggugagcaacccacaagccacuacccuuccguauuccucuagauuagacgccacaggguuuucgugauuaucuaucauagccaauggcuaacgccuaacuauaaggccaagggcucucuuguuaugcucaguagaaggcuaaggcagagacuucucaccuccuaaggaauuccagguuggcuaauguugcacagugaccugggaccgaggggcuucccuagcuccuaaggaacggcaggccagggcagcagacccugaagacauccaugucuaaggguuagcucagcccugucugugagcuucucucaggugacucgccuuccugggguucagaagaaagcacaggacugggcaugucuccuagaaaucuacgaaacugggacuugcuuaaggggagagguggcagccagagaccagaaggaaguguaccuugaggguaugacagggucagggagaaggggguggguggugccugggaccagcaagggagucaagauuugaggagauccaggucggagccaggacaaagcccggccacaguggaagaacaggucccagggcaggcaggccaaggcuggcuuccagccggcuccuguacacaacagggucccgguuaggcugcucuaaguuuccccgaaccaggugucaggaaggcagcugugggacgcuagcaacuccaccucuccuccagcucuccagucccccacuuaguuuuccucacaccuacugccuuagggcaggcagccuucuccaaaguauacccucuaaaaagugccuucuguucccagacagccagagcuauagcacgagacccugucucaaaauacacaaacaagacuuccuaggccaaauaaguuugucuaguucaguuauuaucuccucugcuaauggagacugccacucuacaggaacccugggggauggauuucccaaacacacuggaccacagaucucucucucugagagagcagaucaaauaccucccaggucccuuugguccugagcacacagugugagaacagccuagcagaauucuacuuugaguguucugggagcuguuccauagagaaggaaacuugcccagaguccuggagagaauccuuccauggggccuggaggagugacaccaggaacuuguaucccauaauaagucugccugccuggcaccuggaagcuacaguucuggcuucccgaggggcaccaggcagguaagaagaaaaguuucccccuccccaaccaauaggacaguuagucuuaauaaccccccaccuuccccacccaacuucccuaacucauccuccuccccgccccaccccgccugccccaucccccacagagccacauggauuaaagcgucuguaaggagaugacagagcccuccgcccaguuccccggcuccagccccuucggcuacagugugacccccgagcgccugaccugguuccucacucauccugcgcacuuugacuucuagccuuagccucgugggugaugccaguuuguucugugauuuuuccccuuuuccuucuccagauguccaaacggauucuucggacagagauguuuggagaaacugccuuugcgauuguacaugccagauccuaagcaaaguauguuugaagauacaaacacaagucccugcuccuuagaaagcuuccgggugcagucccccaguguagggcguagggccagggguguugguuguuuugaucuuuggcuguuauguuucguuucucuuuccuuuuuuguacuuugguuuguuaguucuuuuguuuuguuuuuguuuugcuuuguuuuuucauuuuuuuuuucuuucauuuuuuuggccuaauccuuggguuuagaguucagggcuacagguaaggggcagagcggcagggccaguacaaaugguaaccguggugaggaaccuagcuggcgcuggcaggagccugcgccgggguguugcaaugccugugucuugcuauccuggcucucucuuucugguuuucuuucuuuugguagguguccugugggauacaccggggacaggugucagcaguucgcaauggucaacuucuccaguauguuucuuucuucuauuucucuucuucccuggugacuggcagucuccucgagugggagggaagggggucuuacuuaacaagucuuggagggaacagggguguccugagcuccucucaguccuuggugcuuaccaguagccucugcagaggagacgacacaccccugucucccccacccaccucuguaagucaccuguauugccugggaauagcgauguggaauucucugcagcagcagggccauguccaggccucuuccccucuacuggagucaggcagccugccaaauguaggaagaggcauuugcagagcccucuccugccucugaaggugucaggaugcugcugagccaggcagugagugugugcauguuuuugugggaauguuugagagcagggaagaggucucaaaagucugccuucugaucuggccagaaugguuuguguugguguucuaggaccaaggcgggggggagauugagaaaaagcaggucccagggcaguggcuuccaugaauguuuccagagacgcauacugcuacaggaugaggugguccaagggcagcggcagaugcuaacagacucaagcggaaacugaugacucuucccaagacuccucuagucuaaacacuauccaggacuccaucuccuuucuuucuuccacucugagcgagggaaugagccuuugcagcccaaagauuuggccaaccaguggguuguuguaguuagggccuggaagcaguuccuucaagcaccaccagguggggcuggaacagagcaauacgccucuggauagucacagacuugguuuggggcccagugguguguuggccuucgagaccagaaccaugucaccuaucccauccugcagagcagacuagcccccugcuccuuuuagggaggacaucugaguccuugaguacuaacgagccauagaucuuaguugguacuuggauguuucauguuccaugaaaauaccaaagaugaaacccaggggccauuagauggcacauccagaaacacguuuucagaguuuggaccuuaggguggaaaaaugaauccucaaacuguccucagaccacagaacagagcccagaaacauauccacucccuuuggagcauuugggccccagcugaugagggcugauaaaaaaagguaccucuguccacaguaugagagucaguacucucuccagaccccuccauucccaaucacgggcuauggaggaagacaggauaaagacagaagugagccagccauguagcccuaaagaauuagauccagccuauguggcgaacucugggacagggggagccuagggagaggacagagcagucaggcaaggguggacgagguaagagaggcagugggugagguccugguccuuuccacccugggccaaaagccuccacagccuaggaaacuguucuggacagucagcccuaggucagagcgccacagaaccuccagaaugugggcuacuaugcaaagccccuuggccagccagagcaccucagccugugucugccaggagcccaaaagaaagccugcagauggagcucccagccuucuugccugugccaucaguaccaugcaggugccuuuauguggagaauuccuguuccucaagugugcucagcaagggcccuuaugauguuccagaacauaaugaguacaaagaugucacccugugcccccugaagcgcucagcugcccguucaaaaauaccaggugccuagaucccuaguccugggcacuauguaagugcucuggauugguucucucgucuguaggaugaggauagagacagcuauaccuagaaggcagcagugaggaugaaaugaagugaugcaggagagaggcucaucugggagccugccuucaucacuagagggcaacuuaguaucucucccugcuauaaaaggcaaggaggggcaggaagagaauuaguauuauuccuuggaggaugucccccccuccccagcacugcugagcaaagcaucugacccugccaccuacccagaccaccucgagaccaggcaaucuuucagagacuaagaaaacagccuuugaccccaauagcacuuugaaguuucuccugcuacagcccugcccuccugaaagagaaagcuggcccaucuguaucccacaugugucugacugcacacacacacacacacacacacacacacacacacacacacgcacacacacacacauacaggcacacacacacucacacaugcucauaucugcacauauaucacugccuccucauccgggcacuuuaugacugcaauuaguuauguccaagacaauaaauuugcauaaauuuccuaaagccuggcccugcugaaaauccaacauccaauuaauuuacuggucaauaugaacaucucuguacugacacucaguggguccagcccaccuuggcugagggccaugcaagaagaauagccagacaagccugagcaggaucacccauagcuuagcuccacguuccccuccagucuccauucuuccuccccgauuuccugaaucaccuugagagaguauccuggcaccauggagagacuuuaacaacuuuuucugaaaguaagcugaagaccagcacuuagaaccugagaagcuggucugcugucugucaagugagccuggcuggacaucaaaaacauacuccugagugcuucaaaguccuaggcuccagaaugcacuguucucugagccccuuugacccuuugagccagagaggacccugagcugcacuuagggcuucaagcaaucagagccagacugcaaagaagccaaaucaucaacaucaccccaacuucagagugaagggauugcagagggcuugguuuuaagugcugggaugggcacagccuugauggcuuaugcacagaaccaguggagucagaacuccaggaucuuccucaaguuucuuggggucagggccuucuuggucccugacuuagagccgcccacucuccugcucuuuccaaauacagauaccucugaauucccuuucagaaagcacaaagagaugggcccgauaacgcuccggaugcccuuccucuggagcagacgagaagucagguccaaugccacacccucgccaggucuagggagcuaaccugguugauaugaaagucaccgagggaguguacccaggcaggugugaacaggaguccuggcacacacgugugcugaaccuccuguuggccaggucugccacagcugccucugugcacaggugcuuuggagagaccagaugccacggaucacccacauccacauagcaaguuaggaaagaaacagagcccuggguguguggaacagaacaggccgugccuuaaaaggaaaggcaagcucuuuaaaacaccgaugagguuucugggcucccacccagacuuucucccauuggccucaauuguucugaaacgcagccagguucucagaccucccaggaucccguggcaaggccugaucccccaccaccaccauuggcagcugagggacugagaccuagauagcucgggcaucucuuggaaccacaaacaauggcaagacccuuuuauuuaaccugucaaugcuguaagcgcccaccuuucaaaggccugaacucacacauucagguuaacaaucucacuuccaacacuguaacuuguccaccguguaagaagcaugcacgcagcagaaaugaacccacucuuccuacaccgaguuguagguguucuccuaagugcugagauggguuuggguaccacagcucagcccugggagcccaggggauaugagaugucaaguagagcagugacuugcugcuugaagucucuuccccuccccauuguucccaaaugauacaccaaagcucugcacucagacugccaggagauaugccaggccaccucugggcuguggcauaaggcagugacauggggucagccuggagacaugacagauucauccugaacagaugaaaaggaucccccgaccccucccaugaauaagcuaggaguuggggcagacugacuucuagagggccuggagacagagaguuggaaggagaaccagaaggagggguucagacuccccucccuggaucccaccucacgcacccucugcuccuggggacacugccaacugacucuugcaccugugccuucucaccgguacuaacuccauugcucaucucuaaagcuccuucccugccugccaauucuaacauggccucucucuuguauucuuggggcucucagguacuggggaccagggagggagcucaggaggcugggaggggccacuacuaacaugcuuucaccucgcaggcuggcugcccaguguuggaagaguucugaccaacguuuuuuuuuuuucucuuucucucuccugcccuccccuucucucauucucucucccccugccccucucacucuccuuccuuccuuccuuccgcacuaccagagcaccuuggauuugaauugaaggguacggaaccugacuauuccuuugugucaucugcacagccccucccccagccccugacaccaggccugaggaauguuagguuucccuuucccucaaagggagaguugaugauucugaacauuuccccuggcuucgucgagaugcauggacgauguugauuuuagagcaggguacccugcaguucaaacugugcccuagugcucaguuaguacccuccuucagaggaggagccuguagggacuugcuagucaguaaccaagccagacauggcugccccaagggccggugucugcagaaaccugguuuggggugcuaugcagagaggcauccucuuucuuuccuuccuaaguccauugcuucacaaucugcacuaggcuggaagcugacaccucuccauuuuucccauuugcuucugucccugcauugugucugucuaucagauucuaccaucugcuugagacuuucacuccuuccaugaucugucccuaugguggcauguuguauguguguaucugggcuaaacaaccaaggcuuuaaucuguaccuacccuuucuccuacccccaagaaacuuacaugugauucgcuaacccccaugccucacucccaccaaagacacaaaaacuaacccuuuagccugucuaccugucuggaagggacuuugaagauuagcauuuuaagcucucugacuugaugcaaggagacuccaaguauccagaugugucuuagcaauggauguggagggcucaggauuggugggaaaguugugguaguggugguguggaacaccagacuugguacugagacuacguauauggaaagacuuuuucauggcagcccuggggaguuccuagcuccccuaccaucuagucucuauccguugcucucaauagaaagcaaagcugacaauacugaguagagaggagguggaggcugguuguguggugcgguacauaggaaugaucugcaguuguguguggauggaggaugggaguaucuagcuagcgggugucucagggcaggacucaaguguggaaugucuuugugcuaagcccaggacauuugggguugaaacugccagcacagggaggugaguaugggcgugugucugucugaagaggaugcacucacuugccuacccaauaaacauccacucaacacaagaccuugccacacuuagcaccccccacccuccuggaacugcauucaagaggagacagcaacaaacaggaaacacuguugacaugcaacagagaaggaaagaaagugagcuccaggcuuggcuuggcucugugacuaaugaucaaggaaagguuuguccuacauggaccauuugguagccagcccccaaaacaacuggggaagaguaucgaaggcaggggacacagcacauacaggcuugccuuauucgguggucagagaugcugcagcuggcuccaagccaggauaagacccaaauagaacgugaagccuuaaggacacaggggccuggaaggaagaggaagccauuggcuuuuauacuugcaaugagaagccacacugcauguuucuaagcagcagauuagagugagcugcauuguugcuaguuaucugugaagagcaggggaugagucagaguucguagaagcagaacagaaaggccugucagaggguggccaucucuagcugagggagcccccuccuggacuacaggggcagcagugaaaaugcucgcuguagucagauccaccacucccuuggaaagcagaacugagaugccuuuuggauggacaguggggggugaggagagagggaguaacaggagagaaugauaugggcaagcagguguggagagaucuaagcuagucuggcuagcuggcaguuuggcuggccacggcuuauggguauucaccagaaagcagggagaaaucagggcaggagacagaaaugaagcauccauauggauagucaguauauagucugcauauagacagaaaguccgucuagacaauacacgcaugagugucuguguggaaagcaugucugacccuagaagccauagcuuugggugugugagcauccagggggguuguaguucugagguugcuagaguacauaggagguggccuaaaucugagggauuggggacauuucucagagcucugccaaucauggagagucugccucuacuuaucucugagcugagagcaggggagguggcagugccagccagcagcuggggguggggggggggaggaguacuguagccaagcugucaccuuuuccuugucuuccuccuggcuuucuguuuuagagggucagagauagcaggcacagaggguagacaggacagcuuagcccagccucucccagcuuguaauaaagguugggccuguuccuugugcacggggacauuccuaaaugccaggcugugcugucacugguaggcuucccaccagcagacaaggugcagagggccaaggcacuacccugaccaggcugugggaauggagaaaggcucuucccacacccugcuguagccccaguuugcugugucccugcuucuggccuagcuagcaucccuccuaaaucugggucugacacauuguuaucagccuuuuggggggaagcugggaugccugagaaaggcuuuugcccuaggucucuguucaucgccaugaagaacaacucucugcauggccaccauggagcagggcagggguacuggucaagguguugccuccccucuacuguggccuuggaacuucaccccugcuacauccccucccuuccccuccauuuuccacucaugugcauugggcagguguggguuuuaggggaggugguaguggaagucugaaaggaggcaaaggcagucugcaagcaggcaaggggaagggauagaaggaggcagacagauccugugcugagggagcgcaaggcuggggaauagggagguuguguacaagcaucuccaugggcucuguuccugcucugcccuuacagaggcugaggagcuguaccagaagagagugcugacaauuacugguaucuguguggcccugcuggucgugggcaucgucuguguggucgccuacugcaagaccaagugaguguuccauguucaagccaagaacaagccaagccaguggggggauggccuccaacguuucuguuggaacauaauuccucccugaacccacaauguccagcaugagugacuacagcuuccuguccccgacagucucugggccucuacagcuguagcaccaagggacagacacagaaaaaguuuugguucaaacccaacucuaccaucacccccguaggaccuugggcaaauugaggagcuucuccaaguccuaugaugaugaucccagugugagccucgaagggcaccacaauggccucacuggggcucccagcuucccuuugcaggcuccuggaguagauggggcaggaggugcugguggaggagagguccugggccaugcugggaagaagaugcagggagggcugcauucucaggacaaacgagugccucaauggcacuguucacacccacacuggaaguacugcaaaggagcacagaggaaaagaggcuaggccaucucagggcaguuagggucagaacugggaagguugugaagaagagggcaaacucaaagacaagccagacugcucagagcagaaagccagaguccagaagcuugggcagaagcuaaagacaugagauucagaaguugccauaaaaccuugaugccgagcugcagauaguaugggaccaaugaaggcuguagagugggagggcgagacauuugcucagaucuaggaagugggccuaggcagagccaccauuucagagacugagucucugggucuggauuccugcugcccuacagaugggaucugagguccugcugaccucauuuuggaugggaucagaaccagaaaggcugggaaguaaggagaggguagggacgagcccaagaaaguugaguccaugaacugaggaaagaagccaccuguucuggcacuuacucauuaccgaaggcgacaagucuucaucaggcccaccuauggccagaacgugacuaggcacaugaccagcaccccaagccagugcugccaaaaagcauuuuugguuuggggcuuuuuguuguuugguuuguuuugaugaagagucuuaauaucccugacuauccuggaguccacagagcccucccuaccucuacuacauggggccaccaagauacguuucuuaagcaccucuccucaacugggaggcagaaaggcagcauucaggcucaguccuaaggagaaaagaucugaaaaggugggagugcaggguggaacauugcagggucagaaacaagcuggguggagggaggcagcaagaaacaagccuggggagaaaaagugggacacugaaggccagggacgacucugagucauaggaguaauauaauuacaguuguauaugguaaaaugauuuacugagcauuuauuaugugucaguauacagaagucccacaguccuggcuccugaaucacagcauccuauuuuauuuacuuuggaaacuuuacugaaaguguuuagcucauuuacuucuguauuuauuaucugccuccccuguuggcccccaggcugcaugaggcauggcccauguuuaccucaucugauccaaagaagugucuggaacaaaguuuuaaaaaaaagugcuaaacaagugagggaaggagggguuagcacaguguggaucauuacaggcuuuugauggucaguggucucugggaugguaagggguccuacgcuacagauggaggaaguaaaacaucuucuugcacuucccagaauuugcccaaggucacacaguacagagcaaugggauuccaugcgcugcccagccucccuagaaagauagccagggaauucuauccuugacgguagccacacucggcucaccugucuuuccccuuugcagaaaacagaggaggcagaugcaucaucaucuccggcagaacaugugcccagcccaccagaaccgaagccuggccaacgggcccagccacccucggcuggacccugaggagauccagauggcagaugugagugguguucccagaccggcccccucuuagcucuggcuggauagccguccucucuggcugcaaggaccggggaggguggaugccaguagagcccugugugccaggcacugccucccuggggaucuggcuucacgcugcccauuuccauaaggaagaauuggguagggguguugguugccuggagcuaucugugacccacugaucacauccagugggugaucccuuaacuagagcuccauggcuaccacuugcccucccuaucaggaaggggagccuaucuagucuccauuacuaacuccucccaacuuucugucucuccuaguacaucuccaaaaaugugccagcuacagaccacgugauccggagggaagcugagaccacguucucugggagccacuccuguucaccuucucaccacugcuccacagccacgcccaccuccagccacaggugagcggcacccuggcccaucaaacccugcuaaugccuguacgucauuggucaaucagccacagcuaacugagcucuucucuuguguuugcauacugaccacaguccacccgacucuccaggacuggggcaaccuguccaugcaagcaaaauaguuccuacagcuggaaaaauaacagggcuggucccuccuuccauggacagacccaugcaauagucagagcccuugcauauuggccggugaggcucagauccugagaaguggcuaaagaacaugagaacagaagugucccagcugugagaccuuggugguggagguagggggugggggagccucuacacauggcggcucagcaaucacaggauccuagccugucuucucccauuaucaggguugagcaucuguggugcucugcaucaaugccaaguggagagagagaacagugagcuaagggagucacagauuagacaaagaacccagggcagggcggccaugggaccacacaccugcacaaggacaaccuaccucuccuggccuaucaacucacuccuaucugguuuucccagacaugagagccacacguggagccuggaacguucagagagccugaccucggauucccagucaggcaucaugcuaucaucaguaggcaccagcaagugcaacagcccagcauguguggaggcacgggcgcggagggcagcagccuacagccaggaggagcggcgcagggcugccaugccacccuaccaugacuccauagacucgcugcgugacucuccacacagugaaaggucagugucuaccccuucccuggaccccaccuuggcuagaaagcuggcacugcuaacucaaacaaggucccagaaagguuaaguggucuccugggauuagaauugcagcuggcucaauagauccuggcuggagugaacacacaguuuguggcauuagggaacauuaauaaccauacugaagcaucagggacaaacagggcuguugcacacacccaggacccaagguugaccuauucacagcaucaccuaaagacccccauaucacaacagaaacagagagacacugagaccacguagacuagaugauaggggaagggucauuuucaagggcgcugacccaagcaguaaggacgugagccaagaaugaucucagggccugccagcaccagcagccagguccuagugcccaaggcauugcuagaaacccucgaaguugauaaaggaagaaccaggacauucuuacccccacccccgcacccccaccucgggcuggcaagauggcugagguuugcuugccuaccaaaccuggugaccuaaauguaauuccuaaaacccacaggguagaaggagagagccaacucccacaugcugggccccuuccugcucagcucugcaguggcuguuaggcaagcaagaucugugagaggaaagcagaggaaggcacaucacaggcaggagaggcuccagaacagcuaggagcaaagucuaccucuuucugacucaaccagcucgaugccaagccugggcugaucaagcaugccagagaugauccuucuuagaaucuagggacaaaacacugacaccuucagcagugccuaaaaguauuaagcauagacaccacacuagggcagagaaaccugguccaacuauagacuccaagauuuucccucugaguccagcuccacuaccugagugaucuggagcagguacuucaaaaugugccccuucaguguggauagggaaaacaauuccugcuacacguggggcuggcaaaguccugccucacucauaccugucucuguugucaucagcacuagacagugggaaggcauaggcagggagauggggaagggacacuucuaggagaaauacuugagcaugcuuaagagacgcaggaugggcuguggagcaguggagcucaacaggcaggcuggggacacggaguuggaccaagagcccuuggcuucugcuugcuugggagguagagcuuggguagauaaauaggaaggccuuccuuagcagagcuguuuugguugguugguuggguugggggcaggguguuuuguuugcccugggaacucccuagagugaaagacagagaccccaagguaguggcaugaccagagagaacaucuggcccaggcuggagaguacuucaggagagagggaguggguaguuagcuugaucugugugugagaaagugagguugggggucagcugacucaguaagaaagaaaaaagggucuaagccaguuccagggagcagccacgcaccugccugugcaggcugaaagaaaggaauggaagugagugauucggguccucgaguggacagugguggaggcugguggcucaugggggagggggggacaaaaagggucuucagaagauauaggaaguaaggggaguggagacaguuguuaucuugguaucuuucagcccuggcuugaggugccuaccccgugucacuucccugugguagccuuuggauacaagaaggcauguuccccucacucaagccaagccagggaauaaacugucacugcaagagcagugagcucaaauccagguagucucugaaugguggcuagugguuccuggaauuaagcauacuauucucugccuaaccuggauucgaaucccagggacagguacccaggauucacacugggagguauuagcaagaaacaggccuucaaggaccuggggaucaucggcucuaagaugagacaccuagugguggaggaaggaguuaguugauucagaaagaaugaaacagaccuaccacauuuuggucauucaguccuuggcacuucaagucuggguccccuuuuuccuauauguaguauagcccucacccacagaugcuacagaauagaugagaccacacauaaaacacuccaaccugagcgugccucggagacugugaacgucccuacaguacuccccuaguacauuucugaaauucuccagcaucauacuggaguaaacacuacauucaucugugcuuaacagauaagaaaaggcugggagguucauggaaacuaaacguggucagagccacggcucucacucuuauggacacuuucugguuggaaucucuggugaacaccagcacugcacccugacucccgacccucugucucucccacagguacgugucagccuugaccacgcccgcucgccucucgcccguggacuuccacuacucgcuggccacgcaggugccgacuuucgagaucacgucgcccaacucugcgcaugccgugucgcugccgcccgccgcgcccaucagcuaccgccuggcggagcagcagccgcuccugcggcauccagcgccgcccggcccggggccggggucggggcccggagcggacaugcagcgcagcuacgacagcuacuacuacccugcggcggggcccgggccgcggcgcagcgccugcgcgcugggaggcagcuugggcagccugcccgccagccccuuccgcaucccggaggacgacgaguacgagaccacgcaggagugcgcgcccccgccgccgccgcggccgcgcacgcgcggcgcgucccgcaggacgucggcggggccgcggcgcuggcggcgcucccggcucaacggguuggcggcgcagcgcgcacgcgcggcgcgggacucgcugucauugagcagcgguucgggcugcggcucggcgucggccucggacgacgacgcggacgacgcggacggggcgcuggcggccgagagcacgccauuccucggccugcgagcggcgcacgacgcguugcgcucggacucgccgccgcugugccccgcggccgacagcaggacuuacuacucccuggacagccacagcacgcgcgccagcagcagacacagccgggggccgcccacgagggccaagcaggacucggggccccucuaaggccccccgccucgcccgccccacgucuccaaggagagcggagaccaccgacuggagagggaaaaggagcgaacaaagaaauaaaaauauuuuuauuuucuauaaaaggaaaaaaguauaacaaaauguuuuauuuucauuuuagcaaaaaaaauugucuuauaauacuagcuaacggcaaagacguuuuuauagggaaacuauuuauauguaacauccugauuuacagcuucggaaaaaaaaaaagaaacaacaaaaaaaaaaau

SEQ ID NO: 8877 - RNA, 3786 nt, Mus musculus
guugagagagacaaaagacauucuggguuguuuuuuuauugguuuuuuuuuuuuuaaaguucaugagcaaugauguggaaggacuuggcaggauaucuguggggagaguagcuggacauggggauggcuuggguuagagaaccaugggaggaggacgugaugauguccagcuugcaaagccacagaggacguuuacacugagcccagaagugcaauucaguugagauguggaaaagucauggccaguuccugagcaggaaguugguaggauggauggaauccagccauaucgugauagaugaauuaggagagagagcaggcagaacugccaggagggugugggcaucgucuccccgcccccacugguccucaggcuauuugaauucuucuuccuccgaugccuucugugggugcugacacgggugacccugggaccccagagcuggacugcaacugcaggucuccuggggccucagcugcaucuuucuggcuuggcugaggaugguugcucauggcugugaccaugaccugggcugggcuggauuucucccucucggccacuuuaaugaaaagcaguuguauuuaccaggaacuuguaagaggagaggggagaaaaucaguugagucccuggccccauguaggucucucaucccucucugggucucuuucuuccccugcucccaaguccuccaucuuucuuccugguuaucagccuuacugcccuccauucugauggauucuuccaggcucugugggcuuuuagagcagggaagcugccuggguagggauggggccacaggcaccucaaugccucuggcugggcuccuuagcacagcuucucacucccucccuucuuuaugcuagcagaugagagacuugggcuguauaugcuuugagguacuugugguccccaugugauauaucugucuuucucugucucuguuucugucucucucugucuaucaccaucucuaucucugacucugucucuguuuuucugucucucugucucugucuguuucugucucuaucucucuccaucaccaucucucucuaccuuugacucugucuuucugucucugccucucugucugucucucuguuuccucuuagccccagcuuuucagggaccagggacguucuuaugccgaacagagcuucauugcccuuucuuuucucauuaucuaggcaaacucuugcccaucuuuugagacuggacauccuccagggggccuccugugacaacccugccuaucaguguugcugagaagguuggcuugccagcccuuccuccccgaaauauacaugcauccacuguccucaggcaguaagacagacaccuucaagguccuuguuuggggccucuggguuuucucuggcugguugucuccagauggggguggacauagcuuggaagagaaggaacagucuagugcuuucccagcuggaagcauccagaguaccugguuggcuuggagccuugagcagcucacuccacagugcaggggcuacacucccaguuaaaccuugacucuucaggagcacauaggcuucuggcacccaccaucaagugcuauaccggacuccccucgacagcccaccccuauuccagaaagcacaucagucagaggccacugacaaccucaucagggguuguuuucuucucuccacacugaggcuuuuuuuuuuuuaaugacaauguugauggugcacauauuccagaguaauauguuuaggauuaggccacacaaugggguuaugacucccuccugugcagcccucacccaggggagcuugcccuccaucuggccaauacacaucuggaucaggcucacagcugaccagauguugcaucccucuaaacuuaguuaggcuugcagccucuucaccuagagggcuggagcugcaugcaugcacuugcacacgugcacacacacacacacacacacacacacacacagagagagagagagagagagagagagagagagagagagagagagagaucacuccauuggagcacugaagcacugaggucaucuggcccuuggagggggaggggaggggagcuagcuuggccuugaccacuauuccuccuccaccaugguagggcaagcaggcuguugggacacuucugcggagguauguaaauaucagguucccugcuuccagcccagacaggcuaaugggaaggacuugcuugaaaccaggcuccaaaucuggagccugucccuaccucauccaggggccagcugcaagaaucagcaaauuccuuguauacucauuugggggaugcucugaggcccugggccaccccaguucucccugcucacgcugaguccuucucugcaaccaccuuuuuccccacgcugccucauuuucuucccucccuuugcccaccuuccacagaguugugugguuuaaaggauauacaguauggagccugggcucuggacccucaaauaauugagacaugaucugccaaguuuguuugcccauuggugcuggcaagaagccgggcagggaguguggaggaggaaaaggaagccacauuuauugggugccaacuaugugucaagcacugcgcaaggugcuuuaaauauguuaucuuggcuaauccuuggaaccacccugcaagguagauauuauucucuuuguuuuacgcacgccacaaguguggcucagcacggucgcccugguguaccaugguugggagggggcagaacuagcaucucaaacgaaguucacuuggcuccaacugucaugcucuugugauaugccaccuccccuggugacugcuacaagcuacccaucagguccucuuuccuggccacuggcugugagcuuugucuugcuccuucaagcugggcagggaagaacggccuggcaagguccaaacugguaggcaagggacaacaagaggacugaaguugugguguuguaaccaacugaguuuuccgcauggcuguuuggagggccuggggacuugaagccgcagaaacacauuaggaguugagaaagcagggcggcuucggugaaaggcaggcagacgagccuuggaggcaaucuguggggaacuugggaguuuuccaugggucugggacacaaggaaccucauuaggaaaggaagaagggagccacagagcccagcugcuauuguucccuuaucuugccaucagcccucccagcauauggaacauuccaaggacccucuaggggccccucuucugacuauagaaugugguacccccagagaggcauugggggguagaaagguaccuuccggccuggccaugacugaccagguccccacggcagcuccagaaugugguugcuuugcaggggaggacagugagagccuuacucccaguuccaauuacagagcccagaugcacacagacacauggacccacacaaacccaugccaacaccuugcccauauccauacaaacacugguguguaucugucugcuucaaucaaagcuguucucuuagagacgacaugcaaacacaagacuuuccuagucccacaaaaccagcaggaaucugucuucuucuucugcacccggagcuuagcacagaccagaaagguggcaggagacagacacaguauagaccuggaagucagcuuggauagacugaaagccagcucugccccugcaguguggcauuaccuuggagccaugcucuucucuucaagaacuaugagcuggccaugaagacuagagacagugggcaggaugcuggcuagcaugguggcuaggaaaagggccaggaaguaggua

SEQ ID NO: 8878 - RNA, 8900 nt, Mus musculus
ggaagaaucaggguggguuugguggcccaagcacuucaaagcauccuuauguggauuaagauuuagaguguuggaaaagauguaauauuuuuauuccugauuuuuuuuuuaauggaacuugauguuuggagaaaucgucucaguuuugguuuugcacuuuuaacauuuuuguguuuuggcaauauugaaacuuaaaacuaacaacaguuuucucuguuaacauuuuggguuaaucugacagucauggggaacacaccaugggcauagaauuauuuuuaucuuuacaugacuugcccucucuucuccaguauuuccauuagguuuuuuuguuuuuguuuuuaauguaauacaucauacacauuuucagaugauuuuagaauggggcuucccuaaauuacuuggguagcuuucauagcuccacccuuuuuaaaacacguaaguguacuuuuaauauuuucuugucuauaaaaacugagauagaaaaucuauuuuuccucuuuuuguccuuucuuggauaccaggaugaaauuuuguuuauugugugaaagaaagcuaagacaaggagaucuucagcacuuuagagucaaaacagugggugagaacucugaguauaacauucagagagagcucaugauuugucaugagaauggaauaagggagagaucuaauugccuaagcaaacuuacuaguuuuguaaguuuauuuuaaacuuuaucaaaaauuuuaaacauuaaacauauuaaaacauuguuuucuucauuguaagccaaaauuaggacacugauaguaacauauucuauaaaacuaaagugaucaauacuuacaguggcacuuaauacaacagcauuaauuaccauagcucuacagaguuugcaguacauuuuuuaagaaaagcugauuuaaagauuuaugaagcuauuugauucuaaagucaaaccuaaauuuaaggccuaggccauuugacuugcucuuuuugagcagaaauuucauuauuaugggccauguaaugaugaucuaaacuagcaguagcauagucuaaauuagcauuagaguuucaagauuaaagagaagcagaugaaaaaugagaugcagcugguucuaagcagcuuguuuuccuccaucuacaaacugacgaccaauuucgauguuaaagggucuaggcaacuugugucuucagaaaaguuggauaugaaaaauagccucuuacugauauuuuucuuguaaggaauuuauauucuuccauuuuugccuucaugucaugucuccuuccuuccauccaucacauuugcucucuucccccuccuccuuuuucuucccuuucuucuguugucuagcuuuugugguaagcugucuuguugauguagaaauguggugaucuuuuguguaaaacaaggcgacuuuuuacagaccagaaauauuuuauuguucuuggaaucauauuuuugugcuuccaugaguacauacuuuguuuuuauuauuaauuugcauauuaauuaauuuuuuagcauuucaugggggguggaguuaaacuaaugaguuuuaauuuuuuugguuuuggauucacuuuaguaaucccgaaggccuauaaggugaaaaaucacacuuguguuuuggaauuguggaaauauucuugcugguauuauauuuuggucugagauauauuaauacaaaagacuucuaggaggauuuaagugguaguuaaaaguuccaggacaggugacacucacuugaguagcucaaacaguaauaauaaucagguaauaauuuacacugguugacauuaagucaaacucuucugaaauggacugacaauaugcagugcaguuaguuguugguagcacuugaccuccauggcaaguaugucugacaacuuggcuccuucauucuccuuuaugauccuguucauggcaucugagcauuccuccuucagaaagaagugaaauaaugacucuuuccuuugaacauagcuaauugaugauccaggaagauuucuguauuuugauguaauuuggccucccuuccccucuuauggcuauuuccccccauagucuuaacuuggcaauuugaagaacaucuaaaugaguacuuguuaggaaaccugggaaaugaagaguguaagaagcauguguuuaaguuacugagaacugagacuuacugguuuggaaauuggagagcagaaagaauaaagcuguuuguuugugaauuggggugugagagaugcagaagagaaugauuggaaguaaaguaggaggaauuuuuauugacaguagaaaaaagcauuaagaugaacucugcaugagagguguugacuaagagcaaggagguugagcuucacuaaagaagugucagggggucccuuguuggcuaagagauaacuuggucuguagcuaguaaaggugauggauugauuaaacagaucaguucugauguguauauaugaugguuugaggguuugucugcuccucugaacaaauuuaaguaacacaguugugaaauggcagcuuuucuggucaaggcacauugguguugggaacuuacuauuuuggggaaaaaaaagauaacuguuuacccuuuuuauuuacccuuuuuaaacuguuagugacauuuaucauauacuguuuucuugggcucuugucacaguguagguuauguuugcauuucaaaauuaucuauauaauacacaaagauuuacacccaaagauccucccuuuauagauaccuuuggucaacaugaguuuuuuuagacaacaguaaaccagauacaaucacugacuugcuguuugaaguaucuuuucuauuuccuuuacauuuguagccaucuaacauuguagaucuuaagauaauauauuuccagaauuagacaacauauccccugaacucauguuuuuguuuguuuuccuacugcaaaauuguagacuucccuguagugaguguagacagaaguuaauuauaauuuaaugcaucucccagguucuuguguucuuugcaagaugaguugacagugauuaguaaucuguucuauaaucccaagaguguuuuaaauuauuuaagguaaauauuuguuuucaaaguuacauaacucaaaaucacauugacuuuaaauuuacaacggguuuauuuucaguaauuuugacauauuacuuucaaguuucauuuuaaucagauacuuauacauuccuguuuuaaaauagccaaaaggaagucuuggccuguacuuggaagguguuuuuucuuuugucaugagucaaguucauuaacauuaguggggcuauuuuuuacauaucuuauuuuacagaguugacacuuaguauaauuuucacauuuuaucaugugucugauuuuaaauuauaguuagcauacuauaguuuaauuuugugcagagccuauucuuaaagagcucuucccuuagaaauuauuuaaaagaaaugaagaacagugcuuuaaaugacugagaugagucugaacaguuuccuugagucuaggcaauggagauaaaugauagcccauuuuuaugcugcauacaguuguuaggguuuaauaauaauguaggaaagugcaaaagcagaaaagacuguguaaguggccuauaaauuuauaguuuucauuauugcacuauuuaucuuugcacuuggguuuuuggaaauuaaagacuagucacuuucacuuuugcuucuagucuuuucuaauuucuugcaaaauuguuuucaauaucccacccaaaguuaaacucauaugcaacuacaugugcuuuauaaggccaagaaaauauuuauuguuaccuauauaacaauaaauuuuguuuugauaaaauuuuuaauauagaucuuuauuugcccauaaaauucuuuauaaauaugagcuuuauuaaacuguuuaaguaaaguaaaagcuuaggauaggaaauaugucuuguguguauaaaauugugucuuugagauccaacuuccagccuacuauggccuggcuuugggguguuaguaaguuuccauuuagcaaugauaucugagucuuacugggcaagugcuuaagaaacuggaaguaaauagggggcaguucccucuuguguguagcuuucuauaagggucauauaacuucuccuugguuuaugucacauauugguguuucgugaagugaguguucuuuuugaaaauuuaagauggaugcuuucugagggaugguaauagcuaaggauccaggacugugacuuaaccauuggcaguguuauagcuaccuugauacacucuacucagagaacaaagaguauucuugugaauguguguugcuguacucagaauugcaaaaaggaaaaaaaaaaaaaaggaaaggaaacaaacugaguuuucucaauggaacagagagauguauuuuuggcuagaauuguuuuuuauaaguuaaugaucuuauucucuuuucuuuucuuguuguuuuuuuacacaccucauacuuaaaaccagcaaguaagaggucucuuuucagauuauuuuggaaggucugaauguguucuggaugggguguugaucgugacguguucuucccgucguguucugcuggucacuguggcucauagaauuuucaaauucuguugaaaauucagugguguauuugaaaugagacuaucuucuacaacaugguauggauguguguggcuagauuccaugaugugacauaguuguggagccauagcuuugauuuaauuuaaauagaaaguuuaaccauaguccagauuuuagguuuauguacaggaauugugccagguacuugucuaaauguggaccauuuuuggaaaugaaaguuaaugaauguggauuugacucuagauaauucuauacucaaaaauacaaguuaaaggcucacaucauuagaguuaccuacauuugauggccuuagcucuuuaaauguggauggcauucagcauuauaucugugaauuuccuuaggaaaagaaagguucagucuuuauaccuuuucuuggaggcuaaauuuaccacauauggaaguaagaaaauuguagcaaguggcuuuauuuuuuuaguggaguuuaaccagcuuaauuaauuccuuuuccuacuuugaaucacuuauuucccauguauaaauaaagggaaagaucagcacccccuccccccaggcgauuuuuguugucugccuccauuucccaauccuauuauacaaugaauuacggguaucccucuuaagucccuguagugcuuuggggggaggggggaagcucacaaauaccuuugaaaaucugaugaaagugauggacccucuccccaggggaaaaaugcacauaauacagauaaguuugcuacaaccucagggucaucacuuaccuucugaaacccaaguuagaaacaguuuugcucugagcaaacuauagaaaacuguaguacaaauaauugauaaaauuaagagcuauuggcuuaaaacauuucagauugggauuauuaucacaugguggccccuacuagugaaaugugacauugcagcuagcuuuguuagacuuuauaacauccagauagaagggaaagagaaguaaaguucugagagcuauuuauaaggagucaggucaucuccagaugugggagccaguccugguucaagauaggggucaaggugccugacaaguuuagcaggguaaaguuugauaaaccaugcucaggaugccaagggguuagccauuaucuuaaccccuuccucaccaaaagauuuuaguuuuugucuguugggaaaaaaagauggcacuagggaaaaauaaguugccuuacaacuuugcuggaacacaucaguuuggugaagugugggacacuaguauuauuuuugagaaggugcauaaaaccaaaguaaauuauucucuauguagaacauuauuuacaaguaacauuuguuuggguguguuagcuuugacgauuuuuaccaguaaauacugauuuuauuuaaaacugggaguccaguuuacauauaggauaguugauauauccaucuuuuccccauguaaagaauugucuaaaagauuuaugcauacuuuuuacuuuucucucuugauaccauggggugggggugggguggacuuugacucaacaacugacaaaugucuucaaauuuaaaaaucaagaagcagcacuuuaagucuaauuccacgccauuuuagugcauguuuuaguuuaauaaugauuuuuggugcaugccuuugggcuuauucaaaaguguacaauagaaaaguguauuuccuuucauagaaaggagauguuuuucuacuuugcaacaugugauuacaaaaaucuuccucugugggaagauuaaccauguauugaacuacugaaaaguauauauuuuuagauauacagaaggaaucuacacggggcagcauucagaccuauauagaagucauaaaaauucuguauaggaccaaaaggaaguaacauaaaacacuuaaacagacuauguuggguagaaauaccuuucgaucuugcauugacuuccaaaaugaaaaugccacagaaguuugcugaaacuuuuguuugaauuuucucugucaguguauuuagcccaaaugcaacagcuuuggguuagcacaauguaagaaucaaaacacaaaauucagucugguuugccaauccagccugauugaaauaaguaaccaaucacuugcaaacugaaaaacuguccaacuccucuaagguuuugacaaaauaaccuuggcugaugugggaacauucccacuuugauuucugaccugacagcgaagauucauguuugacaugauuucaaaccugacagugucuguuuaaggagccaugguacaguuugcuaauucaaucccagauaccuguugauuaccuguaagaucuagaguucaacguagccagcagccguaucccugagugcucugugcccaucagauaacaugaaguaagcagaguugggacaagccacagcuuugaguauugaccucagagcagagccccagauucaagauuuguaucugcuuucuugggagucacugaacugaugucccacacugcguuacuuacuguagaugcucuccaagaggaggcccagagcacacauccgaauugcuugugguacucagagagggggugcuaacucugaugcccuggccaaauuccaguuuagggaugugggucuucuugucauucuaguuggaaaugugcaucacuuuccauuuuuccuguugcucucagugcaaacuacacaagucuguuccuuugcuccaaucccaagucuccaagauacugguaucacacgggccagguucaugccuuaucuugauacacaagaguuggagaaugggagcuuggcaucaggaugccuuacacugggaggguagacucuugugaggcuuggggauggaaccugcccucuuuccgcauauguuagggagcgugcacugguugggagcuuccaaccauaaggugugagaugaaaccaauuuccccucuuuucuuauaacaugaugagaaagucuuuuggguuuucgguaguuggggaaggccggaguucugcagcuuuaaucuggguaacuaaggcugguauaaucuggguaacuaaggcugguuugagcaagacuuugguaaauuaacuggguucucagaugccacagacuccgagagaagucaccauuauuuuuaguggccgugauggagucccccuguagccauuacuuuaagauuacaugcagaguugcuuuauuuugagcuuuuuguguacacacaaucccaaacuggaaaaacuuaaaaaggaauccugcugugaaagguauauauuacucuagauuuuucuuacuguaaauauuguaagauuguaauacugucaauauuuuauuaaccaacaaauguuaaucuaugugaaaucagacuuauuuuaaaugugcuucuuauuuacuguguguggucccuguugcugacaguauuaaguuauauucugauguaagauuaacuuuauuaaagaauguaaacauuaauguuuccuuaugggaaaacaaauaaaguauaaagaagacaauucuuuuuauugaaauauacuguguauuuacacuugcuagacccagcaccacuuauaaacuuaguccacuguccaguuucaguuaacacagcugacacgguugugcuccacuugaaaguuuaagccuugguauuguuggaauauaaacaguuuguauuugucugcugugaaucaccuugaaauuucuaaucaaguuuguaaaauuuuuauaguaaaacauuuuaaugacaauuuaaaaauuaucuucucuaaagaauggucaaaacaauguccuuucagaaauagagcugcucuuuacugucuuuccaaaugauguugguuaaauggaccagguguauauuaguuaaagucuagggcuaaguucuugauauucuuugaguuuacaaguuaauccuuauuggaguugugccaauauacaauagaauaucauuaauuugcacuguuuggggaccccauuuaagaaugcugaauuuuugccaacuaaaaaguaagcaaaugcaauuuaaaaaguaaauuugagcauucuguguuaaauaugugcaguuauuaucauaugaagaagcgcaguguguugggcuguaauauaaccauauuugcugucauguucucccaucucagugcugggaacucaccauguggaaaccaagcaaccguguugugcaucagccggcuugaguuuguucaauaucaaagcugaagcuagcgaggucugcuguacugcuuauugaaguauugugauucuuuuaggcauugguucuuacaaaauauauacuguaacaguauacuuuguacagauuuaaauuuuauuugaaaaaaugaaauaaaguaggcaaaaaauaaagauguuuauuuuucaugugacuacauaaacagauc

SEQ ID NO: 8879 - RNA, 589 nt, Mus musculus
cagacggguaagagguucuuuucauggagagauaccguggaauaacaaaucaaccguuauggaaacugccaguguaggagguggggagcaggaggugcucucacuguguccacacuaaccuucaucuuccuagguauuucuguugaugaagaaauccuuccuuuccaaaaaugaagucaggcuaagauuucauuuuaaagggaguccuugaaguagcacaucucugcuugugugcugauccgauccucacguuuuuuuuuuuuuuuuuuuuuugguucaguugguuuaguaauuccucgaguuaaaggauaaauuaacucucaagucucacguaagcaucaguuuuauguccaagaauucagaauagcuuuccaucuugggaaugucaugucaaaucugaaucaaccuguauucugauucauagcugaucagguagacacucaaauccuugagggagggagaggauccugaauaaggaagggugcuccacugcacucugggaaguccacaagagacuuggccucccaagcagcuuugagacaguauuaaagucaaguauggucccugccauccuaauagcaccacucug

SEQ ID NO: 8880 - RNA, 10881 nt, Mus musculus
cauggauggaguaaggguuaucuuuauuugggucacaaaguauaaauaugaaccagguuuuggaaauauaaguuguaacaguucagacauggcacuagaaccuuccauggggacugugacagcauacauuauagucuuggugagaccguagucuccuuacccaaaaccuucccucccaccaaccuucccuauaguaauugauagguaucaaugaccaagaauagucaacuccaaagcucccugcucuuccucagccuuuuccuuuacuaaugccuucuccaaacuguccugugcucugccaaccccugcacgaaguagcacccgaagaacagcaggauaagggaaaugucuugacacaaagggagugagguggggggauagaggaccaggaagcccauggacuuccugcaggcauggaugcucaaucucuucugggauuuggcagggagaggacacaggcaaacaccaauaucuauuacacgcuaacaucagcaccuugggcuuucggaacacgaacgguagacaaaaaucaccuaggcaagacugcaguccaacucacagaguggcuccgcccaaaccgaucccugcacucugaccauacacaaccuacccugggauauucugcuccagggacaucuucugaaauguagacagacaauaaauuacuaccgauggguuacagagcaaauaggacccagcguggcauugagccagaugguggagcgcagagaagugggccaggacauugccaaaguaacagucuaggcacuugaaauauuauuguuagauuguuaaaaacuaaauauauuaacauacauagaauaaaauaaauauauaauuuaaaaggcauuuuacaaacaaacaaacaaaaacaacaaaacaacaaaauacuuguuauuuucccccucuggguagaaaagucccaaaacucaagaguucucgagcuugcgguauuucacaguuaguucaucaaauccagcgugcuggaggguccaaacagcagaucccuugcggcuacuugaacacauagcuucucagcucuguugcucucuuccaguccauaaaccauuuaaccuuccucuccuuuuuuuuuuuuuuuuccagucaaaaauccuggagcauauggaaacuagcugacacucuaauccagaagcuaaguguuuaaacaaaccaguggguucaauggaggaggaccaggaaggccugaagggcucacucgauccugcuuucuucugauccggaucccagcgggcauggucuguuuggcacuuagaggcucugagauuuuuuuuuuucuuuuaacagagcaauuacaggaggcccagucaggguagcaacuggaaaugaaugaagacguuuucauggcugcuggugaaauauuucuccucuauguagaacguguaacgaaccacugucucagaaguagccucugaagguuccugaagcauaaagaaggaggcauuugaagcugggucuaaucuuaacgacaugcaaggagcauuaggaaggggagcugugggugccgcaaccuugugaccuagccagagucucugaaaacaguucugaauuggaacucagauggcacaguaguaaccugcccccugcuaccccuaaacaagacaauccagcacuuacugaagcagaccccagacccacccaugccuuggcuugucugcccaugcugcccaggacaaaggauggagccuuaccuauagcucagguccuccucagugggagcuagccacgcccaacuucacuuucucuucacuuuccaagucauaaccuccucuccugugguaccugaggaaaagaagggcugugaagaaaugacaccgugcaggccccacagccagcccucucaagaaacccccaucauggugauccauuucuucaaaaaagcccagaggagguggcaacucaggagucuuuagccagaauuuagcuucucugagggauuccugucccuaccagcagagaauuuagauauauauuuguguaugcauauauaauacauaucauguuuuuagagacagcaccucauaacccagacugcacuagcauuuccuauguagcccaggcuggcuucauagcaggcguguaccugucaccccugacuuuauugauuuugguauuauuugguccucaaaacauccuuauagaguccaaucgcugaaagauuaccaucaauaauauuauccaugccuuuacuaccaagccacgcauuaauacccggggaaggaaaugucuaagaggugcuccugugggugagugaccaggccacagagguaggaaaugaaccccacgagaacagaggaacagaaccugcauggccuggccugaccguagguacccugggcuucacacaccggucucaugccaugucagacaaaaaauaauaauaauaguuucuagaaaguacaauacuaggccagcaucuagggauaugaggagaggcccuaaguccgaggggaagaaagaagugaaugacuccaaaaacaagcccacgaggccccaaacacucaccuaaacaugagaagucccacgaugacaagaagacagacggacgacaguacuacagccaccacagccaagacuguaguguggucauauguguauaggggauucuccacugguagagucagcccaugacaccuguguccgugguaaccagggaggcaucuagaauaacaagaagaagagagaguuaauggugacugcacccccucugccucucucuccacccaccccaucccacccccagaguccugcuucaggcagggaaaaagugagggaggaguugaaggucucucuuuagauguauuccacauggccuaaucuauuacaucuguacuaagguguuccgcuuaagcuacuuaagaggacuugggcggagggcgacucagcaucucucccucaaucuagagaggcccuucaacauucugacccagaaauaaacccagccuggcccauccaugcauccagcaugcggucccuccccacugcuugcugcucggccuauuaauaggcccugucccucugccaggaaucguuuuuuuucucauuuccuucauuuaacuccucgcucccaaccugggagcuaaacuacagccuuuggugucccgaaugcuggucucuuuaucucagggcacaaagcaaacaaaccaagauaacaucuuccugcccagccacccugucacagcaggggaaagaaugucagaaacaaucccagagcucuucucgcgccagaaacaagucacgugacaacccccucuucaaacacaaagcauuuccuuaaagcccuuaggaagacaucccuuccuuugagcacccuugagauccuuugauguagggggagccccauguuacagaaaaguggcauggcuugccuaggucucggcaacagggcggcagcauugccguggacccucuaacuuugcucaugcacccccacaucugcucacccaccaucuggggaagggguaggugugucugcuuggggaugucaggcucgcaucugcugaaggaagcagagggagaaccuguggcccucuacucugaaucguaccgucucuagagagaggugugcaccuggagccucagagccauggugaaucucuccuucccacuggcagggcccugggaggcuccguggagcagagcuguggacucuggcaauggcacaggggucaagauggguagcacugcaucccugucccucccuaccuucggacugcccagcaccuacuucuggguacagagcagcauaaaggugggucagcuccacaaaggacagaauacguuccuuaccuagccucuucaguaugucuggccccugagucagagucaggaaagaaaaaaaaaaaaaaucuaacaguaucccuauccuuccgggaccuaaaggaugcuccuaggaguguuucuggaaaauccugugugcacggagaugaggggggucaaagaaaugaagugaucugucucagaacuagaaagcaccaaggacaaggucagaagcuacgcuugugaccccauuaaugcagggaacccuaagagaguaucugacagguccugggacugucugaccuguucucugaccacauuauuauuacuauuauuauuauuauuauuuauuacagcuuuaauaacaaauaacgaguaauaaaggccuaccacgagccaaguacucugcgcuaacggcuucacaagaguuauuuuauuuggcccuuuugauauccuuuaacauuuaaggucagaccaccugugaagucgagguuaccauccccauuuugaagaaaacaaggcuuaacuuccaauaaacaacgcaccaagguuacaaaguuagagaguagcggagcccuggauuuaauccagcagucugcaugaccucagcagcuaugcuacgccaggggagggaggcagagucugcuuugcaguucugaaccaucauucaaaccccacagguaguuacucagacgguagaaauaaaacuuggccucagagucccacaauucaguuauauaaucccuccaccaccucuguccugagucaagaggauaauaauguaaaugugcuaauauuaccgacuucccccucccgccaaagccuggcuuccccagggaagaagggggguugagcacacuccgagcaucccuggaugcagggcaagaucauguguccugccucaagccaacacacacaucugucaaacuaggacauguuucuccucuccacgucugugacccacuucagaacuuucgugacaacagacgcuccuucuagaggccagagauagcuucuacauacucuuacuauaucuccgaaucaacuccaggaggugaaggaagcacccuuugauagaggggaaucagaacaagugaguuccagacugguucugcuauuucuagccaggugaucuugggcaagucacguuacuuuucuaagcuuugauuuauuuccucguguuaaaucagaaguaaucagagccuacucacuggagcaucaugaaaaacccaugccccaguuaugugaguuauuauacaaccaaaccagagggcaaagccuguuucucaaggaacgagauguucaggccagauggagucaagagaaggggcuucucugcacaugagcagugugcauagugcagcuccaggcuugccucucuuccagcacaguccuucccaacccaacuaccccuagguuugcucucgucacaggaaacccugcagccaguuucugggucagcagccagucagaaguccaagaaaacugcucuuugagggcaacuuuuggcuggugacacagaaggguuuuccuguuccugguggcugucaaaggcugguuuaggaagccaguuagccucaaggucgccacagcagccuggacacacccuggcuggcagcuucugggucuaaaggagaggagaagccaccaagagggacacagauguaggugcacagacaucacauugccccaaaccaggagcucuaugucaaagaacccacccuaugaagucugccuaggaaguugacacaaugccuucuggacgcuugcuguguucuuagaguagugaaauccuaagggguguucuuggacaacagcugccccccccccauaaaacucugcuccaacucuguaaggacagggauagaggaggaaagccaacaccuagugugucccgggaacacaaaagcgugcugggauaggaaugagaccccauuuuucuucccaugaacuuauuuagcuguuaagcucaugcaaauaacuuccuacuugcucucugccguucccucauuuuccaaguagagaaaguucugcccucccagcaaagggcuuauggacaucccaaagaccaucuccuuucauuccuucagacagagugaguaagugcucacccuacccgcugggcugaauuugauuuaaacguaaacaaugaaggcuucaaagaaaucgugccaauaauaccaaugugugauuauuaucacuuguccuaggccacuagguagccuuaaacacauuucuuggguucucugcacuuaggaggucagggaagcccugcugcuuggcugaucaauggaagcccuggaaauccauucaccaaaacacccugaaccacaaacauccugagacaguguggcuagacagacuccuggauggaauucaucuugacuacccucagagucacuuucuccacccuaaguuaaugaugccauuuuacacauugaagacaaacacuuccuguccugucccaggacauuggaaaggagcagacugagacucuaccuuuuuuuuuuuuuuuuuuuuuugguuuucaaggcaguggucucucugaguagcccuggcugcucugaaacucguucuguagaccaggcuggucucaaacucauagauccaccugccucugccccugguauuaaaagcaugagggugugugccaucaucagcuggcugauucugcccauucuuuuaaccaagccucuccaauacaccaaacuucugccuaggaugcuacaagaaaggacacacugucugugaaggugggauuagauccauccgccaacugcuaaauaagggcagaucugcugugugugaguagauaagacuugggugcuuaugaaaguuaaaaggaccaaugcuagucacagguggaagagaugccauacagacagauuuuuuuugacaagaggaagagucaguauauguacaacagcauccugagcuguccagaguuucuuaggaagagccacaggguuccaagagacggucucucaacagggaagagaggggaugucuguagccugaugugggcuauuggccucaggcacaguggccgcauuuugcuugccagagagcauagcgucaccacugucauccccgagggguugccaaagugaccacuugcuggguuuggccuaugagaggauccugaacccauaaccccuccauccacaucuugacagggacuggugaugcugcaggcugaguuggguuccacugauaagccugcacacacaaaaguguucucccaccuccuauuucccacaaacucaaaucuucuaugucuuccccauccuucuguccuaugccugggugaaaaagaagaggggcuuugacucacucuggaugcugguucccucucuguacaguccugccaugccuuaggaucaaggcacacugacuggcucacauguacacacuuggguauacgcacccacacagcaugugacuuaugucgccuccuaucagcugccgggaaaccaaucugcuguguuuccuaacagcuuuccuuuccagagaagucuccaggacccaggacccaggacccaggacccagggcccuccuucccaggugcccccucucaugggcacacacucaucuauaaggaugcagggggaaauguccugaaggauugaggagagucacaaccccaugccacaggaaaugauggugguggugguggugguggugguggcgguggcggggacuuccgcugacuaaaaauaugucccuuccuuugaacuuccucccagagguugaaaagaaacugggugacauuaugaauucaaggaacagugacaaacagaacauguggcuggcagugugacaaugagauuccuugugggaguggagcacuuacuugcaagagggaguacggaacuccugcagguaucugcacuccccguggaugcaguaguccuuguauuuccugaggcaugggucucucuucuucccuaaccccuuuccuuucuucuucuuuuucccauuccuuucuuugcuugggguggccaggccuuguggcuuggaggagaaagcaacugcaggaaaacaguucuggugagcauuucuacuccgucccucugcaaaggcaucuccaaauaugagccaggcugaucucagauucccauuucacccaccccagcaucuggaucauggaauuacaggcggauacccccaaaacuguugagggugcacacacucuuuggucccaccugaagucagaggccugggaacaaacucuuuaagaaccaccagaaagaggaaacuuuaaagaggaaauagagguuagguuaggucccaaggaagaagggcuuuguucuaagaaagccagaguaacugcaggucacagcgcaaagcuaucagccuggcucugccggcuuucuacccucucucugugaucucccacgagcuccauucuauuguaacccucagucagccucauuuccugguccuguacucagugacccacuugcaggaagacugugucacagacaaaaauugcuuugggagaaggaacauggcuguuuggggguaggacgcuucuaagauaagagugucuaucgauuggaaaccucuucucuggaauucccauuggucacaggguuuggugcagaaccuaccucugaaacagaaaacuagccaccucugauuuaaaaggccuuacuuuucugaguuugggcaagaaaucugccugcccugagcccuuuaacaauuuauccaccuuuucaaacauccaauuagauuuauccucaaauguccuauuuauaccugggguagggaggggcguuauaauacguacaaagaacuguccuggaggaacuggacuaugacaaccccccucaucuuuccaggcuguaaauauggggagggucaaauucacauucaggugggacuggccuuuagcccaggagucugaugccagccuucccuguuccugaacccaguaguuaaaaggugcuuacuguccauagcuauagcuuaagucuggcagaaagauggacaugauagguuacacuagggacacagaauccucaagauaaaugagacuucaaaaaugcuagggcauuuucaugaugaacuguuagauuccaaaaggcaggggcuuuuccccaaggugccacagaauuagaauuagagcagugcuaucuggugcuguuccaggcuccuuaaacacucagaagguguugcugguggccagaggaagccagucaucagaacuccaaggagagcaaagcagaauccacagcaaucggagagagagaugcagaguuaagacugacaaguuaggcuccugcugaagagggagccgugagucagguuggcagagguaagaggagcagccauguggguggggggugagucacagcccugcccagcccuauccagccuaagagagagagagagagccaagagaauccagacuguucaggacaugggugaccccagggggccacuguugagaggaugaugugugggaucccagccucucaguuauagagcagacucuugacuuaaugcaaaacagagaaagaacccagggaagccuugggugagaagggagcaggcaugcuaagcagcagguggggcugagcaggugugucucuuuccaaccaaauauagucauuccggggcccacagggcuucuggcuggcuccgccucugagaaucacugcaaguggccagaggccgggaggcccucggguucuggacucugaccagucccugugcucagccccagauacagguuauaggaucacaccuagaccuuucuuccuggagucuccuuagggauuccaguggagucuacacguuucagacccacagcguuucaaaauagcuucacaggacccaacauucaccauucauggccagcugcaggggugcuggccacaucuaccaaagcuaagaagaguuccucacugcccucuuuuucucuagccuggagauagguggaugaaggagacuagcgucgcucacuuucaacguucccaucuguuaacucuuuuuauauauaaucaucacauauauaaucaacaucaaauaggacuugcacuuuuuuuuucacagaaacucuagagaaagcauuucuaucgcgccuucauuccaucuagcuuaucucagaggacaaccugccuccuucaguuuguuccaaaauacaaaauaagaccccacacuaggugagaccaaggacaagacugaccacacuguauuccagaacccccaucuccaaucagcccauaaguuuuuccuugaagucuuccauaaacaucccucaguccuccgggagugggggguaagggugugggaaugggggcaaaagcauaaaucuuuggccuguguauucuucaguugcgaacagcaucuaagguuuaguaagccuccacacccaccuuugaaaagguucagaucugucccuuccaaguccuggacccccugagcacgaucaccucccguggguagcagcugguuuguggauccagugggagggucaggguugcugguugcugccgccagaccucuccgaagccgcuccagacucucaccggucaccaacgcggacaacacuggacaagagaagagaggaggccgcaauaagacccuuugcuuagaccccucucuaccacgccaucgagguccacgcccgcccuucagggcgcacgggccccaccaaguggcccgcucggcgggugggggggcgccgcagcgaccuucccacgugucccccgcacgacgcccaccccacccccgaccucggagacaugagcucuuaccugcggccagaaagagcuucagcaucaccgacggcagcagcuucauggucccgagccuggcggagacggggaggcagcgaucacuuuggaugcggcggccacuggacgccugcaccggggccaggcgguggaggacagcgagguuccacuaaggcacuguccgcugccugccucugggugagauccugucugggaaccuugcggccgcgguucgucugucuguucagagucgguccgcgcguccacuccagcccuugaaggucugucaggccgaccagccagccgcgugcagcuccccgggccgacugagcucucgcucgcagcgcgcggccgggaaua

SEQ ID NO: 8881 - RNA, 10881 nt, Mus musculus
uauucccggccgcgcgcugcgagcgagagcucagucggcccggggagcugcacgcggcuggcuggucggccugacagaccuucaagggcuggaguggacgcgcggaccgacucugaacagacagacgaaccgcggccgcaagguucccagacaggaucucacccagaggcaggcagcggacagugccuuaguggaaccucgcuguccuccaccgccuggccccggugcaggcguccaguggccgccgcauccaaagugaucgcugccuccccgucuccgccaggcucgggaccaugaagcugcugccgucggugaugcugaagcucuuucuggccgcagguaagagcucaugucuccgaggucggggguggggugggcgucgugcgggggacacgugggaaggucgcugcggcgcccccccacccgccgagcgggccacuugguggggcccgugcgcccugaagggcgggcguggaccucgauggcgugguagagaggggucuaagcaaagggucuuauugcggccuccucucuucucuuguccaguguuguccgcguuggugaccggugagagucuggagcggcuucggagaggucuggcggcagcaaccagcaacccugacccucccacuggauccacaaaccagcugcuacccacgggaggugaucgugcucaggggguccaggacuuggaagggacagaucugaaccuuuucaaagguggguguggaggcuuacuaaaccuuagaugcuguucgcaacugaagaauacacaggccaaagauuuaugcuuuugcccccauucccacacccuuaccccccacucccggaggacugagggauguuuauggaagacuucaaggaaaaacuuaugggcugauuggagauggggguucuggaauacaguguggucagucuuguccuuggucucaccuaguguggggucuuauuuuguauuuuggaacaaacugaaggaggcagguuguccucugagauaagcuagauggaaugaaggcgcgauagaaaugcuuucucuagaguuucugugaaaaaaaaagugcaaguccuauuugauguugauuauauaugugaugauuauauauaaaaagaguuaacagaugggaacguugaaagugagcgacgcuagucuccuucauccaccuaucuccaggcuagagaaaaagagggcagugaggaacucuucuuagcuuugguagauguggccagcaccccugcagcuggccaugaauggugaauguuggguccugugaagcuauuuugaaacgcugugggucugaaacguguagacuccacuggaaucccuaaggagacuccaggaagaaaggucuaggugugauccuauaaccuguaucuggggcugagcacagggacuggucagaguccagaacccgagggccucccggccucuggccacuugcagugauucucagaggcggagccagccagaagcccugugggccccggaaugacuauauuugguuggaaagagacacaccugcucagccccaccugcugcuuagcaugccugcucccuucucacccaaggcuucccuggguucuuucucuguuuugcauuaagucaagagucugcucuauaacugagaggcugggaucccacacaucauccucucaacaguggcccccuggggucacccauguccugaacagucuggauucucuuggcucucucucucucucuuaggcuggauagggcugggcagggcugugacucaccccccacccacauggcugcuccucuuaccucugccaaccugacucacggcucccucuucagcaggagccuaacuugucagucuuaacucugcaucucucucuccgauugcuguggauucugcuuugcucuccuuggaguucugaugacuggcuuccucuggccaccagcaacaccuucugaguguuuaaggagccuggaacagcaccagauagcacugcucuaauucuaauucuguggcaccuuggggaaaagccccugccuuuuggaaucuaacaguucaucaugaaaaugcccuagcauuuuugaagucucauuuaucuugaggauucugugucccuaguguaaccuaucauguccaucuuucugccagacuuaagcuauagcuauggacaguaagcaccuuuuaacuacuggguucaggaacagggaaggcuggcaucagacuccugggcuaaaggccagucccaccugaaugugaauuugacccuccccauauuuacagccuggaaagaugagggggguugucauaguccaguuccuccaggacaguucuuuguacguauuauaacgccccucccuaccccagguauaaauaggacauuugaggauaaaucuaauuggauguuugaaaagguggauaaauuguuaaagggcucagggcaggcagauuucuugcccaaacucagaaaaguaaggccuuuuaaaucagagguggcuaguuuucuguuucagagguagguucugcaccaaacccugugaccaaugggaauuccagagaagagguuuccaaucgauagacacucuuaucuuagaagcguccuacccccaaacagccauguuccuucucccaaagcaauuuuugucugugacacagucuuccugcaagugggucacugaguacaggaccaggaaaugaggcugacugaggguuacaauagaauggagcucgugggagaucacagagagaggguagaaagccggcagagccaggcugauagcuuugcgcugugaccugcaguuacucuggcuuucuuagaacaaagcccuucuuccuugggaccuaaccuaaccucuauuuccucuuuaaaguuuccucuuucuggugguucuuaaagaguuuguucccaggccucugacuucaggugggaccaaagagugugugcacccucaacaguuuuggggguauccgccuguaauuccaugauccagaugcuggggugggugaaaugggaaucugagaucagccuggcucauauuuggagaugccuuugcagagggacggaguagaaaugcucaccagaacuguuuuccugcaguugcuuucuccuccaagccacaaggccuggccaccccaagcaaagaaaggaaugggaaaaagaagaagaaaggaaagggguuagggaagaagagagacccaugccucaggaaauacaaggacuacugcauccacggggagugcagauaccugcaggaguuccguacucccucuugcaaguaagugcuccacucccacaaggaaucucauugucacacugccagccacauguucuguuugucacuguuccuugaauucauaaugucacccaguuucuuuucaaccucugggaggaaguucaaaggaagggacauauuuuuagucagcggaaguccccgccaccgccaccaccaccaccaccaccaccaccaucauuuccuguggcaugggguugugacucuccucaauccuucaggacauuucccccugcauccuuauagaugagugugugcccaugagagggggcaccugggaaggagggcccuggguccuggguccuggguccuggguccuggagacuucucuggaaaggaaagcuguuaggaaacacagcagauugguuucccggcagcugauaggaggcgacauaagucacaugcugugugggugcguauacccaaguguguacaugugagccagucagugugccuugauccuaaggcauggcaggacuguacagagagggaaccagcauccagagugagucaaagccccucuucuuuuucacccaggcauaggacagaaggauggggaagacauagaagauuugaguuugugggaaauaggaggugggagaacacuuuugugugugcaggcuuaucaguggaacccaacucagccugcagcaucaccagucccugucaagauguggauggagggguuauggguucaggauccucucauaggccaaacccagcaaguggucacuuuggcaaccccucggggaugacaguggugacgcuaugcucucuggcaagcaaaaugcggccacugugccugaggccaauagcccacaucaggcuacagacauccccucucuucccuguugagagaccgucucuuggaacccuguggcucuuccuaagaaacucuggacagcucaggaugcuguuguacauauacugacucuuccucuugucaaaaaaaaucugucuguauggcaucucuuccaccugugacuagcauugguccuuuuaacuuucauaagcacccaagucuuaucuacucacacacagcagaucugcccuuauuuagcaguuggcggauggaucuaaucccaccuucacagacaguguguccuuucuuguagcauccuaggcagaaguuugguguauuggagaggcuugguuaaaagaaugggcagaaucagccagcugaugauggcacacacccucaugcuuuuaauaccaggggcagaggcagguggaucuaugaguuugagaccagccuggucuacagaacgaguuucagagcagccagggcuacucagagagaccacugccuugaaaaccaaaaaaaaaaaaaaaaaaaaaagguagagucucagucugcuccuuuccaauguccugggacaggacaggaaguguuugucuucaauguguaaaauggcaucauuaacuuaggguggagaaagugacucugaggguagucaagaugaauuccauccaggagucugucuagccacacugucucaggauguuugugguucaggguguuuuggugaauggauuuccagggcuuccauugaucagccaagcagcagggcuucccugaccuccuaagugcagagaacccaagaaauguguuuaaggcuaccuaguggccuaggacaagugauaauaaucacacauugguauuauuggcacgauuucuuugaagccuucauuguuuacguuuaaaucaaauucagcccagcggguagggugagcacuuacucacucugucugaaggaaugaaaggagauggucuuugggauguccauaagcccuuugcugggagggcagaacuuucucuacuuggaaaaugagggaacggcagagagcaaguaggaaguuauuugcaugagcuuaacagcuaaauaaguucaugggaagaaaaauggggucucauuccuaucccagcacgcuuuuguguucccgggacacacuagguguuggcuuuccuccucuaucccuguccuuacagaguuggagcagaguuuuauggggggggggcagcuguuguccaagaacaccccuuaggauuucacuacucuaagaacacagcaagcguccagaaggcauugugucaacuuccuaggcagacuucauaggguggguucuuugacauagagcuccugguuuggggcaaugugaugucugugcaccuacaucugugucccucuugguggcuucuccucuccuuuagacccagaagcugccagccaggguguguccaggcugcuguggcgaccuugaggcuaacuggcuuccuaaaccagccuuugacagccaccaggaacaggaaaacccuucugugucaccagccaaaaguugcccucaaagagcaguuuucuuggacuucugacuggcugcugacccagaaacuggcugcaggguuuccugugacgagagcaaaccuagggguaguuggguugggaaggacugugcuggaagagaggcaagccuggagcugcacuaugcacacugcucaugugcagagaagccccuucucuugacuccaucuggccugaacaucucguuccuugagaaacaggcuuugcccucugguuugguuguauaauaacucacauaacuggggcauggguuuuucaugaugcuccagugaguaggcucugauuacuucugauuuaacacgaggaaauaaaucaaagcuuagaaaaguaacgugacuugcccaagaucaccuggcuagaaauagcagaaccagucuggaacucacuuguucugauuccccucuaucaaagggugcuuccuucaccuccuggaguugauucggagauauaguaagaguauguagaagcuaucucuggccucuagaaggagcgucuguugucacgaaaguucugaagugggucacagacguggagaggagaaacauguccuaguuugacagauguguguguuggcuugaggcaggacacaugaucuugcccugcauccagggaugcucggagugugcucaaccccccuucuucccuggggaagccaggcuuuggcgggagggggaagucgguaauauuagcacauuuacauuauuauccucuugacucaggacagaggugguggagggauuauauaacugaauugugggacucugaggccaaguuuuauuucuaccgucugaguaacuaccugugggguuugaaugaugguucagaacugcaaagcagacucugccucccuccccuggcguagcauagcugcugaggucaugcagacugcuggauuaaauccagggcuccgcuacucucuaacuuuguaaccuuggugcguuguuuauuggaaguuaagccuuguuuucuucaaaauggggaugguaaccucgacuucacagguggucugaccuuaaauguuaaaggauaucaaaagggccaaauaaaauaacucuugugaagccguuagcgcagaguacuuggcucgugguaggccuuuauuacucguuauuuguuauuaaagcuguaauaaauaauaauaauaauaauaguaauaauaauguggucagagaacaggucagacagucccaggaccugucagauacucucuuaggguucccugcauuaauggggucacaagcguagcuucugaccuuguccuuggugcuuucuaguucugagacagaucacuucauuucuuugaccccccucaucuccgugcacacaggauuuuccagaaacacuccuaggagcauccuuuaggucccggaaggauagggauacuguuagauuuuuuuuuuuuuucuuuccugacucugacucaggggccagacauacugaagaggcuagguaaggaacguauucuguccuuuguggagcugacccaccuuuaugcugcucuguacccagaaguaggugcugggcaguccgaagguagggagggacagggaugcagugcuacccaucuugaccccugugccauugccagaguccacagcucugcuccacggagccucccagggcccugccagugggaaggagagauucaccauggcucugaggcuccaggugcacaccucucucuagagacgguacgauucagaguagagggccacagguucucccucugcuuccuucagcagaugcgagccugacauccccaagcagacacaccuaccccuuccccagauggugggugagcagaugugggggugcaugagcaaaguuagaggguccacggcaaugcugccgcccuguugccgagaccuaggcaagccaugccacuuuucuguaacauggggcucccccuacaucaaaggaucucaagggugcucaaaggaagggaugucuuccuaagggcuuuaaggaaaugcuuuguguuugaagaggggguugucacgugacuuguuucuggcgcgagaagagcucugggauuguuucugacauucuuuccccugcugugacaggguggcugggcaggaagauguuaucuugguuuguuugcuuugugcccugagauaaagagaccagcauucgggacaccaaaggcuguaguuuagcucccagguugggagcgaggaguuaaaugaaggaaaugagaaaaaaaacgauuccuggcagagggacagggccuauuaauaggccgagcagcaagcaguggggagggaccgcaugcuggaugcauggaugggccaggcuggguuuauuucugggucagaauguugaagggccucucuagauugagggagagaugcugagucgcccuccgcccaaguccucuuaaguagcuuaagcggaacaccuuaguacagauguaauagauuaggccauguggaauacaucuaaagagagaccuucaacuccucccucacuuuuucccugccugaagcaggacucugggggugggaugggguggguggagagagaggcagagggggugcagucaccauuaacucucucuucuucuuguuauucuagaugccucccugguuaccacggacacaggugucaugggcugacucuaccaguggagaauccccuauacacauaugaccacacuacagucuuggcugugguggcuguaguacugucguccgucugucuucuugucaucgugggacuucucauguuuaggugaguguuuggggccucgugggcuuguuuuuggagucauucacuucuuucuuccccucggacuuagggccucuccucauaucccuagaugcuggccuaguauuguacuuucuagaaacuauuauuauuauuuuuugucugacauggcaugagaccggugugugaagcccaggguaccuacggucaggccaggccaugcagguucuguuccucuguucucgugggguucauuuccuaccucuguggccuggucacucacccacaggagcaccucuuagacauuuccuuccccggguauuaaugcguggcuugguaguaaaggcauggauaauauuauugaugguaaucuuucagcgauuggacucuauaaggauguuuugaggaccaaauaauaccaaaaucaauaaagucaggggugacagguacacgccugcuaugaagccagccugggcuacauaggaaaugcuagugcagucuggguuaugaggugcugucucuaaaaacaugauauguauuauauaugcauacacaaauauauaucuaaauucucugcugguagggacaggaaucccucagagaagcuaaauucuggcuaaagacuccugaguugccaccuccucugggcuuuuuugaagaaauggaucaccaugauggggguuucuugagagggcuggcuguggggccugcacggugucauuucuucacagcccuucuuuuccucagguaccacaggagaggagguuaugacuuggaaagugaagagaaagugaaguugggcguggcuagcucccacugaggaggaccugagcuauagguaaggcuccauccuuuguccugggcagcaugggcagacaagccaaggcaugggugggucuggggucugcuucaguaagugcuggauugucuuguuuagggguagcagggggcagguuacuacugugccaucugaguuccaauucagaacuguuuucagagacucuggcuaggucacaagguugcggcacccacagcuccccuuccuaaugcuccuugcaugucguuaagauuagacccagcuucaaaugccuccuucuuuaugcuucaggaaccuucagaggcuacuucugagacagugguucguuacacguucuacauagaggagaaauauuucaccagcagccaugaaaacgucuucauucauuuccaguugcuacccugacugggccuccuguaauugcucuguuaaaagaaaaaaaaaaaucucagagccucuaagugccaaacagaccaugcccgcugggauccggaucagaagaaagcaggaucgagugagcccuucaggccuuccugguccuccuccauugaacccacugguuuguuuaaacacuuagcuucuggauuagagugucagcuaguuuccauaugcuccaggauuuuugacuggaaaaaaaaaaaaaaaaggagaggaagguuaaaugguuuauggacuggaagagagcaacagagcugagaagcuauguguucaaguagccgcaagggaucugcuguuuggacccuccagcacgcuggauuugaugaacuaacugugaaauaccgcaagcucgagaacucuugaguuuugggacuuuucuacccagagggggaaaauaacaaguauuuuguuguuuuguuguuuuuguuuguuuguuuguaaaaugccuuuuaaauuauauauuuauuuuauucuauguauguuaauauauuuaguuuuuaacaaucuaacaauaauauuucaagugccuagacuguuacuuuggcaauguccuggcccacuucucugcgcuccaccaucuggcucaaugccacgcuggguccuauuugcucuguaacccaucgguaguaauuuauugucugucuacauuucagaagaugucccuggagcagaauaucccaggguagguuguguauggucagagugcagggaucgguuugggcggagccacucugugaguuggacugcagucuugccuaggugauuuuugucuaccguucguguuccgaaagcccaaggugcugauguuagcguguaauagauauugguguuugccuguguccucucccugccaaaucccagaagagauugagcauccaugccugcaggaaguccaugggcuuccugguccucuauccccccaccucacucccuuugugucaagacauuucccuuauccugcuguucuucgggugcuacuucgugcagggguuggcagagcacaggacaguuuggagaaggcauuaguaaaggaaaaggcugaggaagagcagggagcuuuggaguugacuauucuuggucauugauaccuaucaauuacuauagggaagguuggugggagggaagguuuuggguaaggagacuacggucucaccaagacuauaauguaugcugucacaguccccauggaagguucuagugccaugucugaacuguuacaacuuauauuuccaaaaccugguucauauuuauacuuugugacccaaauaaagauaacccuuacuccauccaug

SEQ ID NO: 8882 - RNA, 3133 nt, Mus musculus
cgccccggaaaugaugcgcugccccgcuggcggugcggaaguggagauggcggagcuguacgugaagcccggugagcacggccggcgggcuggugguacucguccucucccguccccucaaccccaguguauccuccguuagucuguugggcuccgggccucguuucacacacuuccucgccuucgcaggcaacaaggaacgcggcuggaacgacccgccacaauucuccuacgggcuccagacucagacugguggacccaaacgcacuccccuuacuaagagggucgcggccccacaggauggauccccuagaggugggugagggcugugggcagaauccuguaccaaaaggaaaagauggugucugggauaaaccugucccaucggccuauuuuccucaaggacuccauaagaaggguugggaagccacggcucagcgcaggcgcuuuuugugcucgaucuuuuugcagcucuguuaaguaaacgauauguuggauaaaaggacuccaaacucucauuuagauguuuucaaauauuucuugccaagauuucuucccaggaucauauagucuuuguguuauuuacucguuuguuuaaucaguauucacuugucaggagacugucaagagccaggaacuguuugaaugcaaacuaaaaaacagugaacaaacuaacaaggaauuuugauuccacacuugcucgagauaaaaugacacgugaaauauuggccuaguucagagacuuaaguagaguguuccaauauauauauauauauuuuaauggaggguuggaagguggugggaugcuauauuugauuagguuugaacaucauccucaaaggaagaggguauggguagaggcuuaaaaaugaaccaugacagaaacuuaggggucucuagcaccuaaugaauguagagagaaaacugguuagaauuaaaucuuaaaucaauaguaaagauagauugaauaagcuagagauaagagacugagagacuuaauauuucuguaauuaaucuucaaaagcaguuggaucucuugaguuugaguugagccuggucuaaaaaccauuaaacucagguuccaggcuauguagagccaaucuuuaaaaaaguaagaaaggaaggaagagaaaauagaaugugaaugugaaggguguuuuuuuuuuuuuuuuuuugguuuuuggagacaggguuucuuuguauagcccuggcuguacuggaacucacuuuguagaccaggcuggccuugaacucagaaauccgccugccucugccucggcgugcgccaccacgcucagcugugaagggguuuuugauagcaaauacugugcagccuauuucuauauucguggcaugaugauaauauguaauuggcucaaugcugugaacaaaguuaagugaaaugaggagauaggaacuaaaugagcauugcaggggacuaagccuuguugcuugaugcaaacauuucagccccagaaacuucuggaccaccuccaguggaucauccaccuccuucaaguaaggcuuccaggccuccgcccauggggagcuguccugcuacugguguggagcccccaaguuccccagucauugagucugaaacucugauagaagacgugcugagaccucuggaacaggcauuggaggacugccauggucacacaaagguaggcccaggcacuuuaggggguggaaaggauuucuacccaaccaaguaugguuuuuaaagacagaguuucugauggccucuuaagcaaucucuccaagucuuuccaggaaaauggauacugaugucagagggauccucaggacuuuugaaggaugcuuugugaauaauauauauaaaauuuuuguuuuuggagacaggguuucucuguauagcccuggcuguccuggaacucacucuguagaccaggcuggccucaaacucagaaauccgccugccucugccucccaagugcugggauuaaaggcgugcgccaccacugcccagcuagaugaguuauauuuaacuauuagugaguuauaagcuucuuuauuuuuguaauaaagccauucagaauauacuguugauuuuguacucaauuuugaagagacaaacaagcucuguaugaagguuucuucagcucuguagaggcaaaggauugaagaaggaagaagcagcaggauaguccgcuccaaauguuauuugaacaguaauauuaagaugagccccugaggggcugaggcggcauugaaaauuuaauauucuugucguguauaucauuugucuugggaggacauuggcuuuaucauauuuguaguggagagccucuaagcauuagguagaggaauaugaacucuagugacuaagaaucaaccuccugagccagagugagcacaugcuaguagcacugagccggaugagcuucuguuucagaaacagguaugugaugauaucagccgacgcuuggcgcugcuucgagaacagugggcuggagggaaguugucaauaccuguaaagaagaggauggcacugcuagugcaagguauggguggggguccuuuauccucccauugauggcugaauugguggcaagguuuuaacugauugggaggggaggaauggaagacaugacuuuuacugcuauuugcuugcucaaacccugucucucuucagaacuuuuacaucaccagugggaugcagcagaugacauucaccgaucacucaugguugaccaugugacugaggucagucaguggauggugggaguaaaaagauuaauugcagaaaagaagagucuaucuucagaggagaccaaagaagagaaauuuacaguggaaccugagaaccagacaauaccaggcuuccaacagccaucauaaugccuguggcuccccagacucacuucaccugacuuccuaugccuuaguguggaaggcuucuucuuccuuuuuaccaccagggagacuauuggucuugugggucuugaccaaagauccuaucuagaccacugcaagaucacuuguuauguacauuucaauaaacaucucaauaaacaucucaauggugggaaguggguaggaaagaugagccauucugaugucagacugguucuuuguggugucagcuucccugcuccauggacacuac

SEQ ID NO: 8883 - RNA, 2636 nt, Mus musculus
cacagaaugcccuaaugccacucugaauucuuccuguuuuucgucccuuccuaaaaaacacuucguugcaauauuuacuagaagugaguagggcuguuaggaggaagagaaguggagacgcaauuagaauucacagaggaagggacagggugacaccccaggauuacauaaauuuacaggggcugccaaauuggucgaacaagcccguggaaccuggaagccagagaacaccaccgcuguaaaggaaagaaacugaagccuuucucggagccuaucugggcugcucaaacuuucagaaucuaccgaccauggugagucagacagucuugggguggaacuggagccaaccugaggaaucucagggucuggcaggagucucccugaccccuacuuucuccucaggagcgugugcuuggcuuguugcuguugcuucuggugcacgccucucccgccccaccagagcccugcgagcuagacgaggaaaguuguuccugcaacuucucagauccgaagccagauugguccagcgcuuucaauuguuugggggcggcagauguggaauuguacggcggcggccgcagccuggaauaccuucuaaagcguguggacacggaagcagaucuggggcaguucacugauauuaucaagucucuguccuuaaagcggcuuacggugcgggccgcgcggauuccuagucggauucuauucggagcccugcgugugcucgggauuuccggccuccaggaacugacucuugaaaaucucgagguaaccggcaccgcgccgccaccgcuucuggaagccaccggacccgaucucaacaucuugaaccuccgcaacgugucgugggcaacaagggaugccuggcucgcagaacugcagcaguggcuaaagccuggacucaagguacugaguauugcccaagcacacucgcucaacuuuuccugcgaacagguccgcgucuucccugcccucuccaccuuagaccugucugacaauccugaauugggcgagagaggacugaucucagcccucuguccccucaaguucccgacccuccaaguuuuagcgcugcguaacgcggggauggagacgcccagcggcgugugcucugcgcuggccgcagcaaggguacagcugcaaggacuagaccuuagucacaauucacugcgggaugcugcaggcgcuccgaguugugacuggcccagucagcuaaacucgcucaaucugucuuucacugggcugaagcagguaccuaaagggcugccagccaagcucagcgugcuggaucucaguuacaacaggcuggauaggaacccuagcccagaugagcugccccaaguggggaaccugucacuuaaaggaaaucccuuuuuggacucugaaucccacucggagaaguuuaacucuggcguagucaccgccggagcuccaucaucccaagcaguggccuugucaggaacucuggcuuugcuccuaggagaucgccucuuuguuuaaggaacauuugcauccuccugguuucugaggguccucgucaacgaauccucugcuuuaaauuuauuaaaaucuuaauccacgauguaaggaaagaaaggcagucaagaugguucaguggguaaaagccagcaaacuugaccccugauuuuaacccucaggauccacacggaaggggaaaacucacuccugaaaguuguccaucugugcucacaaauaaauauuuuuuaaaauaacaauguguuuguugguuuuguuuuuguuuggguuuuguugugguuuuguuuguuuuguuuuguuuuugagacagucuggcuauguauccuuggcuggccucaaacucauaaagaucaagaucggccugccucuaccuccaaaugcucugguuaaagggaugugccuccaugcccaguugaagucauccugaaccacgaguccaggccacucacucuuuacuaagaucuuuacuaaguaucugccauaggucaggcucagugcuaaaugaggaauucauucuuaaacuaucuccaucucccuagaacuccucucuccucaagaaaagaacugcagagacguguucccaagcucgagccgagggggacgaugaauguguagcgagggcuuucagagcagauuacuggccauugggguuaaaggauagaugaauggaaauugagguuugaaugagaauggcucguauguauaaauacuagacuuccaguugguggaacuggaaaaaaaaaaaagaauuaggcagaguggcaugguuagaggaggcugagggggcuggacuuugagauuucaaaaguucagccauuucccaguuaacucucugccuugugcuucgugaucaagauacgaaugaacccucaccaugccagcugccacauccuaccaugauggucauagacucuaacugaugcucuaaagcaguguuucucaaucuuccuaaugcugagaccuuuacauacaguuccucacguuguggugacccccaaccauaaaaugauuuuuguugcuacuucauaacuguaauuuuggcuacuguuaugaaucaugauauauaaguaucuguguuuucugauggucuuaagugaucccugugagagggucauucaaccccuaacuuucaaagccga

SEQ ID NO: 8884 - RNA, 3593 nt, Mus musculus
cuuacuaugaaucuuuguuuuuauuuggagaacuggcugaaccaaagagcccuuccucccaccacuugucccugguuugggcuuacaugguuuuuguuuuucuauacugguuuuauuuauauuaaaaccccaguugguauacaugugucugcuugguauacaugugucuugcuguaguggucauagaguuuguuuuacaaugauagggggagcaaauacuucccuucuucggggcccugaguucaugucauuucuuacaugacacagaauauagauaaucagugguagagcugagcugaucauguucaaggugguagguucaaucuacagcaucaacagaguucuuuggggaaaucugucccagaaaacagcuccuugucccucccucagucacugucgucgucaucgucaucgcucucccucaccaccuccucuggagccuuggcauccucuucaucuucccucaacccugcaaagaagucguccgugcuccaagccuuacugcucagggcacgaagcggcccucccuuuuucuugcgucgccgauagucauccacaaccacgguucgaagcugagucaugucccaaaacuugaggcgcuggucguggccacuacuggccagaaaguggccgcaaugggauagggcuagcgccuccacaggcuccccggcaugcuggcccacgguaccuaccacucgguuuggcaggauguucacagcccugagcagagaagaguguuaggaacuagcuuagcuugguuuauaauuccuaggcugcuccuggcuccccuuaccugaugauuccauccguggagccagugcacaacagauucucagugacuggaacuaugcagucgauggacucugcucucagggcaaagcggucacuuguagccccaaaaccauuccaguugaagagguagaugguccccucgcuagauccacaggccaccuucuucccguacugcagguuaacagagcaaacgguguuuguggagucacuucacagcagauccccuaguagauggaccccaucccaucauacccagcuguacuuucaugagggcgacggagguuagaucuccugacugaggcucugagaguaacucaaaccggcgucucuugauguugaagacaccaaggcagccauccccacuguaaagaaaagcagaugagaugggaaguuccauucuaggaagacuacuaaaaagugggcaccuauucaccacugggccccgugggaagaaaaugagcagggaguuagguuuaagguuguaccuggcugucagcagcagcuuuuuggcugggucuagagccaugucggcaauguacuccucaugcugccgcauauccaucaaagggcccucuuuacgcuggucccauagccggaugccaccagugucgucccccguaaccagagcauucucauccacaagcagcacacuguuaaugggggcacuggaaacacaaaaaugggaauuuguugggguagagaccucucuacugcgaaggugagcccucaacccucacuagguccacauauaccugauuuuccuuaccugugggccuuggaaauucgccuuuccaauugucccuguucgacaucuaagauguggauugcuuuguccuuagagacgguaacaaguucuagggggaaaaggcccagguuagguacugcucguuguccucugcccucuaccacaugcuggcugccuuccccaguccuggugcuuacucugcccauccucugagaagacaacagcccggcaggacuugaggugguguccugaggaccagaguuccuugguuucucccuccugacaagaguaggcaaagcugaggaaaaggaagugagagugaaugauccuaaaccagagcugaugcacggagcacaaaccaaccuucccacggaaguaggacacuuccaggagcauagaacuuaaauccguuuucuuucuuuguaguacuggagacuaaacucaagucuucacacauauuaaucaaauaauuugagucacacauucccagccuguuuauucuuuuucuccuuucucucucucucucucugucucuuucuuuuuuucuaaagcuuuuugacacaggguuucucuauguagcucuggcuguccuggaacucucucuauaaaccaggcuggcaucaaacucagggauucaccugucucuggagugcugggauuaaagguguacaccgcccaguuuagccugggaccuguaauccuuuugucucauccuucuggaugcugggauuacagguacacaucaucagacuccacuucucuucacuauuuucaaaacccugagcccagagaaagucuggguguggaccacugugagggcccagaaauaaucaucuaauggcaagcugugugcaugaguggguuccuauauucuuaagaauucugagaccaagaugaaugguggugguccacgccuuuaaucccagcacuaggcaggcagagguaagcagccuggucuacaaagcaaguucuaggacagccagggcuacaaagagaaacccuaucucaaaaaaccaaguuuuuuuaaaaaacagagccaggcgugguggcgcaugccuuugaucccagcacuugggaggcagaggcaggcggauuucugaguucgaggccaaccuggucuacagagugaguuccaggacagccagggcgauacagagaaacccugucuugaaaacaaaacaaaacaaaaaacaaaaaccugagaccaaagccagagaauccuuugagacuacucugggccauagugagaucuugucuacaaggacuauugacagaaauccagucucagaaguugaaagaguaaaaaucaggcagggcccacugaugcuaaaggaagacauagcuaauuacuguauagucugacuaaugucagugcugacaaguugcaacagaauagagguggagggcuggagagaugguucaguggacaaagugcuugccucaggucuggggauccccaaaaccuaugaaaaagguaggcagguaugguggccaauucuaaucccagcacucagaaggcagagaugggaucucuggcaaguuagcuagcuaagacuagucaggaccgugaaacuccggacucaauaagacacccuaccuuuaaaaaacaaaaaaaaaaggagagggcuguggaaaaacgcauggaaucaauccaaggucuucacaagcacacuugccgaauguuacugaacgauucgggccgucugagucucauaagaugccuucccgccacacuuccuaccccuaccuccauccagagcaguuuuaacacacuucacccuacgccccacucacacgaacacaucuccguccacguccccugcugccagcagaucucgagucggauggaacgccaggccacuggcuggggcuuccagcacgaugucuucugggguaucacggauccggggugcugccuucguggagucaaggucuuccucuucauuguuugaguccucugcaggacucucuucacacgugggguccauaggauccacgcgcgcuugggaccaacuucauggacaggggcguggccuaagcaguugcuuccgggagg

SEQ ID NO: 8885 - RNA, 3552 nt, Mus musculus
uggcugccuuggugucuucaacaucaagagacgccgguuugaguuacucucagagccucagucaggagaucuaaccuccgucgcccucaugaaaguacagcuggguaugaugggaugggguccaucuacuaggggaucugcugugaagugacuccacaaacaccguuugcucuguuaaccugcaguacgggaagaagguggccuguggaucuagcgaggggaccaucuaccucuucaacuggaaugguuuuggggcuacaagugaccgcuuugcccugagagcagaguccaucgacugcauaguuccagucacugagaaucuguugugcacuggcuccacggauggaaucaucagguaaggggagccaggagcagccuaggaauuauaaaccaagcuaagcuaguuccuaacacucuucucugcucagggcugugaacauccugccaaaccgagugguagguaccgugggccagcaugccggggagccuguggaggcgcuagcccuaucccauugcggccacuuucuggccaguaguggccacgaccagcgccucaaguuuugggacaugacucagcuucgaaccgugguuguggaugacuaucggcgacgcaagaaaaagggagggccgcuucgugcccugagcaguaaggcuuggagcacggacgacuucuuugcaggguugagggaagaugaagaggaugccaaggcuccagaggagguggugagggagagcgaugacgaugacgacgacagugacugagggagggacaaggagcuguuuucugggacagauuuccccaaagaacucuguugaugcuguagauugaaccuaccaccuugaacaugaucagcucagcucuaccacugauuaucuauauucugugucauguaagaaaugacaugaacucagggccccgaagaagggaaguauuugcucccccuaucauuguaaaacaaacucuaugaccacuacagcaagacacauguauaccaagcagacacauguauaccaacugggguuuuaauauaaauaaaaccaguauagaaaaacaaaaaccauguaagcccaaaccagggacaaguggugggaggaagggcucuuugguucagccaguucuccaaauaaaaacaaagauucauaguaagcucuggugccaagcugggaauugacuaaggauagcaggucagacccugggcucagugggggagggcaagguuccucacaacuaaaguagcacuuaggugcaacagggcccugucccagcagggaaagcugucaccaggcccugggcugcccaggccugcugggcugggggguuggcacaggcucugcuuaacccauuuaggguaccuguaaaaagaaggggucacugcuuaaccauaguaccugcuucagccccaggagaccacaagcugguccuagguucacucagugccuccagcagcugugcggacacagcauccuuggccaccucaugcccauccugccaaucagaggccaacacaacccaaaugaggccacugaaaggcacuggaugcccagggaucaccaccugguaccaaaagcgaugccagccagcaggcccuguuccuaaacacuuggucaggaacacugggcugccuagcuucauccguugacacagcaguugcagggcagcccgagccccuugggaccccagcuucucccuggucuggguuaguuggcugacaucuggccugaggaaccgcagugagggaccugcaagcugcuggcggaagugcugcuuuaggucuggcuugagccacuccacagccaccugcucuccacagaggcgugacugaccugucaaaaaauaaaaaaaaaggcagagagacaagggcagaguuaaacacuaggagccgcaagcacuuaagaccagacuuugaagugacuugccacaggcuauguuuaaugccucuacacuucuagguggugugacaacuucccugggcuucauuauucccuaggggaauacaaagcagucaggcucuauuugcuuaauaaccaucacaauagcuaccuuucuggucaaagaaaacugaaacuaagauuuaucacuguuuauccuccacugugguacuggcugcauuagcacgucuggaauucaccuuuaaucccagcaauugagaggcacaguuagguauaucauugaguuugacaccagccuaauuuacaaaguuaaguccaggacagccugggcuauuacaaagagaaacccggucucggaaaaaacgaacuaacaaacaaacaaaaaaccacccaaaacuaguaagacaagugacuuaaauauagguaaguagugguaguagcauuaauauggcaguaguucaggaacuccacuugugccugacuauagauuuggggguauguuguuaaguagccagccacccuuccgcaccuuccaccccuaccuucuaccagggccuuuuuggccauagcagcagcucggugcguacugaacuugagcagcgcaaucugagagggcgcagacccagggcuggguagcagcagugucuccuggaggcagggaccgaacgguugcagggcgagcaguaacgcucggcgguuuaagcuaagaggcagcccguccaccgucagcucgcacuucucggugcuucggcacaccaggagcuggcaagaaggccgcagcuggugguugugcagcguagcaauggcggccugggcaccgcgccgcgagcuguagcgcgcauaggcaaagccgcgguucaaaccacugaaggucaucauuaggcggaacucauagaggcgccccacgcgcuggaagagugggauuagcuggugcucguacacguccugcggaagucguccgauauacaccucggacccugacgguggcgggcugcccacccagccuggagggaaaggauuuuguugguuacugugguccacaaggauguuuuuaagcuccaggauaaagcugggggggggggguagggguggggaugggagggagaccaucuggaaauauugauaccuuucuggcuccugggggucguuaccauaauuggacuagacuauaaacaacuaggcuggcaccauccuugaaggccaguguggaagggaggccagacaaauagccacaucuaguagagaguacgucagguaauuuggguuuucugacuuuggauccuaucuauaaagaguggccgaggauggccuagugucacaggggcuggggcuacuguaccuggggguggcccuccauacuuccuuugcccguugaccugcaccaggcggaugccagucucccuuacccacgccuccagggcugccuuguucucuggauucacccucucacaccauugcugggggagaaagguagguuggaauggggcaucaccggcccugguccaccucguuagagguguugggggucaccguaaccauccccuucugcaggccgugcccaacaaucacuuaggucuucauuuacuuaccucgcacucccguuuggacugcauagcucuuuccaaagucuuacaguucccucuuuagaccuucuuucggcuu

SEQ ID NO: 8886 - RNA, 3552 nt, Mus musculus
aagccgaaagaaggucuaaagagggaacuguaagacuuuggaaagagcuaugcaguccaaacgggagugcgagguaaguaaaugaagaccuaagugauuguugggcacggccugcagaaggggaugguuacggugacccccaacaccucuaacgagguggaccagggccggugaugccccauuccaaccuaccuuucucccccagcaauggugugagagggugaauccagagaacaaggcagcccuggaggcguggguaagggagacuggcauccgccuggugcaggucaacgggcaaaggaaguauggagggccacccccagguacaguagccccagccccugugacacuaggccauccucggccacucuuuauagauaggauccaaagucagaaaacccaaauuaccugacguacucucuacuagauguggcuauuugucuggccucccuuccacacuggccuucaaggauggugccagccuaguuguuuauagucuaguccaauuaugguaacgacccccaggagccagaaagguaucaauauuuccagauggucucccucccauccccaccccuaccccccccccccagcuuuauccuggagcuuaaaaacauccuuguggaccacaguaaccaacaaaauccuuucccuccaggcugggugggcagcccgccaccgucaggguccgagguguauaucggacgacuuccgcaggacguguacgagcaccagcuaaucccacucuuccagcgcguggggcgccucuaugaguuccgccuaaugaugaccuucagugguuugaaccgcggcuuugccuaugcgcgcuacagcucgcggcgcggugcccaggccgccauugcuacgcugcacaaccaccagcugcggccuucuugccagcuccuggugugccgaagcaccgagaagugcgagcugacgguggacgggcugccucuuagcuuaaaccgccgagcguuacugcucgcccugcaaccguucggucccugccuccaggagacacugcugcuacccagcccugggucugcgcccucucagauugcgcugcucaaguucaguacgcaccgagcugcugcuauggccaaaaaggcccugguagaagguagggguggaaggugcggaaggguggcuggcuacuuaacaacauacccccaaaucuauagucaggcacaaguggaguuccugaacuacugccauauuaaugcuacuaccacuacuuaccuauauuuaagucacuugucuuacuaguuuugggugguuuuuuguuuguuuguuaguucguuuuuuccgagaccggguuucucuuuguaauagcccaggcuguccuggacuuaacuuuguaaauuaggcuggugucaaacucaaugauauaccuaacugugccucucaauugcugggauuaaaggugaauuccagacgugcuaaugcagccaguaccacaguggaggauaaacagugauaaaucuuaguuucaguuuucuuugaccagaaagguagcuauugugaugguuauuaagcaaauagagccugacugcuuuguauuccccuagggaauaaugaagcccagggaaguugucacaccaccuagaaguguagaggcauuaaacauagccuguggcaagucacuucaaagucuggucuuaagugcuugcggcuccuaguguuuaacucugcccuugucucucugccuuuuuuuuuauuuuuugacaggucagucacgccucuguggagagcagguggcuguggaguggcucaagccagaccuaaagcagcacuuccgccagcagcuugcaggucccucacugcgguuccucaggccagaugucagccaacuaacccagaccagggagaagcuggggucccaaggggcucgggcugcccugcaacugcugugucaacggaugaagcuaggcagcccaguguuccugaccaaguguuuaggaacagggccugcuggcuggcaucgcuuuugguaccagguggugaucccugggcauccagugccuuucaguggccucauuuggguuguguuggccucugauuggcaggaugggcaugagguggccaaggaugcuguguccgcacagcugcuggaggcacugagugaaccuaggaccagcuuguggucuccuggggcugaagcagguacuaugguuaagcagugaccccuucuuuuuacagguacccuaaauggguuaagcagagccugugccaaccccccagcccagcaggccugggcagcccagggccuggugacagcuuucccugcugggacagggcccuguugcaccuaagugcuacuuuaguugugaggaaccuugcccucccccacugagcccagggucugaccugcuauccuuagucaauucccagcuuggcaccagagcuuacuaugaaucuuuguuuuuauuuggagaacuggcugaaccaaagagcccuuccucccaccacuugucccugguuugggcuuacaugguuuuuguuuuucuauacugguuuuauuuauauuaaaaccccaguugguauacaugugucugcuugguauacaugugucuugcuguaguggucauagaguuuguuuuacaaugauagggggagcaaauacuucccuucuucggggcccugaguucaugucauuucuuacaugacacagaauauagauaaucagugguagagcugagcugaucauguucaaggugguagguucaaucuacagcaucaacagaguucuuuggggaaaucugucccagaaaacagcuccuugucccucccucagucacugucgucgucaucgucaucgcucucccucaccaccuccucuggagccuuggcauccucuucaucuucccucaacccugcaaagaagucguccgugcuccaagccuuacugcucagggcacgaagcggcccucccuuuuucuugcgucgccgauagucauccacaaccacgguucgaagcugagucaugucccaaaacuugaggcgcuggucguggccacuacuggccagaaaguggccgcaaugggauagggcuagcgccuccacaggcuccccggcaugcuggcccacgguaccuaccacucgguuuggcaggauguucacagcccugagcagagaagaguguuaggaacuagcuuagcuugguuuauaauuccuaggcugcuccuggcuccccuuaccugaugauuccauccguggagccagugcacaacagauucucagugacuggaacuaugcagucgauggacucugcucucagggcaaagcggucacuuguagccccaaaaccauuccaguugaagagguagaugguccccucgcuagauccacaggccaccuucuucccguacugcagguuaacagagcaaacgguguuuguggagucacuucacagcagauccccuaguagauggaccccaucccaucauacccagcuguacuuucaugagggcgacggagguuagaucuccugacugaggcucugagaguaacucaaaccggcgucucuugauguugaagacaccaaggcagcca

SEQ ID NO: 8887 - RNA, 5789 nt, Mus musculus
gucuugugaguggaccccuuuauugagaguguagagccagcaaagggagcuucaucuguuuacaagacuuguauaacugucaccugugcccucauccccaucucgcccuugaauuccuuagacaaggcacaguacgugaucuagcucucaauguuugggagggauuuguuuuuaacuaaucucugucauagaguucacaaguuacacuacaguggauaagaguuuuagucauuuucaaugggagagccauuuaccuacucccaggggacaaagauauuuguagcugucacaaacuggaugggacugcuacugcugacaucuacuaggugacgacgcugcucaacauacuauagagccccuuaaaaaaaaaaaaaaaaaaaaaaaaaaaagaccuguccugaaauggaggcacacacauuuaaucucagcacuggagaagcugaggcaggcagauaucugaguucaagaccagucaagugggacccugucacaaaaaccccaauuccaaaacuuaccuagcucaucaucaacagugccaagccugaauaacccagugcccgcccaacugcagacaggcaaguuuaacccugagcucuucuaggaagaucagaggguacuaaaauuacaggggacuaaaauguuuuguuuggacucccaagggcacagauccuauuagcagaggggaaaacucgcacuaaggaaaccuguauguaagggggugggaagaggaagauauucuugauguaagaacauguggggcagggaaugauacagacuugucaccaaacaaugugaaacaggccuugucacugucauuuacugcacauguugaacagugucugagaaccggggucucccagagugagagcuuuuguuugguuuuagggcuguuuuguugcuuuuuugcauaaaacagguucuuccaagaaccuguucccgaggaagacaaaacagagauccucagugaagugaaacagaagaaacgagguuaaaaacucaccagacacucaucccauuuaauauccuguuacaugcacugaggaaaccaagaacauuaggucucagggcaucaaugcucugagauucuagcucagguccccucuuugugacauaucaugcacacauacccacacacacauugacccaggcagaaaucacaugcaugcacaaguggguagagaaccgcgggguggaaugggaggaagagcugggucaaggguauaccaguacccgcagacuggagacucagaacccuucuguugcaagcugaacaagaguaaaaauuaaaacaauagcaggacacaggaaaagggaggauguucagacaacagguuugauagaugaagagggaaagaugcagggggauauggggaaagcagucucaaagagggagguccuucuuuauugggaacacagaugggcagagguucugugacuccaguaauguacugaggcugaaggaauaaaccacaguaccucccccaacguagagggaaaccacaaacacccacccucgagcccugcccauuaacacucuuaagaaccuucuccaguacccaaaaaagaaaugacgcccccaccccaccucaacacacacucauuagguccaguauaggccaaaguuaggccaaagagaacgcuucaguaacucuucuugguggaaccaaagccagagaaacccaucacagcugccauuucaucauccuccucaaaagucaaguccuccucggcucuccuuuucuucuccuucuguuucucuuuuuuguaugcuuuagccuuuuccuccugaaggauaaggaagaaaaaaaucacucagaaucaguuggcuccagagcugcugcugcugaaagagaaauguaagcuucaggauucuuuuccgucuuucagcaugacuaaaauccacaguaaagacugagaggucagugauaaagcacugcccagcaugcaugagggcuugagacagacucuaaauggcagugaaggaagacuguaagacaagauuuaagagauaaaaagagauuuacuaagucucuggaguuuuuaaucauacacccuaguucaucucuaguucuuuuuguuuuguuuuguuuuuuuguuuuuguuuguuuuuuuuuucccgagucaugguuucucuguauaguccuggcuguccugaagcucacuuuguagaccaguccggccucgaacucagaaauccgcuugucuuugccucccaaguacugagauuaaaggugugugccaccaccucccggcacucaucucuaguucuaaccagacaacauccugggacaugaagcauaugcuaagaucuguucucaguuuuguguaaauauuaagcucuaagaucuucagcacagggaaugaggcucacuaagguuauuuaacuugcccaaaauccauacaaauaaauggaagagaauaauucugacccuguaacucagauacauaggccaacuaggaaauaguuguauuuaguuaaucccucuuauaguuuaaaaaaguuuagggaaagcuaugugugcaagcaugggaacaggauggcaaugggaggcuuugaacuuucuucucuuggauaugaacccauaauuagucuaaaacaaaccugucuuuaaaaaaaaaacaacaaaaucgccaggcgugguggcacaugccuuuaaucccagcacucgggaggcagaggcaggcagauuucugaguucgagaccagccuggucuacaaagugaguuccaggacagccagggcuacacagaaaaacccugucucaaaaaaaaaaaaaaaaaaaaaaaaucaaugaaugaauaauugcccccccuccccaccccaagagaucuaaucuaaaaagccaaagaaaacuggauaggcuuugagcuguuucucauggaucucgaacaaagaugcccuaguacaaagaaacccaggaacaaaacuggagcuaggagagugagcggaggaagagggccacccucgguccacaaggaaaacacuccaagcuggggagcaggguuagcagagccucaccucuucucugagcuccuucauccuuuccucaaaaucauaaucuuucugcuucucuuccaucuucuucuuguucaccucaaaacgcuucuuuaccugauccagaguggagcguuccacgcgcauggacauacccagguuucgcugaucugggugagguuaacaacggagacaagucauuauaacauccucagccaccccccccccccccgggaaagucucgcccuggcuuuuuuagguuuguuuacuuguuuaccuuuucauaauaaaguacacaacaaaaauaacuauggcuaaaagaagcucucagccucaccugcuccuauuuacugggcagauuaucaucaaggccagccaacguccuccucuggccucuguggucaugcacagguagcacacagccagggauacucagaagcaagcaagcaaacaaacgaacaaacgaaaggccccagaaaaccacucuaccacaccugcccuccagcacaccuuuaaaacccaacccagcuccagccaccaacuaccuccaugccuuacguuucuuuccauuaaugugguccaggaaguuaauggagucuuucaccacacagucacagacauugcaguaguagcugacaaaugggaagaaacagcacaugggucaaucugguuucuaaggaucuuacuguuuucaggaaagaaacucaaaucucuagguaaaauuagaugaugucuaauuaaugucucaauuaacaaaacagacaaacuucacaugacuugcuuuagggaaagucccucuuuacacuucauugugaaugaccuuacaagcaggcccagagaauaaacuugagccuccgaaccacaggcacgggagggccuggaagaggaccuucuaacuuuauuuaagccccaacgaaugcaaaccuagucaauuccacaacugcggcuuuauuagagacccagguccagaaccuccaaggugaccaccccucaauuccuugcccacagaaacuaugagcuauuauuauguuaugcugcuaacuauuuaauguacacagcaaaggaaucacaacaguggauugcuaucugucugagucuccugauguaaguuguaacuuugacagacuuuaaggaaugguggcaaagggugacaagguccgugaaacucuucgauaggucacaaucuuggugcacaaaaacuauaguuaacagcuccaccuaaaacccaccccgagccuucaggucuucuaacagacuauauagccccccugaagauaucagggaaguauuacaguaccaauaggaagaagcccagagaaccaccccuccuagaaauaggaccgagugggcuacaaacuucaggggacaaagaaagacaaagaaucagguuauggucagaacgguggccaucccugggcccaggauucuccucaacacuuccuaaaaaccaauacaguuuauuaggccagcugugguauuaagagucggacaggaagcaacucacccucccauuucagacuguggggucgucuuggugauaacaaucgucuuccccagcuuggacuccagguccaccuuguaaucccugugccgcagaagcucccgcuugacaggcugcacugguuucccugaaaggaaaaagauuaugaaccccaaaauucagaagacuacucaugcuuuuuuuuuuuuucuuuuuaauuccucaaagaacggacacaacagguacuuuauguagcaauucaaagaggcuaggaaagacucuaauuggccuggacuuauauagacauaggccuggucacuauguggaccaagcuggccucagacuugcaaugguacugccaacucucaagagcuuuucucccuuuaaagccagcaaauguaaacaguguuuccuauguguugucuaguugaacugaggaguucugaauuuuuccuggaggugacccuuucaaaagagggguacucacaccgaguagcguauguucaauguuuucaugcaguuacaucuggaaucaacuaagacccaagcagcuggacacgcuuguuugggagguuuugauuugauuugauuuggaauaugggcuacgccuaggggaagcucacguaaaaaggagaggaaaaagcuuuagggcuuuuguuuuguucuguuuuguuuuguuuuguuuuguuugccucguuaacugcaagugauuuaucuauccuguugcugaggcauuccuucucuagccacagcaucaucucuaccguccccuuaucccuucguggagcgagcacccaccauccuucuucucucucuccucugugagucucuucuccgcgagcuucucauauucaucuuugucccacuuucggcgaaaguccaaguuuuuugucuguagggggggaaaaggugcucaagauacguagcugugccuguugcccuggagaaacuaagggaaccgccuaacggccaccggggcggccccaggaccuuucggaagagaagucucucuggaacgcccaggggucugguggacucgggacccccaacccgagagacuuccgagauuccacugucccugcgccaaggccuuacgggggagcucucgaaccugaacccugagaucgcgaagaggugucaggaagucagucaaaucucacagccugucucuauuuagcucugaaaagccaucccccagaccccucaaaccucgucacaccaacaccuaccccgcugccagacgccaucuucacagcgaagugaaugggaagccguaaagugcaguaaaacgcgcccuggagccagaaggcaaga

SEQ ID NO: 8888 - RNA, 4163 nt, Mus musculus
ugauaaacauucauauuuuuagacaagucucuagagggucuauauaacaaaauuauaauuuuugcauuagaaaacuacauaaauguaauguuuuguauacaaauaaaggcaugagaugauaccucuuaaaauguacuaaucagugacagagcaauugccuaguguucccaaggcccagcacccccaacacacacacauacacaagcauaaucugcccuugaacccauagacacugucuuuauagcauacuccuuagcuaagagcugcaugagaaaagugaaucuuuaaugagaauguaggauuuagaucucaaucuucaucuuuuaaauuuuauuaacagauaauuacuccuuaugccauuuuuaguauuauuauaaaaauauccagaaacaaacaagaaaacuacaggaauaaguugagucaauuuuuaugcuguagauauucuaaaccuuuuccaaaauagacgguuugagccuuuguugaauuugaaacaaaaccuaauuaaaacagcuguugccuaagccaggccugcccaugcacaccuacagucccagcacuugauugagagaacugaguucaaggccauccugagauacagagugagucaaaaauaaaaaauuucuuuguaaacaccuuacuauucucuaucacucuuuaaugccuuuuaugauccaguuuaguaaaugguaacguuucuuuguuaacucuucacucaccauauuccagguacuguucuaaguaagccugccuuaugauuuaagucaguccaauagcccugugcggcugguaauacuaucaccuccauuucagagagaagaaaauagaagcaaacggauuaagcuacaaauuacacggcccaaaaaucauacaaucaagucacugauauguacugguaugccuugaccucaagcuguucagacuaguuagggcuucagaggcucuggcagccgucaacagcaauacagaaggcaaguucucaaugaaaggggccagaugacuuccauucugaauucauacuuaguuugccuaggggcagcuuuuuaguauuuaaaaaaacacacagaauuuuucucuguauaugaaauuuuaaaaucccagaccaggacacagguuuucauacugggaaauacuaaugaaacaauaugaauaaacaucagucuauuaaauaauuguagcaguuaaauuggcaauaguuaaaauauaaucuuaaucuaagcauguggaauaguuuaucugauaacugcuuccaauauuuuacagauaaccuuagugcuuaagaaaaagauacagauauccauccauaaaaacuaggauaguuuaagaaggcucuagacccaguguucauaaaccuccagaugaaguggguggaccugaaccuuaauauauaaugcaacaaugaauuucuccauuuccuuaccuggugcuuuccuuuuccuaaaaacaaaagaacaggauuuaucuugaucuacaccauucagucauuaaacuccaugaaccaccucaacuuucaguauucauagaacaacaucauaaacagugaaaauuaguagcuuuuauuguauaagaaacaaccuuuaugaaaaacuugcauuucuguaacauggaaacuugcugagguaaaaaaaaauauauuucuuuuaaaagaaauuaacuucacugccuguaggcuagcuuauuacugaucuuagcaccaaaaaaaaaaaaaaaaaggacuagaaacuuuuaggaaacaaauuguaauaaaguccugugauuaaaaguucaaguguuuucauuucacucaucuuucuuauaucuucccuacaacaaaccugucuauguaauccuauuuucuuaagaaugaaaacccaccaccauaguucugaaaaacaaucaaaaaauuuucaacaaaacucagggaauaagaacauuucaaagaaaaaaaaaguauuucaagaccuuacucugaaaauaauuuuuucuugagcugacuagucuaaggacuaaagucaacaagcucacuucuccagaagugauuccagcucuuccugcaaagagcuaagcugcuccuuuucgcggucuucuuuuuguuugagcucauccagaacugccugaaaccuguucuugagagccagguuuucuaccuucauaaugagaucuuccuggcgcuuugcccugucuuggguuucuuggagcuugccuuucauguuaucuaucugcuucugaauucccauaaccaacugauugguuccuucauuuucuugguguugcucgucggauucauuuagcuugucuuguagcugucucuccagaucuuccucagugucaaggauguuuacgucuucuucaucuucacugcugcugcugaggucauugaauaucucucgaagcucaucaugcucuagugagucauggccuugccuguggccagacauuccuggagaagagauguccaggccuugauuuucugucuccuuuguuucaucuucagcaauuaucucccaacgaguacugacagcuucugcaucuguacucagcagacgcuugacuucuuuuuccacauccggagauucaauguacuucuucuuugcugucuuccggaaccgucucuuucugacauuuuuuagagguagaguaauuccaugguuccaaacaaacuuuuucucuuuguccuuaucuuuuuucuuguuugcuuugggaucagcaguggcagcugccuccuccacaggaggguauaggucaccaucuacuguggcuacaagcaucugagagauaucagcugucuuguaaaagguuuucuuaucgaugguuuucaagcuuuccguaacacaaggcaaaucgaccaauuuugcagccaagggcacucgauccacucugacaaugccgugacgcccaucaggguguaacucaaugcucaguuugucuuucagguugacaugcccagacugcacugcccuccucaccguagcggcauauucugggggcagucguaagauaaacuggcucucuagcucaugaggcgcaucgucuuuguucuuacucaucuuuaauuccuugugagcuccuacaacaauuaaagggggggggcaaugucauuaaguagaauuuuaaauucguaauuaccaaguuccaaggaaaacagcaacaaaaguggaacgcaagcuagugccuauuuugucuuaauuuuuuaauuaagucccaagucuagucuuuaaacuuuuaaacuuuggcacugucccuguuaaacucacucgucugcuagaugcaguaucauauuagagccucuaaaagacgcugcugauaaccugaacagcaaaagaaacggcagcgacugagggguuuuaggcacagaccgucagucuagucuggcagacaaccccgauccacagauucucuccaauaagauauaaaauaaaaguauuaaagaaaaagaauaaguaaagggagugaacgaacucuucgacuccgguacuuacaguucaccagcgacugugaacuuagcuuuucgcggcuugagcaaagcagcagggagcggugcguccgccuuccgguuucuuggcguucucggccgcccggcagggcgaccuaugcgcuaacaaugagacggcuaaggacccgcggcgcgaaagcucccucucagagaaccgaacaccggagacaacuuucccacgucuccucucacugaagaaaacgaaagugcuccgucagagcggaagcagacgcggcgcuacgucacagaccggaagcagacacggaggggcuggccgccgcucuuccggaaguacuagcggcgcgcgcaggcgcacuucguaauuacgucguuccgugacuacgucuucucgugagaacuugcccuguauaggcuguuuccagaaaagcuuugcuuuggaaaugcaagauggagauuccaaaaaaguaaaacauaaacuuaccccguaagacagcacuuuacgaagucgcgggucgggacaguuucuagagugauuaccagagauaaaggucgucccugcagaaagcaucuuuacuucccagggcguacccagucggccuccgcuaaaacauuggaaacaacacaaaguaaaaguggcccaaacagugaaaugauacaguauugcuguucacucucuaacgcgaaaaaucaugcuuauugccuugaaaggaacuaagccuuuggcuucauuugu

SEQ ID NO: 8889 - RNA, 11843 nt, Mus musculus
ucaguauaaauaccuacauuuuuaauaagaaauaaacuaaacagaacuccaaauaaaugauucaucaacagaaaauguuacagagaacacaaaauaauacacaggaauauauuugcaguagaguuuuacaauagagauuuaaauaacguuuacauguuugccugacaaggcuuaauuuucucuaauuaaaaaugagaauuugugcucaagaacauaaccuaagcauugcuuccugaaagauauuuuuaaaauauauuuggauuuaucagagagccaauaccuuaaaauguaccuuuaaaguguauccguggugucugggaugaagaaauauaagcaaacagaaauuugaagaauuaaacaucuuucuguaaaaaucaguuaauuuugcuucaagaugaugcaguaacuuaguaaggacucugcgcgccgcuguucaccaaccaugagaugguggugacggagcucagacagaaccaccgaguuuacagcacaaagagaggacagacugagacaagcaaguccuccaccaagcagcaacaaacuaaagcgaauggcuggauucccggcuucccuuccgcacacugggguccuggcggacacaacuggguucugaggcaccuuccaagaccucucagggugugagcgagauccucagggcagcaauggcgccuggacagagaggcuggggcucgcacuacagaggauuugugcugcucuccauucuccuggggaugcggugggaagccugggcaggacagauucucuacuccgugucugaagagacagacaagggaucuuuugugggaaauaucaccaaggaucugggacugcagccucgggagcuggcggagcgcgggguccgcaucaucaccaaagguaagacccagcuuuucucucugaacccgcggagcggcagccuggucaccgcgggcaggauagaucgggaggagcugugcgcucagagcccgcgaugucucgugagcuuuaacaucuugauagaagacaagaugaaucuuuacccuauagagguggaaauaauggauguuaaugacaacgcucccagauucuuaacagaagaaauaaacauaaaaauuauggagaaugcagcuccuggggugcgguuuccacuaaaggaagcuacagauucagacgugggcaagaacucccuccagagauaccagcucagccccaaucaccauuucucccugguugugcaaaguggagaugauggcaccaaguacccagaacuggugcuggagaaggcucuugaucgggaagaagaggggcuucaccaucugguccucacagccuaugauggcggggacccgcuccgaucuggcacugccagcauccgcgugacagugguggaugugaaugaucacacgccagucuucucucuaccccuguaucaagcgacagucccugagaacgugccaguaggcacaagacuucucacuguaaaugcuaucgacuuggaugagggaaucuauggggaagugacuuauucuuucuggaaaauaacuccagaacuucuacaaauauuccaucugagcucccugacaggagagcugucgacuuuaaaaggucuagauuaugagcaauccagcuucuaugagcuggaaguucaagcucaagauggugcuggcagucugaccaaggcaaaaguacugaucacaguuuuggaugugaaugacaaugccccagaagugacugucacaucugugagcagcccagucccugaagacacgccaccugggacagugaucgcucucuucuaccuccaagacaaagauucggggaagaauggugaggugaccugcucuuugccagaaaaccugccuuuuaaguuagagcgaucaauugauaauuauuacagguuggucacagcacgaaaccuggaccgggaaaagaugucuguguacaacaucacacugaaggccacagaugguggaaucccuccccuguccacugaaacucgcauguccauucaugugucagacaccaacgacaacccacccaccuuuuccgacucuucuuacucuaucuacgucccggagaacaaucccagaggagccuccaucuucucggugacugcacaagacccggacagugacaagaaugcccaagucacuuacgcuuuagcagaagacaccauccaggggguaccggugucguccuacgucuccaucaacucugacacggguauccuauaugcacuuggauccuucgacuaugagcaauuucgggaucuacaacuucgagugacugcucgugacaguggggacccaccucucagcaguaaugugucacugaaacucuuugugcuggacaagaaugauaacgccccugagauccuguacccugcccugcccacugauggcuccacagggguggagcuggcuccccgcucugcagaaccuggauaccuagugaccaaggugguagcuguggacaaagacucaggcccaaaugcuuggcuguccuaccgccugcuuaaagccagugagccagggcuuuucucaguagggcuacacacuggugaggugcgcacagcaagagcccugcuggacagagaugcgcugaaacagaaccuuguggugguuguacaggaccauggccaacccccacucucagccacugugacacucacuguggcuguggccaacagcauuccugauguccuagcagaccuaggcagcauuaggacccccagugaaccugaugauucagauaucacccucuaccuggugguggcaguggccacuguuuccuguguuuuccuugucuuugucacuguguuauuggcucucaggcuguggcguuggcacaaaucacacaugcuacaggcuucuucaggugguggccuggaagaugugccugccucacacuuuguagguuuggacgguguccaggcuuuccuacaaacauauucccaugagguuucacucacugcagacucucgaaaaagccacauuaucuucccucagcccaauuacguggauacacuuaucagccaagauagcugugagaaaagugauucuuuguuaacauccauagauuuucaagaauguaagggugaagccccaaguucccaggugaguuaaucucuuuaccuuuucugugugccuguguguaaagugcucucauguugccagguuucuucuucuauugucuugggagggucucuuauuugaacccagagcuggccuauuugcuccaagaugccccaucuccaucucuugugcugugggcucacagguggaucaccacacauacuugguacuuauacaaguguuggggauccaaacggugacucucacacuuccaagucuaucaauuuauccaugaaccaucuccaaaggcccuuuuccuuuaucuuaauuuccacaagaacuauagugugcaugaaaugucucuaucaguuugcaaaaucaagaacuugaaaaauguagauuuuaaaacuuuucaguggugcaguaaaguuuaucaguuuauuucagugguuguacuuuagcaagaagcacauagguugugauaucuuuuaauuaaacaguguggcuuaauuaaauuuuacauuuuacauuaacucaaauauccucuaagugaaaaugaauuguugagucuuucccuucauuaagaguggagcauuccuuagccacccuccugggguucuccuuagaauucaaaccuaaaaaaagagucuuagugaucuuuuccgucugaagccuuucucuguugugcucucuuuuguaacucugcuuaguagacuuuaaaagcgugauuaguugcucagcuaucuaaagcauagucaucuacuaaaguuggguugcucauagaaucuuagauauauauacuucaaggaugaaguguguccagcacauguucaacucucaauacucaugagaaaaaugcagguauggugguguacucuuuaaucccagcccuggggaggcagagacacaccgguuuacgggaugagucuggcuagcccuaguuuaacuggucaaaccccaagugccagugagagacccugacucaaaaagauaaggugauggcucuugaauaauagugccugauauuuaccacuggccuacacacacacacacacacacacacacacacacacacaccaaacaaaaggaugaaaacuugucaaguaucaauaaaaucuauauuaaaaaaccagucaugguaucuaauaccacacuaaaauuaauuggucaaaauggguucaauaugucaaauaauaugaugcuuccaaggcagguguggugguuuugcuucuuguugcaccaacacucaggagagggaaacaagaacuuugggccagccuuuuccaucucaaaccccaguaucuuuucaaguguuguaacccuugagaaauagacaauugcaugucuucacacacaacuccaauguauuuauucuuuugguggcauuccacuugaaacgucuguuuccuccagggggggggggcuggaggggggaggguaaggggugacacuggaaagaagguucuaggaaauaaccaucucaugcucgcaaaccccaggccaacauucacucucauuuacccauucuucugggagggggaaagauuagaaauaacuaaguuuguggaaggauuaccuccauauucuuucagagugcccuuguacuacacugaccuauaagaagcccaggauaaggugauagugaccacugggacuuucugaaugcuaauuaaaagaguuuguuacaauguaacgcugcaguuugccaauggacaagcauuuaguagcacgagagaauaguuuuacuccuguaguauuccaguguauagucacuuaagaagagggcacuauuaaauuuuguggggggaaggcacacuuguauaaacaaagugucuagagauaaugagaaggaacugcccuaaucaauacuuauuagauucucaaaugcauuuuuuaaaaaagaggagaugucagcacuaagccgagagagcuauugaaaccaagccuuccagggagguuuuccuccaauccugagguuguugugaaguacagagcaagugcaaagggagcaaccaguccaugaacuuuagucccuuugugucgaaaggucaaaucauguucccuuggugauuugagugcugauguuauaguugauagugagaauagcuguaaugggaaauggguggucuaacuucagccagcaucaugucuuuaccugugauaguggggugagaaucagauaauauuacuguuaggcaauuucucagaguauuuuuuuggaaaauaaaaugacuuggaugauaaguaugaauugcggcuuugaaaagacacauuuccucgaggugaugggggcacaacuuuaaucccagcacuugagaggcagaggcagguggagcucugugauucaagggcagccuggucugcguacuuccaggauagccaagcuauguaauagacccuauuucaaaaaaagagaaagagaugaaaagaaaaaaaggagggaaggaggaggaggaagggaagggaaggaggaggagggggagggugaugaggaagagagaagaagaagaagaagaaggagaagaagaagaagaaggaggaggaggaggaggaggaggaggaggaggaggaggaggaggaggagaagaagaagaagaagaagaagaagaagaagaagaagaagaagaagaagaagaagaagaagaagcuuaaaaugauauaaaauauuugcgauaaaacagaaggaaacguaucgcacuauaucgaugcucaauaaauaugcaauauuauuuuucucugagauucuaccggcugagaaaguguuacagucauguucggcucaccauucguauauuaaagauuaaagcacgcuuaugucaacagauauuaugccucuggcgacauaauccuagaaauuugugauaaaaggcauuucugacaauacaauuuugaacguuauucaguguauggaaauuucugguuuaaaaccucaaauuugcuauuugagccuuugcuaggcugcaguuuccuacugcagacucugggcgccgcuguuggccagacuagagauucuggaagaccucuucucgcgcagccgcagagcgcuuuccaaggcuuccuuucucagccuuuacaccgcuucuuucugagcaaaagaagaaucguuucauggacuagaucugauaccaaaguucgauuggagcccggaauauccacaccacgcagcuucuucguaacccggcgucuccaggcuggugagcaaggaaaggggagcaagaaagaugcgggagggcacugcugagaggggccggggacagaggcggccaaugcuccuucccuuccugcugccuuuguucugccccacgcucucugagcagauccgcuacaagauccccgaggaaaugcccaccggcucgguaguggggaaccucgccaaggaccuggguuucaguguccaggaguuaccgacgcgaaagcuacgcaucaguucugagaagccuuacuucagugugagcucagagagcggagaguugcuaguaagcagcaggcuggacagggagcagauaugcgggaagaagcugaugugugcucuggaauuugaggcuguugcugaaaauccacugaacuuuuaucacuugaguguggagcuggaggacauuaaugaccacacgccaaaauucgcgcacacuuccuuugaauugcaaauaagugaguccucaaaaccagggacaagauuuaucuuaggauccgcccaugaugcagauaucggaaccaauucucugcagaauuaccagcuuagucccaaugaucauuuuucacuggugaauaaagagaaaucagacgguaguaaguacccugaaaugauauuaaagacagcucuagaccgggaaaagcagaaacucuaccacuugacccugacugcuuuggacuuugggcauccaccccucaacagcacugcacagauacagguccuagugaccgaugccaaugauaacccuccaguguucagccaagacauauacagggugagccuuccugaaaacguguacccaggaaccaccgugcuucgagugguggccacagaccaagacgagggugucaacuccgagaucacguuuucuuucagugaagcuggccagguuacccaauuuaaccuggauucuaauaccggagaaauuacaacucugcauacauuagauuucgaagaagucaaagaauacucccuuguuuuggaagcaaaggacgguggggggaugauugcgcaauguacgguggaaauagaaguccuagaugagaacgacaaugucccugaaguguuauuccaaucucuaccugaucucauaauggaggaugcugagccagggacauauaucgcucugcuuaaaacccgugacaaagauucuggacgcaauggagaaguuaucuguaaauuagaaggcggugcuccguuuaaaauacucacuucuucaggaaacacguauaaacuagugacggauggaguucuagaucgugagcagaacccggaauacaacauuacuauuagagcuacugacaagggugacccgccucucucuuccagcucaagugucaccuugcauauaggcgaugugaacgauaacgccccaguuuucacgaagguuucauaccugguccauguugcagaaaacaauccgccuggagccuccaucgcucaagucagcgccucagacccggauuugggggccaauggccagguuaccuauuacaucauagccagcgaccuggagccugaaucucugugguccuacgugaccauaaacgcgcaaagcggagugcuguucgcacagcgcgccuucgaccacgaacaacugcgcuccuuccagcugacacugcaggcgcgggaccacggaucgcccacacucagcgccaaugugagcaugcgcuuguuggugggugaccgcaacgacaacgcgccccgagugcuguaucccacgcucgagcccgacggcucugcgcucuucgacauggugccgcgcucugccgagcccggauaccuggucaccaaggugguggcuguggaugcagacucgggacacaaugccuggcugucuuaccaugugcugcaggccagugacccugggcucuucagccugggacugcgcacaggcgaggugcgcacagcgcgugcccugggagacagggacucagcgcggcagcgccuucuggucgcugugcgugaugguggacaaccaccgcucucggcuacagccacgcugcaccucaucuucgcugacagccugcaagagguccugccagaccucagcgaugacccuuugcccccggacccucaaucugagcugcaguucuacuuggugguggccuuggccuugauuucuguccuuuuccuccuggcugugauucuagccauugcacuucgacugcgacacuccuccagcaggaaggcauggggcugcuuucagucggaaguggugguuccccccaacuacagugaggggacuuugccguauuccuacaaucugugugcugcagaguuuaacucccuaacauguaaugaucaguugaaaucaggacaagaucuacaauuugcagauucagcgggggccuuguuuccacuuuguaauuccaaugagucaaccucccaucagguaaguuuccuccaagcauaauguacucuuuccuauuaguucuucauauucucaggaaauucauacuuuucagauagagcucguucuuaagaaaguuauaaugaaaaguuaauggcauggcuaagugccuaagagcaccuaccugccuaguauguugauucagucccuaaggaaaguuuuaguggguuaaaaagggggcuggagagagacucagccauuaagagcacuggcugcucuuccagaggaccuagguuugauucccagcacccacugcugacaauugucuguaacuccuguuccaagggaucugaugcccucuucuggccucggaaggcaucagacacccacagugcacaggcaugcagacaaaacaccuauacccauuuaauaaaucugagcggugaccguacaauuccucaaaaaaaaccgauagaguaagagcacuugcagagcacuugcaugccuuacagguguaacacaccaaccucagauucgcagcuagugcucuuagccuauggugugaaaaugugugguguugauucuccuuaaaauuuaaugagcuuucgccaugaauguuuguaguaacuugaacauacuaugaauauaaaagcagucacugagcuggguguggaguguggugacuuacaucuuuacuuccagcacucaggaagcagaagcaggugggucucugauuuugaggccagccuugucuacagaaugaguuccaagaugggugccagggcuacacagauuuacccugucuuguaaaagcaaaaccaauaauucaaauaauuguuaaauccaaaaacacacuaacaauagauauuuucuacugauuuagcuaguauagcuucuauaauuuuggggguuuuauuauuauuucuuucuccacccuaaugacucccagaauaagaucucuuaagcucagaucuauacccauggaaccuuauaauuuuauacaauauauacuguauaaucaguuacuuaaaagaagguucaguauucaucagaagaucaaaaggcuugauaauacauguguguaaugucagcauuugggagguaaggcaaggccagcccaggcuauaugagacccuuucuaaacaaacaaaagcccagaaggucaaaagcagauugauguuccuugaagcauagguuuuugagacuuuaacuguacagagguucauacaauaggccccaccacugaagaagagaugaaaaaugccuucccucuguuucucccugaaacacuccaauauauaauuuuuaaaauuagcaguaguagcuggucagugguggcucacaccuuuaauccuagcacuugggagccaaaaguaggcagaucucugaguuugaguguggccuggacuuugaauguucggaguuuuguuuguuuguuuguuugucuuuuccuuucaucuuuuccaaggauauagcucaugucacaaggcuuaggaagcaggugucucugucugcugagccaucugauggacaugagcauccaucuuuucuuuguguuccuaaauugaaauauguagaggucuucuacaaauuagacuaccucuagguagaaauagucuugaaguuuucaaguuuuuagacaaacuagccaaucuccugugcaaauaaaaauuauuaauacauacaaaaggccauacuacauugugucacucucuggacagucugcaucaccugcuucaguuacugacaacuucaaacuauugauaccauuuccaugguggcuuuaauauuugucuuuuuauaauaaucauauauguuccucacuuuuuguuguucuuuggaugaaaguuauaguaguagggcuaaccguguguguguguuugugucugugugugugucucacuuaaacacucaucuaguuuaaaguucaauuauugacaggcuugguagugcacacuuuaaucccagcaccaggauguaccagccugaucuaccuagugaguuccaggacagacagacacacacacacccucacacccuccuuucuccucucuccuuucucucucuucucucucucuaucucucucucucucucucucucucucucuccccacacacacauauauggaaagagggcaauaagaguauuacuucuaauugugucuuuaucugucccuuccaaguauuuuucaacuaggaagaaauuggugauuuaaauaaaauaacaagucaguagaaucucuauuuuaaaaaaaaacugguguaaaaguuucauccuguucaaauuucacaauguuaaucugaaaacuuauuggugugugauuaaaauaacacuuaaaaagaaagcaugaaagcaacgacucuguggaaagcuacuacaaugauuaguuuaaaccagauaaaacaacccuccaaacaaccaucuccaagggaucuuguuuacucuaaaaaugaauuaauuuccaguaacaacuauaauucuuaauuuagugguguauguugaagccacucacacaaagcuaggaaacaaugggaaguaaaacugccguguuugcuuuuagaggcguuaauguggaccagucauucgauguaaugcuagcccacagaucugauaauuaauauaaucauacuuuaaacaacacacauuuucacuuacuucuaaaauauguguuuaggaacaaauuuaaacuuaaaaguaaugagaaauaaauuuaaaaaaaaaaaaaagauccacuugcaaggccuaaguaacugcaucuaagugcaguaaccauuuaagacucuaagcgccgcuguucaccuacugggagagagaugcacccgaaaccccaucgaauucucaaggcugaugaaaucagaccggcagauuccggaguccaacugcguaacugcggagacauucugucccuaaaugugugacucuccagcuuuccguaagauuauuuccgucgccacaagcgaagguaauccagccaccuaugcccggugaagacugaggauucuuuugcaaaugaacaauggcugcuuccaagaaucaacacaggcauggccggcuggugcugcuguguacgcugauggggacgcugugcaagaucagcguaggacagauucgcuacuccgugccagaagagacagacaaaggcacugucgugggcaacaucuccaaggaccuggggcuggagccccgcgagcuggcggagcgcgggguccguaucgucuccagagguaggucgcagcuuuucucccu

SEQ ID NO: 8890 - RNA, 21686 nt, Mus musculus
ucaucuuucaaagugaauuuuaucaaaagaaauauaccugucuccaugugaaugaauaccaaaguuguaagauuuuucaauacaaaauaaacauuacuauguuuuaaguuggugugcuucuguugaaaauaaaauccaaauauuaucaauuuagcuuauuauacucuccaauaagaaaccuugagaagggcucugaugcagcucacuguuggagcucuugccuacguaaaugugaagcccugcuuucaaucucacgcccucuccaaaaacaaaauaaaacagagacaccaaaggaaauuaaaguaaacuaaaauaauucaacagaaaaaugcauuugcugaaauauuauagugggugcaguaacuucuuccgacucugagcgccgcuguucaccuacgaggagcaaaaagccaccggagcacaguugggauucucaggguccaaaagcuuaaagccucacaguuccggcaaaccggcuccugggcugcaacgaaaauuacuccgcacuuuaaggugcuuccgcugcgggagacccaaggggucacagaaagaagaaaagaaccgggugaaacacacugggcgccuggcggaucgggaaaagcuuugagagaauuccguagucagaagacaauggccgcucaaaggaaucucucagagcgcaccaaacugguccuccuuuucuuauggaugcccugggaauccgcagcucggcagauccgcuauucaguuccugaggaacuagagaaaggcucuuuugugggcaacaucgccaaggaccuggggcuggagccccgccagcuggcggaacgcgggguccgcaucaucuccagagguaggucucagcuuuucucucugaacccgcgaggcggcagcuuagucaccgcgggcaggauagaccgggaggagcugugcgcccagagcgcgcccugucucgucagcuuuaacauccuuguugaagauagagugaaacuuuucgggauagaaauagagguaacggaugucaaugacaaugcgccaaaauuccaagcagaaacucuagauguaaaaauuaaugaaaaugucgccccaggaaugcguuuuccucucccggaagcuacugauccggaugugggagugaauucucugcagagcuaccagcucagcuccaauaaacacuucucccuagucguucagagcggugcuaagggcgucaaguacccggagcuagugcuggaacaggcccuagaucgugaggaagaggcgauucaccaccugguccucguggccucugacggaggaaacccucccagaucgggcacuguccucaucacugugaccgucuuugaugcaaaugacaaugcuccagucuucaccuccacugaauaccgcgugaacauuccggagaaccugccugugggcacccaacugcuaaagguaaccgccaccgacaaagacgaaggugccaauggagaagugacauaugcauuccgaaaaucgcuggacacacaauuguccaaauuccaacuagacaaacauaccggagaaauaaaaauuucugaaaaucuagauuaugaagaaaugaguuucuaugaaauagaaauccaagcugaagauggaggggccuaucuugcaacugcgaaggugcugauuacaguagaagauguaaaugacaacaguccugaggugaccaucacaucucucuucaguccagugacagaagauucgccggugggaacugucauagcccuacuaaacguccaugauuuagacuccgggcagaauggagagguagccuguuccaucucagggaaucuuccguuuaaguuagaaaaguccauugacaauuacuauaggcuagugacacaaagagcccuugaucgggaacagguacccgcuuacaacaucacaguaacagccacugaugggggaaacccaccuuugucaaccaaagcugacuucacucugcaaguggcagauaucaacgacaacccaccuaccuucucucauccguccuacuuuaccuacaucccagagaacaaucccagaggcgccuccaucuucucagugacugcccucgauccagacagcaaagagaacgcccagaucguuuacucccuggcugaagacaccauugagggggcgccacuuucuuccuacauauccaucaacucagacacuggcauccuguaugcgcucugguccuuugacuaugagcaguuucgugaacugcagguacaggugacugccagcgacagcggaaagccgccccuccacaguaaugugucguugacucuguuugugcuggaucaaaaugacaacucuccagaaaucuuguaccccaccaugcccaccgacggcuccacugggguagagcuugcuccccgcucagcagagcugggcuaucuggugacgaaggugguggcaguggacagagacucgggacagaacgccuggcuguccuaucgccuacucaaggccagcgaaccagggcucuucacuguagggcugcacacgggugaggugcgcacagcccgagcccugauggaaagagaugcucucaagcagagucuagugguggcugugcaggaccauggccagccuccucucuccgcaacggucacuuugacuguugcaguagcugacagcaucccugauguccuggcagacuugggcaaccuggagccaccacaggacucugaggccucaaaccucacacucuaccuaguaguggcaguggcagcuguuucuugcgucuuucucgccuuugucauuguguuguuggcacucaaacuccggcgcuggcacaagucucacgugcugcagucuucgagagauggauuggcuggcgugccugccucucacuaugugggcguggacggggugcgcgcuuuccugcagaccuauucgcacgagguuucccucacugcugauucgcggaagagucaucugaucuucccgcagccuaacuacgcagacacacucaucagccaggagagcugugagaaaaaagauccuuugucuuuguuagaugauuccaaguguccuguagaagacgcuccuuuggugccagugaguucugauuuuacuuauucuuuaaacaauuacgagccgauuuaccguugugcuugagcccaaaugcuggaaaugguagaucucuauuuuaaaaucacuucucacgguuccagguuccagcuugccucuugcuaaaacauuagcgaguagaaucugcuaguuaagacuguacugggaacuguggugaaaaaucaccuagguugcccuaagguugugugaguagcuuuggcagaaccuuguguuuuauugcugaguacaacauggaugcucccuacaagggaacuaacuucauguggaagugucaguugauuuauguguccucgcugaccacaugcugcaacccuaccacuuuagcagaccggagcucuuuugaaggcaagucuguuaaaauuaaguaaaugucagaaacaaaugcauuggccccgacagacacacaaacuaaaucuaaggcuguucguugguguucuuaaaggacaaaacaauaugucuuuucgaauacauuuuuucaaacaauaacugaauauacgcuuuagauauuugaaguuuuucauuaauauccaaccaacaauucauaacuaugugcuuagaaucuuuauaaacauaaucaagcccauuagcccagcggcauuccuucugcauaugauuguguggcaucuuacuauacagccuuuuaauuucacuuuucuugcccgaugaugauuccaagaauuuaugcaagguuaaauugagaauuuuuguucucuuugucuuuuuuuucuccaaaauuauacaugccaucgauuaaagcuaaaauguaaauauggguugggguggacagcguugcucacauucccaagagcaaaagcuaaccacgugaugaggauauuuucucucuaauguagaagaaaacucagccagcagaaucucaagugcugugacagagcuuuacaauaaacuaagagggggaggggagggggaggggaggggagggggaggguguuuuucagaggggaaaccaggaaaggggauaacauuugaaauguaaauaaagaaaauauccaauaaaaaaaauaaaauaagagcuaagagcaaagaaagaauugccagcucaucagaagaucugaauucaagcaaagauguucaugaaacucuucuaaacaaaugauuggugaagauauugcugagcacauguaguucaagaaaaauaguaauauauuugauucgaucucuggauuuuuuauuacgcuccagaaguuacuaaaauaaagaguacucuacagcgucucaaaauacaccugagacccugacacuuuugugucaacucuuggcuagccauagauccguggaagguaaguaaaggcucuggaguuauaauacgauuuauccauugaagucauuguccuacaucuuugucccacaagaguaacaauuauuaugugcauauuucaguucuguuauuuguaaaagugcaagcuucaagagcacucuuuugacauugcaaauguucuauuaaauuuuugagagcaaugcugaacauccuggauguuuggauacagucaggguugcauuccagugucuaaaugugggugcagggguauuuacuuuauaacuaacgagagcuagagcugauggcaaauauaauuguccucaaaaagagagauagucauuucccguagaugacggacuuggguaacaaugggccauugguccugugggccuucacuuucuuucacgcuuuuuaauuugaaggaaauacacuuucaaucuaaccaaaaugaguauacauguuuauauaugaaagaauauuuauuaauaaaaaauuucacuagggaaacaaaaucaaugagaaagaaaauucaaauguuuuggcuaucaacuuaacacagaaaauaaaagauucccccaaaaucugaaacgccagacugcaauuccacucagagccucugggcgccgcugucggccagugcagagcaagcucugaugccccgaucccucagucucuaagcugcaauuuccugcgcagaaacgaauacacacaccaaggggaacucucacucauacagacuaagacaccgauucccaggacaaaacuggggucccgcugucccgagccaaaaggaccuccacccucguaggcugaacucucuccuacugugaagaucugaagaccuacaggggaccugagccagcaaugggagggagcagcgcgcggaggaagcgccccggccgcccgcagguacuguuuauccugcugcugccuuuguucugucccgcgcugggccagccgguccgcuacuccaucccugaggagcuggaccgcgggucggugguggggaagcucgccaaggaccuggggcucaguguccuggaagugucggcucggaagcugcgggucagcgcugagaagcugcacuucagcguggauucggagagcggggacuuacuggugaaggaccgcauagaucgcgagcaaauaugcaaagggaggagaaagugugagcugcaguuggaagcugugcuagaaaacccuuuaaauauuuuucaugucguuguggagauugaggauguuaaugaucacgcuccucaauuuccaaaagacgaaauaaaccuagagauaagugaauccgacagcccaggggcgagaacaauucuggagucagcaaaagaucuugacauugguaugaauucucuaaguaaauaccaguuaaguccuaacgacuacuuuuuauuguuggugaaagacaauccugaugguaguaaauacccagaauuagaauugcaaaagaugcuggaccgagaagcagagagcacacaccaccugaugcugacugcuguagaugguggggacccgccccguacugguacuacucagcuccgaauccgagugguggacgccaaugauaaccgcccaguguucagccaagacguguacagaguccgccuuccagaagacuugccuccaggaaccacaguccuaaggcuaaaggcaauggaucaagacgagggcaucaaugcagaauuuacauauuccuuccuagguguggcuaacaaagcccaguucucucuggaucccauaacaggagauauuguaacucgccagucguuggauuuugaagaaguagagcaauauacgauugauguggaggcaaaggaccgaggaucucuuucuucacaguguaaaguaauuauagagguucuagaugagaacgacaaccgcccagaaauaaucaucacuucucucucugaucagauuucggaggauucuccuuccggaacuguuguggcccucuucaagguacgggaucgagauucuggggaaaacgcagaagucaugugcaguuuaagcggaaacaauccauuuaagauucauucuucuuccaacaauuacuacaaguuaguaacagauagcauccuagaccgggaacagaccccaggguacaacguuacuaucacagccacugauaggggcaagccgccccuuuccuccagcacaaccaucacucugaacgucgcugaugucaacgacaaugcaccuguuuuccaacagcaggccuaccugauaaacguagcagaaaacaaccagcccgguaccuccauaacccaagucaaagcaugggauccagaugugggauccaauggccucgucuccuacuccaucauagccagcgaccuagaaccaaaagcgcugucguccuucguguccgugaaccaggacaguggaguaguguacgcgcagcgugccuuugaccaugagcagauucgcuccuuccagcugacuuuacaagcgcgagaccaggggucgccugcgcucagcgccaacgugagcaugcgcgugcugguggacgaccgcaacgacaacgcgccacgcgugcuguaucccacgcuggagcccgauggcucugcacucuucgacaugguaccccgugccgcugagccuggauaccuggucaccaaagugguggcuguggaugcagacucaggacacaaugccuggcugucuuaccacgugcugcaggccagcgaucccggucucuucagccuggggcugcgcacgggcgaggugcgcacagcgcgugccuugagcgacaaggaugcagcucgucagcgccuucuggucgcugugcgugaugguggacagccaccucugucugccacugcuacacugcuccuaguuuuugcagacagccuacaagaagcguugccagaccucgucgaucaucccauccccuccgacccucagagugagcuucaguuuuaccuggugguggcuuuggccuugaucucagugcuuuuccuucucgcaguaauuuucgccauugcuuugcgccugcgacagucuuccagcccuucauccacugguugcuuugggucgguucuugguuccaaaucuagaccaguacuuccacccaacuacagcgagggaacauugcccuaugccuauaaucugugcgugccgggagaucaacuuaaaccagaauuuaauuacuucucauccguuggagauuguccagccgcacaagauauucucaacaaagauagcuccucggcacuguuggcuaguauuuuaacuccugguguugaagcagacgagaagaccuuuaaccagguauuuaauguuaugcuuuuuauauuccgguacgccaacguacuccuacauagagcuacuauuuuaguggaugguuuguuuuguuuuguuucguuugagacagggucucucuguguauuccugguuguucuggaauuagcuguguaaaccaggagggccuagaauucauagagagccgccugccucugcuucccaagcgcugggauuaaaggcguggaccacugcacugggaucuauuguaggagcuuuaggauccuaauagaaauguaggucaaacuugugggcaucacugcuuuuggaagggugugggagugugcuauggaaacaaacuuguaccucgugugaaccaaaaccaguucuauccagcaugcagaagguuugaggugcugaaauacucuacuauccaaucguauuuaauucuuuguuuuguuuuaugagacaggguuucucuguguagcccuggcuguccuggaacucacucuguagaccaggcuggccagaaauccgccaacugcugggauuaaagaugugcgccaccacuguccggcccauauuuaauucuuaagguguuuuucuuuucuuuucuuuucuuuucuuuucuuuucucuuccuuucuuuucuuuuccuuucuuuccuuuucuuucuuuuguucuuuuuuuaaguuugagcauguagugugcucuaggucuugcuucaauuaccaauuaauucucuccuccuccugacucuaacacacacaaauauaugaaaaaucucacgucaauuuuucaucaaaauaccuucuaguuuuggauaugauuuacaggcauauuuuauuaucuuuuaaaugauaaccauaauacuauuaaaauuuugaauggaacauuccgucguuaucauacucauuaaaaauaacucguuaagaauaaaagcaacguugguggaaacuggagagauggcuuagugguuaagagcgccauuacucuuugagaggacccagguucgguucccagcacccaugacuggcaguuuacuacugcgauaacuccagcuccaccuucuucuggacuucacaugaacccauacuugccugugcacauacucacaaagacacaugcauauacucauaauuaaacuaauaagauaaaaccuugaauaaaaaguaguaagaauaauagccaugaauccuaccugaggauuucgucuggaccaugcuggcuucucauucacaaacgccgcgucucuacaguuaguaaaaccagcuggaaucacaacuaaccuguguauuuuaagucccaguguuauuuugaaacguuuuuuuaauuaaacaaguccaucuaauaacuacccuuuucauaagugcucuugguaaaauuuacaucacaucacauagcuguuguuugcuguugucggcuucacaaauguuaggauccacggaaaaggugagugugacaguuuucuccgcaacagacaccggguuuuuauuaguguugcaauaauaagauugggcucuaggcgccgcuguugaccaaucggggaacgggaggacaaagcuauugaguacuucuccggaaucucuagcacacaaagccgaaaaggauggauacucacgcaucucaacucuggaaguaaaaacaccuccguucgcuuuggaauauguuuuggaugcgggauaccuggaaccucguagacacaaaagcugacucggaaaaauaaauaaaaauuaaaccggcgcaagacccuuacggaauaacgcucacacccagccauggcgaaucagucucagcgccuggaccgccgcgcgcugaucccgcugugcauuuuccuggggaccuugcugaccuuugggacaggacagauccgauacucgguuccagaagaaacagauaaaggcuucuucguaggcaacaucuccaaagaccuggggcuggagcccugggaggucgcggaacgcggaguccgcaucaucuccaggggacaaucgcagcuuuucucucugaauccgcgaggcggcagcuuggucacugcagguaggaucgaccgugaagagcuaugugauacgaugcccuccugcaugcugaauuuggaaauucucguggaggaaacccugaagauuuacggaguugagguggaaguacuggacauuaacgauaacgcucccagcuuccgggaagaggaaguagagaucaaagucagcgagcauaccaguccugggucgcgauuuccucuuccuagcgcuagggauccagacgcagggaugaacucccuccagagcuaccagcucagcccaagcaguuauuucuccuugcaggugagaggcgggacugauggggacaagaauccagagcuagugcuggaggaaggucuggaccgggagaaagaggcaucucaccaccuccuccucacagccuuagaugggggagaucccguccgcaagggcacgguucccauucgcguggugguccucgacgucaaugaucacaucccaaaauuuacacagccuguguauagagugaguauuccugaaaaccucagcuccgggacgcgggugcucgugguaaaugccucagacccagaugaggggaucaacggggaagugauauacucuuuccggaaaaugaaaagcaaagcuucugaaauauuucaacugaauucucaaacuggggagguucuaguuggaaagccucuggauuuugaaaaauacagauucuaugagauggaaauucaaggccaggaugguggagggcugcuuagcaccacuacguuguugaucacgguugaagaugugaaugauaacgcuccagagauaacugucaccucugccaguaacucagugccggaaaauucuccuucgggcacaguaauugcucuucuaaacguucaagaucaagauucuggagaaaauggucaggucucuugcuucauuccuaguggucuuccuuuuaaguuagaaaagacguauggaaauuauuauaaauugauaacaaauagugaacuggaccgggagcagguggagagcuacaauauuacauugaucgccaaagaucagggcaguccaccguugucuacagaaacucaccuacugcucaaaguggcagaugccaacgacaacccuccaguuuucucuagcuccucuuacuuggccuacauuccugaaaacaaccccagaggcucuucuaucuucucggugaccgccauugauagggauagcagagaaaaugcccaggucacuuacucucuggcugaguacaccauccagggaacaccucuguccucuuacguuucuaucaauucagacacgggugugcuguaugcccugcaauccuucgacuaugagcaauuccagaccuuacaacugggagugaccgcuagugauaauggcgacccaccauuaagcagcaauauuucgcugacccuuuucgugcuggaccagaaugacaacacuccagagauuuuauaccccucucucccuaccgaugguuccacugguguggaauuagcaccucgcuccgcagagccggguuauuuagugaccaaggugguggcuguggacagagacuccgggcagaacgccuggcuguccuaucgccugcucaaagccagcgagccaggacucuucuccguggggcugcacacgggggagguacgcacggcccgagccaugauggacaaagaugcucucaaacagagucucgugguaacugugcaagaccacggccagccuccucucuccgccacugucaagcucacaguggcgguggcugacagcauuccagagguucuggaggacuugguuagucuggagucucccgccaacccggaugagucaggccucacccucuaccuagugguggccaucacugcagucuccugcaucuuccucaucuuugucaugguacugcuggcucucaagcuuaggcgcuggcacucauuacgucugcuccaggcugccagcggauuggcuggugugccuccuucgcacuuugugggcguggacgggaugcgcgcuuuccuccagacguauucccacgaaguuucgcucacugcagacucaaggaagagucaccucaucuucccgcagcccaacuaugcagacacacucaucagccaggagagcugugggaaaagcgagccucuccugauaacugaagacucaacuacaguuuuaggcaaaugugaaccgacagauauucaggugagagauaaauguuuuugucucccaauuguuccuguuuuggcacaagucuugaaggggcuuuuguugagcuggguaugaaaauuaggcuugggugagugaaauugguccauacauauuagaacacuacccguugguuuguguaacuuacaacaucaacagauuaacauuucuuuucagaagagcuuugucaaagucaaguuuugguacuugcgucuuuucuuucgauuuugaagagcuauaucgauuaucuuugcuugcuuuguagugaguuaccuucaauguuguuugucuaucgugauugguggcuaccaaugcaaacuaaucaugauucaauuugaugaugcacaaacggaauuuaauuucaacuucacagcgucucuauagucuaccacgauuugcuucuaauguuuaaauugaauucaacucuguagcacgcccacugcagcuacacgcccauuuaucuacacucggcuuguaaugagcuuuucuucgaagcauggaucaguucuguuuugcuuuuugauggccgauggaauauuuggauccuguugacuauuucgauuuuguaucauugcuuuauccuaucgaaacuuggcaagguuuuagugggaagaggccaugcagcaccauuuuuuuucuuaugcuuucuauccauuacuacugagaacucacuacauuguucugaagauuaaccagacuguugaguuguuguuguugcuuccuuuuauucuuuuacuguagugccccguagaaugcuuuuauuuuuccuguuuuuuucuuuuucuuuucuuguucuuuuuuuauuuuccuuucuuucuuucuuccuuccuuccuuucuuucuuucuuucuuucuuucuuucuuucuuuccuucucccguucuuccuuucuucuuuuuuuuguuuuguuuuguuuuguuuuguuuuuugagacaggguuucucuguguagcccuggcuguccuggaacucacucuguagaccaggcuggccucgaaaaaucugccugucucugccucccaagugcuggaauuaaaggcaugagccaccacugcccugcucaaaugcuuuuugauguaacaaauucaaacuuggaaauuauuuuuaucccaugcuucucaauaaguuucaaauuccaauguguguaugugauuugcaaaaaguuagagauuggaguggauuuuugcauuguauaagugauuaauuuaagggcuuggauacaggccagugaucaugugcuuggcaugugcacgacccuuggugcaauccuuagcguccuugggggacaaagacugacuuugcguguagucaucuguuccuucuucuuucuccuucuccuucuucuuccuucuucuccuccuucuucuucuucuccuucuccuucuuccuucuuuuucuuccuuccucuucuucuccuucuccuuccuucgccuuugccaccuucuucuucuucuucuucuucuucuucuucuucuucuucuucuucuucuucuucuucuucuucuccuucuccuucuccuucuccuucuccuucuccuucuccuucuccuucuccuccuucuccuucuccuucuccuucuccuucuucuucuucuucuucuucuucuucuucuucuucuucuucuucuucagaaauauagcagcuuagauacuuuuuucuuuccuuaaguuaauuuugcacuacauuuauuuaagcguagucaauugugguaaucagaaagaaaaagcuugcuauugaagccucaauacauauccaauagugugcaugucaucugaagcaaagacaaacaaggaaaagagacuuauggagauuugaccacaggaaucaccuucauaaucaaacuccacauccuugggucacaucuagagauuugauucaaauuacuugcacauuaauauuuccuuucaaguuaacguuucucauuuaggaguuugaucguaacauaauucauuauugauugggugauugggaacauuucuuucaguuguuaggauaagaacaguugccuaaguuuguccugaagcaagaaaaaaguauuugaauguuuugugugguguuuauucuuaugaaacuccaaacuuugaagaaaaagaacuuuaaggcgcuacacuugaacuagaauuagauuauucaaaagacuaugaggcauuugauugguaaggagaggguggucuguauuuuuaagcacaaucuaaacuaguuggaggcucucagacaagcucuugaagaagaaaaagaaaagguugucucugaaaguugauuugcaagucauaggcaauucaguuaggaugcaacauaucguuuaaauaaaaggaugaaaagagggguugaggauuuagcucuaugguagagugcuugccuagcaaguguaaagcccuggguuugguccucagcucugggaaaaaaaauuagaaaaaaaaaaaagauaaaaagaaaauucucgggcucccaauggaggagcuagagaaaguacccaaggagcuaaagggaucugcaacccuauagguggaucaauauuaugaacuaaccaguaccccggagcucuugacucuagcugcauauguaucaaaagaugaccuagucggccaucacuggaaagagaggcccauuggacacacaaacuuuauaugccccagaacaggggaaugccagggccaaaaagggggagugggcggguaggggaguggggguggguggguaugggggacuuuugguauagcauuggaaauguaaaugagcuaaauaccuaauaaaaacuggaaagaaaaaaaaaagaaaagaaaauucucucccauuucaugucaggagauucuuacuuaacagugauugaacauuuaacaauccuugugauguaucuauauuacaacuaaaaauaacuucuggcauugacgaucuuuauuccaaauguucccuaaauagucacucaaaagugccucuccucugcuaacuaugcauguguccgaugaugucuggugucauuucgccacugucaaguuuuccuauaccgcgugguggggcuauuuucccacgugaucuugagaaaauacuuuccugauucauccaaugugugcguuuccuuagaaaagacgagcuuuuuaaucuguugucacuggguuaauaguuauguuacagaucccaccucugaggagcuuuguucgguagcaacacuggaaaacagucaaauucuaaacucagaaauuccuuugcuccccauaucucaacauagcuguauucuuaaacccaaugagucugcgaaggguucugauugcaauuuuauaaauggccucugggcgccgcugcuguccaauucgcugcaagagcugacuccaugcucuaccgguugaaauucuguacauucacuggaggcuuaaagaguagggguacuugaauuuucugcuugguaaaucagauuagagacugugauauccucaaacguggagcguuuggguuuucuuccugguuggaaguaauucgcgaagccuccucccuucacacuggugcgggagaaggauggagcgcagcagcgugaagcuagggagcaggaccccguggaggcaaguacucuuucccuucuugcugccuuuguucugcacggggcucucagagcaaguccgguacucuauuccggaagaaauggccauggguucagucgugggaaaucucgcugaggaccuggggcugccuguucaggacuuacugacaagaaaccuuagaguuauugcagagaaaccguaucuuucugugaacccagagaacgggaacauaguugugagcgacagaauagaccgagaguuucucugcuuccaaagcccucugugcguccugcccuuagagauuguggcagaaaauccccuaaacguuuuucacgucagcguggugauagaagauauaaaugauaacccuccccguuuccuccaaaauagcauuguuuugcaaaucaaugaacuugcgauuccaggcacuagguuuggccuggaaucugccauagaugcagauguagggcugaacucucuccagaguuaccaacucaguuugaaugagcacuucucucuggugguaaaggacaacacugaaggaaaggaugcccccgaauuaguguuggagaagccucuggacagggaaaaacagagcucccagcucuugguccuaaccgcaguagaugggggagaaccaguccuaacgggcaccgcucagauucagaucgaggucacugaugccaaugauaaccccccaguguucagccaaaguacguacaaagucagucuuagagaggacauggccgcaggcacgucugugcuaacagugauagccacugaccaggaugagggugucaacgcagaagucaccuacuccuucaaaucacuaggagaagauauuagagauaaguuuauccuagaucaucaaaguggagaaauuaaauccaaaggcccuauugacuuugaaaccaagaggacuuacaccaugaacauagaggccaaggacgguggaggcauggccucagaauguaaaguuguaguggaaauucucgaugagaacgacaaugccccagaagugguuuuuacuuccguguccaauucuauaaccgaagaugcagaaccggggacagugguggcucuguucaaaacguaugauaaagauucagaagaaaauggaagagugaguugcuucguaaaagaaacgguuccuuuuaggauugaaucuucugccagcaauuacuauaagcuuguaacagaugggauccuggaccgggagcagacuccagaguacaacgucaccaucaucgccacugauaaaggcaagcccccucucucuuccagcacaagcguuacccugcauguuggggauaucaaugacaaugcuccaguuuuccaccagaccuccuauuugauccaaguggcugagaacaacccuccuggagcuuccauugcucaggucagcgccuucgacccggauuugggauccaaugguuucaucuccuacuccaucauagccagcgaccuagagccuaaaucacugugguccuacgugucggugaaccaggauaguggcgugguguucgcgcagcgcgccuucgaccacgaacagcugcgcuccuuccagcugacacugcaggcgcgcgaccagggaaagcccucgcucagcgccaacgugagcaugcgggugcuggugggugaccgcaacgacaacgcgccacgcgugcuguaucccacacucgagcccgacggcucugcgcucuucgacauggugccgcgugcugccgagcccggauaccuggucaccaaagugguggcgguggaugcagacucuggacacaaugccuggcuaucuuaccacgugcugcaggccagcgaucccgggcucuucagccugggacugcgcacaggcgaggugcgcacagcgcgugcccugggagacagggacucagcgcggcagcgccuucuggucgcugugcgugaugguggacaaccaccgcucucggcuacagccacgcugcaccucaucuucgcugacagccugcaggagguccugccagaccucagagaugaaccuuugcugucugacucccaaagugagcuucaguuuuaccuggugguggccuuggccuuggucucagugcucuuucuuuucguugugauccuggccauuguccuucgccuucgacagucccaugguccugcugucucagacuauuuucagucgggccucugcuguaagacgagaccagagguuucucucaacuaaggcgaggggacucuuccuuauuccuacaaucucuauguugccuccaauugucaaaagacaauuucucaauuucuuaccuugacuccagaaauggucccuccgcgagaccuuuguacggaagcuucuguagcagugagugucgcugaggagaauaacaagauagucucggauucuauugcuucuaaucacgugaguuucaauuagccuuucauucgcaaguuguuucguuuucaaaaucuuuuggaaauauuuuauauuugucugucuuuugguugguuuacuuauuuuuuauaauacauuuagaggcaggguuucucaacauagcacuaguuguccuggaacuuagaccggguugaccauaaacucuuagagauccuccugccucugccucuaccacgaucuauauucuuuacaaagaauaucuuagagcacauuauauaccaacagucucaguucuuuccuaucuuugcucuauaugccaguaacuacugcgccauuaggcuucaaggacuuugaaauauuuuaucuauguacacccaagcgcagagcuuagaaguauuaugaugcacugccacucaagcaauuuaaaucucucucucucucucucucucucucucugugugugugugugugugugugugugugugugcaugcgugcaccauguggcagucagaggacaaccuuugggaaucgggucuguguuucuaccaugugggucccagaaauggaccucagauucacuuaugcuuggcagcaagcaccuuugcuggcugagucaucucucagugguccuacucaaauacuuuaguugagcuauacuuuugucuuucugugguaguuucuugggagaucaauaucuugaucuuuaaacugagaaaugauauauacaaaaaguuuucaaacuauaugauaauaauuugguagugauauucagauauagcagggguucuuuuaauuucacuuuuaugucuuacaagcaaguuuucuucaaaucuuauuuuauggcuaucagagacugaaggguagcucaauuagaguuuauacuuaagcauggcugauagcuagaguccacuguccagcagucgucacuaaaaagugcuugcuuuuaaagacaguuucuagucacauuaaauauguacaggcagucgucuccuagaaucuuuucuacauuuugaugugcuucuaaauauauggccaguaguucuguuuucaaaauuacccaggagaaggaaaguuuacaguauuccucagauuacuaauuuucuuuuacuaagucuuucucaacaccaaauguccuuuuugcaauacaauacaucuguauaacuguauaguagaaucuccaguucaaguuaaugcagguuggaaucuuuccacuuacucuaaagguguccauaaucuucauugauugauuagagucacauaugaaucuaauaauaugcauuauaacaguucucauguuuguuuuccauaugauugugaauuuuuguuuuuucaguaauaaauuccaacuuguuacaauaguucuucccuuuagaaauuuucaagaaaucuauugaaauuuuugucuuacuggaaaauauaggaaaacaaacagcuacugaaaauaauucaaggaagugaauuuguggggggggggggguuacggacugcucacugaacugcccaguacuguugaguuuucuguuuccaucuccauuugaagaacaguagguggagcuauuuaagguucacagaccaaaaauccucucccggaguucacgacugugcaguaauugguucggacucugagcgccgcuguucaccacggggaaggaaaagcagggaagcccugcuugcuuugcaugcgccuaaaacacaaugcggacagauugagacaaaaccccucuaggagcaaacuggccuggaggaacucgucccaccuccuaacugucuugcuccaaggcuucaaaagcagauucugguucaggugaucacaggcagaauuggaaauaauccucaguuggugaugauccccaugcaacggcgggaggacugcaaagggcuggucuuccugggaguccuccucgggaugcuguggaaagcuggauccacccagauacgcuauucgguucccgaggagcuggagaaaggaucuagggugggcaacaucuccaaggaucuggggcuggagccccgcgagcuggagaagcgagggguccgcaucgucuccagagguagggcucaacuuuucgcucuaaacccucgaagcggcagccuggucaccgcgggcaggauagaccgggaggagcuguguaugggguccaucaagugucaguuaaaucuagagauucugauggaagauauagggaaaauauacggaguagaaauagaagugagggacauuaacgacaacgcucccuacuuccgugaaagugaauuagaaauaaaaaugagcgaaaacgccgccgcugggaugcgguucccucuuccccacgcuugggauccagauaucgggaagaacucgcuucagagcuaccagcucagcccgaaugcucacuucucacuggaggugcagaacggagcugaugguaacaaguacccagaauuggugcuggagagcucgcuggaucgggaggaaaaggccgcucaucuccuaguccucaccgcuuccgacgcgggagacccgguucgcacuggcacagcgcgcauccgcgugaugguuguggaugcgaacgacaacgcaccugcguuugcucgguccgaguaccgcgugagcgugcgggagaacguggcugugggcacucagcugcugcuggucaacgccaccgacccagacgaaggcgccaaugcggaagugaucuauuccuuccgguacguggacgacaaggcagcgaaaguuuucaagcuggacaguaacuuggggacaauaucaacaauaggggagcugaaucaugaagaaucgggguucuacgagauggaggugcaagcuacagauaacgcgggauauucugcacgggccaagguccuggucacaguucuggacgugaacgacaaugccccugaaguagccaucacgucccucaccaacucugucccagaaaacucuccccaagggacauuaauagcacuuuuaaacguaaaugaucaagauucuggggaaaauggacagguaaucuguuccauccaagagaaucugcccuuuaaguuagaaaagucuuacggaaacuauuauagauuagucacagaugcaguccuggaccgagaagagguuccuaguuacaacaucacaaugaccgccacugacaggggaaguccgccccugacaacagaaacucaccucgcacuggacauagcagacacgaacgauaacucgcccguuuuccuucaggccucauacugggccuacaucccagagaauaacccuagaggggccucuaucgcauccgugaccgcccacgaccccgacagugacaaaaaugcccaagucacuuacucccuagcugaggacacccaccagggcgugccccuuuccucuuacguuuccaucaacucggacacugguguccuguacgcacugcauuccuuugacuacgagcaguucccagaccuacaacugcaagugauagcgcgugacagcggggacccgccacucagcagcaacgugucacugagcuuguucgugcuggaucagaaugacaacguccccgaaaucuuguaccccacucucccuaccgacgguucuacuggaguggagcuagcaccccgcucagcagagccuggcuaucuggugacaaaggugguggcaguggacagagacucaggacagaacgccuggcuguccuaccgucugcuaaaggccagcgagccagggcucuucuccguggggcugcacacgggcgagauaagcacggcucgggcccugauggacagagaugcucucaaacagaaccucguagugucugugcaggaccacggccagccuccucucucugccacugucacgcucacuguggcgaucgccgacagcauccccgacguccuggcagaucuagacaaucuagaaucuccuuccaccuccgaaacuucagggcucacucucuaucuggugguggccguggcggcggucuccaccgucuuccuggucuuuguucug

SEQ ID NO: 8891 - RNA, 1195 nt, Mus musculus
guaucuuucuaagcauuuuuauuucuauagucaaacagcaugcauaagcuucguuuuuuaaaaagucuggcaaacuuguucacaauauuaucaguuguuuuuuuuuuuuaauagaaauugaagucauccaucuuuccaauauuacuguagccuauuuuuucuucuuuauaacauguuagaugaauucccccaugucaguaaaaacucuucaaaagucaucuaaaugcugcagaacagcaucucauaugguuagauauacauauauuuuuaggugcuaauagauucuugcuuugcuaaccaaauacacaugcauacacauuguaacacaauuaaguacaaucugcugucaguguggcuuuuccagguuucuuacuucuuagcauaacacggggaauacauuguugcagcccagccauaggcugcuccucuucccggaccuccacacccaggguuagccagaacauguaggugcuuggacaaccacagugccuuuucuuuaugcuuacuuuugucuuuaaaucuuggaagagucccuugaaucugcugcugggcuccagggaugccugguggaagccaaguuccucugugugagaucaucaugggcuuuugggucauaucaggccagauggaguugcgauugcaccacuuaacuggcugugugugacuuugaaaaggccuccaaggccugccuuccucugcuggaaaugagggguaauuuuaaucucucuccaggugacugagcccaugacccaguggcuccaggccuuauagaacccucccgcugucacuugucggaagguggccaccuguuuggccucuagcauuucccagacugcccagcccucucgguuccaggcuagccuuauacucaccuuuauucccuggcagcaccaagcaccggccacugccagggcgccccccugaccugcucccgucugugcucucccacaccuucacgagcucagucacaccagacugagggguuuuccuuuggcuuucaugaagacaccugugugaauuucuguccucuggggguugugggagggggugucccucacacccuccaucuuuguccauggggcaagagugaguuucacauacauaguuaaaucucaccauggcaaccuugcuucugagcaucucaggaacucuccagaauuccgagggaggaggaagccaaaauguucaguguuca

SEQ ID NO: 8892 - RNA, 1448 nt, Mus musculus
ggggguuaauccaaauggcagaacuggggccgcaggaaccccaaauccaaaggggggagguggaggcacgcccauaccagguggagguggaggaaugccaggugcuccaggaaaagggggagggggaggaggcaguccugguccuccaggcaagggagggggugggggaacgccaacacuuccaggcaaaggaggaggugguggugguauaccuguaccuccaggcaaagggggagguggggggauggcaguagccccaggcaaagggggagguggggggauggcaguagccccaggcaaagggggagguggggggauggaagcaacuccagguagaggaggagguggagggauggcagcacugccaggcaacugggggggaggggguauacaagcaccuccagguaaaggaggagguggagggauacaaguaccuggaggcagaggaggggauggugggaccacaccuccaggaagaggaggugggggugggggagguggaauaacagugccagagucaccaggcagaggaggggcagggggaacagcagcacugcuagaaacagaaggugcaacaaccacagcagagagagaagccauuucauucuuggcaucuucuaguucuuuugacagcuuggcaaccuaaagaagcaacacaagaaaguacuucugacccuacuucaaggaugacuggaguuggaaaggaccuaagaaaucacuuaacccaacuuucuguuuaacuacagacagacugaguggucacaagaucacaugacucuccugucacaaaacuagaacucaagucuuuguguucuuauuuuaagugugcuuugaguuuacucaguauaaaacugaaguaugugcaggcagccccacaacugugcaaacaagucagcaggacugcaggucgucuaagcauuuguaacugcagagaaaagagagugaggcugucagaaccauaagcuaagguggacggaaaagcaagucaacauuagugcuuaccccuaaguguguuauuucuggauacugcuguaagcaacuuuuaucacgcuuuacauuuuucuguauuuucuaaauuucugucuuauauauauauuugcucccaaaacuaaaaacaguaaaugagaguuuaaaacaccaucuaauaacugcucuucccucgcacggggagccuaaggagccaagaacaguguagccgcauggccagcagagcugagcuacagagagcagcugcaggcacgcagccaucccugcucagacguuaccucuccugucagcuuggacaccucugccuccaggucuuguuucugugcagugaucugcugcuuuucagaauccaaggcauccuuuucuccuugaagauccugaaguuucugcucaaagucauuuuccaucuuuuucauuucuacuuguaacucgugccgcgcuguuaauucugaauccaacua

SEQ ID NO: 8893 - RNA, 1448 nt, Mus musculus
uaguuggauucagaauuaacagcgcggcacgaguuacaaguagaaaugaaaaagauggaaaaugacuuugagcagaaacuucaggaucuucaaggagaaaaggaugccuuggauucugaaaagcagcagaucacugcacagaaacaagaccuggaggcagagguguccaagcugacaggagagguaacgucugagcagggauggcugcgugccugcagcugcucucuguagcucagcucugcuggccaugcggcuacacuguucuuggcuccuuaggcuccccgugcgagggaagagcaguuauuagaugguguuuuaaacucucauuuacuguuuuuaguuuugggagcaaauauauauauaagacagaaauuuagaaaauacagaaaaauguaaagcgugauaaaaguugcuuacagcaguauccagaaauaacacacuuagggguaagcacuaauguugacuugcuuuuccguccaccuuagcuuaugguucugacagccucacucucuuuucucugcaguuacaaaugcuuagacgaccugcaguccugcugacuuguuugcacaguuguggggcugccugcacauacuucaguuuuauacugaguaaacucaaagcacacuuaaaauaagaacacaaagacuugaguucuaguuuugugacaggagagucaugugaucuugugaccacucagucugucuguaguuaaacagaaaguuggguuaagugauuucuuagguccuuuccaacuccagucauccuugaaguagggucagaaguacuuucuuguguugcuucuuuagguugccaagcugucaaaagaacuagaagaugccaagaaugaaauggcuucucucucugcugugguuguugcaccuucuguuucuagcagugcugcuguucccccugccccuccucugccuggugacucuggcacuguuauuccaccucccccacccccaccuccucuuccuggagguguggucccaccauccccuccucugccuccagguacuuguaucccuccaccuccuccuuuaccuggaggugcuuguauacccccucccccccaguugccuggcagugcugccaucccuccaccuccuccucuaccuggaguugcuuccauccccccaccucccccuuugccuggggcuacugccauccccccaccucccccuuugccuggggcuacugccauccccccaccucccccuuugccuggagguacagguauaccaccaccaccuccuccuuugccuggaaguguuggcguucccccacccccucccuugccuggaggaccaggacugccuccucccccucccccuuuuccuggagcaccuggcauuccuccaccuccaccugguaugggcgugccuccaccuccccccuuuggauuugggguuccugcggccccaguucugccauuuggauuaaccccc

SEQ ID NO: 8894 - RNA, 19149 nt, Mus musculus
uuuggugggauaaugcaguuuuuauguauaugaugccugugcagugaaaaaugugagaaguuaccugauguagaaagaacugaguuccagccagcgccaauuccagcuggaguucauugcccagcucugaauccuagacuagcuuucuaguuguuucuuagaugggcaaaccaauuauugccaauagccuaaccagcaauuaaauaauuacuacauguugggcacaaacuauaggccaggccauauguuaaacaugacauguuuuuccucacuaaauccucacaauuuccucauggagucuacugguaucaccacuaaagaaauuuggacucugggaguugcagugacuuauaauugauagaaauuuauacagauuaaucugacauccacguguuuacccaggauuccccacaagcauuaaccaaacaugcccaagaguacucuggguauggucuuuauaugaucucuccccucagcaaugccauccauuuuccugacuacaucuaccuaauguggggccuucuaguaugaacugaauaacccugaggucugaaggaaaggauugcaaguguauauuucugaugacagggucagaaguuuuuggagucuccaguacuuagcuaauaucagggagucuacuaacuuugcugucuccuacaucuggccuuuaucuccuguuuccaaccuuccaacugcugggugagacggugcauagagcuguccagcucaucuuacugcagacuguccagaagaauuccaaugcugagugaaaagacagugagcuaccugucacuccuuucuuguaccacugacaacacccacaguuaccaugcccgacuggagacuccuccaggaaggggucugugcaugguacacacaggauccagcuuguuccucagucagucugugagcaguugcuuacauccaacagagccaagcacuuacuggguuuuaucucaggacaucuuuaccagcuaacauccucaucucaaacacccaugcucacauaccugaagacaucuuuacccuucucaggucaguaaucuaacucuucagcagaaaugucccauuaauuccccauuugaggaaacuaauccauggugaauacacacauggccuaacuaauaaaguacugagugaaugguaacaauuuuauuauacacaucaucaucuguuuccuuuucacaucauacaucgguaacuagcaagaauuaaaaucccagaaagguacaaaaaaaaaaaaaaaaccaauugguuuauuagauccaaaacaguaaaauggacauaaagccaguuagagcuucacacccucuccuccuugccacuguacuucaucugcaguuaagguuucagagagccacgccuuccuccccucagguucaccuugcauggaagcaagaacuguaguaggggaacccagaaggaagucagaggugacuuuaguaccguccaaacuuucaucucuaacagucucuguguuggaaggacagaaggaacaaaugaggggaagaggggcugaggacaguugcuggggcucauuacccauaacguuccagagaccuguccaugucucaucccugagagggacaaucaucaggccgugagaguuugagggaaaggggaguuaauucuagaaccacauaugguuuccaaacccuucaccagaguuaguaaacacccuggggguacccaguucagaccuggggaaaccauacuuuccuucccaccacagaggugacaaggaacucuuggggacacagcauccaugcugcucuaaaucuccacaucacuuuccuugucguugucauggucgccaucauagaacucauugggugcuucuggccuguaaaacaaggaacaagagauuagaaacccacucuucaaguuccagacuccucccagcacccuccucagagccacuuuucuaugggagucuucuccaaagccaguuccucuccucuugcuggcagggacuuacugcaauccauguacucaauaaauggagacuccugugugccaggcacugccguaggccuuaccaaaacagcagagaaucagcuagacuagauuuccauacaaucucucaaagcuuacaucaugagaccagcaauaacaaagcucaugaaugaauacaauaacuucaaaugguggaguguucuacaugagaaaacugagucuggugugaacaagaggguaacaauggaccuacaaaaugagagaccguucugacaaugaaagaccuaaauucugugaagaggcuggccaggcaaagaucucaggaaagucccaccaagccccaagaaaaccaaguacagaagucacaagguccaaggaaacugagccauucgagaaugacaaggaggccagcaaugcugggaugcaugugggcagacaaaaguagucucagaagacgagucuguaugcagaucuguaugcagggcauguucaaacuguugcuucuaaguacgaggagaaggaaagguguaagcugagacugaugcagggaagagugucuuaguuaggguuuuaccgcugugaacagacaccaugaccaaggcaacucuuaugaggacaacauuuaacuggggcuggcuuacagguucagagauucaguccauuaucaucaaggugggaacauggcagcauccaggcaggcauggugcaggaggaaccgaguaggagccuucuacuucuucaucugaaggcugcuagcagaauacugacuuccaggaagcuagaaugagggucuuauagcccacacccagugacacaccuacuccaacagggccacaccuucuaauagugccacuccuugggccgagcauauacaaaccaucacagaaaggaaaggcugcaagacuggccggaagguaugagcagaagaccaacaugagguaugaguagaagacuggcaggaagggaugcacaaguggaagacugacaugucauuaaacuaccaggggagggaagugacagcaacacagggcucagaaaguacucaauacugguuuccaucucuuugaaaaccuuuucuaaaacaggccauuauaaagucacagaagaggagcaagagacuaaggcaggcaaacaaggccaucucuaucaccucuaagagcccaggguaaaaagugagaagucggucucucaggguaacuacagaaccuaagaaaguuacuugcucucucugagcccuggguucuuccucucgucaucugaggauaagacccaucucuuggguuaugcagagaguagagccagaugugaacacacaacuauagaagaaaaagccaaacccagacaaaaggagaacuuaaaaacagguguugcugaaccaacuaagacaauggcaaucaguuucuagaagucagguuuuagaggcuuguagacaacugcuaaagaaaagaugauuagauagagccugaaccagauauuuagauacuuccucacccacgccagggaauggggagguauccaugaaagagggggacuggaaggucccaaggauuaagaccaaguccagaggacagaaauggaggccagaauucuaugacccagaauagacucuggaggaacugagaagucacccacagcagcagcagagccagcuccaaccucaugcacagaagcucacagcaacucgaguggucucagucuuguaaauguaucuggucccuacuaaauauaucucuuuccaucuugauuucuuuugacucuuuuggguucuguuguccuuucucaucauuuucuagaaauuucuucaaggauuaacaacaaaaagaucuauacuaaucaguccuuauuucauucuagcuauaaauauuucaacauagauccaagaaagauaaagauuauuuacacacacacacacacauacaccucacucaauacagcucagaaaucuggaaaagugaacuaaacaaauguagagacccuauaaaagagaauguaggcaguggucuacugguucacugcucaggacagaguaaaaugcuggcaaauggagagacagcucagcaguuagguacacuugcugccauagcagaggaccugggaucucuuuccaguauccaaagagcagcucacaaccauccuugacuccaguuccaggagaucugacacccuaucaaguacauaaugauguacauaaauacaugcaaaguuaaacaccaugcacauaaaauaaaugaaucuaaaaauaaacaaaagauuuuuuauuuaaaaaaaaaaagauguaaguaaaccacuaaguucuuucuggaaaauaauuuggcagcaaauaugaaaaguucuacugcaugcauaucucauuugcccuaauggcaacagcuaugaaaacuggacccacucaaacaagcauacagagaaacauacauagagacauacauacauagagggauucagugccagucuucacuauuuuuguagccacaaaagaaagggaggggacggugcagugggguaaauauccacaagugguaacugauuacccucgcaaucaugugaccaccacacaauggaauuauacaacugagaaaacacugaucuacacacacugacacaggcaaguguaacuccaaacaacauauagaaaauauccucccacggauuaacaaaaaaauguauaaacaagcuggguagagcaagcaguccaugccuauaaucccagcauuuagaaacccgaggcaggaggguaucugauuuaaagaccagcuugguccacacagaggaaaccaugugucacccccccccccaaaaaaaaaccagcaacaaaucaagaaaaaaaaaagcuguauaaauaaaauucuggauaugcacaugugcauguaguauucuuauaaucuauagaaaauuaucuauucaaauaauacauaaaucaagccauaaauaacagcuacuuccauggaauaauucuggaacuacgugaacacaacauauuuugauguuuauaauauuuucauauuauuguuguuuuguucuuaaaagugucaaaaagaguagaaggcucgcagucuaaaggaaaccagccagggccagaugaacuugugccuucucacuuggaagccuucucugcaagccuaaggaagcaccugcccuccagccccugccccagaccugcuguaguucuccucgggaccucucucuucagcgucggccucgucaguccugucauacgucaggaggucugccgggacaucaugaaucuggacacugggugcaugguucagcaucuucaaguuuucaaagauugucuggcggaucugguccagauacuaguuuagaagaaagaaagucagcgguguuggggugauuccuauaguacaggaaauccuacccaccuucgucccugaccguccugaucuaagguaguauuucaaggucagauccucaguuggcaacugucccuccccaacaaccccacgauaagaucgacagugacagcccagaaauucuuucucuugcucucuccacuuccccccuccuggaccucuccugaacccccccccccauugcuguguccagccucuccaagcugcuaaccuggcgugaguucugauucucgaugcgggugcugacaucuggauggagugugaaaucuggggcaaaguacucgaaguauucuuagagaugagaagcaauugggagaggggaugaacaagaguauggcugagacaccagagugaaucccauggcuuucugaucuccucuccgaggccugguccccauguguaagaguauuugcucugcucugagcacagggauuuagucugcagagcuaccagaaggugcaauuucccuccaaacaaggucauucugaggacuggugagaauggugucccccugugguggcaucaugaaguggaucuuaccacuauagggaaguuccucacuaauggccucuucuaccagcagagauguuucauauguccugaaaccagcaagcagagggguuuggguugauggcgugggcugaaaggaccaccccuccaauuuuagggagucugucgugaaccacagaguaguagaacagaacacucaccaacaccgggcaacauuucggacaguguagccaccaccucccaguaccaggagagggauauugaaacucuugacauauucaacacauucccuguuagaaacaagaggacuagguaaaucuaagacaugugaccccagacaugacuggaaauauuguacaaagacuugaccaacaauauuucucugucauauuguguaguauaacucaaaguugcauucuuugugugugacuacuuguauaaacggguuugucuucacaugugugccagugcaugugugucugaggaugugugcauguauguucacacauguauacaagggcuagaagacauuuucauguguuggccuaaagauacuagccaccuuuuuuuuuuuaaccuggcacuugccaaguaggcuaagcuggcuggcuaccaagcccuaugaaucuucuggucucugcuucaccagggcugggauuacagaucauaaaugggugccaccgggccuaguguuuuuacaugaguucugggaucaaacucaagucuucauucuguauagcaagcacuuuuacugagugugcuagucacccuguccccaccuggcucugagcuauaugcuacacacacacacacacacacacacacacacacacacacacacacacacacaaacacacaaaugaacaaauaaaaauacuagcguacuuuacuguguugugucucagugaacauuuuaaaauaaagcacacccucacggccuugcuuacuacucuccgccacaccuggccugcuacccaacuacucccaucggugucgccaccagaaugucuguucuaagcuucaggacauaccuucauaccucguacuucucuccaucaacacaugcccugcccaaauaaugugauuggcuuccuaacuggcugcccacuacccacccugaccccaacucccacaccaacccuuucuucauuuagcagucagaacaguaacucucaaacucauuggacccugucacuucccuguuuaagauccuucaacgguuuucuaucacccauggaagacagggucuaauagcucugcacacucucagccuggccagcuuauagcaccugccuauguucuggccucauaggcuguacugucucuugucaagacaguaauucuuuuuuacuucggucuuagggcuuugcacuggcccuucacacugcuuggaguaggauucucuguucuccuuuuacggcucacuccuuagucuccaggucucccauuucaccuucucagaaaaccuuucccaaagcaugcugucuacuauacauucccaagccagguguggugaccugagcuuguaaucccagaauuucagaggcucaagcaggagggucacaaguucaaagccagccuaugccacacagugagcccuuaaauaaaacuguaccauuaaaaaguagauucccuguuguuacccugucuuauuuuuucccucauuagauuuuugauuguauguauguguaucauauacacauauauaugcaauaauuaauaauaauaacaacaacaaauuacaacuuuaaauaacaacaagaaggaaggcaacgcacccauguccucgaaugcugagauugaagcagccuaaucgaucacagcccagggagucagcgccacacugcaaaaaggaaaaucccaaauggcuacaguagcacgaaugcucagaacaucaguguccucuagcguccuuccucaccaacuuagggagcuuacgcuuccugaucuccuuccuguagcccaggcaaguccucuuagggaggugcuaagggaguuaccuggagcacgaugcacgucggcugguagaaguccaccaccuggcugaugacuggcuggaaaaggugcuuguaaccugggagagggccaaaggugggcaaccuggcaccccaaggggauggggagacagggaacaaaaggaaaaaggggguugagagagcauguagcccaggaaaggggcgacccacagaaccaaccacugguucugaacuucuggaggguguuacaacugccaaguuaaacacuagcaaccuuccucccagaagaauaaaugaacaaaacguauacacacauaauauaugucauacaaauuccaaggguucauggucccucugaaggccauucguccuuaaggaaaccuggcccaacaauagacaauaccaggcagaagagguuaauugaaagagaagaaaaggggagacgagugagcagagagaagucaucagaacuuacucuggucaucaaugccaucucguaagggcacauugagacaauaguagcggccacucucugcuccaacuucauacaugucaccuacagaaaagagagcgcagugaccgugcacaggaaguucccucaacacagccguuccucugugccuucuaccaccaaggcuccagcaaccugcauucacucaauacagggucacagcuauguaacucaggauggccaggaacuuguugcauuacccagguuagcuuugaacucuuaauucgccugucucggccaucugauuauugguauuauagguauguaccuccuugucugguucaaaaaauuuuacuuagccgggcaugguggcucaugccuuuaaucccagcacucaagaggcagaagccagccuggucuguagcaauagacaaagaaugaacauaaaaacuagaauaaauacaacuagcagugaggacucuaagaaaaagagaaggugagguaccuguuugacuuaauggaguggucagaaagguuucucugcagaaaggacauaauacuuaagaccagaaggcuaaggagucagucauggcagagagcugaaggacagccaggggcaauggcacaucccuggucucccuaauucagcaugcugauuauggaggauucuguacagacacacacacacacacacacacacacacacacacacacacacacacacaaagagcuaagggguacaaaaaaaaaacaaaaaacaaaaaaccacaguaauucuauucccuaccuguuccaggaaagaaguaauuuccguauuuguggaaggacacagucaugacccggucagugagguagaaggcuuccugaaccccgucaccaugguggaugucgauaucaauguagagcacccgagggugguaccuggugugaggacagagccauguucugaggaagaggcuuaucacccaguccucuccuccccaacacaaucucuggaauuauuuagagucugccucuggccaagucacuugaaaccucaucccaccagcuuccuccaggcuagagccuggggagaaagggaacaugcagcggggcugaaaugugagcaggcagcagggccaagcaggaagaagcaucaagaacuuaggagaagccaguggggaaggaggucagggcugggccacggccugaggaccugcaucccaaagucucucaucuccucuggcgauacuuacuuaagcagcuccaggauaccaauuacuaugucauugacauagcagaagccagaggccuguggggagaugguucuauaaacagaggaacaauucuucuauccagcuaccccagcacugucauucagccgaccucaccuaggguagccacaguuuuccccauugcaaccuuaccucaaauuucuuggcaugauguagaccaccggcccaguugauggcaauaucacagaucugaaagauaaacacccauucagucuuuuucuugcccaccacugaagcuggguuccagaucaaggcucuaugguccugaaucuggaaacccacaggaaaaaggaccaagacucaggguuacaucaccuuguuguuuagcuguguugcuccuugcagagaugcgccuguguaacgggagcagaacucgaaaaguccuggaaacacugggcugcagggcaaaaagugggugggguuaacaccccucuugucacuuucccccaccuuccccacccaaacuccaauuaccacugucuaaaacacccccuaccccuucuccagaccugagccauucacagaccuauccaacaaagguuuuagaccaaaucuuguaccaagcuuuguugcaaagcauaguacaggaagcagaaaaaugucuaagugccagggaguuuguacucaaccugggaagcaaaguaaacagcuucuuggguauacaagaaaugggagggagcuagcugaaggaggaggcuggcucaucacagaggugucugugugugucacacuuugucaugauguguaaugauauucuuuucaguuacaccuuuuuucuuuucuugagacaggguguauccuuggauguccuagaacucacuucuuacucuguagaccaggauggccucaaaccugccucugccccugcugggauuaaagccauucaccaccacugccuggcuuacaguugcacauuuuaaagaaagaacugcauuccuguuuauguggaacacuaacaaugacauaacuaacugaaagcuguccucucacugucagcacaguaagccacaugucaacuguaucaauuaccacuuccauacuguacgaucccacugauguaacagucgagaaaagaaaaaauacaaggauagagaucagaucaacagcugcuuggggcuaaggugaagagaagggauugaccagauuuguagaguaaaggaaauagucaguacccuaguauacugcaucaaaacucacagaagcaugacaccacggagcugggaagacagccuggucaguuaaagugcuuguguuacaagcagcuggaccggagucggucccaaggacccauguaaaaaggucaagucugguuuaugcuucuaaucccagccguggggaggcaguucuaagggguggcugacuaguuccaagccacugaaagaccuuguuuaaaaaaccaagguggcagccaggugguggcggcaaaugcuuuuaaucccagcauucaaggagacagaggcaugcagaucucugugaguucgaggucagccuggucuacagagagaguuccaggauagugagaacacagagaaacucugucucagaaacaaaaacaaaauggaacaaaaaaauaaaaaaaauaaaaaaaucaaggugccuaggugugguagaacaugacuuuaaucccagcacucugaagcagguagaucucuauagguucaaggcuagccagccaaccuagucuacauagcaaguccgagaacagcgagagcuacagaaauacugucaaacaacaucaaaaaaaaagcaacaagugcuguuaauggcaagucagcucuccaguuccuaguuaaaauauaauuuauauauaguaauuuugcuuuaaaaaagauuuauuuuuauuuaagaauuuguguuugauaaggagaaaacuaagcaaauugagaaaaauaagaauguaaucauaaauucuaagaaaaaaacaaaaaguuauacagaaaaauagguuaaguaauaguuguacuauugggcagcuuagcuauaaugauguaagcacagaugggcagugguugcauauccucuuaauuccagcacuuggaagguagaggcaggcagaucucugugaguucgagaccagccuggucuacagaaacccugucucacaaaacccauuaaaaaaaauuaauuaacuaauuaauuaauaguguaaacauagaagacugauuaauuuuaaaauguaaagauugggcaugguggcagacaacuucaauuccagaauucagggccagaggcaggaaaaucugugaguuuguagcuaggaugucucuagagaguuccaggccagucaaggcuacccaggaacuccaugucucaaaaauaaaauaaaagguugaggcuaaauggaguagcucacaccuacagucucacacaaaggaagaucaggaguuuaaggccauccuuggcuacauaaccuagguuccagaaacccugacucuaaauaaauaaauacgcaaacauaaaaccaagggggugucaagauguccuagcagauggggacacuccccauaaagacccaugaccuggacuuaaucuguggaacucauagggagaucuguucccacagacugucccucugaccuccagccauguaccacucuucaaaagauaagugaauaaauaaaugagaaaauaaacuucccaguaaauaaauacguuaauaauauaaacugugauaucaccgcauugugaacugggacaaaagcggagcacacuggggugguaugggaaaaugaguggcucauaccaccacaccaauggcuuaucagacaacccgaguacuuauaaaagaaacagcaguaagagauaauacaguagagaaguaugauugauuauaaacccagagugagaaggcagacaaccuguguucacccauguaguuggugguugugagguugggcagugagcuaugccccagaguucuuaucuguacaaaggagacuauaguaaguccugcuuaauaaggggcugagaaaauggcuuuaaggcauuuaaaacaguaccuaaagcauaguagguauuaucuaaauaguacagauuguagaaggaguugcaacaguaaaguaauuuuauuauuuugaaauguaaagauaaacaccacagcaaggcaugguggugcacaacuuuaauccuagcacauggaaggcagaggcagaugaaucuuuaaguuugaggccagccuggucuacagagcuaauugcaggacaacuacggcuacauacaaaaacccuaacucagaaaauaaacaaacaaauaacugaaauaaauaaauaaacaccagagaaauagguaaaaguaaaaugggaagagagauugauagauggaauagaucugaaauuguuuuuucccccaaauuauaauuuggcuaugaauaucagauuacuuauuuuuaaauuacaauuuaccuaggcugguguggaaccuacuauagcagaccagacuagccucaaauuauggcaagcuuccugccccaggcuucucagcugggauuaauaggugcuagccaucacaucgggaaacuauuugaaauuaauuuuaaaacaggagaaaggaagaaaaaaaaucccugauucuccucugaaacacagaacccauauaagcacagcuauaguuuacaucugcuggacuggcugagggaucucaaaugcccagagggaguguucccuuacuucccaagaauguuuauaggacuccagcugcaaccuaagagaugacucugcauucucagaccuggaaaccaaacugggaagaaaaacaacagaaaugaauuuuuaaaaaagaagaggaggaggaggaggagagacugggcaguggugccacacaccuuugauccaagcacucaggagacagaggcagacagaucucugugaguuagaggccaaccuugacuacagaguaaguuccaggacagacagagcuacccagaaaaacucuugucucaaaaaaccaagacaaaagaaaaaaaagaaaagaaacuguccaagacaguacgugacucaacaccaaaugugcagcacaccgaguauacggcagaacucuucaggccaaaaucaucaugaaaagcucuaugcaaagccaagcagugagacacaccuggaauuccagcacugagaggcugaggugggaaaaccagcaguucacugauaacacuggcuacauaaaaagauccugucucggaaaacaaaagaaaccaggaaacaaggugggaggggacaucuaucgagaugacucagcuguuaagguacagguuacucuccuagagggucugcacucagugccagcacccccauuaggagacacacaaccaccuguaaccccaccacuggggauuccagugaccucuucuggccuccauaaguaucaacacauguggcauacacacauauacauacauacacauauaguaaaauuguuuucaaagaaaagggaauuggggaacugcauggaaguggugugugggagcggagaaggcuuuaaagaggcugugaggagagccgagagcacucccucugugggagugagguaucaggaaggaaggugcucaggacagcuuauagagccugccuuuauccuacagccaggaccacgccaucagucggcucucucaguaaaacuaauuaggaaauccgcuuacaaaccugggcucugagccagaugugguggaggaagaccaaaacucagaggcuguggcagauucuguucuagucugcuuucaggacuacaaguucaaggccagccuggggccauguggcaugacuuuaucucaaaacaaacaagaaaccuagguuccggaucugaguccuacuacauccacucaucagcuaggugacucaagcuacacuagcaaauuuccccagaccuccauuuacuuagguguaacaccaggaaaaaggcgauugcaguccaguguugcuaugagaauugacuaaaugcaacccucagcgucaugcauaauaggguugggacucaacaaacaggacuguaggaaacaacauggaggaugaacaaccucauuucuucaagaaauaaauucaaaggagagagagaaaagacagaguaagucucaggagaccauauaaauccaaaccuuguuuggauccugauuuaaauaaaaugcaucaugcacacacacacacacacacacacacacagagggagagagagagaaauggacauauuuaaacacugauuacauuuuucauuaaagaaaaacguuuaauuucugaagucuaauacugauauuuuuaaaaguaucacuuagagauacauaauaaaauauuuauagauaaacguauguggcaucugggauugguuuuaaaaucaugugacacaaggggauacaaaugacuuaagacugcccagguauggaagaaugugccagaaucacagcacuugggaggcuaagacaggaggauuccaaguucaaggacagcauuacuaacuagugaggcccugucucaccagucauuuacacuaaguguugaagcugggcaaggagugcacucagauucacucuucuacucugcuuucagaaauguuugacuuccccaaugauaacuuuaaacaauguccacucugcuggggcaggccuguaaucauguaacugaagaggcagguggaucucugcuaaguuugaagccagcccggucuacauaaggauuuccagacaugccagggcuggauagugaggucccugucucacagguaaauaaauaagaaaauaaaacaaacaguacugaguuuuccauagcuauuaugcuuacuaguuuuggauuuuuuuaauuaaaugaauggauuuauuuauguauauaagucucuauuuguauguuugccugcaugccaaacgagggcaucagaucccauuacagaagauugugagcuaccauguggguccugggaauugaacucagauccucuggcaaaucagccaguguucuuaaccgcugagccaucccucuaggccaauacauuuauuauuuuucacuaauguaccguggaguguuaacaaggcucauggcucauuuuguugcccauucuccagcauccuaacccugagucuucugccuacaauaaacacaagcuccguguuaaccuggucugauuaggggugauguagcuuauaaacaaaaagcugaguaucaugcacaaaggacuggauucaauucuuaguauuauuuaaaaaaaaaaaaauuuaaucaaaagcuagucaugucaaaucauucccuggcuuuaaugaccuuaaucaacuauaggaacaaaaccauuaauuuaauacauagcuguuuacuuuaaauacaaacaaacagaacaaaaacagggucucacuaaauaguguaggcuggcccugaacuagcagcuuucuugcaucugccucuaagugccaggauuacagaugggaggcaccucaggccuugugcuuuaaaaaggccccagccaucuccuuagccuccucucagcucacucuccuauucauuuucuggacagcuuuucugauacucagagaaguccuauuccacccuaccacagcccuuuagcacacgcugccccuccuacccacauuucuccccucucccucagccaucuuucaaaccugaacucaaccucuaccauuucaucucagaccagcccugcucugaggcuagauaacugacucuuccaaguccacacgcucagucaugggccuccucacagggcuuagcaaagagagaauauuaaaacuuugucggggcuggugagauggcucaguggguaagagcacccgauugcucuuccgaaggucuggaguucaaaucccagcaaccacaugguggcucacaaccaucuguaacaagaucugacgcccucuucuggagugucugaagacagcuacaguguacuuacauauaauaaauaaauaaaucuuuaaaaaaaaaaaaaaaaaaaaaaaacuuugucauuuucccucaccaucguaucccucauacuuagcccagcuaagagagagcaaaugacuagcaggcauucacggagcaaaugaaugaaugaaugaaugaauucacugacuccuccaugaagaccccggccucccagugauugacagccccauccugcccucaccagucaucacccacguugaaggcauuaaggcucuuggugaaacccugcauauugguggggcugacucucugcaggaagucgauguaguccucagaauggaagcggcacaugucaugcugggaggccugguaaggcuugaagaccugggagugggcacaaaagggaagcuguuaccugaguacugccuaggugcuagcccuaaucuugcaggauaccuagagaccagaaguuccacuccggugagcuagccaaaacaggaucagccccagaagggugccagugggugaccaacuagacaagaccuuacuuaauuauaaucccaccuaaaugcugaaagacauucccaauaccacggcagguaacaacugccauggaaacaaguggaaaccaaaaaaggagagaaagggguugguuucugaauucccagaauuuuucugcuuagucucaggaaaaaacaaauguggcuuuucuuuaucagcagucucuuucucucuuccucucccuucauuuuuuacucuguaucuacaaauucuuuuguaauuaaaacauuuuaucacauuauuuacuuauucuuuguguguguguguguguguguguguguguguguguguguguauggugaagucagggugucagaucucuccuuucaucacugggguucagaguucggacuugagccaucaucagacucagaggcaggcaccuucacccagugaaccaucucugcaaccugcugaauaucuuauaaccuguugauccaugugaauugagauguuaucucaggagaacaaaagucccuuucacuguuccuuugacacauggucuuauuacuggcuccucacaaugccaggaaggggaagaaaaaaaaaaaaagacucaguuuggaaguuuggacaaaaaaaccuggaaacgaucaggcagugcucugccagucaccaggcugaaaccacacagagugaucccagcccuggacacuguccaaagcaaucuucuuacccccuauuccuuguuauucuacagcaacuggaagagggaagaagaaaggcgaccugcuaggcaagcuacuuuuaucaagaccccugaagaucacuucgucucccuccucccuuuggcccagucucuucuccccugucagccuugacuccuggccaugugcccugucccuagucccugcccucccaggcccgguuccuccugcacuuaucuccucuccuaaacucagacucugcucccuucucugggguuuucaccuugggguaaaauaugugagcuauaugacaaccuaacugaaacucaaaguaauaaaccaaagauuuauuauccuugguugggggacaaguggagguucaaacaaugcuuugaaaacugggcaaacaaacaaaagacacuuuuuuuuuuccucuucuagaaaaugcauaaaagaucacacagacaaucucaggggagucacagccuugcacuaagcucaccucagucuuuucuacucccaaaccacugccugugccucaacacacugauuacagguuaacuaucuucauagugaacaagggucagacucacuauguucccauuucacggcuauacauuccgaguaccugcauaacugaacugcaccauaaagacagagacguucuauguuaaaaagcaaauucccaggacaucuucucuacacacauacaccacaaagggugcagagcuguccccaagaguuguucuagcuccuagcagguaaaugggcagaggagaaggagcaggaacuauggggagaauauauucccagucuuccuccucaguccugaaccaccauccaccuuacagggcagaggggcuagaggcgcacuacaguagcagaacacucaccuagcgugugugccgcucuggauucgacccaccaacacguaaauaaaauaaaaugaugcggugaaggaacauaccugucuucaaaguguccccuaaugcuaggccaaaggcugaucuguccucaaguuaaaagggagucccaucuaaggucaaaaaccuaucucccuuuaagucgggggguguuucacuaccaccaccaccacugcccugcacauagggaauguuuccggugcccucuauccuucuccccucuccucuagagguagguugcaccuggcaaguccagcccaccuaaucuaaggccucagcucgcuuccaggcccaaaccccuacagaagugccaacacucacgaucaucuucuuauagagaccauaaugcaggacuaggcuaugagucaaugccaggcgaugagguuucauuggguguccagcuccugagggugggaagaaaagaguuggucaguccuuaccccuagaguugcagcccuugccgcagaaccucuccucccgcacaacccugagcccuaccauaguggaaguugcccacaucggggucguagaaauacgccacggucuuggccauggugcuggggggaccaggccccgagccucagcugcccgcccgcccgccaccggacgacagccccacccccgccgug

SEQ ID NO: 8895 - RNA, 11471 nt, Mus musculus
cagcuggcggcgcgcgcaccccgugaccgguggccacgugacgcucgcgggccgggccgcuagugcuguagcugcugcagccgcgggaagccugcgaguaagugggagcgacccggcgggauccccccgacccucgauccuaggucauggcgggccugaggggcgacgcgagcgcagucugggugggggacgccgggccgggcugcgcggguggacggcgaaucguugcccucccugcucggggcuaccuguaucccucgguguuugggggaaacuaaggacccuggaagcucuagcaagcugggagagcgggaaguaccccaccucuccccgugccucgccaccuccaucucuaagugccccgaggugacccugacgcaccucugguauagaagggagcgggaggcagaggaccugccguaggugaggaugaggaugugggcaggaccaggcccagcugcuaggugacaguggcccgccgacuuuaugcuauguaguucaacgugcugucgugaaaacgagaaggcagguacugccgaggccaauuuuaugcaggaaggaacgggcccagaaaauccuggugcuuuguaagguccuccccagccaaggacugaccccacaguacccaguaccgccuccuggugguuggcggggacacgcggcccagccuguucugugcgcuaggagaaggcuguugcuuggcuaaaaggacuuugucccaguccccagccuucucagccccugccuucccccuaauucaauuuguuaucucuacacuacaggucuagcgaugaagcucauuauccuggaacacuauucccaggccagugagugggcggccaaguauauuaggaaccguaucauccaguuuaacccagggccugacaaguacuucacccuggggcuccccacugguaugcugugggaaagagagggugguggguagggcgguuccaauugggagaaaauaaaggggguuuacaggagcagaacauaacaggugaucaaaacaaaguaaucacaauuaaagaggggaggggauugguucauagaaccuuuggagacaaagggaggguugcaaaaugguuguaaauaacuuuuugaaauaaagguacgauugccauuccuggaacaggcaguaaagaaccagcccuaguuaaaguugcaggugagguauagcccaguccuugaaaaacagagguuuaauuaucaacaagaagcagagguuaaauccuaacucaggccuguucucugcauguagaagguacuagcucagcccugcucauaggagaacugagaaguuaaccauucagauacuuuucuauaaagcuuaauugauuauaaaguccaauugucgucugaaaaaaaaaaaaaaaggucugaauguuagccuuuacaggaagauauuuuugcucagugccucaaaaaaguauccuaaauauuucuuucacaaguggggagauggaucuuggugguuuugucugcccauccacuguaaagaggccuucagacuuuugcaguaaauauuucaggcuccacuauuguagcuccucauuuugccauuguagggaggugauauauagccacaggugauaauauauguggaugaguguggcuaugugucaauaagacuuuauuuauagacacugaaguuugagcguccauaauuuucauguuaugaaauauucuuuggauuaaaaaaauuuuuuuuaacaacuucaaaaccauucugguggcucagcaguuaaaagcacugccggcuggucuugcagagggcuugaguugaguuccuguaucagucccccagcuaucuguaacuccaguuccagauagugugaagcccucuucuggagucugcagacaccugcauucacgugcauagucucacacauaguuaaaaaggacauuuuuuuguuuuguuuugagacacagucuuacucgguaaccuuggcuuggagcugccuguguagaccagacugggcucaaacucagaagugcaccuucauugcuccccagugcuaggauuaacggugugcacuaccacacccggcaagugaagcuuucuagccgcuuagccaccucuccagccccacucagcagguaccagcauagugguacugucccugcuguacaccaaacauuaagguucuggggauauagcaacaacauucaaaaaaaagcauaaagaccuacuuuuuaaaaauauuuacuauauuuauaugaguacacuguagcuguuuucagacacaccagaagaagguaucaaauucuauuacagaugauugugagccacgaugggguugcugagauuugaacucaggaccucuggaagagcagucagugcucuuaacugcugagccaucucucccgccuaaaugccugcuacuuuuuuuuguuuuguuuuguuuuucaagacaggguuucucuguuuagcccuggcuguccuggaacucacuuuguagaccaggcuagccuugaacucagaaauccaccugcuucugccucccgagugcugggauuaaaggcgugcgccaccaccgcccggcuaaaugccuacuucuuaaagcuucaauuauagugggaaagacagaguaagcaaguuaguuagugaaauguggaguauguuagaaggcaacaggagaaaggcugggagugugggggagcuggggcagauguaauggcagagaaggucucugagaaaaaggcacugagggaagaccuaaagaagugaccugaaggaagagcauggccugccaagaggacaguggugcagaggccuugagguaaagcccaggacaguuggagcagccuuugugggauuauauuuaucaggcagaaggaggacaccauuagguuuugaaaagaaugauggucucggcuggaugaggguaaguucgaaaguuucagccauucagaacugacauccacaguauaacaccguuugucuagauucgccaguuaaucucuugguacauuugcacuuuucucuggcuauuguucucugucuagccuuguaguuuguuguuggaaucccacgaaguagguucugggcauccugacacuuuaaauccugcagcccuaaccucucaaugaggacaucugucccccauaaccacuauaggcccgaggacaggucugccacaggaugucugucggcaguaucaucucauacgcagccuauauugggaagcuuucccuuaagucuaccuuaaucguguuuggggugcuaguguuuauuuccuucuccuuguuucuacaccugacuaaggacuauuccugcgucuuuaagccccccuucaccaccacaccccaucuuggaagguuagucuuaaauuaagccacucuccagucuguguucucuuuugggcccaucacugagcugcacccaccggugguucagcucuuuagacuuacucccuguguccuuccugccuuuugucugcuuaccugcucccgaggcuccacucugcuguugcucugauaagacuucccugaacuuggaagcacaaggugugacccugccaccgcuuacaucuucgcuguguccccaugucuauagagucucuucuaggcugguugucucugucuucccaucuacagacagcccugugccuugggccuagucaaaggcuucuagaauaucacaucgguaaucaagucuggcacucaggcagaugcuaacccgugacuucugucagcuguguggcuggccccgggagacccucagaguccuguccccuagagcagaagagucuagugggcauuagacaccaagcacggaguagguaggugguggguggggcuggagcuuaggugagacuucuuggugucuggaagcugaaggauguuugugguuguggugacgucguuccuauugcgucucacagggagcaccccgcuuggcugcuaccagaagcugaucgaguacuauaagaauggggaccuguccuuucaauaugugaaaaccuucaacauggacgaguaugugggugagugccuuucauguuccuccucucaggggcucagccuuggagaggaauggcuuauuggugcuugcccagcuauaaacuggugcuuauguuacaguagugcuaaaggaugauugagacagacccuucuugugcuuugcacacauuuuagagaacacuugcuaaauacgaaggugcucuucccccucugcuugguccccagcuccacgccauuccucucugcaaauucgauccugggauccagguucuacgucuggacugugucgucgcucugccaggcacccuugguggaagcugggacuugugcccuugguuaucuccucugucacccaaucauuuugugacgguuucauuuuaauuauuaaaaaaaaaaaauagaaaccugguaaaauacauaaacauuuaccaucuucaaaacuggguauuuugaaauagccaaaccacugggguccggggaaaagguugauaaggcaggggagauucuguuaguccaaggaauggggggcaccugggaaacacaggcauuuuugucuaaaaagcuuaaaaaucaaggcuggagagaugguccaguggugaggaacacacacuggcuuuaaguccagcacuacaaagacagaaguuggaagguguuuucaaggucucagugacaccaagccagccuguagcaaguuccgggauagccaggacuccauagagacccugucucaaccccauucccucccagaaaaagaacacacacuguucuugcauagaacacaaccucacuucccagcacccaccucaggcggccaccucuuaacucucgcuccagagauccagcacccucuugugaccuccaagggcacuccacucccagcccaacuacaacagacaucuuuuucuugagcacuuuuuaucgaacaguucaagugucuucacggcacccugagacuccuguccagaacuaucaaccacccucagccugccaggcuguggcuuccugucagacagcucccugguucccccucuuucaaagugcuggaaaccacuguuugacccugguccccagaaucucaccuuuccagggucuucauacgagucaggucauuaauguguucguuuggcucuuuguuacuuguaauuggauguuggguagcauguugucagggcucaucccuguguggcaugcagcagaaugcuuuucuuucucuuucugguuuucugaggugggcgcuuucuguguagcugagguugggcuggaacuugugacccucccacuucaccucucagguccugccugggauugcaaguguguacuucuguacacagcaguuucuuucaguuuaaagacuaauguauuuuaaaaaguaaauuguguguguguguguguguguguguguguguguguguguguguauaccagaggauugcuugcuggagucuguccuaccauauagaucguagagaucaggccaucaggcuggugguaagugccuuuaaccacugagccaucuugccauaccugcuuuuaaauauguuuugagacaaauuuuccuuuccuuugagcauagcuaaagauugaccuacaugucagggcagucucccaagugacccuaaagccaguuugaucuccuggcauucuccuugggaggagggcucugaaucagucucagcugagugagugucuccugaccccacaggucuuccucgagaccacccagagaguuaccacuccuucauguggaauaauuucuucaagcacauugacauccacccugaaaacacccacauuuuggauggaaaugcggcugaccugcaggccgagugugacgccuuugaggagaagauccaggcugccggagggaucgaacucuuugucggagguaagcauggcacguuccacgguguguauccgggcccaugccuggagugacugcaguacgugggcaggagaacaugccacgccuucuucacuuggucccuuagugcuaacacagcagagucauccaucacuaugcgggacaggaaaggcauagagugggagcccuggauccugccucagcccuucugcucuggagcugugugaccaagauagcuucuucaugcacucagugccuugcagagguuuggauuuggauccugauguccucaagacuaccugaccagacauccauguaacucagcuaaacauuuaaaguccuagacuccaguuucaaaacacaacgugcaguccuugugugcgguuuaucaguugaaccccagggaagcauggagagaaggugggaaccugggugucugcuucuugggugcugacagugucgaugugcugucauguugggagucaccuuggguuuaaaccuggaugguaucuuacuccuuaaccuaacccucauaagagaagaaggagggcuggacauuguggcaacaucuuuaaucccagcacuuggaagguggaggcagguggaucucugagcuccagcacugccagggcuauauaauagacucugcccuuauuuaaaagaaggaaauaaagaaaauaguaaggaggagugaggagcuugcagguccugaggcugagguuuguuugcuggguuccaccucuggggaggaggggagaagguguacugccccacaguguggggugagagggacgcgaccuuucacaguucugcgcugucugagggugcaagcaagucaccagagccuuguguguggcucaagucucagagauggggagggaggucacgugcuugaggaagaucugaccuaguguccaaugagaagaaaugcgguuuucaaggacccuuuuccaagcagaggacacgaucuguuguugaagguuuuggucccuguaacucacagagcuacucugccgucugcgcaggcauuggccccgauggacacauugccuucaaugagccaggcuccagccugguguccaggacccgugugaagacucuggcuauggacaccauccuggccaacgcuagguucuuugauggugaucuugccaaggugcccaccauggcccugacagugggggucggcacugucauggaugcuaaagagguaaacguccaaggauacauucuuacuaaagcugaacucuugauaaauaaagccaaacuccuagcuagucuuggccccgcuccuccuccgcuuuuggaggugaggucauuccuggggugagggcaagucugugagcauccgucugugccuuagggccagggccuaggcugucugucucugcuuguguacccuuuucauacagccugugggauggaggaauaagacuuuguaccugccucuguucugagcagacacguuggucccugcggucgguuugaaaguaugcauccugaaacccaaggaugccgugucagcagcccugugcuugagggcagugagugcaguaaauugucacuaaauguuuuggacuggguuuagugagguuuuucccuaaaaagucagauaugauuuuauuuuauuuuuuugugguuccaguuuccuuacugucugaauuuuacuuuuauuuuucaaaaucauauuucucaugcacaucugcauguguguguguauauauguguaugaaaaugcaugucacagcacucucagggagcucauagggaacuugugagucauuuucuccuccauggagaucgucaggcuuggcugcaagcaccuuuccuugcugagccauucacuggccuauguguuugaauuuugaagcauuuuuuuguuuuucugggguauugcacucagggggaaauggcuguagauguuuacuuuccaauuucuuugcucaaguucauaaguaagcauauaaaucaguggagagguaaacuucagugaauuaaugguaccuggauuuccaccggguggcugaauccaucccucagggucugcuuguaucuugaaagcaugagaguuugcaggcccgccguaacagggagggcaucugaucuggaaauggaacaaaggccagaaguaguuagagcuuuagucaccucccugugccucuguguucaguccguugagacaagagcaguaaugccuuccuuucaucccagcacucaggagacagaggcaggcagaucucgaguucuaggccagccagaccccaucucagauugcccacuccauggguggggagugggggacucagaugagaggacagucuguagagugaguucuuagggucaccucagcaccucugcuccugguguccuagcuccaguggggccaugccuuugcuuucuauaaauagagaacacugcauggagccacaguaguacuugcaaugcugugauccugaaggagagcugacaagggcagcuuuucugagccugcaucccugccuguugucugauccccaggugaugauccucaucacaggcgcucacaaggccuuugcucuguacaaagccaucgaggagggcgugaaccacauguggacgguguccgccuuucagcagcacccccgcacuguguuugugugugacgaggacgccaccuuggaacuaaaagugaagacagucaaauauuucaaaggugaggcucaggccuuggugggagggaggcauggaucuggcuuucuagguuuuauuucauuuuuauauaauugagucaaggucucacuguguaucucuggcugaccuggaacuagcuuugaagauucacagaaaaucaccugccucugccuacugagugcugggauuaauguguacaacacugcacucagcaccuguuuuauuuuuuauuuuuauagccuccaccaugcccagcuauucuggacauuuuaauccacaccuaucguguguguguguguguguguguguguguguguguguacucgcgcuaugguauauaugugaaggucagagggcaaguuuggaguugguucuuuccaccaacuuuguauggguucuggggcucaaacuuggguagccaggauuguacagcaagcgccuuuacccauugggccagcauccuacccaccaccugugacuucccccuacugcuccaugauacggccauucccuuuucugccacgacuggaagggucuguuucuggagaucugaggagacaaggaaaugcaguuacaggucacuaacuguagggcuguggugaccuugcaagacauggagccuugaguuuccugucagacaucacgcaggcaucucucccacagcuggggcacuaagccagcccuguggggcaucuuuaguuccuuuacaaggugccugcuaggagaguugaggauacauuuucuagaaugccugcccaguaauuguaaaacccuaguuuuaagccaacuuacauugcagucuucauuggcuaagcaguuaaauuaguuugcccuuugcuaaaaagaugaauauuuccuguuuuuuuuaaaaaagauuuauuuauuuuauguaugugagaguacacuguagcuguacagaugguugugagccuucaugugguuguugggaauugaauuuuuaagaccucuguccugcucacucuggucaauucugcuuguuccagcccaaagauuuauauauuauuauauguaaguacacuguagcuggcuucagacacaccagaagagggcgucagaucucauuaugggugguugugagccaccaugugguugcugggauuugaacuuaggaccuuuggaagggcagucagugcucuuacccgcugaggcaucucgccagcccauauuuccuguuuuuuaagacaggguuucucuguguagcccuggcuguccuggaacucacucuguagaccagcuggucuugaacucggggaucugcccaacucugccucccaaauggugggauuaaaggcgugcaccaccacacuuagcucaaaaagauuaaucuuuacuccauucccauaguggcaggguugacagagggggaacucugucacuccccagaaacuaacaguguuuaguguuuagagaucacagagaucgagggcugcucugagccacuguguuccucuugauaacugugcaguuuugccucugccuacuuugaccacugcuugcuuuacauuuguugcagguuuaaugcuuguucauaacaagcugguggacccccuguacaguaucaaggagaaggaaauucagaaaagccaaucugcgaagaagccauacagugacuagccugugccaggacgugguauucaguaccucagagggauaggcaggucuuuccagaaagucucuguaggagagagaguagaauuacuuuucaguccacucuggcugcugcagaucuguggcuugguagauacauguuaaggaguuuggcuauggagaacauuguugauuauaauuuuccccuuuuuuuuucaguacugggggcugaaccuggggccuuguacaugccaaggaggugccuugcuaacugagcuauguccccaacuuucugccccuuuucauaaugguuuuguaaccauccgaagucuccaucacugacuguaauuauauucuucugccccugugcacaugggcagcacacgccugucgagaacuccugucuguaugugugcuuuuucuagaguuggcagggauuagggcuugugcacuuuggacauaaccuuucuggagacuugagagccccucuucugccagccuucccacugagaauuuucauuuuaaagaauacacuuccagaacuugaauuaugcacaaggaagcagcccuuccugccagaaccaagaaccugggggagaagccugucccuuguucccauuguguggauugucuuuccuguugucaguagcuagccuuucuguaaacaggccuucugggcauguggggcuaagauggcuuucacagguaaacucaaagcuuccaaaggccagccuugucuuguucucucucaagauuccaacaagagaaaaguggaaaggccuccugucugagcucuguuuuccucaacagauucuuacacacucccuaguaaggagauccgcgugggucacagacacgcuaugauuucaguguuuuuacccaagguggggagcugacaucugcacaugcgcugugcucuguggccuccucagagcugagugccaagauuauacaugcuacugcucucuccucgcuuaacucaccccagcacucccaccuucggguuuauauccucuguccucagcaucagaacuaaacccuucaccccccuguccuucaggcucccuucccaggcuccucugcuuggccuugcuuuaucuucucugccucuguggaguagucagcugccuccuucuccguccuugugccugucugaagcuagagcugccuauuuccaggagaggucuuucagaacauugcccaggccccuccagaaguacuguguuugguaccagcauuuguuuguaguuuuuauaugugauugugcuauuguucuguguuaagcuaauggaucaauggacuuguuuacaaugugauauuuucuauuaaauuuaauauuuucaaauaaaaugugucuuuugugaau

SEQ ID NO: 8896 - RNA, 1388 nt, Mus musculus
uaagaccuugguauuccguccuuugaguuacaguggggacaacugggagagggaagagcugggagagggaucacuggaagucuaguccacuuaguucuuguauuggaaggguucaucaccuguuucguugaggagacacgugcggacgauggcuucugucaccgcauaggggucacaguuggcagaaggccgacugucuucaaaauagcccuucuucucuuggccgacaguccagggaaugcagaugcuggcacugcgguuggcaacaccagcagaaaacucguugauguuggagguuucauggaauccagucagaugccgggcguuguccaggccucccuuggggucguaggcacggaugugguacuggugccucuugcucaguuugucaauggccuccucaaugcacuuuagaucguucuccuccugcauggccuuggugcugaaguugguauggcaguucccuggaaugggcuugggguuaaagguugcuaucaccccaaagucuucgcagaccugauacaagauaaaacgggcuauccaaagaugaucucccauuuggauccccacacaggauccuaucuggaauucccacugggcaggcauaaccuccgcauuugucccggggaucuugacuccggcauacaagcaggcccgguagugagccuccacgaugucccugccauaggucuugucugaguaguaauacgggccuugggguccagggaagccauuggaaggccaaccaaacagguggccgucuguucccaugagaguauauuccugcuccauuccaaaccaagggugcugguugcucaccauguccauuauccguuuacagaugugccucaaguuggucucugcaggcuuccgauuauacuugaaaacuucacauagcaccagcuuguuggggucuuugcagaagggguccugaaacauggcaacaggauggagauauaugucgcuguuggagccuucagacugaaagguacuagagccaucaaaguuccacucagguaacucuuccacacacuugggcucacaguccaggguacagguuuugcagcacaguccuucuccgguaccaucaacccagauauacauggcuuggauuuucucacccuggggcagggacauguacauuuacuugaugccuuuguucacgugggagcuugcugagguggccaugguggaagguguucagagcgguggcuggccggaugauggauggaugaacaggcuacgagagcgaggcgaagaguggagaggagaugggugugcugcucagacacucugcucuacucccauucucggcucugcaguuugguguuauuauuaaugaagcuaugauaacaaguuuguauuuuuggugcuuagagagcaccacg

SEQ ID NO: 8897 - RNA, 1388 nt, Mus musculus
cguggugcucucuaagcaccaaaaauacaaacuuguuaucauagcuucauuaauaauaacaccaaacugcagagccgagaaugggaguagagcagagugucugagcagcacacccaucuccucuccacucuucgccucgcucucguagccuguucauccauccaucauccggccagccaccgcucugaacaccuuccaccauggccaccucagcaagcucccacgugaacaaaggcaucaaguaaauguacaugucccugccccagggugagaaaauccaagccauguauaucuggguugaugguaccggagaaggacugugcugcaaaaccuguacccuggacugugagcccaaguguguggaagaguuaccugaguggaacuuugauggcucuaguaccuuucagucugaaggcuccaacagcgacauauaucuccauccuguugccauguuucaggaccccuucugcaaagaccccaacaagcuggugcuaugugaaguuuucaaguauaaucggaagccugcagagaccaacuugaggcacaucuguaaacggauaauggacauggugagcaaccagcacccuugguuuggaauggagcaggaauauacucucaugggaacagacggccaccuguuugguuggccuuccaauggcuucccuggaccccaaggcccguauuacuacucagacaagaccuauggcagggacaucguggaggcucacuaccgggccugcuuguaugccggagucaagauccccgggacaaaugcggagguuaugccugcccagugggaauuccagauaggauccuguguggggauccaaaugggagaucaucuuuggauagcccguuuuaucuuguaucaggucugcgaagacuuuggggugauagcaaccuuuaaccccaagcccauuccagggaacugccauaccaacuucagcaccaaggccaugcaggaggagaacgaucuaaagugcauugaggaggccauugacaaacugagcaagaggcaccaguaccacauccgugccuacgaccccaagggaggccuggacaacgcccggcaucugacuggauuccaugaaaccuccaacaucaacgaguuuucugcugguguugccaaccgcagugccagcaucugcauucccuggacugucggccaagagaagaagggcuauuuugaagacagucggccuucugccaacugugaccccuaugcggugacagaagccaucguccgcacgugucuccucaacgaaacaggugaugaacccuuccaauacaagaacuaaguggacuagacuuccagugaucccucucccagcucuucccucucccaguuguccccacuguaacucaaaggacggaauaccaaggucuua

SEQ ID NO: 8898 - RNA, 1984 nt, Mus musculus
gagaaguucguucagggugcucagcugguuccuggagaggucuucccuuucuugcuugcuugucgacgguaagcaagccuuugccuggcaaagagcgaucugccucuuuuuauaaaggugucacccagggugaaccccacuaaucccaugaccuccucacaggcgcugucuccaaaugcagcuacaccagguggcuacagcuuuucacuuccgaguuuggagagaccgugauucagcccacagcacucaagugugauuggaguauucgaaggacagugagggaaacaggaccacacaugauggcucuucaagucccacucagagaaugcguggugggcaggccuggggggagggcacgcggagggcuggggaucucucucuguuuuccacaaacucaguauguccggucacaaaccaggaacuccuaaacugagcugcaauugugguugagagagagagagagagagagagagagagaaccccguucuugcagugaguguagaguaauugaggggaagccagggugacugcagcccgcagauagaaugucaccucuagugagcaucuccaucuuccuguuuucacaagggaaggugagcacuuuaaagccagauaugugguuuucgucucuggcugccaacaagcuuuacaggauucaaagcuuacggucaguggugagcggugcuuugaaacugaccaguuaggcuugaaucuuguggcuagguuaggggugauaggucuuuugaagauuuuagccccaaggaccuuucaagacaagaagcagaaaaaaacuucauuuuccaaggacugauguucugucuucacugagccuuguccaaaagccaccacucaucagcugagccaccuuugggcaguaacuuacccucucggggcuguucccuuaaucuuaagaguggguuaacaggggcuggagagauggcucagugguuaagagcacugacugcucuucuaaaaggucgugaguucaaaucccagcaaccauaugguggcucacaaccauccguaaugagaucugacacccucuucuggugugucugaagacagcuacaguguacuuagauauaauaauaaauaaaucuuaaaaaaaaaaaaaagaguggguuaacagugugauuuccaagaaucugaagggcuucacuuuagaaagagcucggaauauggagugccugcuuacuaaggccagaggggucagaguucuuauauccauucggacuuuuuagaauccaccuucucuuuucugcaagaugcuauagagacccagcaaagggaggcuagagagacggcuccguguuaagaucacuuaaugcucucccagaggaccugaguucgguucccagagcuuacuccaggguucacaacugccuggaccuucaacuccagggcaucuaaacccacugcccucuucuggcccucacagguauguacacaaugugacauauacucacagacacauguauguacagcuaaaaacacagaaaucuaggaacgggaucaguccuugagauuuaauacacaaaggguauauacguguauguguguguguguguguguguguguguguguguguguguaagagagaaguaacuguugggcaucucuccccaguuguuguccaccuaguuuacuuuuaaguuuuguuuuguguaugguguuugcacaccuguguauagacagacgcaggagcacaggccaaaggagggcauuggguguuacccucggcuuuauuccuuugaaacaaagucucucccugaaccugaagcuuuuuuuuuuuuucagcuagacugacagcuuacgagucacagcaguccuccuguucccgcuccccacagaccugcagcuacaggcccacuggagaccauguccagcuugcuaccugggugcugagauuugaacccagguccucaugguugugcugcaagggcucucagccaucucucaguccuccaagagaaaaauuuaaaag

SEQ ID NO: 8899 - RNA, 6287 nt, Mus musculus
aaacugacuuuaugccucccucauauaaguccgcuggagaggugguaaauggcucaagaggucuuuuccagguaagcaagauuuuguugucuucuacaaauuauuuuguaauccucccaacacaggcucuccuuucugcacugacguugaccuuauuaccuuggaaaagucaacacaaaucuaugcucuagugcauuucagacacaggagucugguuuuguucugaagguaccacccuaccccgccccaauugccuacaagguuuagcuuuuggucacuguuuuauuauuuucacauuucuuuaguuuggucuggguuuuguuuuuuucaaaacaggguucuucuguguagcccuagcuguccugaaacuuacuuuguagaucaggcugaccucaaacucagaaaucugccugccucuucuuccugagugccgggauuaaagguguguaugucaccauguccagccagucacuguucuauugaugugaggagacaccaugacuaaggcaacauauaaaagaaagcauguaaugggggcuugcuuacagaguuaguccaugaccgucaugguaggugguaagugauuucuccacgagugaaaugagccaauccaaaccagauuagaauauauacauaaagguagauuuauugggaaacugcucuugagaaaguuugcuggucccaaggaaccaggcuagggauauggccauaggaagggagacaaaggggaggggaggggggaaagaaagagaaaaagcagagagagagagagagagagagagagggaaaggggagagagggagagggaggaagggagagaccaaaaugucuguaaaauaugcacuucagcuguuugucagagucugaaucccaacaguaggaaaagcagaggcaggcaggcaggcagacauagcgcuggagcauaagcugaaauucacgucugauuggaaaguggcagguagaaaaagauugacacuaggccuggugagggcuuugaaaccucaaaggccaccccucccacacaucccagugacacaagaccucuagcaaggucauacuuccuccuaauccuucuuaaacaguuuaaccaggaaacaggcagucaaacauaugagccuaugguaggcccuugcuaagauccacuuccucuuguuaguucaaccaucuuuaugaccuuggccaaauggguucauaaggaacgaaacaggcagaauuccaucacaacuaauuuugcuugucacuuaaaagucuuacaggauaaguaucauaucugcaggcuacaguaaaaugcagccagaacaaagaaggcaaugcaugcacauucgaauucuauuccuucccccaugucuuaguuugggguuucuauugcuauaaagagacaccaugaccgugucaagucuuauaaaggaaaacguuucacugacuggcuuaccguucagagguucaguccaucaucaccauagagaugugcaggcagacauggggcugggcagggagcugagaguucuacaucugggucaucacaggcagcuggaagagcaccggagccacugggccuggcuugagcaccugaaaccucaaagcccacccccaaggauacacuuccuccaacaaggccacacccacuccaauaaggccacaccucuuaauagugccgcccccccucugggccuguaggagccaugcuuauugaaacuaccacagcuucucuucugugguugcuuagguuggaggaaagcuugagcuuuggaucuagggaacgggacaguuaagacggagcaggucccagcucucagccagagagcacauuccccauagcaaacuucgggagcaaugaacuuccuuccuucagaggcucacggaggggguugggagaugggacaaguucugggacccugggauucucugcugaaggugggauucgucugauuugcuggcuccuccuuugauucaggggcgguggauguucacaaggacguagcaagccauuuaaaaaguguuuucuccugcacaguugacucuaaggcaguacuuccuggcacgcuucaugcacugucggacuauugaauggcucgcugggaaccaaggcugggcuuuggagagguugcucagugguucaguuuccccagugcacacgaggccuugugcucaguguuugcaucgcaagcacucggaaaaaaggaauagaacauaacgcuuggggcugguuaccgugguacacgccuauaauccuaguacuuggaggcugaaggaggagcgugaguuugaagccugggcaauauagcaaccucagaaccauuuagagauguauaaggagaacaugugcacagagaggugguaagucagagagaaagaggagaaggaagaggagaaagagaugaggaaaccuuucccaagcuaguagacuggggagcacaagccuccccccacaccuuuucccuggcuacaccaugcaccccccagaccucacccccgaaucaggaccgaaaggaacagucacaaggaaaguguuacccuugacuguucuaucgggagugagaauuuggggucaccagauauugacauauuugguccacaaaauggcacacugaaaaaguuaugguugucuguaugaguguggccucuguaucuaaaagaaaaaaauaagagaacauacuguuuuaagaaauuaaaugacaagguuucucuaugagacaaggauucucuguguagcccuagcuauccugguaacucuguagaccaggcuggccuugaacucacagaccuuauaugacuggaaugcugagauaaaaggcauucaccagcacagccuggccuuaaaauuuuuauaauuaauuuaaucuuccuaucuaaagugaaauuugacucugauaaaccaaaaaaaaaaaaaaaaucaaacaaaaguaugauaagccuauagaaggggaaaaaggcauaauuaaaugaauuaccuuaaauucaacagugucuacuacaaacuccuuuuauugguccaacuagucgaugguauuuauauauuuagguuugcgagacaagguuucacucuguagaccaagcaaggcuugaacucagagauccaccuaucucugccucccaagugcuaggauuaaaggauugcaccaccaccgcccggcaaugauguuuauuccucaaggcugaguuuuccugccuguggguuaaauaugucacccagaaauucucaggauguacguaugcacauacucaagcccauaugugugcaccugcaugcacucacugcaaacgcuagagaccccagauguuaaaaauggguguuucuuucuuaauuuucagugaguuuccauugacccaauccaagauuuuguugucaguccuacaugugaaaaguaagacacuacuagccuuacucucagggugagcucugaagaggaagcugugaggaaugauuuuggaacccuuugcaaacauugacccaagggcauaaaaggaagagacugaguuagagauuaccagccgcuccucuggagaaaaacaauugaguuugacauuccucacugcuguucacaauucagacuuagcuagaaaguugauuguagaggaaggaaaggaggaacccacccuuuccugcccaaaggauuaugggaggagagcaagugucagcagaaucuagacuagagguaaggacagauucucaggacaacagggcagcagggcagcagggcagcagguaggccaggagaggaaaacacggcaaagaggauuuguagcuuagcaagaugucaguccagcagacagccaaggcacgaggucucaggagagggccuccaccagugccuucuugucauugaguuaaaagcuaauggcgacugcacuccuacccacugugggagggaagcugcaggggacaggggugggcugagcugauaggaauggacuccauucauagcugcagaagaugcagcagacacagggguagaccauggauagauuccugauaccagccaucucucacccaagguagaaagaccaugaauuguugggguuuggucuguugcuauguccacaaaugcugaauucucagccccaagaucugguugcuguccagacagaugacuguguuuucacagacacuggccuguguuguguaaaccuugugccccaauguaaagccgacugguuaauaaaagacuagcggcugugacugggcaguagacagagaaagguggggcucgaggauggagugaagggggcucaggagagaccagggggagaaggaagaagauggaaggccaucaugagaggagauggaccgugagcauguggccaggacaggcagaugggacagaggcagcccaggcgagacuccaacagcaaguaccaaggggcacaugguuuggauacagguuagaacagcauagaacccgcccgccuaggcuaagaacuuguaaacaaaauaccagguuucugugucuguuauaccggcuagcuagaguaagugauuccuuuacacuccccuagaugcugugaguucucacaggugccuccccugcacacuguucagauaagcugagucuagucugaagggugaucucuugggguguugcaguugcuggcuguguuugcucuuccuguuucucagcaaguagaaguagggugggguuucaacccugacaggauggacccuacaagaaagucugaacaaaaucccaugguucuguuaccaacuagugugauacugcuuucuaugaaaucaugcuaccucgggacagaaugcagugagcuaacccgucuaccagaaugaaacagaguagccuaggaauaagacauuguuucuauacauagggaauugcuuauuuuaauaggauguuuuuauucuggaacaaauugucaagggauaggucaguggcuucccagugccaggugggugagugucuuaggguuacuguugcuaugaagaaacacgaugaucaaaagcaaguuggggagcuuacacugacacauaguaguccaucacugaaggaagucaggacaaggacacaagcaggucuggagccugaggacaggaguugacgcagaggccauggaggagugcugcuuacuggcuugcuccccguggcuugcucagccugcuuccuuauagaaccuaggaccacagcccagggguggucccacccacaaugggcugucuucuguccucaaucacuaaguaaagaaaugccuuauaggcagaucuuacgggacauuuucucaauugaggcucccuccuuucagauaacuccagcuugugucauaaaacaaaacaagacagaacagaacaaaacaaacaaaaacaacccagcacaguaggccuuggcuuuccucagagccugggcacagaaaucaggagcuccuggguaugaaugcauguugucuacuacaucgcaccuugugaccuugagcuugcuaucucugagcaugugcuauaggacagggcuucgugcuacugacagggcucuugggagagcagaguacagcuaaggaagcaggcggguauaaaccccuggcuccugaacacaacagugaucagccugcuugcuaguauggaaggauuguuacaauguacacccccauucccuucuuuuuacuguacuauaggacgugugacugccgagugcauuaaaaacaaaacaaaacaaaaaaacccaaaguagacugucuaugcucaaggucaccuucauaguguaagccccacacuguuccgacugacagcccuaggcuggcaccaguguuccuuggggacugugcuaagcccuugcacugccaacccuguauccccagaggccagcuugaagccuggaauacagcaggcuccaugaguuccuccccugagcucugcaagccucccuagugacaccucgcuuuuguucacaggguuuccuggccucuucuuucaggggcaucuucagagucagagcagugagccaaccgugaugguuacgaggcuucaacuuuauuuuuagaaacuguuggacauuuggagcccagauaggaaaaaaggagaaagaaaaaaaaaaaaaaagcggucaaagggaacgugucagauaaugcugaguaagaccauuuuuggucacaagaaggagcaucggaggcccugugaacggaggacucuggcaggaaugaacaccaagugugucuaacucacuggaacugguggucacucaucugcagucaccacaccagcugccagaggugcuucccuaaugagggggcccgucaccgugguaaaaagaaagcuaauaauugucuucuuuuaaagaauuuauuuuuac

SEQ ID NO: 8900 - RNA, 1449 nt, Mus musculus
acccgaaguggccucaggaucuauguuacagaugugaagguaguccacaccuccggcagcuuccggcuaccagggauaguuagauugcauaagcagguguccgagcaaaguccaagagguuaaugacgaacgacucuacuuuaucuguggccagggagguggacucggcacugucagcaccaggcaaacacacagcaaagcauuucccaagagagauaagucagagagaggugugccugcuagaaagcuggcccuuuuccuggggcugucugcugcuuucccaggaauuggccuuaucugggcacaguaaucacccucugcgccccuggcuugcuuaggugagcuaacaguacucuaaacaaaagaaacacccagacauuuacauuucuucugaaaucugguaaaaggucaggcaauucucccaaaucaugaacuaagccugacauguaaguuagaggggcuuagcaugcaagaccuuggguucaaacccuagaaccaucagaaaaggaucacauuucccaucugaagucaaagcuuugaaagcugugacacugguuuccagacaugacauagagaagcauuuauuuaaaggucauacucccauuauucucacuuuugggucuagaauuuucccagugauaaaacaucugcagaaauagauacuuccuaguguguuacaugguuugggaugccgucccaacagacagacacaucauaguguuaucccaguaagacucuucaaaaugaacaggagaagagagcacugugcuuaaaaguuaagaagaaauaaaccagggcacccuuuguauguuccuguauauguugccauccuacccccagggaagcagaguuuguguucucuugcauaaaguaauguuccuuuucugguuuucugguuccucuguacgugugugcaugagggcauguguguguguguguaugugugugcgugcgugugugugugugugugugugugugcaugcgugugagggcaugucugugugugugugugcaugcguaugagggcguguguguguguguguguguguguguguguguguguguguaggggugauucuggauucuuuccucaguugcucucaaucuuacuuuuugagauggggucucacuaaacuuggcuggcagcaagccccagugguccuggcuucauuucuccagagcuggcauugcugugacauuacugugacuagugacagcugcuucuucuucuucuucuucuucuucuucuucuucuucuucuucuucuucuucuucuucuucuucuucuucuuaaacuucuucuucuucuccuucuccuucuccuccuucuccuccuucucuccuucucuccuccucuucuucuucuccuccuccuccuccucuucuuccuccuccuucuccuccuucucccucuccuucuucaggaagcucuuuacuaacugagccauc

SEQ ID NO: 8901 - RNA, 15506 nt, Mus musculus
accggcuagggcgccugcgcgggcgggcgugcccccggaagcaguuccucggccugugacacguagcaacagggcuaccgccgggucuggagcugaguuggagggguuacuaggggccgcuggagcuacagccguuacugccgccgccgccgccgccgccgccgaggcguuuggugagugucccggguccauguugcgcuuucggcuucuggcagcgguuguccgggccggcuuccuggucugucugcgcgggcuguggucucucucaacgcccccuacucccucuccagacccggagcugcgcggccccucguuuauauuuagcuggagcggcgccuacgcgugaccucgccucugccucaggccuaucggcucccccaguugccgagugucuucucggaccccagcuccccacccccaccccagaccacccccagaugcggacugcgguucccggcggaggguguuugcauaagcaaaggaccuugccauccaagguagacagugcuugccauccaucucucuucucuugcagaucguuggcaaugucaggcuuugauaacuuaaacagcgguuucuaccagacgaguuacagcaucgacgagcaaucucagcaguccuaugacuauggaggaaguggaggacccuacagcaaguaacuuuucaacuuugacaaccuacuuagucuguaauucacgaacgaguguguucuggaugcccggcucugccuuaaaaaaaaaaaaaaaaagaauauaugaacuuauuccuguucaggaaugcgauuuagugucauuuauccuggucuagagagagaagacauuugguuuuaguuugaagggguugcccugcuuaugauuuauuuccugaaaaagaaaaaucuucuaaugugucaaaaaaaaguaccuuguugaaauaauauuuacaaauagucuggaugggugcuucagcuaccuagaauauaaggcuauuuauucacaagaaaauuaaaaguuauucgauagcuuauuugaaucagcagauauuuaaagagcucagugacauggguuagcaguguaagcucaccauuaugagucaucuggugacugauaggacuauugauaaucuuuauuacuccucaugcugaaguauuaugguuaguacuagagaaguuaucaguuuugggcugaaaaagagaauucaaaaaaucuuagggucugaacuguuaaaaaaaauaagaucaucuauacuaucugguguuugggguaguuugaaaguuuucagucagucucuuucacauuaugucuuuagucuccuagaaugaugggacagaucuuaguggucgcucccuagaguggaggaguuuucaugugcuuaccccuuuuccugaugcucuuuaaucuuucugagacucucacagaaacaaugggcccauuucccagaaauguguggauacacucauacaugccaauacuagcaagcacauaacuugguacaauuuagaugucaucuguguacaucuauagaucuugaauucaggcuucauaaagaccgcucugggaugagagcaggggaaagcugugaguccagucaaucugaguuacaggcacugcuagaaugugcuugcaguaguguauguaagugaccgugccacagcuuuucuaagcacaaagaaaaugcaggcuguuuuuuguuuuuuuguuuuuuguuuuuaaauaucccauagauuauuugaaucuacuuaauuugagguauagauagauguaucuuccaauuuaaccuguugaugaaaggagugaguauauaaaaauauccucuauggguuagauuuuuuuucucucucaaccauaugccagggacaguuuauucugaauuaguuggacaggauuaaaaaucauacagagagaguuccuuucauuuaucaaaauacguauuuuagugagaguuuuguguacuuggaagcaaauaaaugugugaucagauuccaucuggaaaaucccuaaacaacagaauuuuugaagaaccugacacuauauguuagccuucuuuugaccaaauaaucuuuucucuuuagacuaauuagacaucuucuguuuagaaugcaguuucucaggcuaauuucuuuccagucuuauauccugaucauguuuuuguaacuuaaaugugugacuuguccccuccuuauaccaacaguuaugugacuuugcuuuucucauguagcuguuaugcacaaacccucuugcucaguguucaccugcuccuguucuaaccagcucauaugucaguaagcauugcuucauacugguagagauauuuuacauauccauagcuaucaaucagcuagcauagauacagguuuaugaauuaugccugagaaaguaaaagguaugaugcaguagcaacaauacuugugagguucccuagcuuucuuuuuuuuaaagauucauuuauuuauuguacguaguacacuguccaucagaucauauuacagaugguugugagcuaccaugugguugcugggaguugaacucaggaccucuggucaagcagucagcucagccacugagccaucucuccagcccaagguucccaagcuuuaugaaaaaauuagauuguuuugcuucuauaugugccugcaaguagaucugccaccuaauuguauuuuaaauauuaucucagcuuaccaacuuguauuuuauugguuuugcuuacuuguuaucaaaacucagugauaacuucaguuguuagggaaaaucuagguucauauaguuuaauaucuggauugccuuaaacuuugacguauugaccuuacuguucuaaaguugcccugugagguuagccuuuaccauuuuauggguuccucuuacugguauuucaccaugucaucugaguugauaccacgucauuuucuagauaugcccuuaaaauauauaguaauaccagucaguuauuuuaagaaacugagagcuguuacauuuuuacuuuuagcuuaucugauaauauuuuauaaaacauuuuuaugaccauaaguagacagccuauguugagauuuuaucuuugcuguugauacacagagauuaugacaguguugauguagcauaugcuacuugccugcaaugaaagcauuauuguaaaaauuaggcaugccacaacauaguuugguuugcaaccaacagugacucaaauuuucagaacaggucauggcaggacagugaaauaguaaaaucccaugucuuuuucacacugccuuuggauaccuuuggaugcccauccuugaaguuguugcuuacuguaccucuagcuuauaaucaguggcacucauuccaagaugcgccaugaaucuuaaggaauuuuuuagagagcuucuaaauucaaaaacaguuugugccuuucaaguaugucaauauuugcacauauguuauguugagaaaauaaggucugguccccgagucugaaucagggaacuaaugugauuuguuguugccauacacuugggaaaggggaguaaggugauuucauuuaagaauucccuccacugacacaggaagaacuguggcuguuauucaguccugacacuuuaauacacaucuuuuuaauauucugugucacagaacacaucucuuccauacugaaauugcacugucucuaggaagauacgcaugcuuaaguugcuagcugacccacuggcuuuucauggagacuauuuauuuaaaacaaaggacuuucugugauugguuagaauucugucuuucgcagauaaauuuuuaaaaauuagugaacuuuucauuucaagaaaaacagcugcuaguauuuaucacuagcuucaaguuuucagaccaaaaaguggggauuuuggaaaacuuuuguucaucaucuauagcuucguagcaaacaagcauuauuuuuuucccaaugaaauuagggacaauuuuaacaaguguuauuuucuaauguuuagaauaugauacauaugauacuaauauuuuaaaguagcaaguaguauuacaaauuauacaugagaauugcaacccauuuacaaagugcaagacagauuaauauauuuuaauguaacuagggcauaaaaaguuuauugaugcuauuucaaguuugcuauguugcaaauugaauuaaaaaaaacgacuuuugaguuuaaauauagcauuaaaaauacucaugcccagguauauuggugcacacugguagcacuagcaccugggaugcagguggaucugggaguucaaagcucgccuguucugaacagugagcuccagcucagcaaagggaucgucuucccuuuacaggacugaaaaggauauuauagcacucaguuuccaaucauaccuagucugcaacgcuagauuuucuucacguaccuugaccaacacaguaauaguaaaucacaacacacugaauaugaaaguagauuaaagaaaucuagcuauauaauuuaauuuuucuuaguaauuuuauuguaaauaguuuugucauuauguguaauauguuucaaguuacuucaaauaaauuuuuaagcauuugauuuccuugauaaauauugauaguuauaagucauaaaauacuuuggauuuccaguagauuuuuaagaauacaaaggggcuauaagacuagaguguuuuagaacugccaacuauacuauucuuucugguuucuuuuguauuucuucucuccaucucccugcuuuccccucaagaauaaacuauuuaaucagcuuguagaaaccucuuauggagauacuguagugaugucauggacucugguaagugcuaguagaugacacaacagcaugcucuccuaacucagaaaagaauuguuauccugcucaacuagcuggucccgaugaaggcuguucuuguguaagugggcaugcgcauaagaaaucagcaugucuguguuccagaaaagcuggaaaccugcagauagagaauauaauuuugaagccaucuguguaaagaaggauuuugaaaugacacuuauuaguuauuaaaaguugaugaucacuggaguuuaguagccuaguuuugaauccuggcaccacaguggcaaauuacuuuaacccaaauuugaguuuacauauccuuauaaugaagguaauagacucauuucauggggcuguaguuaguaauagacaauucgccuuaaacucuuacaaaauaguguuuugcacauaacacugaaagggaguguuuaggacauuugcaguaguuaagauauacuuccauauugcaauaacucauuuuagaguuagccaauugauuucuaaauuuuaauauuuuuauucuuugaagguuuuguuacauauauacaauguguauuaaucauaucuauucacuaccacucugcagcuccuugugccuucuggucaucucccucccaacuucauguccucuuuuuuaugguuauuaauagcauccugagucuaauuaguacuaccuugugugcauggauuugugaccaccuauuggggcaugaacagcucaccugcaggcaguguccugaaaaaaaaagaaaaaaaaaaugacucuucccucagcagcuguuagcuccaguagcuuuccuauaugggugcggccuuggcccguccccaagccuugguauaaauuuugacuggcuugaucuuguuaagguaagcacagauacugucagcucaugugugcagcagccaggccacauucaaaagucagcauugcgcaguucuccucccaugcccuggcuuuuacauucuuacugucuccacuuguguggaggucucugagccucagaugguaggagacugauguagauggcccauccacagccaaguguuauuuggcacuuugacugguuguacuauuaaaaucucaaaauggacuuuagauaugaacacuugccauugcuucauuuuccucuuuuuuuuuuucuuuuuuuuuuuggugugggggggggguugacacaggguuucucuguauaucccuggcuguccugaaacucacucuguaggcuaggcuggccucggacucaaaaauccgccugccucugccucccaagugcugggauuaaaggcgugugucaccaccucuaccucuccugccccaacacccaguuuuuuguuuguuuguuuguuuguuuguuuguguuuguuuguuuguguuuguuuguuuuguuuuguuuuuugagacaggguuucucuguguagcccuggcuguccuggaacucauuuuguagaccaggcuggccucgaacucagaaauccaccugccucugccuccaaagugcuggaauuaaaggcgugugccaccaucgcgcggcgcuucauuuucuaauuggguaauuaauuuaaaauuaauuugauuuuuaaaaucucagcauuaaugguucccauuacauuuuugcauuauucaagcagaauccagaaguaaucaaaaauaaguaggcuaucauuuuaaaaauaucuuuaaaauaauuauuuuaacuuuauacuacucacuggguaacgagauuaguccacugaagcacuagguguauggugagacaggcauuuauagacagggcuccaaggcaguccuguuccucucagucacuuagauagcacaccauaaaauguuuuuccugaagacaggauuugguauaaauccagugaggcaguaaauguacagccccuuagaaaacuuuaaagcacaguucaaacacaagauaguccaagaacauuuuauauucaggaagcugucaaaaaaaaacaaaacaaaaaaaaaaaaacaagcuucagccgggugugguggugcacgccuuuaaucccagcacuagggagacagaggcaggcggauuucugaguucgaggacagccagggcuauuacagagaaacccugucucgaaaaaacaaaaaaaaccaacaagcuugauuggucccucucuugcccucccuccccacccuccuccccaguuuaaaauugauguuucuuaccaaggucuucuaauuugcaaccuacuaaucugugaugugugaaagaaugauuccauggguagccaaacuauggaaaauauagucaagccugucaggauggcgucugcaccuuuucuucguggagauccuauaaagagguuuggaagggacuaaggacucuguagcugucagaggaaagaaggaauccaugaauaacaacuugucaauugguugaaauauggagaauaaaacauaaaaugucuuugauuuacaggcaguaugcuggcugugacuacucgcagcaaggccgauuugucccuccagacaugaugcagccacagcagacauacacugggcagauuuaccagccaacucaggccuauccuccaacaacaccucagccauucuauggagacagcuuugaggaggagcccccucuguuagaagguaggauggggugguauaggcugaagaccaugucugaaaagcauaaugccagaaauaauuguuuucaguuuuucaaauaucuuuauggacuucaguaguuuagcaucuuuaauaggaaaauuugaaaugcuacccauccccuuuguuuucccggagacaggaucuugcuuugaaacccagggugaccucagacuugaagcauuccuucagccuuggccuuacaaauucuaagauuguagguaugagccauuauacuuaaaauguuuugaauauuaaauugguuuuacaacuuugaauuucagagcauuucaaauuuuguauuuugagacuagaucagcauaugcucuaaucucuaguuaggaaaaacaaauaauaaagagaugcuguccuuucuuaucaaagaacaguagguagcauuuggucagugacuauuuaguggucagugacuauuuagaagagagugcauauuggaccaggagggaccauuucuuugugcacguaauauuuaaauaugacagugugaacaucuauauuucagauuauuaauuaaacucugccuauggaagaugugaaagcaaauagcaugauauuuguagauaucauggaaauaaacucuacugauugcauaaaaagcauggugacucucaaauaauauuccagaaaucugagcacaaaggcaugcaguaauuacauguaccuucaugggcuacaugaguauuccuaaagccccagguaaagaaucagucucuuuguuagccauguccagguguucuuuuacuugagaaugagguagagguuggucuuuuucaucuccauaucccgucuaacacagagguuaggcauaggcaaaagcccagccuguaaaauggccaugaggaccuugaaaagcaucauugacuauugcugaacccuguuuguuccuuuguauuuagcuuuguguccuguucagacauugauucuggaaaucaccacaaaucccaaaauuuguaacaagagugaccauugcugaaaacuauuuugaaauggaaggaauuagucucugauucugcggaguaaugggcuuuuaaauauaaaauuuuuagguaaauuuauagaaacugcuaaaggcguaucacaaauuuugacuuccuuauuuucuuacuauuuuagaguuggguaucaauuuugaccacauuuggcaaaaaacacuaacggugcuacacccccugagggcagcugacggcagcaucaugaaugagacggacuuggcagggccagugguguucugccuugccuuuggggccacacuguuacugguaaguuagugauuguuggguaaaaugagagcagaauuuuaaauacuccaacaaaaggcauuuggagccccagcucuuugacugacuuuaguguuucuugaauuuaugcuuaucccuuauuuccccaucaguaguaaguauuggacaacauauggaaaaacuaauuucuugagucagauguaggagacaaaacaacaaaucacagcuauaauuagagccuuaagagacugaagcaggaagagugaauucuaggccagucuggacuguauauugagaugauacgcauguauguauguguguaauaguaaaagauuagaaaaaaugaacaucagaauuucuuaauuuuagaaaauuggcaguauuuuguauugucuuauacuuuuaaaaauugagguuuuauuuaauuuuguucuaguuuuguuuauguugcugugguaaauacccagaggagauggggcuaaggaacccugaaaugguuauuuuagcccaaccccaguuauggagcacccagaugucaagaugucaggagcuuuaaauagucuauuucauccauagucacaagcagacagaaacaauugcagucaugccuaccgcuuaguucaccuuucuacacaguucagaacacaaauccagggaauugugucaaccuccuuuaagcacugucuucuuguauucaagaacagucccccacaaacaaguccacaggcuagccucaucuugauagucccccacaaacacuacacaggcaagccugaucuagacagucccccauaaauauguccacaggcuagcuugaucuagaccuucccucauaaauauguucacaaguauccugaucuagaaguagcucacugaguagcuacuucuuccugagugauucuagguugugucagauuuaaaaugaaguauuucaaauggcuagcccuuggacagcauuucauuguauagcuuuccuguacauuuuaacuucuuuuuuuuguuuggaggguuuuuuuuuuguuuuuguuuuguuguuguuguuguuguuuuuugagacaggguuucucuguguagcccugguugucuugaaacucaacucuguagaccaggcuggccucaaacucagaaaucugccugccuuugccucccaagugcugggacuaaaggugugugccaccacugcccagcacauuuuaacuucuaaugaauuacaguauaaaagaaugacaaguuuuugucuccaccucucaguucuccaugaauauuaaaguauguugaaagaaaacguuguuguuucagucugaauuacaacagauaaguaauguacuugauagaaaaugcuaucuguaagcagaagaccugagcuuccacacacacucccacuuggccuugaccuggcacuuuaguccuucaguucccucugugggauaauagcccugugcugcccaacuagccuaacagaauuguuuugaugugccaccacccagacaagaggcugggcauggaguuguagaccuauaaucucagcauuugugaggaugaggcaggagcauuacucucacuuuaagaccaaucuggguuagcaugagaccuuugucucaaaacaaaagaaaaagcaaacaugcucugagaguuguaaaaugaagagcacugugcaaaguagacaucauuacuuacugcucaguuaauucacuucucagugaaggaacucagcuucuucaaagggccacagccuaucucagguauuuacaguaaacauuaaguccagcaaaugccucaaggauuuuaccacaauuuguagaggaauuuucaagacuuagucucaucuuuugcaauuccucuuugggauuuuucugcagacuuguuuucaugagaguguuuuguuguucuuaaagacaggucucacuuguguagccuugccuggucuggaacucacuuagguagaucagguugaccuugaacucagagaucugccugccccuccuuucagaugcuuggauuaaagguauuuugccacugcaucuaguuaaucuuuuauaagagcagaacuaacagcaugugugcuuuugauuuuaaggaaagaacuguagacuccagcauaggauuuggcacaaaaggaguaaaaguuccuccuucucauuauguucaccuggcuuucuuucucauccucuucccugcggucuggcuuccugcuuuuucuggauuuccucccccauuuguucaguuguauaccaagcucaaugcuaccaagaaauacaguagauaccuguuuuggcaagugguacaucaaaguuaagaguuuguagucagggucugcacagguucaagcaagacagcaggcucccagcacugaggaagaaaugaacacagaugccacugcugaccaaaagcugucugcaguugguacccacuugcaaagggaaaauuuagucuuuuccaauauuacugauuguaugauuuccaauaauacagucacuguguauauuagccauacuucaggauaugcccuugcccaggaguagacggcuaacacaaaaggaacucaaugguauuuuuagauuuugaagacuuuuugucuuaauacagcuuugcuuggaguuuuugugauuuuguguguugucuauucauuuguguguugcuaaagagauuacaaaaaaggaaauggaguuguguggauagggaaauggggaagauguucgaggauugggauagagaaaaagugugaucagaauuugaauuaagaugaagaagggugugaaccgagugcuuugccuccuuccacugcacuucugucgauuuugaugcuuaugaauugaguauuuuaugcaugugccauuuugugugaaaugaggcccaaaugauacuucuugucuuuaaccucuuuuguucuuuucccauaggcuggcaaaauccaguuuggcuacguauacgggaucagugcgauuggauguuuaggaauguuuuguuuguuaaauuuaaugaguaugacaggugugucauuuggcuguguggcaaguguccugggcuauugucuucuucccaugauccuguuguccagcuuugcagugguauuuucuuuacaguaaguaucuuuuuauuuuuucuuuuguuucugagacagggcuucucuguauagcgcuggcugucuugaaauucacucuguagaccaggcuggccucgaacugagaaaucugccugccucugccucccaagugcugggauuaaaggugugcgccaccaccucccagcuguaaguaucuaucuuaaacucagauuuaguuggccagcuuuguguaauaaaauguacuucaccuucagguugagauaaagccuugauccaacaaauaucuguugugccucauugucuuaguuaggguuuccauugcugugaagaaauaccauggccaagacaacucuauaaaggacaacauuuaauuuggggcuggcuuacugguucagagguucaaccauuaucauggcaagaagcauggcugcauccaggcacacauggugcugaagaaggaacugagaauucuacaucuugaugcaauugcagccaggagaggacugguuuccaggcagcuaggagaagagucucaaagcccaccccaacauauuuccaucaacaaggccacaccuacuaauaaugccacucccugagccaggcauagacaaacacauagucaaacuaccauacuccuguagauucgaaccaugcuaugcucauuuugggugaagaacaaugaaaaugagauuugaaguuuucuauacaaucucaguuuuaccuuugauaagaguuuuacuaguuuuguguuuacugaaaccauagcaauaaugaucauuaaaacauggaagauuucaguucguccauauuaaaauuauguuugauagucugauuaucaaucuugaagcaguugggcuuguugaaaacauaugauuaguaaauauauauguagucauggggcuugggaaugcugauauguauaaauggagaaagguccugaaaacuguugagcauccuaacggugcaaagcacggggcccuucagcaaagguauccagcccaggucccaauagugcuaggagacagcuuaaaggagcauaauaauuauacugcuuacauuaaaucacuaaguauucuuuaagucacuaggcauuugauaaauagucuuguuuguauauaugacguguauggauuaagaaugucuugaggcuuaucaauugcucaguggauaugcugagcucugcaauucgugcucuccucugcaaaaucaugcauuaaaacuuuguugccuuagauuagugaauaguuuugaauugguuuggcuuuuaauaucuaaucuuucuuacucuuuuuuucauguuacagaggaaugguaggaauucuucucacugccacaauuauuggaugguguaguuuuucugcuuccaaaauuuuuauuucugcauuagcuauggauggacaacaacuuuuaguggcauaucccugugcuuuguuguauggagucuuugcccugauuucugucuucugaacugauuuugucugggacaugauaucagugggccgaauucauaaaaaggaccuuggacucuuaaaauuggaccagcaaacaacugcagugcagcucauuccgcuucucaguagccuggaagugacagaaauagacauuuguucauuuguacaggacaguugaacaccguggagucaccugagucggcuuagcagcucugaguguuugugcucacacagcuaagaaggaugauuucuuuccugauccuaccgccuuuaacaacucuuuuuccuuacaaauuauaauaggauguuuugauagauuuuuaccaaguggaaaaccaaccacaaagcugauaaucuuucucaaaaacaacccaguuauaguaaagaagaaacaaguuuuacugcagaaauauuuuucauaggaauuaggaaagaaaauaguugcuguguccucaaguuaagugcacugaaguaaagcugaacaaaaccgaauuccaaccuagagcuuuuugaguuugcacaucaaauauuugacauuccuauaaauugucucaugaaaccuaugcugagauucagagauacaagcaguucacaaucuaccuuacuacagagaugaaauaugaacaacuguuuagacauuaaaugugucaacucaauguggacuggccacgugaaugcuuaguucugucuccacaugccccacaaaaaaaaaaaaaaagaaaucacuaaguuuuuuugagaaaacaauauuuaaaaucucacaauuucaguauugcauuaucaguguauaguggauuugaugcuuauuaaauuuuucccaauuaacucugcugugaaguuuacuuucucuaaacuacuguucucugucuucuuuucauuaggguuugauuuucacuucugauauaaacucaguuuuaaaaguagaaguaaucuagugugcagucaggcagagacaaaguuagaagguguuuacuuugaaugacaguauuacuuccugacuuuaaauucaauuguuuuauaucauuauuacagauucuggagacacaaucuguaggaacauguuacauaugcuguguguggacuccuggcuuuuaaaccgucucagauuuuggacaauucucaguaguaguuaagaacaagaaugagauagaaaauaaggucugaccuuuuuauaagaggagaccagcagccaaaagaaaaauacuaaauuaauauguguauacuauuuuuagaguaaauuuucacauagaaaaggagcgucacacaugauuuucuuacuuuauucuugguguuguggaugaucuuacuuuauucuugguguuguggguuucauccugaugcuaaguuucagacuauacuuugacacuuaauaaauugcuuuugaaacuuaccuccaguuuuugcuaguaccuucccccaucucugguuuguuuaugugagacugagugauuggugcuggaucucacgcagucagccccggcuggcccugaacucuuaacacucauuuucaguucacuuuauguaguucuuacugaggcaaauuugugagugccaucuuuuaaugcacugcuauuuauagugaauaggaaagacaauaccugagaaguuaucucacacuugguuauaguuaacccauugauucccaguuccccagauacaccuaauuuuauucuuacucauugcuuccccucaucaaaaucuuuuuuauuuaaaucauuguuguaugguuuuaggugguguuggcuauguuuuauuuaaauacaugguacuggcauacaauuucuuauccccaugcucagcaaaaguuacgaacauaauaagauaugaagcaauuuaacauuuaauuauuuuucuauaaaaauggcuacauaguggaauugcaucugauauguaaagaauuuccuugacuacaugaaccauguauagcacuuucucuuauaagucucuuuaaguaaaaaucaacaugaucguguuuauuuauacagugaagucugauacagcguaucucaaaaguauuguguagccgucauuguugagcacccagcguagcuuaaaguuuaccuauucaguaauugaaaacuguggagagccucugaggagagccauaagauggcgcuagccuccccugugccuaacuaguaaacaagccuuguacgcaggcucgagagugaacucacuccuagucacugcccauucucgggguguaauuguggggugaugggugagcaacgaaucaggagcugucacaccacaucaggugcugaaacgucacacugcgggcuauauaagcagcgccauuuuccugguuuggggucuuccugagaaguaagcaauaaagcuuggccgcagaagauuccau

SEQ ID NO: 8902 - RNA, 866 nt, Mus musculus
uuuuuuuuuuuuuuuuuuuccagcaggacagagaaagcagugagucucugcgcuuaccuuagcgagugagugcuggagacucaguucuugcgaagaaauaaccuuuuccagagcaaucagaaaccacagccacacacugagccuggacgucuugucaaaucccaaacagguaaaggacagagguaucgaugaaaagugucaagagauuggugcucucggaaaacaaugauuccacacuuaagcucuaguagguguacguuucuauguguguaugaauggguguaugcauucacaucuaaucucuagcuaaaacgaaucgggggggaaaaaaguugaaccgagaggaugcugagucgaagaaguggagcagaggaaaaaaauauauauauucaaccaaagcuuccguaggaaaaaaagaaaaaacgaaauccaaaccuuauagaacagauaaauccuuugcaccuggaagaguugcaagagguaccuggacuuagaggcauucagagagcccagaggcagggcgacagauagaugcgccccccaggguugcagcagccaccccaccugcaggcaagggcaaagggacgcccauguccccgccaggugggaaggaaaagcagccgggaaggcgagagaugccugcggggcuugggcuccgaagcugagaggucccacggugccaggagcaguucggaugcuguugugugagcagugcaggcaagaaaccauccagggaaaugacuauuacaucaucuuaaaggaauagggcuuggagagagcggaggcagcucggagucacguccucggcggugacagguugccagcacugacggggacgugcgcucgcggugggcacgggaccagag

SEQ ID NO: 8903 - RNA, 75645 nt, Mus musculus
agugaacgccccuuuggccgagggguguggccggagcucggcgaggagccugaaggcgggugcaugacaugggggucaccguggacgugcaccagguguuccaguaccccuucgagcagguggucgcuugcuuccuccgaaagguaucagucccucugaccugggaagugcauccgcugcggacagucugaacugcccccgccugcgucacuugucgucuguacccaacccucaugggucuagacucacccuccgagucccccuccagcgcgcgugcugcucccgggaugugcagggcgaggguggaggcgguuuuccucgaaagcugcucucagggaugagcggaggguaccgugcagaacaucacguccacacgccucccuggcagagggugugggcuccggguggccucccugggcggacugucuaguccugcuuucugguucaucucccacucuuuaaacgcuaauacaggcucuugaagcugugaucucgcuagacucucggcuguuacucuacuguuucaagacuuucucuuaacuaaauagccgugggacuccccucagagcucacccucucuggaccuuaguuugcuaaucuguagcgugagaaaaaacagugcacacucccaggguugucgugagaauuugagugagauaauuaauaaggaguguuuaucacaggauugauguguuguaagagcucagaaauacugcuguuuguacuauuguaguuuugggauuccauggcccucaugaugagggcucuuucuaggaacugugccuccugcuaacaguaaaaugaaaaccaucauccccgagaauugguugucugggaggugggacccugaacuguaaucuguuuuugguucaguuagguaucugggugacccugaucagaggucuucucuccaagaucuggaagaugaggacuuguacccauaggucuuuaaagucucuucagcuuucgcaguguugaacaagacuuguaaugauugcagcuguccuugggcagugaacuacaucaugaaaucuguauagccuagaaguuggacugaagaggugcugugaagaugguuagcuagggccucccauuacaggagggggcuccaucacuuauaccugcuagguccucagcaaaagucugaugaauaggcagugaaugaaucugggguacacucugcuuuagaucaggcuucuaggaagggaaaaggaacagcugacaccccauguuuuguuuagacuggcaguuuggaguguggguccccagcacauuuugugucagucaccuuugcgcugugaugaagugacugggauaaugaacugaggagaaaauaaucuauguuggcucacuguuuuaagggccucccauucauaauuacuuuguucuaguuugcuuucuguugcugcaauagaacauuggcccaaggcagcuuugggaggaagggguuuauuucagcuuacaggcuauucaucacggcaugaagucaggggcaggugcacaaggcaggaacucuagcagagaccauggaggagugcugcuucccuggccuugcucagcuaacuuucuuccagucuccugcgauggcucaugaagcugaaauuucugccuuuuccugccccagaccccaaaaucuacugcacaauuuuacccacagacaacaaggucggguucaucacagcacuauccuccuagugccaauuucuguccuaguuuccucgcugugauaaaaugcugaccaaaaggcaacuugcaggagggaggcaaggguuuagcuuauuuuacuucucccaggucacagucaucaucauugagggaagccaaagcagaaagucaaggcagggaccuggaggcaggaagugaagcacgggucacgguggaacauuaggucaugggggaacauuacugacgugcucuccaugcggcccuggggaggcaccacccacacugggcugggcccucccacaucaaucauuaaucaagaacgugucuuucaauaugcucgcaggcuggucuguugggugaaauuucucaguugagguucuuuauuaacaguugauguugcuuugucucaguuugacgauaaauaaccagcccaggugucucaccgcccugggccuguggagaggcagcaccucauggacggaaccugagguagaacaaaucugcuuagaucugagccaaggaacaagguggaaacguugggagagcugcaaucccauaauccgauucaaggauucugccaauucaagggcauauaccaaugcccaagggcaccuucccacaauucuccaccuauucaagagucuaccacuacccaggagggcugccuugggaccuaaccauuaacaccuagcccuugggggauguucaagauggaaacuguagcaccacugccaccugggaaaaaggauugucauccggaaaaggaguccucugccuucucagaauggaaaagacacuuugucuaggcuucauugaccuccccacccccugccccuuucagacucucuuugcaaaaccacacacaaaacccuacucacccucuucuuuguaaugcacuuccacauaucaguuucagguaaaggugauggguuuuuagaaagggagagcaagaguaauaaauaaugaugaugcuggcguuauuucaaagggugaugcauacuucacacaaggagcauacaggaugggagggugggguaggguggcuauagcaguccuacauggaggcuuugguagguaggcaggcuuucucaguaaagugacaccuucagguuugcugaaacaugaauaggaguuuucuuuucuuucuuucuuucuuucuuucuuuuuuuuuuuuuuuuuugguuuuucgagacaguucucuguguagcccuggcuguccuggaacucacucuguagaccaggcuggccucgaacucagaaaucugccugccucugccucccgagugcugggauuaaaggcgugugucaccaccacccggcugaauaggaguuuucuuggcacucucucugucucugucucugucucugucucugucucugucucugucuguuucucucuccuuauacacguuugcgcuguauaauacaguacuauccuccaagcaggcuaagaaaucgucaugacugacucacgucguggggaaauagucucagaagucuaaguaacuuucccagcagucccagcuagcaggucggagagccaggaucucagcucaacugaaucuaaagcccaugguucaccagcaggcugcgcuuccagcucugcacacaggggccaugcaggagagucuggggacagagcagcggcucaggccucaguuuugcuggguguaguacccuuugguucauuugccucucauaguuuguucaucuggauggacucugcaccuaauaugaugcuuagcuuagaugugugcgggugggacacgguauuugcuagccauuucugugcaacaaaucacucuaaaacuuaguggccuugcccagugacaggcuuuuaauucuggugauucuguggguugacugaacucaugugguuggauuuagugugguguggcuaaggucauuuauacaagaacauucgguaucugaugccauucuuauaagauagucagcuaagugcuuggcauguuuaagaacuauggaaggacccagguggcucaugcauguaucccaggccauuggugagucugaggcgggacgaucagcaguucguagccagccugagcuacauagcuagacccugucccagaaaacccaaaaccaaacaaauuaaaccaaaauauuaacaaaaaggaauuccuguagguagccacagugaguuaugaguguaguauuuggucaugacuaaaagacauuuucuuuugguucuccagaccucugggucuuacaaucuuuccaacccuucuuugaaugguuccucugagucaugguguguguguguguguguguguguguguguguguguguguguguguaauauugauguguacuccauagucccuuaugcucugcacuuugacuaguugugaguuucucuauuacucacuaucuacuucacaaaacauuucccugaugaugucagagagcugguagacagcauucuagcauggaggaaaaagagguucaugagccuuuacuccuaacuaagcaccuauggacaguacaaggcuucucagggagagagaguuaguuuucuuuaaggguguauguaccucuugguaggucuaccauacuccaggggauggccccacaccuagaacuauaguugaugggauauuuaauaauaauaguaguaguaguaauaauaaugauaauaaugacaugaaguggagguggauaggaaggugggcaugaaucuggguggaguuaagggaaaggagcugagagugaauaugguuaaaagacauugugugaacaucucaaagaauuaauacacguauuuauauuuuaaaaaagggauugcuuccucuugguagauauggugcacugaugcaccuguccugcacgggagcccccaugcacugagcagccugugcggcuguguagacagucuccuuuuaucuguucguggugauguuaccaccuucagacugauccacaugcaugcgcuuuugauagagucuucgguaguaagaguuagauuuugggcaaaauaugcuuuaaauacuuuuaguccucaugaugauacuuuuucaaaaaugauaauuaaaaaaaauugagcaaagcagucggccgaagagacagucaugugaggaguccucaggacgguuaaucugauuuugcacuacagugggcaaggcugcuuuagaacugaggacauuguguuuuaaauagaaucuacugcucuguggcucuugguuuguccagauucuccuuccaaguucccauucaguacuauuuuuaaaacccaaggaaugccugauccccuuacaccugucuguuggcuguugugggcaaaacauuagcugcaugcuuucaauuaugaguggugccuagaaaauggaggauacaauccuauuugugaaguacagguuuccucaccaucauggaagagugcugagacucaguauaguuccuucaggugcugcagcaguggcuucacaguguccugguuccccucuuugcauaauucuacuucccucccucccuuccucccucccucccucccucccucccucccucccucccucccuccagucuuuccuuccuuccuuccuuccuuccuuccuuccuuccuuccuuccuuccuuccuuccuuccuuccuuccuuccuuccuuucuuucuuucuuucuuucuuucuuucuuucuuucuuucuuucuuucuuucuguuuuccaagacaggguuucucuguguagcccuggcugucuuggaacucacucuguagaccaggccuggccuugaccucagagauccgccugccucugccucaagaguuccgggauuaaaggugugugugaccaccgcccagcuguacauuucuuaccuuuccugcacucaugaguguauuuuccuuccacuugacuaaaagucaucuugggagagaacacaaaguuguguagacaaguguggaagcauagaagauaccucuuuguguggcuuauguaggucuuuuugaugaauguuaucuuucaugugcugggugcugagagaauuccuuacaugucaaaugccuggaauguaaagucauuacuaaggaugcaugugagcuguggugaucagugagucuucaugucaguucaaaugagugcagagagcuugauccauggggaucuguaucccaaacaccagacagguucuagaucacaggaaacacucaacaagucccaugaagaaaucucacccuccugugguuggcaguauauaauuuuguacuaaaguuauuauuugggaaucugaggcaggaggauugcuugaguucagaaguuugaggucagccugggcaacacagugaaacaccuucuggccauuacacaaaaugaaacaaaccaaaaccuuaaaacaggaaagucaacacaggauucagaaacaugcacucucuggaauacuguaauaaaaaaagaguaaaauaaauuccuucuuccauccaugaccuaagacuuuauuuauuccaguggcgugcugcauagaauggaucggugcuuacccugaagcucauaaaguggauuuaugaauggcuauuuccauuuagaguagaaagcugauuggauaauuaauaauguuuccuucagaugccaucuucacucccuugcagaccugacacuuacacguguagaacaucuuuccccacagagcuccagagguguuuuggaaggauccauugcauuccccaauggaauggggguuuggcuagauguuaggccuuagugcugugcagagcugacagcugcucuuuauguccugugcugggcggcacucuucauccuuccaaccuaaguucuccugagaacugaggugugacaugaaggagaagcuggcugugaggagcauggcucucaugucaggguguagaguggacaguuguaggggugcgagccaggucaguucauauuucugugccucaguuuccuugucugaagaauuagaggaauagcuaucuucuaggguugcuguggauauuaauuaacacgcauacuuuuauguaagcaccaagcuuaaugcuggggcaugguaagugcuuucaaagcgcuugcugaguucuggagaccauuauguuuguucaggaaugugaaacugaaaagcccagggaagcacucugcagaaaucuuuacuaacuuagaacaauaagggagaaggugagcaugaauaauggugcaccuccgaaugauaaauuauuuuuuaagugcaauuuaaauuuuaaagugugcuuaguaacucauccaguggaggcuguggcuuagugucugaaagaagauuuuuuuaucuaucaaagugcuaauagcuacauauucauuauaugccuauuaauugguauccaugcuaagucugcgcacccuuugacaauaaaauaaaacaagaccuuguccugaaggagcuucgugucagggggagcagaaaggaauguauagaucauugugccgagcuuucucagggguauauacagacguauaauguggggcaaggaacguuuguucgaauugcaucuuucuacguagcccaggcuggccuugagcacuugguacuccucgcucagccucucuaguacuguaauuaugggcaugagcuaccacaccgggcagaucaaugaaggggugaugaacugaagccucauuugaucuugguaauaagucaacuuugcuuuucuuccagagugagcuucuuuauggagaccauggaaaggcugggcaguguauggugauguuucuguauagcuuagcaugcagcaaggcccuuuguauguguuugcaagcagcuggguagcagauccccuuauagcguguugaccagauauguggaugccaaugaaccaggcauccugcgguuccucauucuuugugcuuucucagauaacccuauucaaaagcaggcccacuguaauuccuaugaaggcguugacuaugagaagaagggccguguuucaaaagucagguguuggccucucaacuuuucagauagcugauauuuuaauaacuuccugcuuaccagagugccuucugaaugaugaacuuucccuuagcaaacaaaaggagaggcuuaaucuuuauaaagcuccaccuuguguguguguauaaauaaaaauauaauagaaauauauauuauuccuauaauagauggacucaauuucuugagcucucacuuuaauaauuauauauuuacuuuaauguauauucucugagcuuggcauuauguagcuuuugggccucuuuuuaaaagagcuuuuuuauuagcaugcaugcguucuauguaaugaugggcugcaucaugacauuuguauauuuacacgauguauuuuaucauguuuaaacucauuacccucuauuguuccccuuccacuccagcagaugcccuucaucuugccaacuaguuccccacuuuccaaggugugugugugugagagagagagaaagagagagagaagggggaggggcagcaugggggaggagacugagggagagagacagacagauagaggaggggagacuagagaguuucauuugagugcuugcaggagcauguguacugccuaucuacaggaguauuccuaucucauccguagccauaccacugaagaaacugucugucucuacaacaaccaguaacugucuauagaucuucagaggugggagggugagccucacuaacugccuauaaaucuccagggaagggugagcuacuguaagugccccacuguguugauaggucuguguuuugcagcugcugugaguuuagaagcacagcagauacgguauacuuuggauaccuugugcuacgacauuccacuccuuuuuccucuuacuuugagcuccuuauucacacuguucucugagccuugaaggggaugauauugacguccguccuacuuagagcugagcacucaacagucacuuccuguccucauuuugaucaguuguaagucucaguaacgaccacuuaccgcaaggacggucucugcccugacgagacaucaacauagucucuggggauaaacagaacaauguaaaaggcaauuugguagaacaagccuaccaacuaggacccauggccucuccagccacagggcguuggccaggcucuguacaguaaguauagugcacucauucucuccuguggagcaggccucaaauccuuccaaucagaaagucgggguuacucgaucaugggcuugccacuauugcauuagugggcguaucuugccugaauauccuauucaguaggauagcuugcagggucuaaaucugaggaagacaacugaggacaguguccccacagcuccuugcucagcaccacuggcacugugagggcaggacagacggcagggagggagcaucugacaucaccucuagcuugauuucucaauguccuuaaaccagaucuucaucgagaugaucuuaccgucuagcuccaguggacagccaacagcaggggcaaucaccuguauaauuuugaaaacuccugagggacauugcagguagauagcccaucccuggaaaugggauuuuucacuuaauaaccuaugacuucuaggaagagcuuuauccaccugcucaagauaccuccauucaaaagguuuuuggacucuuuugauacguaaaaaggaaaaugggaagggcggaugauaaccucaggagugcauauuuuaccuuuguuaguguugcaguagacauaucuuggcaaaggaaggagugagccuacuuauuccauaaagaaaguaaaaacaaauaagauuaaaaaagugaagccaaaaauaucuugagaaaucuccagagucacugacaaacuacagcacaucugguguguguacgcuuccaccaaaccaggcucgaugaagacaaggcuuuuagcagaaacugggucagcagaccacauugcuuccaggagugucugguauggaguugggaggggcaggcucaucucuguuugugugcaggauuuacacaugaaacuuuuaacaagaagaggccauaucauaauacucauuaauauguuuccuguuugggagagaacuaaaugagagcaugucaggcagcugcgguguaacacacgcagggugggcacgguauagaucuggaucuggcuggaucaauuccuuagucacuugguguuugaauagguguccagaacucaugagugccacuguucucccucggaguagucucugcuuuguagcaggcuuuggauacauuuuguguguaagaauuaaaacaugaauacguagguuaccacaagauggcauucuauuauuccaaguaaugccagguagagggagccuugguuuaauacauuuuuaauuucuucaaagaguuaaaauaaaugccauccaugucacgauauuuagcuguuucacacaaacuucuaauuuuuuuuucuuuuuugccauucuuuacggaaacuugagguuuaugucuguuaacuccagaagaagucaggaaggaaaauaccuuaauuuuugcaaaugauauuuauuagcaugaauaguucacggucucuuguguugagcuauuaaaaguuccauuuccuauugcagggauuauaaaaugaguuauccucaaguguuuucuauuuugucuuccaugcuuuuccaucucuuacccugucuuauuuucuuuuuagcacaucugacauuuauuuacugcuuuuguuuguuucuucaacuaauaaaugaauuuguaagaagcuacaugcuuuucaugucacuccuacauccucagugucugaaacagcauuugucaugcuaucuaauuaucuaucuaucaucuaucuaauuugucuaucugucuguuaucuaucuaucugucuaucuaucuaucuaucuaucuaucuaucuaucuaucuaucuaucuaucuaucaucuaucuaauuugucugucuaucugccugucuaucucucaucuaucuaaucucucauguauguauguauguauguauguauguauguauguauguaucuaaucaucuaucuaccuaucauuugucugucugucuaucaucuaucuaucuaucuaucuaucuaucuaucuaucuaucuaucuaucauuugucugucuacuugucugucugucucucugucuaccuaucaucuaucuaauuugucuaucuaucugccugucuaucuaucucucaucuagcuaaucucucauuuauauaucuauguaucuauguaucuaacuaugcaucuaucuaugcaucuaucuauauauguauguauguauguauguaucuaucuaucuaucuaauauauguguaucuauguaucuaucuauauaacuaccuaccuaucaucugucuaucuauuuaucuaucuaauauauauauauguaucuauguaucuaucuauauaccuaccuaucaucugucugucuaucuaccugucuaucuaucuaucuaucuaucuaucuaucuaucuaucuucuaucuaccugucuaaucagaaaaaacaaagagggucuuauuauuuaaaugaauaucauuucucuuaguagguaaauauuaaaauuaagugaaagugugagguaguauaguuuaaccuguaaaaguuucacugacaauuuagugauguaaucagaacugagaauguuuuauuacugugccugucuggugauacauucugcuuuucuucauaauuuaguuuaguuaucuuccuacgacuuacagcaugacuguaacauuuacaugaaaugcauuuauggauauuuaaugaauaagcugggaugcaguaaaggaaacaguuacacuuuauguuaguguaaaagguuaauucacacaccuguccacaugguuuagggagcugugugcagcuuagaugucucagagucaagaagucuccucuguagaggacugaauccccaauuuauccuucucuuacuaacaugaaucucuugagggcuaacuugcgggaaagugucauuguauuuucagccuuuccuucuaaggcugaacugcaugaacacaugcacaaaugcaccuuucuccuccuccuccuccuccucuuucucuuccucuucuuccucuuccucuucuuuccccuucccuacuccuccuucuccugccccuccucuucuucuuccuuuuucuucuggguuuuugaccaaaauagauagauagacagggucucuuuguguagccuggacucauaguuagaccagguuggcuucagacucacaugaucaaaggugugcaucaccaccacccaggcaucuucauuauuuuuuuuucaagauuucauuuauuauuauaaauaaauacacuguagcugucuucagaugcaccagaagagggcgucagaucucauuaugggugguugugagccaccaugugguugcugggauuugaacucaggaccuuuggaaggacagucagugcucuuauccacugagccaucucaccagccacuugagcaagguauuuaguuuaucuaaauaauacgucuauacuuaucuaaauagccuuaucucucauauauacaauagaaaacaaacaaacaacauauaacuuuaugucaugcuucugagaauuaacagacaauguauguaaauugacuagguuagaaaaugguagcaauuaucauccuuggucuaacuaacaucuaacuugucuuucaggacaauuuaauaaaagaaguaaagcauuuaucaaaugucuucaacaugcuugacauccuguccuuuuaugauuauuuucuugaaguguuaacacagucaccaagccauggugaagugguaaaggaauucucuuuguguuggacuggccuguuuaguucucugacucccauggaccagcugaguaaugaaauaauccaauuuucauccaguuccuacuuuuaaaaauagggguuaaugauauuauguaaugucuuuacaacagaauagcuguuagagucaaacagggugauacaauuaaggcauuuaguauagguagggaacagagagcauucauaguuuaugauagucugguuuaauaauaauaauaauaauaauaauaauaauaauaauaauaauaauaauaauauccucaaccucauucucaccucugcucagggcuuagauggcauccaaagaagguuuccuuugggacagagggauggcucauuaguuaagcacaguugcugcucuugaaggaacccagguucaguuccaaguacugaugugguggcucauaaucaucuguaaacuuaauucugggaggccucugguguccucuuugacaccaaacacuuauggugcacauacauauaugcaggacccauucaagacccaugcacacaaaaaauguucccugcauuucaugaaagccugcuucacuuguuugagucuaagugcuaaaaccaagauccuugauuuaaaacugggugucuuagucaggguuuguauuucugcacaaaacaucaugaccaagaagcaaguuggggagaaaagaguuuauucagcuuacacuucuacacugcuguucaacaccaaaggaagucauaacuggaacucacacaggguagaaaucuggaggcagaagcugaugaagaagccauggagggguacugcuuauuggcuugcuuccccuggcuugcucaacuucguuucuuauaaaauccaguacuaccagcccagggauggcaccacccacaauagguccucucacguuuuaucauuaauugagaaaaugccuuacagcuggaucucauggaggcauuuccucaagggagguuacuuucucugugauaacuccagcuugugucaaguugacacacaaaaccggccucuacacuggcuuuuacuuagaaguuucuuggaagauauuuacugguccugcagacuccugucacuucuaucagcuaauucauguugacaaaagagaaugcuaacuuuucuuuguguguguguguuuuucuuuucaguaucccaauccaauggauaaaaaugucaucucuguaaaaacuguggaagaaaagaaagguaaguucucugucuauacccuuaguuuaguuaagguccuuaaguauacugacuuugaaaaggauguauuugugugugcauguguguuuguuccugugugcauguccauuacaucuuaagcagggcucuuguuacuuucuaaauuacagucggugguaagccucaggcuggguguaaguguauagguaacaugcugacauccuacuuucauagauucauucaaccugaggaauaauguuaagguaggaauuauguccuucuuaaugcagaaggaaacuaaaacauggagggacuagccugcccaaacucacuugucuauauccuuaacacacaucaauuugugaacggcaagacauuuuuauauuacacagagauggugguggcucauguccauaauucuagauauugaaugauggaggcaggagagaaucaggaauucaaggcuagcuuggaguauuaaaaaaaaaaaaagcauauagaugugaugcugccauaaaguucuuggauuguggaaccauaacuguaguuuggcaauuuaugguucaugcugucuguuuuuguugcuguguuguuagacacuccccucuguuuguauguuaucaauggcugcuucaucugacuaacagcaggagcuggguauuugcuaaggagaccauguggccuacagagcuaaaagcguuccccaugaccccuuccagacaaugcugaccuugcuccaccuuagggaccuuuguugcucuuugcauuuccuuccuaagggcuuccauugucacgaucaaugcugggaccugagaagugggcggugccaggagcucugaugaugagcacacuugaugcacgagucuguggagacauccagagucuggcccagaugcucuucagccuuagaaaccacaggcugucacuguuaguaauacggcugcagcccuuucugugauuuuuuaaacuuuuuuuuaaaacuuuuuuuuuaaaaaacuuuuguaucugauuuauagggaugcuuucuacauaucugcagguauagaaguagauuguuaaaaagcauuuucucacauacuugcuuguaguauagaacaaguuugcuaucuggccuuagauuaaucauauuucaagcccugauucgguuacuucccucauuaccugauuuuuuuuuuuuuuaaggcucaaggucuuuaucugucaagugggagaacaauucuguugauuuagauuguuaugaggaucaaauaugauaauaaagugcauauucaaaaguggcauagagugcugguuguaauuucagguugucaucuuugccuccauuuuuuguuuguucauuuguuuuaaggauauagucucacuacauagcccgggcugaccuuaaacaugcuauguuaaacacagagagccaccugccucuuccucccagagacugggauuaaaggcauguguuaccacucacagaagauacuauauuuuuaauguaugucucguucacauuggcugagaugaccaaaggacugcuuagggguggagcguuuguucccugccagcaggcucuuguuggacucaggggccaggacagcuguugucagagucuggcaaaccccgcacugugacugagccuuauuaauucauagagaaacaguaacacuucagucugucucuuuucuucuguuuccucuuguuuuaacucauuguugucauuauuauggguaauuuuaauuccuccaggauggagugaucucuggucacaagaguuuuauuccucugugugagaagaaugugacucacguaguuaauuagguauacagucagaaaucugugccugacacugugguccaggagguggaagaaucucuucccauacuccuuguuguugagcagucagccauuggccacugccacuggacgcuugacacugauuacccagagugguggcucgucugggauucauauuucuggccucagcauguguguucugaguuguuuuaccuuuaucccuggaacguuuuugauuuggcucagaauacugaucagaaacagaggauguuuuaagaaaacauugauuuuccuuuguauuauguuuaugcaugugugucuggguguguguaaacaccuggguguaggugucugaggagaucccuggggaguggagguauaggaaguugugagcugcugagguaggugcugggaacugaacuguguuuacuuuugacaagagcuguaaguaggcacucuucaccacagagucaucucuccagccccagaaaaucgaguuuuauaguaagccucaucuguaagaauucuacauauugacaguuuaaauuaaauuaggaagcucuauggacucuuggauaagaaugcauuuuuuuccuaauuauuuuuuggcuaugaaauuuucuuuuucuagaugaaucaacaggacucaucuauagaaagaggauugcuaucugucagaaugugguuccagagauuuuaagaaagguaaauucaucucagaguuuacucacaguggauauaaaguugaagaauuuuaacagucauagaaaaagacagcauuuucugauauaaagugguguuaggauuucuugcuucuccaaaucucauuguuuuguaggggaaauauuucucucaugcccacucuaguuuuggcagaugccacaugauaugcuguguguuccucaauguccuuugugaauguggggagauuugaugauucuuuuguggguacuuuuagcauuuugaauaaaguguugucuuuucugguguacccaugaucaccaauggcccuuagguaaggacaauuauaagcgagcagauuguaaaugucagucuccuguuuggccacacuucuguuuguaauacacggucagaaauaauaacuguuucugaaagcacaauauuucuagugcacuacacaaaccuucugguguguauuuugguacaauaagguugcugaugcuggaaucuucauuauagaaaauuguuuucucucuuugauacccuuaagcacucugcugauucuguguuggacggaggugaguggaaaccaucauuugcauggcuugaaccauaugaagauuuuucuucuugagaaagggccucacacuacagccuaggcaggcauggaacccacuguguagcccaggguguccucauacugagaguaauccucucaccucagacaucuaagugcugagauuacagaugugaaccacuaugccuagcuguagaaacauuauugaagacaguuuuuauuuauucugaaaauuucacacauguauaugauaucuugaucuuauuuacccccuucccuuuuuaacuuccaucagacuucccaacacaucucccucugaaccucuguucauagcagacaucagcugucaauaacuccucagcuaagcccuuacuuagccaugcugucuagacuggaauuuuuaacuggcuccaucuugggagggucucagguaggaaugcacagcugccgugaguucaugcgugaaauagccaugucauguccauaagacagccucucacagcaccccccucccagcaccucuccccauccacagucuuucuuuucucucuggcgccuugcucccuggcccugggggugauggguauagguguccuauccauggcuggucaagcacuuauucuagcgcuuugaauaguuaugaggcucuucaaucacaauguaugauuuuuuuuuuugguaaaaccugucuuuuuuuuuuuuuuuuuuagauaauuucuuuauauacauuucaaaugcuaucucaaaaguucccuauccccccaccccaccccagcccugcuccucuacccacccacuuucacuuauuggcccuggcauuccccuguacuggggcauauaaaguuugcaauaccaagaggccucucuucccagugauggccaacuaggcuaucuucugcuacauaugcagcuagagacaugagcucugggguuacugguuaguucauauuguuguuucaccuauaggguugcagaccccuuuagcuccuugggugcuuucucuagcuucuccacuggggaaccuguggucuuuuaagacauaagaggagagcaucuggacagacacuuuaaaagauuccccaaaagagauucccuaugugauacagaacaacgcugggcacccgaguauuagcuugcaaauuaaguugcugugcuuauacuaggaaaaauggcagcuuccauccauuccccauuguggguuaaagcacuguuauucucucaauggaaagaaagcuggaacuacagagaaaaugaacuucuucuccacuugccgaugggaaacuauguuacacguccacagcaaauuaucacuggcuuuuccagaguucauagcugccuuugcccuauauacgcacuuugaaucuauuauuuagaaaggcauucaaguccgucuuguuucucaauucuuaaauaauuuaaggcucugacuuguacaguucugccuuuguagcuuuccuuguccucuccaccugggaaagcaucgauuucuagggacugaacagagauuacaacgaggaaaauauuucgcuugauacugcccugcaugggagcaugcagcgggcgucugaugggaaucuaucaacucaaggaggccagccccagagaugacaggagcaucugagaauuugcuuaguggccuccaucaguccugggccauuugcaaguccuucacagcauguagugaggccacagugugucuggauaucaauacuuagggcuauugcugccgugccaucuauauauaagggucacuuguccccccuguuauccgagacugagaugggcucuagguggagucuucauguagcuugcucuucugaaauugaggaugcuguuuucucucuguugggcaggugaguauuuuaaagguaccugauauccagcuagaagaagagucauggcucagucuucagaaaaggaacauggcuauccggagucacugccucacguggacacaguaugcauccaugagggaagagucugucuuccgggaaagcguagaaaauccaaauugguaagaucacguguguguguguguguguguguguguguguguguauguguguugggggaggggaucaauaaacaagcacacaauuucauuguuauggucucuguccauuacacacauauuucacuuuauuuuuuaaguagaugaauguauuuuuucuuuuugacagaacacaacucuuuuccaggugcucuccaaauucugauauuuucuugcucucuucaaaggcagugaaugucaccagcugguugacuauucuuuuggaccuuuaaaggcagucuagguauucaacagaguuuaaauaaggaaaacauuuugcuugauguuaucacgaacgugaccccgcuagugggccugcagguuuauggagaugcucguacacagacucaccuaccuugcuuaguuuguauaucuuuuuuuacacuugugcuuuugcauugccugaguuuuugugcacuuaucuuuuauguuuacucgacugcuacugaguuuuaccuauuugauauacagagagcuagcugcuuccucugcacggcauucaacuucacuacguuuuauuuagucccugccucuguggcagacacgcugaugguaucuaguuucucuuucuuguaaaggcgaguauaauuaauacccaugagauguauguccucuauagaugacucuaaugugauacgugagugaguuguauguccucuacauaugacucuaaugugauaugugaguggauucucucaguggaaucuuuaaguguuguauuuguugcaagauuaucuauagacaaucaaauuuaccuuuucuagcauucagcucuuuaaguuuucacaaauauguaaacuccugucacaacugucccaguuccugccuaacccuguagguaaauuccucugaaaugugugaucuuaaguaagugaguucuaugguguaugccuuauauguuaguuuuaaaguacugugggcugguuuucaggacacacacaauuugagaucuagggaaucuugguuugagcugcuauaauuagauacuacagucuuugugcaucaagcaacauuucugguuucauaguucugcaggcugggaaguccacucuguggacucuggcagauccugugucugugaggccugccucuaguuuuucagacgucugucuguuguuaaucccaaugguagugaacacgugcuauguucuucugcaugaaacagauuccauggccgaguuuauagaauuauguaaacaucugggcgugguggcgcacgccuuuaaucccagcacuugggaggcaaaggcaggcggauuucugaguuugaggccagcuuggucuacaaagugaguucccggacagccagagcuauacagagaaacccugucucgaaaaaccaaaaaaaaaaaaaaaaaaauauguaaauaaauuccuucccaaaggccuagugcccuaacuccuuaccacuguggguuaagguuucagcuggaggcauccagguguaggcagcuuuucucucaugcaugagcucuuugguuccauccccagcacacacacacacacacacacacacacacacacggcaaugcaaagcaauaaaauaaaaaugucaacacauaaauuuggggguacacagacauauggucuguaacauagauucuggcacauugucuuccaauguuaauacaaguuugugcuccauaacaacacccaacaguguucauuucucugcaguguugcugguaauuaauuaauacacauuuaaguuuuauaaguauaagggguaagaaacaaucaguuccuugaagauagauuuuuuaaaaaaaagauuuauauaacuuuaugugcaugguguuuuaccugcauguauauaugugcaccacaugcaugccucaugccugcagaggcuggaacuggagauggaguuauggaugucugagcugcugugugggugcugagaacgaagcccagccuguugcuggggcagccugugcuucuuaacugcugggccaucuccccaggccccuuguuuucuuuuugagacaagugucugaguauuuauccgaacuuaucuuaaacuccuaggcuccugccauccuccugccucagcuuccccaauuucaucuuuuuuagguauccaaagauagauuuugaaacaaaauaaaacaucacaagcacuaaaccauuauagugaauaaugugauuucaggggauaguuuacuauguuuuauuguuacuguucuguguggcuugaaauuuuuauuaaauagcuacaguuguaaugaaaaauaguaaaacccucaaauaacuaauugucgcuauguaaaagacauucuuaaggcccggccuuuguccagaucauucccccuugcacggcuuggcuauacaucaaugaugagcgaggaaguaccagaggccgacucacugauccauaguuuuuauuuugcugaugccaaaagcuaacauagggcauggauggugggauuaaagccggggcagagagcagagcucuguuguugguaugcagauguaguaaacagauggcauuguccgauuucaugcaugacgccauucucuucuaguauuggugugggcuacugcuguuguuauuuaguauuauauuuggguguuggguagucuuaaaagcugaaccgaauacuuguucaguucaugauaguuaaauuacaguuugcucugauaauccaagaaacuucucacuuuguaguuuuuuuuuuuuuuuuagaugaaaaaauuccgauuaugggaaaaauagugcaugccacugguaucuaauaucuaagcaguucugggaaacaaaucacguuaacuagagaucaugcuuauuuauauacuguauguacaucauuuacauuguuuugguuuguucuuauuugacuccuagguuucugaacuuugagcaaugacaguguuauaaugaaaaucucugcgaugguauauuuuguuacauauuuaauuauuuuuuucuggagacagaaucucaugacaccaaggcuggucuucaauucauuauguagccaaaaaugacccugaacuucucgaguacuagaaguacaggcugaugcuacuccacaugguguauggucuguaugguccugggggugggacccaggccuugguguaugcuaggcaagcacuccacccacugggcuacaccaaccugugaucuaagaauuuuuuuauaacucaauucuaguugguaguaugcauauauguauguauggagagagagagagagagagagagagagagagaaugcuugaacaugaauguguguugccgaggacuugggcaagcuaggcaggugcucuaccacugagcgguagccucaguuugcauaguucaaaacacagaagcagaaauuuuguuuauagcuauuucccauuagccuucaaggcgcacaagacuuuacuccauguuucuguucugugucaucucagcacgccauccccagaaguguuccuguccccauugaagagcgaugggacuagaaaccugcugucucugacuuccagagccagguuuaaguccaggaaggauguguauucagggcuucaugcauuuggcacagaugaucgcacauauuugcugaugucuucucuguuguacagcgacggguguuuguagguccaggaugccguguggaguguuuuggcgaaucugagagucucuggacucuggcucccagcugacguucuccuugcucuuaugauuucgcaggacaaaccagaaaaucgaaaagucgauaaaacuacagagcaaaauuaaaauuaucucuugugggagcgugcuuuuacuuagaaaauggagaauuguagcgccuuguuuuaauuuuuuuuuuuugaagaaaaaaauggugguuugcuuucuauaagcuucuauuuugggauaggcuuauuauuuucuuagcauuuauguuugaacugguuccucuuuaauuuuaauaauauauuugauuuaacccaauacaucccaaguaucauaucugcauauaauuaguauaaacagcuguuaaggacuauuuuacagaaauuccaagugaguuucugacaucuaucaauuaaaguauggcaguauugauuugaagcucagcacccauauggggccugugacugugacucagaaacugcaguuuugauuaagaagucagaguaagcuugccaucgccugcccuucccuuugcagcuucagaacuaaggcaguuuggcaauggugcucaugcauucugaccaguacauuuauucguuuugaguucuaauuuuguaacugaaaacuuuuugcucuacuuuucuuaugugccugugugcucaagugcacaugugcuugcuccguggcauguacuucgaggucagacaacuuggaguaauucguucucacuuuccacuguguguguccuggggauugaacucagguagucaggauugguggaguaauuuuaccugccgagacauugcuauggcccuaaaaauaauaaaaagagccagguggugguggugcaugccguuaacacaagcacuaaggaaacaggggccagccugguuuucagaaauaguuccaggacagccuggacuauacaaggaaaccuugucucaaacaaacaaacaaacaaacaaacaaaauauguguauguauacuuauacauaauacauauuacauauuauauauaaauaauaaaaaguuuaauucaucaacaaauucauccauauauaaugaugacuuuuuuuuuuccgagacaggguuucucuguguaucccuggcuguccuggaacucacuuuguagaccaggcuggccucgaacucagaaauccgccugccucugccucccgagugcuggaauuaaaggcgugagccauaaccacccggcauaauaaugaauuuugguuacuuucacucccccauugcuaucucucauucuauacucuuuccugcuaaagccauucuucccaaugagucccccuucuucuuccauguuguaugugugguccaucaaauuaaauuagaauugcuugcacaaguauagucuggggguuacuuacugggggugggauggucaagcucugaccaccgcagaggaauguuacuucuuugucugauagccauuuucugucaguggaucuuccgggaggggugaggccguauggacucuguacuggcuaguugugugucagcuugacacagcuggaguuaccacagaggaaggagcuucaguugggcaaaugcugucaugagauccagcuguaaggcauuuucucaauuagugaucaaggggggagggccccuugugggugggaccaucucugggcugguagucuugguucuauaagagagcaggcugagcaagccaggggaagcaagccaguaagaaacaucccuccauggccucugcaucagcuccugcuuucugaccugcuuaguuccauucccgacuuccuuuagugaugaacagcaauguggaaauguaagccgaauaaacccuuuccuccccaacugcuucuuggucaugauguuugugcaggaauagaaaccccgacuaagacagacucccuucccuucugugauggacuguuaagaacauagcugcugugaguucucacacgcucacccauauaguuuugaguaaucucauuuauucuuuuuuccuuuguaauagacuuuuauuguacugucuagaccaugauagauguacaugugcuuugguuucaaucauugcuacuuuaccuaagaaaugcaguucugcaugacaguugucuucuggagggguuuugccuccugcuccacaucccauaacuauauguauuuuugugguaagacagaguguuuguauucaggcucucccucauuggguuagguggagguggagguuuugcuuuggaugacguggugaaucuucuacacucagugugguaucucaguggcuccagucugagcuauuccauguccaauacuccauccuugugcucugacaguaugagaccucacaucuggcuuuaaaaugcucagcugaguagacaugaaggaugcugaagguucaguuuuuaugaaaauuucagugagaccauuucuuuaacaguacaauagacaucgaaagcacacaugccauuucacaaacagacuaaauuaguggguugaacagccuaguuuuauaguuuuauagaggcuccucaggugaauauuacucauucuaauaaauagguauguaaccuuugaaguuaccaguuuuagauuccuuggcuaaaagugccaaguuucaaguaauuaccugacaaaucaaguaguaugauuuaugucauucaagagguaaaugggcaguuucuuugugcacccaucuuugaucuucaggaauuguauuacgcuugugucagcagcagauguaguaguugggugacuucugugagaauuuaagauugguccugccaucuuuugauugauuuccaggcucaugguuucucaaguauuagcauccucuggcucuacuugcuuuacuugacaauuauuucuaagccucaguccugaugcugaagggcuugagggugcuguuaccuaauagccugaauaaguaccacugccuucaucugcagacgcaacucccgcugcucacauugaccuugauuucgaggacaccagagggugaccugacaauuaacagagugcacugcuaguuaugacaagcugagcaccaaggucccuucugcucaaaccuaacaucuggggagagccuuauuugggcuuaggaugacugacauuuaaaaggaucacauuugccuucugcaaauuuguguucacauaguuagagucugguuuccuuaccuguacuuccugccuugugggggcuuugcccugaagccacgguuuucuguaauccagagucaagcacaaugugugaugcacagaagaugcuccuguccguuugacaaaugaaugacugauguucaagggauucaggugguccauacuggagugguggaagggaugggaaaagggcugauacugggcaaaggucaguagaacuuugggaaacucuggugggauuggguagaaggagucuugugcagcgaugugggaaagucucaaaugauguucuuggcuaccugugcgcucuaugcucugggaauaguugacuugagcucuaucacagagugauaugaagacuuaguaaggucccaagugggacuggucuacucuuagaaagcuuaaacacagggugaacaugaguuauuguuacuaauggugagugaauguuucugauguugaauagcucuuagaaggaaccaugguugaaagguggugaucacugaguuggaaacaaugauguuuagccaaggcagcauucuguagcacuuacaagugagagcuuuggaaauaucuuaguggacaucuauugauuuuuaaaaauccuccacugguuuagaguugugucuuaguccaagguucagaggggaauuaagaauuauaaauacguuacagagaguugaguuuuauagagguuccggaugaauuugccuagaagcuuugcaaacauugauaaccagccguuguccuauggccuuacugauaagcagauauggagccggcacccccauuuuuugcaaaguccuuguuaauccuguaaagcgugacaggaaguugauaaucuuauucuccagcaaacagcaaacauuucccaguggaaaaaauucuugcuaaaaggcauaggaaacucagaagccucuugaauguaugugagaggaaugguggaugaacagaaggggugaagaagggugacuucagagagauugaugcauggaacaggguuugcuaccaucugcucucagggaccacaccccaugggcacauuucuucuuuguguguuacuuuugccucuauaauaaauuaaauacuuagaauauuaaaacaauaguguuuuaucagccaggcaaugaugaguuauagagcccaaggucccaagauaaucaagaggaacuggugacagucuccagacucagauccaccuccauugucaggaacucauugacccagaaacuuaguugucaucagagaugggcuguauuuuguauuuugucacugugacaacauuucagagggaaaaccccccaacuuaauggaggcaccauuuauuuugucucaguucuucagacauucuagugcauggccagcugguucuguugcuuucuaucaagcuugugauaggguauucaucauuaaggaagggcgugguagagaaaagccacucaccucucagcauccaagaaggagggguggggaggagagaaugagccugaguuauacacuucagagcuccucauguuguauuuccuccuuuccaucugcuucccaaucucauaauaggucaagagaguaguccuuucaucaccucaaacuuaccucaguccacucacuuccaaaaagcuccaucucuauauguuguauuugugaucaagccuugcacaaaugagcuuuguauggacguuccauagaaaugggaugcugguuaguuuuuuuuauugacaacuaaaagagugggcaguugagaaaaugcuucuaucaguuuggcaguuagguuaagucuuugggauauuuuauugauuaaugauugauauggaagggcccaguccacuacgggugacgccaucccugagcagguaguugcuggauugcauaaaaaggcaagcugaacaauugugugucacguagagcaccuuauacagauggcuuuauucaacugugggaaaauucaaguaguagguguuaaucucauuugagagaggaguagaacuuuuagaaagguucagggauguacuuaugugauagggaagccaggagagaugaagauccaggaggauuuuaggaguggccucaucaaucucugucccgaaguggugucuaucugucugucugucugucuaguagguagccuguguauuuacuuauguuagcugaaaacugugcgcuugagagcucuguggauugugugggucuccagggaucaugguuacagaaauggguuuuuauaaauagcaggggcaagaccaucacaugaucuggcauagugggagcaagucucagccaauggaaggucuauggcaguguuagacauagggauuauucagugagggacccugcugacugcaauguccagugucuccuuuguggcaucucacuuucugugugguuauugaaggcucuaaacccgugauuggaacugagaugacaucaaaucaugacuccaguggaauauuuuucccucccuucaaaggcacuuuaauuaaauuuccaucaugaagauaauuagauauuagacaagauuugccacaccuagccagccaguaaucaaggccaggauguuauuaagagacucugcuuuucuggaaacugaccuuuugagcuuucugagucugugguccugugaucuggggauuagucuccaugucuuccccuccccuccuucccuggacucuuauuucccccaaauuuagaaggaaaaauaucuuaaauaguuaagaaaggaaucuugguuguuuaaacuacugauaauuuucagagcuccuagauuuggaaugugugcucuuugcaugguucuggugugcuguaugucgaauugccuguguauggacaaaaauuaacucugcuccuggcacugccuaagugagccagucucauucacagauguugcucuguugcuguuggcugguuucucagcuggugaagacugcccccuacugaccuuagcagcugcauaauuugacaaaguaaucuauaaguacaucucuuuuucuacacuucuuccuucccuuccucuucuuuccuagugcauauagugauuucuuacuacauacuaguuauuaugauugaaguugauguuguaauagagagaaaaaaaaccagagguacuucuacuuggaaaaaauuuggacuucuuuaguaagacauuugacugcuagacacuagagugaccuguggacauacaucaguggcugacgaguggaacuguaacacuugugacugaugaucuccugcaguaucagugaggaggggcagagaaaggggaagguuuugagguuuugugugauggaucugcaagggaucaauccuuccacccuuuggaaaguuuuucaacaucucuuucauacaguuucuucauauuuauauagagaaacuaauuuucaaagcauagcagccccugggaaugugcagucuagcaugugauguacacagucaccguggaaagguuugagugugaauaagaguauggaaaauguguguaaggugagugugaggcaguccugucuguagguguaacagagaggaaggccgaaggaggaaaaccugaaucaccaugugugcuucuuguuauaaacaccacccacuucaugugcaggcuagggagaaagaaccaaccuuucagagugugggagacccacauggugauaaaggaugggcuaguccauguuagcugcacuuuggcugaaaaugguucuugguugcacagaacauauucagaauguuuuacuucuauagaaaugguagucauggcuuuacuauuaguuuuauaugauugccaaaguaauacauacccaguaugugagauuuauaaaccccaggggaguauaauagguaagcagcagcucuaauucuaaugcuuacagguuuuuguuagcauuauaucugucagucugucugucuauccuguuuuguuucuucuuuuaaaauuuauuuauuguguacagguaucucauuugcauguugucugugcaucauguauaugcauugucuguugaagacaggagagaguauuauaaccucugggacuggaguuacagauggguugugagcugccauguaggugcugggacucgaacccagguucacuggaagagcagccagugcucuuaacaacugagccaucucuccagcuccauuuuuuguucucuuuuuaaaaugugugugugcaaauguaccacauuuucuguauccauuccucuguugaggggcaucuggguucuuuccagcuucuggcuauuauaaacaaggcugcuaugaacauaguggagcauguguucuucuuaccggucgggacaucuucuggauauaugcccaggagagguauugcuggauccuccgguaguacuauguccaauuuucugaggaaccgccagacugauuuccagagugguuguacaagcuugcaaucucaccaacaauggaggaguguuccccuuucuccacauccucgccaacaucugcugucaccugaguuuuagccauucugacuggagugaaguggaaucucaguguuguuuugauuugcauuucccugaugauuaaggauguugaccauuuuuuucagguguuucucugccauucgguauuccucaggugagaauucuuuguucagcucugagccccauuuuuuaaugggguuauuugauuuucuggaguccaccuucuugaguucuuuauauauauuggauauuaguccccuauccgauuugggauagguaaagauccuuucccaaucuguugguggccuuuuugucuuauugacagugucuuuugcuuugcagaagcuuugcaauuuuaugaggucccauuuaucaauucuugaucuuacagcacaagccauugcuguucuauucaggaauuuuuccccugugcccauaucuucgaggcuuuucccuacuuucuccucuauaaguuucagugucucugguuuuauguggaguuccuugauccacuuagauuugaccuuagcacaaggagauaggaauggaucgauucacauucuucuacaugauaaccgccaguugugccagcaccauuuguugaaaaugcugucuuuuuuccacuggaugguuuuagcucccuugucaaagaucaagugacuauagguguguggguucaucucugggucuucaauucuguuccauuggucuacuugucugucacuauacuacucagcuauuaaaaaaaugaauuuaugaaauuccuaggcaaauggauggaccuggaggguaucauccugagugaaguaacccaaucacaaaggaacucgcacaauauguacucacugauaaguggauaauagcccagaaacuuaggauacccaagauauaagauacaacuugccaaacgcaugaaauuaaagaagaacaaagaccaaaguguggacacuuuacccuuucuuagaaaugggaacaaaacacccauagaaggaguuacagagacaaaauuuggagcugugacgaaaagauggaccaucuagugacugccauaugcagggauccaucccauaaucagcuuccaaaugcugacaccauugcauacacuagcaagauuucgcugaaaggacccaguuauagcucucucuugugagacuaugccggggccuagcaaacacagaaguggaugaucacagucagcuauuggaugggucacacagccccuaauggaggagcuagagaaauuacccaaggagcuauagggaacugcaacccuauagguggaacaacaauaugaacuaaccaguacccgggagcucuugucuuuagcugcauauguaucaacagauggccuagucggccaucacugcaaagagaggcccauuggacacgcaaacuuuauaugccccaguacaggggaaugccagggccaaaaagggggaguggguggguaggggauuggggggguggguaugggggaccuuugggauagcauugaaaauguaaaugaggaaaauaccuaauuaaaaaaaaagaauuaaaaauucuuuuuuccaaacagcaauuaguuauuacaaaauauugauauuugaccuauugcauaccaucauuuuaaauaaaauugauauucaucuuaaaaaaaugugugugugcauguguggguuugugcacgugugugugccugugugugugucuuaggggaugguagcucacuaaugcuagaggaugucccugguuguugggucuccucacuuucugccuuguuugggaaaggaucuccuguuugccacuuccuacacugggguagcuggcucaagagcuuuuggaaguuuccugggauucuucugucaucacuucccaucucgccauacaugcuuugggauuacagacaugaucuacugcauccagcuuuccaugggugcuggggauccgaacucagguccucccacuuguguaacuguuuacccagugagcuaccuccuuggaccuacuuuguucccguuuuucagugaacaccaacccagaagaaaacagcugacauuaaacuaugaugccuaaccagcugugcuuuucagagacauuucaacagacgcucguccugacaagaggcuuuugggauagucuugugucacaaggaggaaaaugcucuggugcuuugagucauugagaaaaugcagcguuuucuucucugacagucuuaaaauauagcagagugaacucccgucuucuggauggcaaggacgugacccucuuuaccgccugcugcucuuugacuuguggauaaaccuugagcaugcuuuucugagaauucacuucucaaacuggcagaaagacacacugguuagaauaugaucugagagagacguugauuaaucccuaaccuacacuugcuugaggacugaagaguucaucucccaaagagcaggggccucuucagcuacucauuuuuaaauauuaaaaucauuguaaaagucuacaccgacuaauccugaauaaagacaggagagauuaaugucacuagaauguaguuuuacaugaacaaagcacuuuaagugaacuuaagucuaagaagcugcuuagacagagguguauguguccaauugggugggauaacucuuugugugugugugugugugugugugugugugugugugugugugugugugugugugugagcaggaagagcaagguaggaggcaagagggaagaggccuaaaguuguaguuuuuucugugagcuugaucuaaauguauguacugcuguuagauucaaggaagaguuuaugggcuggggcugauucuaagugauggagaaauuaucuucuugcauaaggcccugaauacuuagcacugggaaaaaaaaacuagaaaagacaaggucauacuaccuaucuugacuaaaaucaugucuugcugaguccaguguuucucagaauauuuucugugugucugcgugcauguauguauacacacauauguguauaaguagaugcauguguauaugcacacaggaacauagguccuucuuucuguaagauauaaacagguaaggagaauagagaaaauauuuucuguauugaguagucugcuugcgaagauuuuuagcuaguucauuuaacaaaugccgucgcacucauugaguggaagaauugcccugcaaauggggccuaaggacuugucuacaggcgucagugguggcagcaaaggucaccggagcucugacagauguuaaucugugucauuuacucugcugggaagucucuuucuuugggauaacaucuaucucugaagccugaggcuccuuucagucugugucugccuaccuuuucacuuuuaccucccauaccauacaguuccugggacucucccgggauugaugaagcccgugcuauguaugggcauuuucagauaauggguguguguguacaugugcaagguagguuuuuuuguuuguuuguuuuuguuuuugucaccuugacacaagguagagucaucugagagggaaccacauuugagaagaugccuccaucagacuggacuguaagcaaguaugugaagcgucuucuugaauaaugauugauguugcacugucuguccugggugcuauaagauagaaagcugaacaagccaguaagcagcauccccccauggucucugcuucaaguuccugccuccagguugaguucuuguucugccuuccucagugauggacucugauguagaaguauaacccaaauacacucuuucuuccccaugccaccuuuugauaaugguuuuuauuacagcaauagaaagcagccuagggauguggcuucucagguauuuuccaaggcuucagauuugugccugaguccuugaggguuuucugucuuagaaagcuuugccuccaucagcugaggcugacacucuuccacuugcccuuuuuuauuuccuguaaagacaaugagauccuggcagaaucucuaguucucaguauggcgugggaaaggaaaaccaaguggcgacuuaagaggucuugaagugaagggugagucacaguuagcgggugccuuaacugaaaauguuucuuaguaucacuggcauuuuaaaaaggaauguuuuguuuuuguagaaccgauauucaagguuugugugugguguguguguguauguuguaugugugugaugugcauguggaugugaauguguguguguaugugcaugugcauguggaugugaauguguguguguaugugcaugugcgugugcaugugugugucuguguguguguaugugaaugugcaugugcgugugcguguaugugaaugugcaugugcauguguguguguguggguauguaugugaaugugcaugugcgugugcgugugcgugugcguguguguguguguguggaggccagaggaagacauugggugucuagcuuaauuuccuugagacaggaucucucacugaaccaggagcuaggcuggcagccaucacgucccacugauccucuguguccaccugccauagcccguggaggcgacagacaagucugaguuguuacacauacacacacacacaaacacauacacacacacacacacacacacacacacacaguaugugaguacacuguagcugucuuugacgcaccagaagagggcaucagaucccauuacaaaugguugugagucaccaugugguugcugggaauugaacucaggacuuuuagaagaacaaucacugcucuuaaccacugagccaccucuccagcccuguacauaguguuuuaaugugggaauuugaagucugcuccucaugcuugccaggaagcgcuccucuuauccacggaguccuuuccauagcucugcgauauuuuuaugugugugauugauuauaugcaauauguaauguggagcauauaguaacugugaagucagugguuucaacaaaugaauuaggccagcucaacgauagcccaagucucuagcggggaugcauacacucagcuuuugucuagcuaaggaaucuuauuucccuuuucauucauggaagguaguuucgcugaguucuuggcuuauuuauuuauuuauuuuuguuggugugcugaauauauuaacccaauucucucuggccuacaaaguuuccgauggggaaaaaacaauccacugccagccucccagaagcccucuguauuccacagguuauuuuuuucucgcugcuuucuuccugugaccuuucauauuggauaacguaucugauguagauuucuuuagacgccuccuaguuggaguuuguugagaauuugaauuuuuaugcauaucuuucucuuucaaaaucugggggcguuuggggucaguauugcuuuguauaaucucuuuucuccauuuucaaugauuucuccuuuaagacuccacacguguguaacauaauagaauauguaaguguaacaugggcccaccugacaccauccauagaucuucaaagcccucaccaggucucuuuaucuuuaugucuucaacagccuguccucaagucccuugcuacuguugcuuucucuccuuuaagugguuuaucuuuguugauauucucaucuuguucaugcuucaauuuccugaauuuauuuaguuguuugauuuuuuuuuuuuuuggccuaauugaacaucuuaaaaauaauuaauucaaguucauugucagguaauuuaccaguuucuuuagggugaguuuccagacauuuauuugguucugugacugggucauuuuuucauggugugugugugugugugcccacccauaaguccugugaucuuuuagagagauuugggucuaugaaacaauagucaccucucccauuuaucaugggcuggcuuuuuacagaggaaccucacgaaucagccaggcaagagagugugcaggccucucaaacuuuuuucugaauaucuucucuggaacuuuaugugauuucacaaaugcagaagaaggcucuguuauuaggagcuggcauucucuuguuucugccugugaucuguuuaggguacuguagguucuucaaggcugcaccuaccugcuguguuggcuuuuuuccucagugaccaccaagccuccaaguauacugcuucucuccccuccuugagucauguccccgggcuaugcuugcugaagccaguguugaaagaacauuuaucucuuuucgauuuugugggagaaacaggcuuuguuguuuucucucccuuucugcuugcuucaauaguugggaggggcuaucagugguuggugguuaauuuagagggauuaaggaacaccuagggcaacagugaggcucaggguucagugucuguaagaacuuuccaguccuuacuaagcuaaacuggggaaaauucacacuggaugugggugacacuaaccccuugcacugagguccugacuggagaaaaaagggaaaagaagaaagccagcugagggucuugguuuuuuuuuuucuccccucuugguuugugaauccacugagauguagacaaguagccucccaauggcauggaacagagcuggccaggcagccagacuuuccccuccaugaugauucauccuaugaaccaggaccugaaacaccucuucucucagccuagcaugaugcugugagccuguaacuuagcacuugggagcuggggacaguguggucaggaugucaaggccaguuacuagcaugcagacuuugagggcagccugagucacaugacacccggucucaucccaagugacugucaauagacaguauaacccucucuuuccugcacuugcuugccacaggcauuuugucacagguuuuuucaguagaaaagugacuccuacaguaagcaauagcaacccacuucucccuuucuuuggcacgccuauucuucgucuuacccucacuuggcuguacuucaccuccuaacugguuucaggaggucucgcaaagguaauuuuguuuguauauuuuuauuuacucauuguuuucaugggaggauaagaacuggaggcuuccuguucgacugucuuaugucauucccauguguaauccaaaucucuguuuuauaagauggggauaauggauauuacuagaacuuugguaauuaaagugauagaaaugcuaacacaucugcccccugucacuucugcaauagggauucaauacccauugcagacucuggcuuugcagucucugcuugucugucucucuuuagcaacaguugcuagcauuuaguaaaugcuuggcacacgucugucauucuucauaucuguguuauaugcauaaacuccuuuguuaucacaguuguaaauaggcaaugcuggcaucucauuuacauaugagaaaacugguuauagaaaguagauauuuuauucaaggucaagcaguguaaacuggucucaaggcucaauuuucaacaggcauuguauuuuuaacuacauuuauugucauggagaaauuuuaaguuagucauauaaugaaagggacucuugguccugauugccaugaaaauaaauguauuggaugugcuauguacauugagcuauagucccuucaacugcaaaccgagugauaguuucagccaggcgugcuggugcccugcuucuguucuaguggcaggcagaggcaggugagucucugaguucaaggccagucuggucuacagaguucuaggacugccagaacuauguagugagagacugucuugagaaauacagcacccuucuuccaaagagugaucauuuuuaaaaacuuuuuauuuuuaauuuuauacauggauacaaugcauuuuaaucauaucuacauccuucccaacuccuugagucccuccuucccuuucaacuucauauucucuucaucuguaauuguaaaugcgcucucucucucucucucucucucucucucucucucucucucucucucguccaauuaauguugcccauaugcacacgaguauauggcugaccacuuagguauggccaaccuaucaggggcucgucugugaagaaaacuugagucuuucucagaaacuguggauugccucuaguugggaacugggggugacccuugugagcccuuguugcauccaugcuggaaugcugaucggugucaucuugugcagguuuucugcagccagccuuagcuguugaggguccauggguguggcaucuucaucauauccaaaagacgucacuaauuccuguucccuggcucugauaaucuuucugccccucuucucagauguuucagggguccugcauagaugauccacuuauagaagguaacuccacagguacuugguuucugcaccuuggucaguugaguuucuuugcaaauagcgaucaucugcugcaaaaaaugaacuuccucauugaaagaugagagcggcacugaucaaugggcuugagaccuaaguguuuagaaagcagcuggaaacucaucuguugagcaaaacugguugugguagcuuuuggaagaggcauuuugcauggugaaacaaauauucuuuuauucaaaugauuguuguuuauacugaauaaacuguauauaguuaggucaaccucaaauagaauauuuuguuguaauaaguacuuucucaauuauuaugaauauuauuuuguguuaauuauaaaggcuaauuaugcugcugaaggugucuauaauuuacauauccaaaugcaaagugacaugaaagaugaauuguuugacaauggcauggaaaaacuggguuguauaguauuuaugcccaucaccuuuccuuuucccucucccauguuaagaguugacucuucuuaacuagucucccuccuaggcucauagcuugcuuuauuuuauguacuuuaugcauaugcauauuuauuuuauacagaugaaaauucauggaggugaauuuugugugucuucuuuuuuuuuuuuuuuuccaggacagaguucauucaaacaggccgaauuucaaucacgggggcuggguuucucaacuguauuuuggaaacuuuugcuaguacguucuuaagacaaggagcccagaagguaagcuugcuucuacuuugaacuaauguucauuuuaaagaaacauggaaguuucaguuggguauugacuaagacauaguagaagagugucauguacggauaugauacauauagggggguuaaugaguaaacauguacccagaauuucucuuaauaauugcuauuuaagucaagacuuuaccuuucuccugugagcccaggcugaaaaggucugaacauguucuaaggagcacugucuagggaugcugagcuugcuaacauguucuuggccuaacugagggguuuccugucauggauccagaccgguuuagcuugggcuggaagguaguagcugaaauccuagaaggucggaugccacuuuuuuuuuuuuuuuaaaucccauuuagguucccagcacccaugaugggcaguuaacaaccacccauagcucaaacucuagggacuccaaugcccucuuuugaccuccauggucuccuacacuuacauacauauaaagaauuucugccaugacuggugccccacaaauaugcauauacauggucuuuuauuuuugaccuuaaaauacuucaauuucuuuaaaauauccucaugguuuugacccaccuucauggggguaauuuaaaagucugauuugguuaauaaauuuugauaagaucguuuuggguaguguuaccuaaguuauagacaaaaugcugaagauaacagaacuaagggccauuuuguucugaaaguuacuucuuucuucaccccaacauuucccaggauguggaagauuaguugauaaauagucuggcuccuuaguccugcaaauguauucuucuaacaugugcaguuugguaguaugaaugauuaaaacugaccuugguucuuucaaccuguuccuagguauggagauagaauuaauugcuuucuuucuuucuuuuuauauuauuauuggguauuuauuucauuuacauuuccaaugcuaucccaaaagucccccacacccucccacacccaacucccccacucccaccucuuggcccuaguguuccccuguacugaggcauauaaagucugcacgaccaauggccucucuuuccacugauggcugaccaggccaucuucugauacauaugcucugggggacaugagcucugggggggcggaggggggguacugguuaguucauauuguuguuccaccuauaguguugcagaucccccccagcucccuggguacuuccuccagcuccuccauugguggcccugugauccauccaauagcugacugugagcauccacuucuguguuugcuaggcccuggcauaggauaccacuuuuacucacugaaacauuauugugcuugucuucuacuagaccacacuaugugcguuuguuaaaaaaaaaaaagaaaaaagaaaaaagaaaagaaaagaaagaaaggaaaaaaauaacacugcuauucuccuauuugcaaaacugcuaccucaaaguaaugccccuggcgagaaaauuaauuuuaucacuguguugcugacugaguuggcuccuuguucaucuauuaaaucccauauuagaaaagccauaauaauaauuaaguguaauuguuuugcacauaagucuauucaucaaaaagaagggaucccuuuugggagagauaauauuuaaaaguugaguugaggcuucuuauuauuaaauuggcugcauauagacauaagagaaaaaaguccuuucuguaguucguaugaaaggugauaggaggcuguuugcauccugggggauuagggcugcugcaccugagauaaauacaugucccauucaccugaguaacuuuguauuuuaccugucuucagucugaaccugcgaauacuuguuaaucaugucuugauccccauuuuauugauaaacgaugauuaaacaaggaugucccauacaguccuuccaucucgccuaucuucuuucuccuuacgggagaguaccugccuugugcuaggaacuuuguuaaaugugggaaguggauuuauucugucacaggaguaguaaaauuuaggcucuaaacucacaucgcguguuucauuggcaaguguucacuccccucggcagccccaggcagauguggugacggccuuaccuucucaggacaauuagcuucacauggaucgcugugcuggggacuuguguggugccuuugcuacuuauauauguuaggauucuuugguugucagugacaaagcacacuuuaaguuagccauuggcaugggacaagggcacugaaacuggcugauggcuucaggaagggcugcccugagguaggaccuuaugaauaucuuugcaggauuuguucuccaacccagucuaucccugacuguagagaugcuugugugcugcuggaccuuuuucuuguagccuugcuuucucuguuuagugggaugugggucuccacuguccagguguuauguugaauaggguucuagccaaugaaaagacugccugcaucuaucuaucuaucuaucuaucuaucuaucuaucuaucuaucuaccuaccuaucuauccauauaucuaucauccauccauccauccaucuaucaucuaucuauauguaucuauaucuguaucuaucaucuaugucuauguaucuaccaucuuuguucauucauucauuuguuccuuccuccuuccuucuuucuuuccuuccuuuucuuuuuguuucuguuagcaaaaugacuauccauuuauuucuucuuuuucuaaugucucuggaagagggccuuguuuguaagcagaccaagcaggacuaguagauugagugaccuucuucucugccaugacaauggggaaucagggcugaggucucuucucauagaaaauauucccuaagcauuuuuguuucuaguauguccucauguuagacucuacccuaaugggaaagcaagaaagagagagagagagggagagagagagagagaaagagagagagagagagagagagagagagagagagagagagagagagagaauaagaaagcacauucuguucuuaucucucuuucucucccucucuucaccuuuaccucccacucccaccccuguaugcaaugcgugccagaaaaggacguuagaugccuuacucugucucucacugaaccuuaagcuagccugguggucacuaagacccagccauccuccugucuuccacucaccuauugaauuuguguuacaggucugugugugugugcccaaccuuuuauguggaugcugguauuugaacuagguccucaugcuugcacagagaaugucccaccgaaucaucucuucagucccagcuuuauuaaucuugaucccgacuccuucauaaccucugauacuuggacagugccugcaucgugcaugugcaaaugaauagaccggaaauggaauacacagugaggugccuuguuagccucucaugaauauucacucgaacaaaaccaacaauaccaagugacucuaauguuuuaacccaaggaacccuuuauuuuuuauuacguucagaaguaagagaauauauccaaccccgccagcuucucuaaguuugccuucugaagaggcuaaguuuaauuagcuuuuccguuuuagaaggcauccaugcuuaagugucuuuuaucucuugcucaugugcugauguuccuagggccagcccgccuuucugguaaaccucagagcugugccugcauaacugguuucugcccuugugccugugccagggucuuaaggugacuguaccuuugaacuuuguccuagaaguuguuuagcagagauaauggcaggagccuauagcuuuuuuuuuuucccuaguaaaagcaaaauuaggcucucagacucuuuauguuuguaaguuaacgucgggcuguuguuguggggcuguaggccaaggucacuuguguuucagagccuuauuuuucuuuucccucugauaucuaguguaguuuauaacucgggguccuuucuggcacacaugcuggauuccaccagucagaagcugcucuacucuuggguuagauggggugguuaucagaguuauugauuuccuuagauugucaagcuccaggugcaccccugcagcgggagcgcuuguacauugguugcgguggugcacccucccauugcuaugugacccagcagaagucccuuugcccauuuguuuaucugccaaagagggacuuuuauguauuccuagauuuacgaguauaaaaugugaggguuuuaaaaauggaagcacaugggucacguauaagcacguggucucuuuguuuuuaagggugaaaagcauugaaaucacaguacgagauuuggaaucuuuucccacuccauaagcaucuuuugaugaccaucaugugcugggcguuggguagagugcuggagauacauugaagugagauacauuuacaggauggagacugugccuugugcgguuuuaguuugggguuugucacugagggugaaaaguauggcaaacaguaaccaaauagcugcuaguguuaggaauggguggcgcucagcuuggugucagugcucaguacucugaguccaaggaggguuuuaaggagguggcucuugggcgugagaguuguggaugggaagucucgugccuauugugcauggccuuauccacgucucugagcaaccagugacauagcaaucgugguucuccuuuuaucuauguugggaaaccaaggucccaagugacagaacgguuuucucaagguuacaaaauuagaaaguagggccauuggaaugugauccaaagguugucugagcccagaguauguuccugguuucuaacucuggucccaucuaugaucucugcacucaaacuguguguguguguguguugggggguagggaguugggguucggccccggaaguauguguuuagaguagucaacaagggcuuaugugcauagugaagaagaaaggaugcaagaagagggagcucguuuaugauggaggaacucaaacagggcaggaaaauggggggccccuggucacuuuuauagugccagaagcaaguauccuuugcuuagucagcaaagagccugccugccacaaaaauccugaagaccugaugucaaccccuagaacuccuguuaaaaagcuggacuucuaauccuagugcugaguaggcaaagaaagguagauccuuggaacucucuggccaggcaaccuagccuauccaguaagcuccaggccagcgggggaccucguaucaaaacacaaggugggcagcucccgaggaacaacacugggagcucaucucuuacuucacauguacacacaucugcacacacacuugcacaaacaucaccccccaucccccacagacgcacagacacguauagacagacagaaacacacacucagacacauacagacagaaaaacacagacgcacagacacagacagacauacacacacagucagauuaaaaacacacauauagaaacacucacacagacacacagccagauauagacaaacacagacauaaagauguacacauacacacaaagacaaacagauauaggcauauagaaacacagacagacauacacacacaagaucuuugagcuuuugacucaaauuuauuugugugugacuuucuucuuuuugaaggguuucagguuguuaguugcccauauauagaaauacugucuuuuuuuuuuuuuauuaauuuuguauccuuaaacuuuacugaauuuauuauuguuauucucacaucuuuuugggacaaaucuuuuaaggaucuuuauguaguaaaaucaugcuaucaacaaacaugcacauuucucuccuuccuuucuuacuugaauacccauuauugccuugucuugucuguuaguccugucuagacuuuaguaguauguuaaauacaagugaugaggauaguccauuuuccuuuccucucacagcuuuaagcauaacaccuauaaacaauccauuauugugcaucuuucucaagccugugcugaagagaguccauauacacuaagaucucagccagugagcacuggagagugugucuuauggcgugcuccucaaugugggaggcaccgcauagauguguaauagaaucugagcgcagccccucuguacaaagaaucagauaguagguaaaugcuguucuaaccuguaaaguuaggguuauuuguuauucagcaauaaauaaccaauagaguggguuuuaaaaaaaaucaugugaucagauucacucugcagaccaggcugcccuugaacucacagaaauguuccugccucugccuccugagugcugggauuaaauauaugugccaccacacauagccuagccagggcuuuucaaauguccuuuuggaccacauguaucagaccgaguuuucuuugacaggagggaauuauauuauccauuguaaaaauggaauuuuaaaagguccaaacuaaugaccacacauccuaaacugacauagccagauuuuuuagauauagcgagugcguccaagucagaccuugaaagucauuuccaagugguuugacuugccuauaauuguuucuguaacaaauauuucauacacugucgcaugccguuucugcuucaaccuucugaucagcguguuaagaauacccacaguacaaauaacggggccuucuacaagaguggcugaaauaacaaauuauuuuaucacacauugaaaaauauauucacaaacuuaaagaaagagcaugccugugugauuguauaaugagaacucugcauucugaggcauucguagcugucccuaaccacagagacaaacuggcuaaaaaaagaacacucuuaugacaagauuguuaucacuguauuaucuuccaagccuccacagagaagugaaaagugaauucuggccaagaaaccaagugggggcaacuuaccaaaaacuuaugauguagauuugccuuuuuggaagugggggcggggcggguguguguggcuugugguaacuccucuugacuugcagagauggaagcaaagcuucccaggauuguguuccuugugguguaaaaugcccuuggggugauguuaacuagaggaaagaguuggcuuuggaagcaaacaugucuugucugaauggaaauuagaggcauaauagaguaugcacgcagauccccaguuugccuguaguaucagucucauaauaaggagggcagucacaaggaaguagagucaagcacucuucugaaccaguggucugguggaggacuaucugaucuuaaaugguuuuaauugugauauauagccuccauggucaggcaaggaugggaaaaucucuggaauuuugaccugaucccuauaucucaagucuagaauuuugaccugaucccuguaucucaagucccaucaauggcauuaaugagauucuaucucucaugugcacuaaggcaguuaauaaggcaccaauuucaccagugcauacucaguuaacaugccuugggcuaacauucuuucaaagauagcaauaauagaaaauuuuaaagugagguugcugagaacagucacuaccaccacuggagagugaagccccaggagggcacugagugugcaugacaggacaguuauuacagugugcauacacaauugcuuuggagcaaaccauagacaccauaacagugagguucaaccccugaacuggaguguguuugcgucucaaaggcuguuuaggaugaaguggaauucugggcaggugcucuguguagugacugaaugugaaguuuuauagaaagauucguuggucacuggucugauacucuagaugacacguuacaaccaagaccccagccuuuucucuauaaaaugggugaucuuaguuuuauuccacagagauuugaaaggaguucauaagcuugugagcaugcauggcacauguuaaacuucaauaauuacuaguauuaaaagauguauuuugauaaaaaguguauuuauagguaaauagcucuuugugugugugugugagagagagagagagugugugugugugugugugugugugugugugugugugagaguauguguguaugaauguaacacauguacauguguaugcaugaguguggaagacagaggacaaccuuguaucacacuucagauaccauucaccuuguuuucugacacagcaccugucacuggggccuggggcucucuagguaggcuaggcuggcaaggcagugaacgucagggcuaucuaucuaccugucugugccucccuggcaacugggauuacaaguguguaccaccaugccuggcuuacuucuauucugagauugaccucuggucuucaugucagcaagacaauuaccuuaccaaguguguuacagcgcuagcccuguaaacagccucuuaaguacuuacucgaguaugauuuugguugcuauuuuguugugacaagagucucucuauuauaguauccucggcuggccuagaauuugccuagaauugccucguuggccugaaauucauaaucuuuuugccuuugcuuccaaguucagguggcagguguaggcccauguagaugagauuuuaguugccuuggaaacgucuugacaguuaagugagcuuggguguaggugcuauugcuuucuccuuuugcuucauuauuggcuuggguccaagaacccugacuaggggcaacaaggaaaugaagaaacaacuuacacaugaaugcagaaaagcugggaucagguggucugggcucucugauagagaaaucaccgcagccugggaacucaagaguuaucuauuacauacuguuaaacagggagggaggcaguuuuaucacacacagauaaacaaggaggcaggguuauuauaugcaguugaaaaaggaggcgagucuagcuaaucucuguaggagcaguuucugaaggggagcugucuccaggucauaaauguccaggaggagaaugccauccgugguggacauuuucugugcacauugucagcauuagcauucagacccaagaaggcuuugaagucccucugagccucacccagggaaggguuugccauucuuauggaucuggagucuuuguuauggcugugccaagucaaacacuacuuguuuauucaggauuccuugguucccugccucucucucucucucucucccucuuucuuucucucucucucucucucucucucucucucucucucucugugugugugugugugugugugugcuguuggagaucuuauggccuugaacauacucaguauacaagcacucauucaguuagcuaugucucuccagccuuggauaagauuuuagauauacaaugguaaaggagaaguuuguguuguuucuuuuuguguguguguuuaucauuuuuaaaaauuaucaguauuugauucaaguauaaguuauacaaugaaguauaacuuauaauuaaaauaauguaucucucuuuagcauguugauuuugcucuuucugugugucucuguguguuugcauaugucuagauuaaugguuuuuauuuuuuaagaagcuggaauuauucagccgagcguuuucacguauggacauauuuuaacauuuuuuucucugucauuacauauuuccuuuguuguuguuauuugauguuuuuagacacuuuuuacaaauagccuaagcuuccuuaaagucccugcuugauucaugcugguguugaacuuuagaucucccgccauugccucccaagcauuggcuuacagcguucacagguaacuacacaugcacagucuucaaagguuggaccguuuggacaauacccucuuuauguaauagcuuuuauuaucaauuucuauuuuuuucuauuacuggaaauagaauugggucaaaucucuaaguguaaauccuucuguacauuucugauuaccucuuggauuaagacccucuaugugucuuaacaaguuccuuucuaaaacaauucugcugguuuacagccucuuuaucaauucuguucuggacaucccugguuuucuugugaguugaaugaaugacuugacauuuuagaacugucaaagggcugauuauuuuuagcucauugaauugugaagcagaugcaaaauuaccagcucugagccuccgauuaucuacucuggaaaugauaaguuacugauuuugcuguuggcacaucauuuggccucagugcccgucugggcuuuuuauguuguuugauguugauaugacuguucugugaaugaugaguuccuuaacugagaacuuuguguuccaugcauacacucuuaaaaacauggauauuuuaaagucaguguccccaagagagaggagcagagaaagaaguauuauucuacaacauaaguaaaaguuauuggaacaagaagguuucucuguguaucucuggcuguccuggaacucacuguguagaccaggcuggccuugaacucagagauccaucugacucugccuccugaauguggggguuaaaggcugauaaugcucuuuaaccccacucuugagagcgcaaauagaccaauucaggagacacagaugaguuaauucauuugaugccacgagaugccuacuuuuuaaaaaaauuuuuauuuuauuauccaguuauuuuauuccaaucauagcccacccucuccucuuuccagucuuacccuuacaacuguuucccuccauugcccccucucuucucagagaaggaaagcuccccugguaccacccuacccuggggcaucuaguaacagcaggacugggcacaucccuucccaccgaggcccaacuaggcaguccagucagggggaacaggauccaauggcagggaacagagaccaagagagccccugcuccacuuguuaguggacucacaugaagaccaagcugcacauuugcuacaaauguauaggggaucuagguccagugccuguaugcuccuugguuggugacccaggaucugugagcccccauggucccagguuaguugacucugugggucuucuugugguguccuugacccuucugacuugcuaauuucuauaccccauucuuucacaagauucccuggacucugucugguauuugugagucucggacucugcauucauccacugcuggauguagucucucaggagacaguuaugcuaggugucugucuguaagcauaggagaguauuguuaauagugucagggcuuggcucuuuugaaugugaugggucccaaguugggacaguuauugcuuggcuguucccugaguuucugcuccaucuguaucacugcacaucuuguaggcaagacaaauuuugggucacauauuuugugguggauugcuauuuucuucccuccucuggaauuccugucuaugaacagaggguagccacuucagucucuauaucccucucugauagcaauguuaccuaagguuacuauuauagacuccucauaucuucuuccaucccaggccuccagcuaaucaccagagaugacccccuccccugcugauucuuauuuccacaccucucuugcccuucuacccccagcacccccuuggcaccucccauaccugaucaccagccccguucccauacucacuuacucuucaacucaggccccucuccauccaccuccaaugacuauuuaauugccccuucugagugagauucacuuuuucucccuugggaccuccuuauuugacuggguccaagggucagucauuggggucugcaagagagagagagagaguggagacugaggggcaagaggcgcgaagauuggagacaagacagucggucugaucaagucucaagucuaguuuauuggaaggcaacuauggguauauaugcacacgcucgggagugcagcuggagacacuuaaccacagguccagaauguguaggagaaaaacaaauguuaucagagugugcuuagcuguggugggcuucuugcaaaaacaucaugcuaggaaaacaagucucuuguuaggguggaaaaguaccaccuguaagaaaauagcccgagguggcugcagagaugagagcuacuuucugcuaggagccaguuuccaacauuuauuacccaauuucuuugggucuguagauuguagcaugguuguccuugaacucauugguacaggagacaacauucugagcauaacaucaacaauggcuuagggucuaagaucaacaacuuauaaaugggaccucaugaaacugaaaagcuuuguaaggcaaaugacacugucaauaggacagaauggcagccuacagauugggaaaagaucuuuaccaacccuacaucugauuaagggcuaauauccaaaauuuauaaagaacucaagaaauuagacaccaccaaaucaaauaacccaauuauaaaaugggguuacagagcuaaacagagaauucucaacagagaaaucucaaauggcugagaagcacuuaaaggaauguucagugccuuuaguuaucagggaaauucaaaucacaaugaacccuagauuccaucuuacacccuucaaaauggcuaagaucaaaaacucaagugauagcacaugcugcugagguuguggagcaaggggcacacuccuccagugcuggugcaaauacaaacuuguacaaccaccuuggaaagucaauuugguuugucagaaaacugggaagaguuguaccucaagacccaacuauaccacuccuggacauacacccaaaagaugucccacuauaccacagguacacuugcucaauuauguuuauagcagcuuuauguguaauagcccgaaccuggaaacaaccuagauguuccgcaacugaaaaauggauacagaaaaugggcucaucuacacaauuuagcuauuaaaaacaaagauagcaugaaucuugcaggcaauuggaugguauaucauccugagugagguagcccagagucagaaaaacacauaugguauguucucaccauaaaggaugcuacuucuuaauaacuuauuuccagauaggucugucuucuugcauggccccucccaaucagcucugcucauucuguugucauuagaaucuuagucucccgaaacacagucuuccccagcagagaaaaaugaauauucugugaguuauaaugcguuuuuguuuucuuuuugaccauaaggccuacgaaucccaaauccuuggauggcucauuugaauccaucuguuuguaauagacuuugcuuaccaccauaccuuuugggaaaucucuuaaaccagcaagcuacaauucugggauguuuugucucugaagcaaggugaaaucugggauagaaaguguuuuccugagauuuggauguauguggggucacuguaugaugguaggagagaccaugcauacaggguguagcaaugagugugcugacuugcccauaaguuaggaaacucagguccuguuuugaauaaacucugauaacgauguuguucauuccacuugcuuugaucuaacuggcauuuucuguaaaauuagauugaauuaaugaagugauuuuaaaauuuaaaauuuucauccucuccuccuuauuucuaaacauuuuucugucuguaaauuuuuaaacuugcauaaaaauuaaaggguuucugguauguagggauuaaagugcauaagucauaaaacacuaguuaacaggaaaggcagugaacaugcauuaaggauuuuauaauuuucuaucauagucauauaugaguuuggcucauaugaaccaagcugcauauuaugaauauguguaggccuuugaaauccugguccuaguaauagagcaagauggcuuuauuuuuuuuuuuuuuuuuuuuuuuuuugguuuuugagauaggguuucucuauauagcccuggcuguccuggaacucacuuuguagaccaggcuggucucgaacucagaaaucugccugccucugccucccaaguguugggauuacaggcgugugccaccacugcccggcuaaaaugguuuuuucuagucuauacuuuccauaaauacaguuuagaagcucuagagagacaagauagaauaaugagaguagcuguaaucagugguugcacaccgugauccaagcacuugguaguuuuacaaacaguuauccuaccaaaaaccuggcaaagugaaugcaguuauuccuaccuucccccuauaaagguggaaaugaauggcagcauacagugcugcaacuugcaucccauucucuuagcugcuggugugaagacagaagucuaggcuaggagauaagacagugagcuagcugcagcugcaccugucaccuugaaucagacaguugucagacugcagaggucaugcccuugccuucuuggcuccuacauugcucuuucuaaugcucuucuguucuauucaaccgggcacuggggcaucugugagcugaguucucccgacuguccuggaucaaaucuuccacaagugugugaguuuucugagccuguacacccacucuguugugcaaaauucaaauauacaaagacaauggaaacagaagaugguggccaccauaaaucuucuagauaccuucuagauagaaaacgaggcaggcacggaacuuaaagcugaaacaggcugaaccaagauguacccccuccaaaaaagaagcagaaagaaaggaaggaaaggaaaaaagaaaggaagaaaaaaguaaggaagaaggaagggaggaagaaggaaggaaggaaggaaggaagggagggagggagggagggagggaggaaggaaggaaggaaggaaggaaggaaggaaggaaggaaggaaggaaggaagaaagaagagagcugacugguguguggacugaaugcuaacauacugcagcagagguacagaucuuauguggauccaaagagcccuuguagguuccagcuugcccucagcuaggcucuucacacuaaauuagggcucucaguuugacccaaagacccgucaaauccaccaguccucucagcucaggaguuaauugauugaaagguaacuucauuuccugcaggucguccaguagucuaccuguaggucugugcuuaccucaugcugcauacuacuugaaagcucucuggguugccugauguguugaguuguuccucuucagucugcccuuucuuccuuccuuccuuccuuccuuccuuccuuccuuccuucuuucuuucuuucuuucuuucuuuauuuaagauaggguuucuucuguguagccuuggucauccugaaacuugcuuuguagaccaggcuggccuugaacucacugccccgccucugccuccagagagcugggauuaaagguguaugccaccacuauucagcugaggguggggugaggugugugauuucugaucuagacuucuacucugguauuuggggugguucuagauaaugcuaauuagaagcucccuggcuuuccaguucuguggacuuguuacuuuugcauucuuugccucuucuggggggugucuuauuuuauguagaugucuacucuuggguaggaguucaucuuuuggugcuggaacccuauugugucuacucuuugagggaccuccgcagugggcagagcaccuggaaggggaucuccaagaggcuucugggucuuccuauucaggaacaaaggaguguuguguuuagugucucugaguuuauuggaguaugucuuucugugaccuucaaguuguuugauuugaauucuacuugcuaucugggauuuggcauuugucucaugcuagaccuuagcuaccugucuuccuuggcuauggccuaaacaucguuucuuucuucccuuucuuucugcuucaagcccucucucuuuucugcuuccuccuucuuucccccuacuuuuucuggauuuuuguugccauuguuacuguuuggguuugagacagugucugcauacccuaggcuggccuggaauucacuauauagaacaggguaacuuugaauucauggugauucuccugcuucagcuccacaaauacugucugucacaugugauccuaaacuguuuuuuauuuuuuauuuuuaauuuuuucccccaaauuuccggagcaaaagaaacugcaucuuuuucaguuaauuaauuucuuuuauauugauucccagcuuaaguagaauuuaaagguauaauuaaaauuauucuugaucagugaccuuuaguaggguauagcuuuuguuauuuuuaaagauacuuaauuugucaaaaacuugacuuuuuuauuagucucuaaucuuuuccauaugucugaaauaguuaacauucaaagaaguuaugacauucuucucccaaagacuuuuaaaaucuuuuacacaauuuuuccuagacuuguuuaagacuguuucuaaguaacuaguauaugaacugaauaacuaguucccacuuuaaauuggacucucugaagagccauuccugauaauacccugccagauuaguugcaugaccucggacaaaccauuaaaaucucugucucauuuuccuuaucuguagaaugaggacaguauugcuuccuacuuccuagaguccuugggaagacuaaauuaauuauauaaaacaacaugguucaggacuugggacaagccaaaugaccgguuguuguuuuguuauuauuuaaaaagcaaaguacaagacaguuaaaagcaaaaacuuauuuuccucauuauaggacugaagacaauguuuagugguuauaaagagccugucuuuggagucagugugaccuggguuuaaaucuuguagcccagccuuucucugggugacauuugaauaauacugucuaccucaugaguaugagaaacacaagcaaguauaaugaagcacuuuaaacaccuuggugcacaggaagugaccauaagugaucauugucaucuuuuugcuaaagcccuaauuggaggcauuugcccuccaagcucccagaguugcucccggagucugcgcaguccagaacugcaguuuggccuccaugggaaaagaggggcucugccauaacuucuugaguaauuauggaagacuauaucaaaauagagaaaaucuggauuagguacuuauaugguguauaagaguguauaacuacaggccagacaguggccauaguggucuugaaagugaggaaggagugccuaguucugcaauucgggaaaucucuguggaaagaacuucaccauccaaauauuguuagacuucaggcugugcucaugcaggauuccagguuguaucuaaguaucaagucccugucccuggaucucaagaaguccuuggauuuaaucccuccuggucaguucauggauucuuuauucaucaaaaguuuucuguccaaaaucuccaggggauuuuguguuuuacacucccuaagaguucuucacagagacuuugaaaacucaaaauguauugcuugaugaaaaagggacaauaaaacuagcugauuuuggccuugacagagcauucagaauacagauaagagugugcauucauucuucuguugagggacaucuggguucuuuccagcuauuucuggcuauuauuaauaagggcagccucuggaugacuuuuucuucagucucugcuccauauuuugucuccauauuuccucuuugugaguauuuuguucccccuacuaagaaucacugaagcauacacaauuuggucuuccuucuugagcuuaugaacauaguagagcauguguccuuauuacauguuggagcaucuucuggguauauacccaggggugguauagcuggguccucagguaguacuguguccaauuuucuaaggaaccgccaaacugauuuccagagugguuguaccagcuugcaaucccaccagcaauggaagaguguuccucuuuuuccacauucuugccagcaucugcuguccccugaguuuuuggacuuagccauucugauuggugcaagguagaaucucaggguuguuuugauuugcauuuuccugaugacaaaggauguugaacauuucuuuaggugcuucucugccauuugaauuuccucaguugagaauucucuguuuagcucuguuccccauuuuuuaauaagguuauuugguucucuggaguaauagccagaagcuggaaagaacccagaugucccucagcagaggaauggauacagaaaauugugguacauuuacacaauggaaaaugacucagcuauugaaaacaauaacuucaugaaacuuuuaggcauauggauggaucuagcaaauaucauccugagugaggucagucacaaaagaacacacaugguauguacucacugaugaguggauauuagcccaaaagcuccaaguacccaugauacaauucacagaccauaugaagcucaagaaggaagaccaaaguguggaugcuucagugcuuagaugggggaacaaaauacucacagaggaaauauggagacaaaguauggagcagagacugaaggaaagagcuccuggggacuggaccaccaaccaaagaguacacauggagggacccauggcucuggccacauaugugggagaggauggucuuguuggaaaucagugggaagagaggaccuugguccugucaggguucgaugccccagugugggggaaugccagggcuggaagacagaaguaggugggugggugggugggugaguggaggagcacccucauagaggcagggggaggaaggaugggauagaggguuucuggaggggagaccuggggagggaggggauauuugaaauauaaauaaagaaaauacccaauaaaagaggaaaagaaaaaagaaauaagagugugcacucaugagguagugacagugguaccggucgaucuuuggaaguguugcugggaucugcucgauacuccaacccacuugacaucaggaguauagggaccauauauccagaacuggcaacuaagaagccacuauucgguguugauucagagacugaccaaacaaacuuuuaggauuuucagagcucugggaacuccuaacaacuaaguuagacuggaaguagaguccgugcaggacuacaagaacacauuucccaaguggaugccaggcacccuugcaucccgugucaagaauuugaaugaaaugcuggagagauggcuaggugguuaagaacaaugacugcucuucccgagguccugcguucgauucccagcaaccacaugguggcucacaaccaucuguaaugggaucugaugcccucuucuggugugucugaagacagcuacaguguacucauauauauaaaauaaacaaaauaauucuuaaaaaaauagcaaaaaaaaaaaaaaagaauuugaaugaagcaguucgagcuugcucuaaaaaaagguagucuacuauccugccaaacgaauuucuggcaaaaugguccugaagcacccauacuuugaugacuuggacaaucagauuaggaagauguagcucucuguggaagucccugccugcugugacaggggaaguuuguagcauuugcuguuggcucucuuccuaucuccucuucuuuuguaagcuaucaucuggacuuuuccuaauuucauacauacaacuuaauuaacauguacauauuauuccauacgaauuuaaauauaauaauucuguguaugugcuuuaaaaaaaggcacaaauuggagucaggcuugaugguguaugcuuauaauccuagcacucaggaugaugaagcagaggaucaugucucuacuggauagcaagacuuuggcuuaagaacaaaaacgaaagcaugcuaaugaccaaaauuggcacauuuucauccaauuuuuauaggcagauuucaaacaacauccacaguacgaauagaguuauacaucuuuuaaaaaauaauauuuuaucacaaaugccuuuuacacuaacuacauaaacuucaaagccauccuuuucauugcuguauaauguuucauuaaguaguuaaaacuuacuuugcucuuuagugcugaauguguugaaguucuuucuaacucacaguguuacucaguauuacaguguuacaaagugacaaaaggugaaacaucuuuaggcuggaaacguuuauguuuaugacacuaucuuagaaaauauuaacugaagaauuccuacauauguaacuguucccauggucuuugugaagucucauguuucuuaaugagccacuucaagauagaauguacuacuuuaucuucaggacccagagauugcucaggguucaguggcuacuuaugacuugaugaauauauuguuauacuauuuuccaggaaugguaagaauuuuaugauucuauucuauuuuaaauuacuauuaaaguaaaguaauuucuuuucaaaugcagaaacaauggaaugguaaugaagccacuaggcaccccaguauuuuacauaucaccguuuuauuauuaucuacugauuuuuaguuaguagacaaagaaaugguuuucacuguggcauuuucacaccuguguauguauauauuugguuccuauuugggccaucacaauauucuguccccauccccacuucuauccucucauugggcccuucacucuauaaguaacucacuccuccuucugccuuuuugucagauguauuuugcuaaucuccuuugguccccacuuuuggcuuuuuucaucuauguguuagccugucuuuuacuuuauggacugcaugcacacauaaaccuuaauauaugcauauaauuuaaaucuauauuuuacauauuagauagcaacacauacaauauuugucuuucugagucuagcuuuugcuucccaccacgaucuccaguucugcccauuuuccugaaaauguucauuuuguucuucuuuauggccaaguaaaacccuguuguguguguguaccauguuuccuuuuuccagucaucugcugaaugggcaucuaagcuggcgcuuuauuuccaugaauuguaaacaguagacauggauauguaagugucucugugaugugauggcuuggggaccagaggguuugaugagacaggucguguuguaugcucagcauggugcagcagagcucuuagccugccugcugaggaccaggacuuccuuugaccagauucuaguucugucccuguuguuguugaccagugcugugaccuaaugaaaguugguuugcaucaccgagcaucucuuuguggagauguaaccagcaagggaaacacucaagguacaucucugguggcauuuccucugggccacuggacacugacugaaggggccuuguguugucagagguuaccauuugucuuuaggccacaagaagacuggaggguuaaacacuguuaacacaagcaugcugugugccagcagcuuuacaugucucauuuaauccuuaaagguaacauugcaaagcacaaugcuccuucuguucucucuaccccauuccaggcgaggaaacacauucuuugagguaagugcucguuguggaaacagcuggagaaauucagguugaaauucuaggucagcugcucgauaaccacguggccuucaguuuugagacuuuccuucccuggaaaugaugagagcaaaaguagcucaccucacaggacuguugagaacauuaaaaaugcgggugagauggaggcuuguugucaguaauagauugauaguaaccuaggggaugcugagacuuucugagaugggcuuuuuuaaaacgagcauauguguggcuacaggaaaugauacuuuguucaaaggagacaccugauuugaagacaugcaugcagaaauuauugauuaacacagaagucugaauaugggcaggaauagaaauaguacaaaaggagaauuaucuaagaacccacuggauuuauuuauuuccuggguaacaguuaaauuuauacauucgguugugggcaauucauugauacaauagacagauacuggcucuccauuuuguuuuagagugaggaaggaaaauggagaagcuguacuguggcuuaaguuugaugaacaggaaaaaaaaggcgauaaaaggaacucgauagaagccuuguuauuuuuucauuuguuaccacaagaguggguaaugggccccacuggugccagacacuaaaggcccccccugcuggaagaugggagagagucccuuguaauuaagaccaacacagacagagugaggaguagugaacuuguccauggauggugccuucuaagcagauauggauguucagucgaggguugguccagggugagguuuggcucugagugagaagcuagccuugauuaacggugaaagaaagcuguguuuuacaugaaguucaaaucaggagaaauaaaauuauccaggucacauuucuagagagucaaaauuaaggcagaucaagucuuguuggaagguggagaaaguacuugguaagagaagcguaccagaaacuugaugcuugucauguugggguuuagagggagagggcuaugggaauggcagugucagguuuucuucuauuuggcuguagauuucccuaauucagaugggccacuuuucaacccuuugcugaggauuuccuuuauucugguuuagaaaauacaaaaucuuuuccaagucuuagauucuauuauuuggggaaucuauuauuuccuguugccaguugcaagaguuaaauauucucuuucaggagagagaaagauuaauaauaugaagcagagguauccaaaucaugguaacgguuaauguuauucagucacuccuaaagacuuggcaugauuaauaaaaacaaaaaugaaucuuaccgaagaacauaccaacuaguauggaaaaaaaucaguucaaagcuguugugucugacuaguccuacuugaaaaguauuguauuugagauaauuuguagaugugauuagauauugacucauauauuaaaauucaugacauuuuguuugggaacaggacuaaaauaucugauuuguuuaucagaauuuuugagccauagucaauaggggagggagaagaacuuuugguacacauccagccuuguaauaggcuuuucacacucucauuugaaccuccagccuugcugaauuccagccucuccugcuugauugccuugagucaaauggaggcucuguuuuuuaguuacuguguggguuuggauaggauguugaaugucuccaagcuuuggugucaccaucaaacacaaguaacaguccuuuagggcagaugggaaguagaacaaguuuguucugggaaggcucacacacaguguuggcgcacagcacgugcuaacaaaucuuucuuauuguuauuugguccuguuccaguuuuuauuagaugaagcuagcucuaaauugaaaagagcugggcauccaauuaaaaggugcuuuauugugauaaaauaccucuuucuggagagcuuugcugaauguuucuuuuauauuuugaugagaaagcuggaugcagauagcuuccuccuuucaccccucccuuccucauguuuguuucucccucuccguuauucuucgcaaauaaugcccauccuaucagguucuaguguaggugggauucagcagcagauagccauagcaucuuucuuugcucucauggaauauaccuucugacugggagugacagaaggcagguuauuuuagaagcuugaggauugcuauaugagugcuaucaagacaguggggccuggugacuugauguagacuuucuugggcugugugagcaggggugguccugggaggagguguuuucugaggaggcgcuagaucaguugagcugugaaugcugcagagagcuaggguuaccacuugaagagcuagggauguuccucagagagaacaggaagugagaaagaaggcacuggcaaguuucugaguaggauguugacaugugagucaaguuuguggucagaggagaaugcagagggccauggcugaaagacugggauggaaacagacuggacagagccuggugagcguguuaaggacggcaggucaugcugagaguugaggcagucaaguguuacuacgcuaccucugugcaugucuucacaagucugcguuguuagcaagaugauucugaacaaguucuacacaauccaucuuaaaaagaaaaugggagaugaaaggucacaaaguuuauggaguaaauuugaugcaaauauuuccauucagugcccagugguuuauaauguaagccucaagcguaauuguugacuaacucucaguauuuguugacuaauccggauuuccccagaacuggugugugcugcuggcucccuccaugucaacuuuucuuccucucaucaccccaucuuuuucuuguuuugucucuucaucucuguggcagcucuugugacguggagcuuuccacccacacuucaaggaugcugagcaugagguagacuccuugagggcaguucaucucaaacucauucuuguauauucacaaguuguagguugaaaaguuuuacaaucuaucagcauugagcaccuacuguguguuaaaauucuguucaagauacugggguuaagacauaagcaaaauuucuucccuagcggaguaccuuggcaucucgucuaaagugguaggaaugcaaauuggugauugauugguuagcuaguggguucauucuuucauuccauggacaguuauggugucuucugcaucccaaggcuauauucuucuacaggaugcauucuuguuuguuugccuuuuuauuguuacucuaucugugcuguggguuggcgauaucacaugccuugacauguauguggaagucaggacaacuuugugaaguagucucaucaccuuuuccuuuuguuauagggaucaaaugugguuggucaggauuuccuggcacgaguauucaccugcucagccacuucuucagacccucccucccccucucuuuuucaaggcugagucucauguaucucaggcugauuuugaaauugcuauguagccaaagaugaccuugaacuucugccccccgccccccuuccacuaccuccugaauggugggguuguggcuauaugccacuacacuugauuuuuaagcagugcuggggauggagcuuuguguaugcugggaaccagcuaagcuacuucuccagccucagaggauuaaggaagauuaggggaagcauggcuaguuaauuacaggguguuuacuguaaacuagcauuuuuacacuaggaaucucgguuuucagauuagacaugauuuuaccccgaaaacaacuccaugucgcuaucuuuuuucaaagaggaggcaaucgaggcauaaagauuuuacaauuuugaacgaaguuucacagcaagcuuggauaugacccaaaugucuucauuagacgaguauuagcuaaugauagugucguuuguggcuaccuaggcgguuuuaugcgcuauugucucuucccagaagagguggagggaagggcaggaaggugugggugugggugggugggguaucaggaacuugaaagguggggaguuuagucauccuguuuccuucucaguucugugcaguucccugugcuaauugcuuaacagggagagugcugugcaagcucccugcucccaugccuuuucugcacucccucuuuacugucucugguagcugcauggggccaucuuguccuguuggaucuugaugcugcuggcugcagccuugugcacuuuguggcagcuggugcuauggauaauguguuaauuagguuuucuauggugauaaaauacuauuauugaccaaagcaacuuggggaggaaaggguuuguuuugcuucugcuuccauaucacagucauugaaggaauuucgggcaggaacucaaggcagaagccuuggagccaagagcugaugcagaggccacggaggaaugcuacagacuggcuugcuucucauggguuguucaguuuguuguuauacauuccaacacuacuuacccaggaauaguacuacccaucaaucaagaaaacacccuauggcuugccuacaugcuacuauuuuuuuuuuuuuuaaagauuuauuuauuuauuauauguaaauacacuguagcugucuucagacacaccagaagagggagucagaucuuguuacggaugguugugagccaccaugugguugcugggauuugaacucuggaccuucggaagagcagucgggugcucuuacccacugagccaucucaccagcccgcuacuauuuuuuaaauuaaauuaaauuuacuuuaauuauucacuuuacauuccacacacuggccccuuucuagucaccacccccacaaucuucccccuacccuucucuucugaguggauggaggccucccugggugucuucccacccuggcacuucaagucugugaggcuaggcccuuccuuccucuuccauggaggccagacaaggcagcucagcuaguagaacauaucucauguauugauuauaaaauaaacaacuuuugggauaggacccacucuaguuguucgggacccacaugaagacgaagcugcacaucagcuacauaugugcagggaggccuaagcccagcccuguauguucuuugauuggugguucagucucugaaagucccaaggguuaguugacucuguuggucuucauucuuaugcaggcaucuucucaagugagguucccuccucucggaugacucuugcuucugucaaauugacaaaaauuuagcuaucacaggcaguauuugcuccaaagccaugaaccagaagaaggaguuaucuccaguggggucuuugacaccaaucuuuuuuaucacugugauaauuaagugagcaguucucuuauuaagagcucugcaugggcacaccuuuggggaacugcucugaugucuguaauuuuguaaggucuaauaugacucccuuuggagccucccagguaagucagagcuuccuaagggagugacagcuugauuauaaaauaaacacacugucugcaguuagacaucuuagguucugaccucucccugaagacacacuuuggucuugcagugauaaucaccaauuucucagaaacagagugggcucgugaaggguuuugagaggcuccaagacuacagaauggaaguaguuuuaagcaucgcuguccuggcuuuagggacacauggcccugaggugccuuaguugccggugcuuugauaaaugaggacagauccccuaguaauagaaggaaaaaacauucugaaaguagagagauaauaaaaacaagcugcuuuaugcuuugucagucuggaaagcuuuuaaggcacaucuagaagguggaugcacuuaauguuugcccugcgugugggccuuauugugugugauaaggggaauaaauuuagccucuuuaagucugaucucucuugugugugugugugugugugugugugugugugugugugugugugugugugugugagagagagagagagagagagagagagagauuugaacuagaauaaacuuuauuugaaacuccuguggauggggcuucagccccuccuuuugcccugcccucacucuucccuuucagcaucuaacuguucuucuuaagaguaaagugguacgugggggaaagagggaaagaaaaaucaacugucacauugugaacauaauugacucaauaaauaaugucucugaauucccagggcaaaccucagaaucuuuauuuaugucaauuaguggcccaguaagugguggcggucuuaauuuagacggaugggauggaccgucgcucaguucccccucuccaaggaagucugugcuuuccuuguuuuaaagacauagcgucugaaaaacuaaguuugagaaagaauuuaugugucaguuugcauucuuccuggaggugaagggguauuuaaauauuuaacgggaugguuggaacgagaauaaaauugaaacaaggaagaaaacuccuugucaauucuaucagggcagggauuuugucuuagcuguucagcauuuaacauccagugcacauaguaggcacacaaaaauaauugucagcucugcuguugaauaaauuaauaaaugaacagaagugaauaccaucuuggccugguucuuagacucugcuuggauuuuauccuacuacuuuuuacacccgccaucccuaccgcuuucucucccaggauuuagaccacuagcuuuuuuuuuuuuuuuuaagauuuauauuuaguuauguaugugugagauuguacaugcaugugauuucagguguccgaggagaccaaaaaagcguguaggagucccuagagcugguauuacaggagguugcaggcugccugguguacgugcugggacuugaacccagguccucugcaggagcagcuagugcuuuuagucagucagccaucucugcagccccaacaguugacuagguuuuuuuuuuuuuuuugacaggguuucucuguguagcccuggcuauccuggaacucacucuguagaccaggcuggccacaaacucagaaaucugcuugccucugccucccaagugcugggauuaaaggugugcgccaccacugccuagcaggagacugguuuuuaaaguacaauuucagcaaacaucuccagguaugauuaaggagaagcugcuucaucgugcccagaugagcggagucggaaggguucucagauguguuacaaagguacuuuuacacauuuuugugaauugcaucuuagaaucacaugaacuguguuaucaauguacacauccaggcuuucacuguuagggcuaagaagucucuaaucuauuggagaugguccugguugguuuggugugcuggaaauagauaacauuaauccaguuggccucaaaguccucuggccuugguagucuaaggcauuuuuggaaaaggugacaauccuaagguacccagcagaaagucugugagcuguaaauaggcugcgagucuccugacuccagugauuaugcuacugguccugugguuugcuguacugguucaucugacaagccaugcuucucagccucuguccggguccuuuaacgaugcuucucccuaaagcuguagcacuaucugggcugauggcccuggcacaacuggaaagaccuucaggauuauaugccaucuauucugcuuucauauuagugugugcguguuuguguauauguaugugugcaugcguguauauauguguguguuugaauguguaugcauguguguguauuuguguauauguguguauguguguuuguguauaugugugugugcaugcguguguauauguguguguuugaauguguaugcauguguguguauuuguguauauguguguauguguguuuguguauauguguguauguggauauguuugcauauguaugguguauguucauguggguaugcauauguacauauaagguuuacguaugugauucauguggaugccaaagguaguuguuagguugagaugggucucuacuugaacccagagcccaugcauuuggcuagaauggcuugacaaugaacuccauauauccguccgucuaucucugcuccuugccucccagggcugggaauauagaauauagacguguggcugacuugucuuccuuccucccuucuccccugcuugcuuuuggguuuguuuguuuguuuauuuguuuguuuguuuguuuguucuggucauuuuaaagaagugaguugggaguuugacucaggucaccaucugugcacacugcacacuuugcccauguaggcgucucuccagccccuaagauguuuuacuguguucaccaaugaugcuuuugauuccuuccgaucccugucuuuuggcucacacaacacaaacaccaauggggcccacucagcacugcccugcuuucccuuaagguaaucacaugaaagacuaucaaagauacaaaacucugcccacgcccccuccccagagccaucaaaccugcuuuucugaggaaccauuuuuaaaauuccuuuaauugcuauuauucucagcaacucuagucucugugaacagcagucccccaaacuucuggauccuaccucacaauuaugccucagcuccauguuucuauaggaaagcuauucuuuagcccacagaacuggucuccaaaguaggggaagaagaucugccaucuucuuuccuccacgacccaggugguagacaagguggugcaggcauccaggaaaaagagcagagcaucgcagagcaucacagagcaucgcagagcaucgcagagcaucgcagagcagagcagagcagagcagagcagagcagagcagagcagagcagagcagagcagagacuagagugugugucugaaaccugcaaccagcauggagcguugucugccugcaucaccacauucgagcuuugggcacauacuuaaagcucuuugaacaucuguggucuaacuaggaaggugguuuugucuguuucaaacaaggugucagagaaguggagaauuucauguagaacauauuuggggagaaucuauauacuguggagagaagcaggggaggccaacuaugguacagcugcagcaaaggucucagugacgccaugcggagcuacgggggugcaguacccucagaauuauuugcaauugagggaagacagccauuaugucuucauauccaccaaccauaggauaugggcuagcccuggagagggggcguggccucaggugaugauccaccuuggcugagauccugagauuugugccagcagcagucccuaacagguccuuguguguggaugggaaaagagggccuucaucuuggagagcaucucagugggauguggcagcaccugcugcccacacuaacgugcuugaaccuuggcagggaaagcagcacaauugucgccauucagcaaacauuuaccguugccauuuucccaacuccggcaagcugugccacuugugagacaucgcuuaccuuggcucgggcugcuuucugauguaagcauauucucaacucugcucugcccaccucccaagcaacuccgagagcaggcagagaaagcagaagggggauugcugagugaaacauuacagaaaugucagggaugacugagcccucucuucugcagugaauauauggucgggaccuggauuccccgaagggagaagguugugauaaauguaauggugcuugucuaugaaagauggcauuuugaucuuucuuucuucucuccauagggaauuagaauaauggagaugcugcuaaaggaacaguguggcucccccuuaguggaauaaaaaaaaaaaaucagugaguauccaaagucaaaucagaauuauuuacucaagccguguuuucaugcuuauaaaccuggcauuaugaaucagccucccugagcuauucacgcucugcgucucccagugauacccauagaauacuauuucacaggcauuuuguuaucugcgcagcggcuuuauuugccuggcucucugauuuucaaagcagguuuguacagugcauugaguuacaacugcuuucaaaucgcuaaaacuguucaguauaaucuagcaugauugaggcccuugagguggcagagauuuguaaaggcggcucucaggaucaaccgaagcuuaguuuauuguucucagaacaauaaaaagggagacuuagagcuguaauuggggcaggaaggaucacaagaaagggauguguugauuggccuggaaaacaaauacaucuuauuagacuggaaacuaauccccaagaccaaaauaaugaaauucucccaaauaggcaacuuccacaaugccaaccuuaaugccugaccuuauguggugaguggccguccaaacaagggggacugaaagaauuguguauaaaucaucuucagguuacgaguauacagacuacaugaaagggaaaugaauuuaguguuuguacuuggguucuagcuccagggaaucucauuaaguaugugcaaauauuucaaaacuaugaaaaauuucccaauccaaaauacuuguggagauacuugcuaagugaacauguccuacugcuugaaaugcuguucugaaggaauuugaaucuuaggaauaauucuugggcucuagcuugaaggccuugagugauuagaaguguuugucaugggcacagacuaauaauucgucauuaucuuaggucagcuuggaaggauaccacacauggcuuccuguaaacaaccugcuggucuaauugugguauaugaugaauucugagagcaauuagccaaagaagacaugauaggaccauguacaugcaaguagcuugaguuucaaagcaugccagccaugccucugaauggacagucauuggagacauuaguuggaggguugcauuucuguugauuugcacguugagcgauauucugaugaauacuuagcuauacacacuugacauauaguagauuucaauguuacuggagggcuaauuaagguuauuuuauuuaauacaggcauggcaaaugacauugcuuauaauguguuggaauuggaucuuaagugugguuugcccugauauucagccuauucuuugaacaaaugauaaagacuuugacaacauggccccguuuuccugugcuggcauuuuugagauucacuauauuauuuacuccacuuacuauugugauaaaauacuuuauagaaggaaccuuaaggaugaaagauuuauuuuggcuuuuauuuuuaagaggggauagaguacauuauggugggaagacaugguggugagauuguacagcagcuggucacauugccuucauagcagggagcagagagacaugacuguuguugcucauuucacugucuuucucuuccccuuuauauuacauucagaaucccaagccaugacauggugccaccaacacucugaauaugucuucccuuuuugacuaaaucucuuuggaaauaucuucacagacucaccuagaacucggucucccaauugugugacccucucuucuuccugugaccuguuggcuggccacuggcagggaggauaaagggagguggggcaggguuuggauggccaugaauaccaaccagcuucagugagacagcucaacuuuauuugaggugaacaagggcuauauagauuuggggaguggguagggaauuccaagguauauauacacuauugacuagggugagacgugagaaugcuucauuuacauaaagaggaauaccaagaaucuggcagacagguucuuaucgaggggugggggaaacauugagccuguaaucuggccacaggcuacaugacucuccuuagaggacauguaggagcauguaggcugagaguagggagagagcggccccacuccucucggaugagauuugaggggguuugggcauaucucaauuuuacuuuugcuccaggccaacucccagguuucacaucuccacauccccacauccccagacaaaucacuucugaaauccaaucaguagacuaucaaguccauccuuuuucaaucugacacccagacaucccacuuuaaacugugacacuuuacccuuugucaucaaaggcucauggccaucucauggcauauuguaauaguaaccccuucucauaauauaauaaaagauaccagccaaaagaaaauagcuccuggcaggucuuauagacagguacaaagcaagacaaaacaucugccagaacaacagccacguauuagauuaccagauguguuaaucuguccaaguaacacaacugcaccuugugaaacagcugugauuagagucaucagcagauuaaacuuaaaauaauuaacugucauucuccaacauccaccuguuuucugcacaggccaaguagacuuaaaugaagagaugguuagagccaccaccccuauggccuugauggugacucuuaccuucacaaucucuccagggauucaauaauggcuuguuugacuguuguuccagauagaggcaccucuaauggcuuccauuucuguugcaaucuuaauagaggccacucucacuaaguacuaaugugcuugugcacuugggcacugaucccaucuuacccagggaguaagaugugaagucagcucaguuccguugaggaauuaagggggccugugcuaacacuggaaaggcauaugccugcuagcuuccaaaguuugaauuagagguuuugaaguuuuagugagcaccagaaccaucccggggaguguaaagcacagaagagugagcucacucucggaguucugguugaccaagucuuagaugggcucccaagcuugucuuuggguagagauggauccagucaguguuaggacacuggggaagcagauagcugagguuucaacgugguuggguauacagcuaccuuuauaucagucagcagaacagguuucauccugacuucuagaaaucaaagccucuucuugcauguaucuauuuaucauacauaauaugauaucuuuucuucuguuaguuuaauguggacaagcuccagguuacagcaaacucauaugaagagaggaggcaagagucaugcuaauuuguggcucuaagucaguuuggauuuaaagcauuguugauaaaaaugagugaguuuaaaaaguuuacagucuggccuguugucuuucagccauguucagccuggcccgugugacccaggauagcuaugagugcaacucaguacaaaauaauuaaccauuuaaaaaauauuuugaaguugcuguuauuauuacuauuauuacuacuacuaauuauuauuauuauuagugccuuguguaugauuugauuacacaguuguucagugugaacuuucuagauaauaauguagucuuuacaauaucaaaagaugagaaacuuggauuaucuucuuuuuuuuuuucacugugugagacuaaccuacagcuugggcuuuuccugguguaugggaaguguuuuacucaucucaaguagcuaagugguggggucuacagagugccaggacuucuaaggggggcacuaguguuuugugccauagaauaauuccuguauuauaugcacagagcgggaugccacaauucaugucacuuucucaaaggaguaaaugaaaaggaucucuacucuucacagagccaucuacaauuacuauaaacugaagacugcuauuuaggcuuuaagcuguucuccaagccagcaucaucgacuuacuagucauauacaacuaaaaugaugauuuaaugauugacuuugaggugugccauuuugugaaguauaaauuguucuuuaaucauuacaaaccagauuuggaaaaauuugaggcuuugauuucguagcucagcuacaaccuuauuuucuccccuccccauuuucuugaccauuuuuacaauguuuuuguaguuuaaauucccucugucuugauggagccuuuuuacuuccucaaaaaaagcuuuaggaaaaauaaguuguaggaggggaauguacuguucucaugagauggaaaaagugauaaaauaaaauggaaaggggcuggcauuugggaggcugaggcaggauugcugagaguuuuacaauucuuaauuuucucuugguuuuugcaugugugcauacaccauauauauauguaugcauuuauaugccaauguguguguguaugugugugugugauggagggagggcaggagaaggggcgauaaucuaagguauugguucuuacacugcaccauauuugagacaggaucucuugcucugcugugugugccaggccugggagcgcauggagauucucuuguuuccauuucccaucaugucugagugcugggcugauagaugcacuugauaaugugucugacuuuccauggacccuagauauuugaacucagguccucaugauuauguagugagcauuuugcccacuaaaccaucucuccagcccagaucucuugucuuuaaaagacaauuuguagacuuauacaaaugugcaaaauagauuuuuuuucauauuuuuaaaacacaugucuuuaaucacagcacucaagauguacacucaucucuauguguuccaggcuagucagggcuauguaguuaacccuaucucaaaaaaauuacauucauguagcauaugccuccauuuuuccugguaccuagcaucagaaguaacauuuaugaacucucugaccugugcauccaacuggacauuugaagauguagaaagcuuagaagguaauuuucucauggauugaaauggaggcacauaaaucucaguaaccaauaugcuuguggcauugcugcugacacaucuguuugauggauuuuugauuuccugucacguuugaauaaaacaaauagucccgacaucuguuuguucuugccgcuggcauuuggaacuggcuuggugaggucugauaacacagaagaguucugucccaccagaaugauuaagaccucacguuuggcuguagcuucaguuccacucugaacuggauccucuugguagcuggacuuaauaaaaugaggugccugcuuuguucgaagaucauuaggggguaggaaugcaauuucuucaagaaauuauccauagugagagaauucaagugacucucgggaguugcuucagaaaagagggcaaauaaguauugaucgcugagacguguuuauuaggugauaaaaccuauuucuuucucuugcagggaagcugccacugugucuacuuuuccucgagacucacuucuuggccaugacaucauagacacaaugacuggauggugguuucaggacagagucagaggggcuuagagaagaggggaccuuccugcuagacacagacuugacacucccuccccuuuggggccugcuucaaaucacaggacucacagagcuggagguuuaucaccuggucuuuuuuacgaucucaugaauaaagggaaaaaccuaucagaugacau

SEQ ID NO: 8904 - RNA, 739 nt, Mus musculus
gacagccauugcaguacauugagcuccauagagacagcgccggggcaagcgcgagccggacgggcacugggugacucugugccuuguggaggaaaaucaacuaaacacgggcaaaggagauccuaagaagccgagaggcaaaauguccucauaugcauucuuugugcaaaccugccgggaggagcacaagaagcagcacucggaugcuucugucaacuucucagaguucuccaagaagugcucagagaggugggagaccaugucugcuaaagaaaauggaaauuugaagauauggcaaaagcugacaaggcucguuaugaaaaugaaaaccuacaucucccccaaaggagagaccaaaaagaaguucaaggacaccaaugcacccaagaggccuccuucggccuucuucuuauucuguucugaguaccaccccaaaaucaaaggcaagcauccugacuuauccauuggcgauguugcaaagaaacuaggagagauguggaacaacacugcagcgaaugacaaacagcccugugagaagaaggcugccaagcugaaggagaaguacgagaaggauauugcggcuacagagauaaaggaaaaccugaugcagcaaaaaaggggguggucaaggcugaaaagagcaagaaaaagaaggaagaggaagaugaggggcagaaugaagagggugaagaaaagaaggaagaagaggaagacgaaaaugaagaagaugaugauuaau

SEQ ID NO: 8905 - RNA, 518 nt, Mus musculus
uaguguuaggugggcagcggagggaugccuggaguuacuguaaaagacguuaaccagcaggaguucgucagagcucuggcagccuuccuuaaaaaguccgggaagcugaaaguccccgaauggguggacacagucaagcuggccaaacauaaagagcuugccccauaugaugagaacugguucuacacacgagcugcuuccacagcacggcaccuguaccuccgagguggugcugggguugguuccaugaccaagaucuauggaggacggcagagaaauggugucagacccagccacuucagcagaggcucuaagaguguggcccaccggguccuccaagcccuggaggggcugaaaaugguggaaaaggaccaagauggggaccgcaagcuaacaccucagggacagagagaucuggacagaaucgcuggacagguggcagcugccaacaagaagcauuagaacaaaggaugcuggguuaauaaauugccucauucauaaaaaaaaaauuaauuaau

SEQ ID NO: 8906 - RNA, 1075 nt, Mus musculus
gagagagagagagagagagagagagagagagagagagagacuaagacaggagaggaggcucacgcaguucaaggccauacucugcuauguaacaagaccugaucucaaagacaagaaagacagaaaacauauauacagagauuuuacaaacaaucuaccuccuagaaagcaagugaaauggagucaaggacuucaguggaagaaaagaaaaagugucagaaaaccaauaggauggucagaaaacccuucugggacaaacagaaaccaaaacacaucuugaagcuacucuuccucaucuaacugcugccuccagucugaacccagaaaguucuugauuauuugaacugauugucgaucaggguccccuucauuuuugcuuucuuggcuuccaauucagccaacuccugcagccuccucuugcucaggccuuugcgcuccagcugcuuuucaaucacuuuggcauucugcgcguaagagucagcaacuucccuagccucuaucuccucuucuucuucaucaaugguagacacaguaacagagcugaacuugcccaugucuuuaguccuuuuggucaucauaaccuucuuaggaggcucuuguuucugaguauauauauugguuuucccaaagccuuggccaaauuucacuacugcuccauccacaaugaaggucacaggagcauucuucggcugggauugguagaagagcggcaguccacacuuugcacacuucuuccuguacugacguucaaugcccucaggccuccgaagauaaguagucuccucaucuucuguguuacaaaacuugugagcauguuuggcagcaucgaucacgcgagaccggucccggggccucaugggcaauuucucuaacuggcaauccagcaccaggaccaucuggccacauaaacaguaguagacauggaggggcuucucgccaucaucauauuccucgcgguuccgggugucugagcagaccaccgaccgcgacacgacuuucggcauagcuccggcagagcagccagaaaacucccagaaaaugaagagucgcgccgagauggcgucacagacacucc

SEQ ID NO: 8907 - RNA, 1146 nt, Mus musculus
uucuucaccucauuuucuguccuaguugugagacagaauuaaaauuaacauuugugaauggucaaauauguccagacaaugaccucuaccuuuccgccacuuuauccccaaauucuuauguguacagcuuggauauacacagaccaccguagaaauucaggcuucuauucucuggccacagccuguagcuguuucuagucucacaagcucucauccuuuuagaccuuuuuaggugugacuuucgauuugaggggugauuauuuugcuaauaauaaugaaacauaauugucguaacaguaacauuaauacucauuagucuccauugaguacuugguuggagaaagcacuuuagagguaugagcucaugcuuagcaccuccuaggagauaaguuaacuguugccaucacuguuuuacaaagcacucggaaacucggaauuuuccuuucccaagauccacuagccuuugguaaagccagaagacugacuugaaaacucaagcucuuuccuaugcugaacugcugcuucuauggaauuuuguaucauucgauuagaacauaauuucauuuugaaaaaagaaaaaaaaaacacugaauugcaauguaaaaauauuaagcuagagaacucccuaaagcaauucuguaguuaugcuuguacauauuuuaugaaauaacucgcucuaaccauuugaauaucugacucaaguuacuuacacauuuuacugcuucuaacaauaaugaaauauuacgucauuaguagcaauuaagugcauacuucucauuauauuuuacuuucuaccagaaguuauuagaacaagauguacuuucucuauucuuuauuaacuuccagugauuuuuuuuuagcaaauguguuuuaauauuaauaaaaagagccauauugacauuugggaaagucauaagucugcaagugaucagcugugagaaaauuaugaaaauguuauaaaauauucuuacucuaauaguuggugacauuuggcauuguaacuaucacuuaagaaaaauuaaaaggcuuuuuaaaagcuaaccuguuuuguugggggugcugacauguaugaauaguucugagugucauaccaagcaaaacucucuucaaaaugaaauaaaauaaacaacagaauggaaugaacua

SEQ ID NO: 8908 - RNA, 117769 nt, Mus musculus
caucuugggcaauuugcuuuguguccacgaggaucaaaaaguaaagcuugugcuuguguguguuuguguguguguguguguaugugugugugugugugugugugugugugugccaggagugcaaauaaacaguuugugugccugugugcccaaguguuucaguuuaauuauuucuaagacaaucugaauuguaucuaaguauuaaucaagugaccagagcuggcgugaccagugagcgcacgacaaguuuggauuuggaccugggacgggagcugaggcugcaguagggcugggggugaccgaggaguuacagcuggagcgggcgggcggucccggucccgggggcgaucggagccugggcugcggcucacuagcuuggcuggugggugacaggcaggaaccggagcagcacugccgccucuggcgcgaaggcucuggcgccuccucccgccccaucacuguggcucugugcgcgcugccggccgcugcucucuccagccucugaagaagaaagccccugagccgcugucgcuugaaccauggcuucgggccgaagggguugggacagcucccacgaggacgaccugccuguguacuuggcccguccgggcaccacagaucaggucccacggcagaaguacgguggcauguucugcaacguggagggugccuucgagagcaagacguuggauuuugaugcccugagugugggacagcgcggcgccaagacuccccggagcagccagggcagcggccguggcgcagggaaccggcccgggauggaaguggacgcgcgcaggggcccgggccgggaggagagcagggaacccgcgccggagucccccaagcccgcugggguggagauccggagcgccaccggcaaggaggucuugcagaaccuuggucccaaggacaagguaagagagccgggggucuucucccccauggcccuggcccccuucucagccucagccgccauggccuggauagaacuuucuuacucauacuuuacaaggagaugggcaacugggcugagaaaaagggcauccuccaagggcccaaguucucacguguccccaauuguagcaucuuccagugugcacugcaagggucucaggucugggucuuuaucccagucacccaccugcacccuggcugguuaguucugggugggugugucaauccuggucugggaaggcuuagugauucccagacuuccuuuacuucugaugaaccaacagaacaauugucuugguuccccuuggucccggauuaaaauuuaauccaggucaccagggcagagggcauaagaaaauggggugacucucugacucuucugaaacuuuuggguguggggccacuaaacaucggaaucuccgugccucacuucugccguagcaugacgcuucacaucuguguuuauuaagaguauauuuguguacauagcuuggcacgagccugggucucaagggaugcagcugucucuaaaaaaaaaaaaaaaaaaaaaaaauuacauauuugaaaauagacaggggcauuaaaagugcauauuaaacuagcacgagcugccagccccccgcugcucuuacaugugucaaagcuaauuucuucuguguguguuuuagagaaacucacgcugcacugaacugucugcgcuuacuauggagauuuauguguuuaucucauaauaagucagaggcaugguuuagaaaauucagggugggugcagaucuggaggagucaacguugcaaucguaggauuugaguuggggaacaguaguaaccagaugaccucacccuggucuaggcaauggcugcacacuccacccccacccccguguauuauuccucacuaaugccaucaugaauaauauccugaaauggaaaugucugccucaccgugauuacgguuaauacucauccugcuuugagcuguuuuuccauuaaaaugcaaugagguagugaaaggacagcuuaucucucccuggcuugauuuuugauaguuuuuguuuuuuuuuuuuuuuuaaacaaacuuuuaaguacuguuccuaacccgggaaagcaagaccugaagcuaguugugcguagagcgauccuuuguaagacagugucagcaugccucggaauuacccaucugcuuccugaucuucaucacuucuuccucugaguaugagacucgugucggcccggcccacuaacccuuuuaggaaacgcuucugguauacaagaaagguuuuggcagacuucucagcagaagaauagcccucuacagaaagcuaauugcuuuucuacaugucuaacuucaugacucuuaaaauguuccuuuccugccguaagggggaaaggagggagugggaaaggccagacacaauugcugugagucaguucccuuugcuggaacaccccugauguaagccagauaauaugcuugcuuugcaagauugaagccuaguaacuagagaaagggaaaauggucuuccuuuaaacccagcaauucucucguuuuuguucccuuucacaaacucuauacuuuuuggcucuuaauugaaaaauaauaauacgacuuagacaucagcaggguugcuagagcuacauggguuuuuaaguucaggcuugcugucugcuucuugcaggucauguuauuaucucuaauuuucuuuaaucacaccguuuaaaacacacacacacacacacacacacacacacacacacacacagggguuaucuaguuauacuuauguuuauucccuugagucuauggacuauguguuuggguuuauaucuggcccugccugggaugccuggcacauuggaggugguuaagacauguuugauauuaaaauuccuuauuuaaaacaucugucuuccuaggcugguguaaaaugaaaucuguacuggucuaaauaucugcugucuacuacucacuaccucaugaagcaaguuauagacaucuuagaucggaaagcuaacaaacuugccuaccuauauaguaucugcaguuuauucuuaggggaaaaauuagcauuuccuuauucaaauacauuuaaaagauuuuaaguauauggguuuggcucucaugucugucuacaaaugaaauuggguaggggcaugguaagaaguccuaagccuccaugauuuaacaaaacaauaacaaccacuuuuuggcaccugucaguugucuacgagggucacaaaggaagcucuguucaucauuguccuucagggauccuuuucacacaucagcagugggagcagucuaaguagccaguugcacacagacacaggaacuuucuugcagaaguugaguaggaugggagcucacauuucauugguuaaagcaaucacaugacuuuagaggaacuagaggaauacaugcuuaucacuauccuguaaggcugggaauaacuucuaagcaacucuaguaucuuccagaaacuagggauaaacuauugggagaggguugacaucaucucuucaccaaauauauaaaugaagccuguaaccaagacuccuugggcucuagguuucucaucuacaagaugauaauaacacugacuacuaugucuauaauuagaacuuaacauauauuauuauauuacuguucaacuucauuuaccuuuauauguuuguaggcaaucugugugugugugcauacacgcgcgcgcgcgcgcgcgcauacacacacacacacacacacacacacacacaugcucugucuguuucuguccuuuuucugucucugaaggcuuuuucugggguccuguuguauagcucaggguaggaaggaacucauugugaugauguuccugccucugucuacugaguccuugaauauaaguagcuuaucuuuauuagucuuguuguccauagcuuccuugccuuccuccuuuagguacauuccaguguugugacuucuuucuuaggcuaugcuguacuguguacauuuucuucugagaagauugugugccuuggcuuaagagcugaaucuggagcuccagaugggaugcagccauagcagagugcauuaggcugcuuaauuuucuggauuuacaugcagcauaugcuuguguuguacaagauuacagcuagugauuaauuaucugugucuuauugucuccauaguaggcuccuuguuaaccacgcuuucagaaacucuuucuuguaagccccucugaugcugaaauggcccauuucaugaugguucagguagauuaaaacaaacaaacaaacaaacaaacaaacaacuauagaaucuuauuuucuucccuauagguuuuccauuaucuuagcucucuccuccaauuaaucagugcuuuucaagcuguauuuaugaugcaacacuaccagcuuuuugccaucuacagacaugauagcaaguagcaacuuuuaggcauguucuuauauaauguuauguguuuauuuuuccaagaaaugauugcauguaucaggaaguugaaacauacaccaaaugaucccgaucacauaggugauaaguagagagcagcagaacccaaacccuugacuuuucugaucacugcuuuuuguagacaguggguagcauuauuauuuuaauuucaccagccucagcaucaugcuagcuccugacaugucaagauaauaccaagcaagaacagaucuugcaucaacaccaccaaaaaccccgcuauccuggcacucgcuccuuacucagagaagcuuugagaugagucgcucaacccaugagcacaguuggugcaagauccuuauuuguccacgcccaucuaagccuauuaaaagauuauugaaaaguaugcugauuaaaaaaaaacagauacauuuuaucucugacauaauaauuaucacacucuucuuaaggaaaugaguauauuuagcaaauuaugaauagguucauuaacaagucuuuggcagaauaaaaauguaaauaaaucuuucuaccuuguacagggaaugcccaguucuuaguuccagccaucacuacaagccaguuuugugauucuacggccaggugcaaaugguuaucuuaauaacgugccuaaguuuuucucaugauagauaacucacacugccaaauucuuccaaaauuaaccaauacucauaaaacgacacuaagugcauaggaaagcaauuuuaaguaaaaaguguguguuccuuaagcaauuuuauuccacccaaaguguaauguucaaagcaacaagaaaauuacugagaggagcagaguuaugacaccaagucugcaagaacaaaugauaccucaaaggcuuugucauccgggaaaacaaagccauggcauuuugauugcaugguuuugcuagugacucaguuccagggacucauugcuacuucccugguuuccaugugagacucuucugugcaagauguuuucccuaugaagucagccaaggcucuauggguagaagggagaauuugaacaggauaagaugugaacccuuaacuuuguuguccugcauuuuaagugcucaaauuuggucggugugccuuuccuugcccugcaaauaaagauggcugcuggaaauagaagcccagacuuaacagaagacucuugcucuuggagccuaagcccaggagugcaaaugauuuauaugggaguacucuagcaaagaagaggguagauguuuccuagagaaaagugaucuugcuaucccgacugacaccauaagcuugaguccuguguuccuggacccaaaacugaaguauuugaaaacucuuggccuucugguuaaguuugacaguggguuuugaggaacaugcaaaacaugucuucuaaguaaugcugcaauuggcagaguucccucaaacuaaugcucccuggaaaccugguuuugcugacugcucugguaaugucuaagauggcugggcugcugucuguuaggauuucugucagcgacuccuguagcugauacuggucaugauuuaguucugcugggcaucacucuuuagaaaugccuccgugagaugagacaaaacuuaucaggaguaggaagcuggcugagaggaauaugagcugaaccuccacuucugcuuggcuggauuaagcuuucuagauuaacgucuaggaaaauaauguuacgauaucucucuguucucuauguguccucgugguauuuugaaagacacuucaccuuccucagagaacaauaaaaagagguagggagagcaaacaaaaccacaaacauuauuagcugucucagcuuccagcucaaccaauuuacuagcuguagcuuugccaacucucugagccaaaguuaccuccuuccuaaaaugagagggcggguccagaugguuacuaugguaauagugcagaaacuuuucuguucugaagaaaggucuuaucuaaaauauuuguacgugauugauauucuguaaaccuaugcacacaaaucuuuauauauacaaauagauguauauauauacauaaacacauuacaugcaaaauaucguauuuguagaguaugagaaucuaaaacugcaagcaacaaagucaaguauaagaguguuaagugcagcagagaggacucaauguguaaagugcuugcugugcauguaugagaaccugaguuuggaaugcaguacccacaucaaauccaggugugguggcaugugucuguaacuccagcacugggacacagagacaaggacauucuagggaaaccccugguaagccagcuauucaaaucagugaguuccagguucaaagagagauguugucccaaaaaauaagguagugagcacuugaagaagauaacucaaagucaagcccuggucuccaccauugcaccacacacacagaaacacacacacacacacaaagagacacacacacaaacacauguaccaugggagggagagagaaagaaacgaaauauuauaaagauacaaauauauuuauucacaguuuaaugaaucccagcuaugcagguacacaauggaaaaaacuaagcuggauuaugcuauguacuggcauauaucuaugguuccugugaguggaggcucagguaggggaauugauugagggguauggacucgcuuaaacaucacaccaaguucaaaaaacaaaggaacaaaggaagggaagagaaaaaagauaaacuggguaaacaacuauaaaauauuuuuuaaaagcauaaucuuccagagaaacuucaugaacacaauaaaggcguuuuuggcucacuuuuuuuuuuuuuuuuuuuuuuuugcaaaacacacacacacacacacacacacacacacacacacacacacacugcaugcauucuaaacuaaauggaaagaugcaauauuucuaugaucagguuccuuuuucccauucuccagagucugaacgugguugcccacaccucagucuguaaaaccccacaccuucugugcaaugguuguuaaggaguuaggagaucuggcuccucagagcagagcucugugaaugagcaggauucacuguguagauccugagagcugcuuuggccuuuccuucaugugaaaauggaagaaggcuccaucuguaagccaaaaagcuugccuuugccagacagggaaucugccuugaugcuccacuuauguauaagaaauaaaguucuguuauuuacaugccacauaauuguaguguuguguuacaguagagggaugugacuaagcuacucaaauauaaagaaaaucaaaacaaauggcagaaacaacaaaacccuaacaaaggcuuagagcgaagauaggugggaacacuuuuuuuuuuuuuuuuuuuugguuuuuugaaacaggguuucucugugugugucugcccuggcuguccuggaauucacuuuguagaccaggcuguccucgaacucagaaauccgccugccucggccuccgaagugcuggaguuaaaggcaugugccaccaccgcccagcuggaacacagaauuuuaauguguuucuguccucaaguauguacaacggucuuuacuagcauuacugcacagccgaguguuauguuucccauaacugauaguuaccucgacaaaucauuagcaccuaaaggccuacaauucacaguaggauuuacucuugguauuguagauucagaaaaacugacaaacacuucucuaccauucuauuaucuuacagaauaguuucauugcccuaaaaacaccuuugugcuguaccuauauucccaugaccucuuacagacacuaaucauuguguucagucuuugccuuccuaggauuucagauacaggccaucuccaaacuaccugggaaaaaauagcucuaggacuaccuggguacugacaucuacggguauuccagucccuuaagucugcucucccuauucauugguaggagacuaauggauucaugaagcucguguaauuaggauaauacacuauucauccuuucuguauacgcuguuuuauuuuucagugaauuuauacaaauguuaguuuccuccauaccucuucaaugcuugauaacucauuucuuuuuaguacugaauaauauucucuuguuuggccauaucauagguuauuuguuucaccacugaaagaaguuagaguagcuacacaguuugaaaauuacauauguuagcagauuuuguaaguacagacauuuuuuauucauuuggguaaauagaaaggacuacaauugauuaaucauuuggcaaguguauauuugggccuaugucaauuugcgugcuguucagcgguggagaagaguuccuguuccucagaaaauugcaauagcguucgcaauuuucagucuucuacuucuaauaagcguaauggcauuuugucacuuuuaacuuucaauucuccaaugacaucagaaguacaugaagcauccuuucuucaacauccauguuuguagcucuuuuggggaagucuguuaagguauuugguccaaguuuuaaucacaucauuuauuuucauauuguugauuuucauaauucuuuaugcuuuaaaugauaaucuauccgauguaucuuuuggaauuauuuucuccccuugacuuuuuucuucccuagauauuaucauucagagagcaaaguucugaaugccaguggaucucaucuuaccaaguuaguucuuucauggcuugcauauuugguauuguuccuaaagcaccgucuaguccccaaggucuucuguguuuucucuuguguuaacuuggaguuagacuuuuucauuucgcauucaggccugcucugcuugaaaugaauuuauauaaaugaauaaagauuguauauauuuuccacauggauguuuuguuguuuuagcaccacuuauugaaaacauacuuugcuucuuuguauugucuuuuccucuuuggaaugaucaauugacuauguguuaaucuauuucauaaaaauucauuuaugaauuacacauguggagaucaaaaggguaagucacauuaccacaaggagugauaauguuucccccaaaagccauagccuagcuagcaaaauuccugugccaaggagaaaccccuuggaguaguugucaauauaagcuauugucauugucuuugauggccuuaagaacuuggaggugauacucugauugagauccauugauccguguauuuagucuucugucaauaccacacugucuugauaacuguaguuuuguacuauguuugaaagcucuauaguaucgaguucuuuaauuuuauucuuaucauucagcauuguguugguuauucuguauccuuugcauuuccauauaaacuuuacaguaauuuuaacaauauccacaaaaaugaauguuggacauguauugaaucugcaguuguaagguacugauaguuugacagcauugagucuguauaucuaugaagauguaugauuuuuccauucuuuuaucucuuacuucauaucuuuuauuagcuuuuauccuauacaucuuauauauauuuuguuugauuuacaauauuuuaucuggggagugcuacuguaaauaacgguguuuuauucaagcccaccuguucaauuauacuauauaagaaagaaagugacuuuugugcauaaaucuugacuucuguauucuuuauagacuuuuugagcaucaauuauauuuuuaguuucuacauaaaugauuauuauuuguggaaaaauaugggaaaauaucauuucuaggggaaugacuuuucugaacagugcugccuguaguuugucuuuacaaaucaaacuuucagccuuucuauaacaaaauaaauacugugcuuugagaucauuaauuaguaucuacucauucugcuuacauauuuuauacccagcuauuuaauuuuaaggaaauccaucuuacuauacuuuggaugcgauguaauuuacuccuaccaccuaagcugugugcauaccugugauuuuccauguuccccauuucuucauggcacauucaugccuuugacucauaaagauguauguguguguaagauguaguuauuagaccuaaguaccaaggcacugaaagcaauauaccuccagaugaugaaagcugcauguggguauugacugauaauauuuaguuaugggugcucugugcugagucaauauaauuauaaaauuuucuccuuucaugaaacuccuacaaaagauuaagacaaaaguccauuacucuuugguaaaugacaccaaggguuaguuucuuauuuuauuggggcaccaccucaguuucuuucuucccaaucuguguaccugcauuuccuuaucuaaucuuauugucuagggauuccacuauauugauugauaugacuggugagaggguauauucucuuauauaacauaccuuguucuugagcuuaauggaaagguuuugcuuuucuucccauuaagugugauguuagcuguaguuuuuuauuuguuuguuuuguuuuguuuuuacacaagucuuuaccaaauugaggcuauucuuccucuuuugugauuuuccaggcuucuuuuauauauguauauauaucaugaaugguaguagauuuaguaaauugcuuuucaugcacucauccauauaauuauguaauuuuuuucuuguauacacuguuauaauuacauauuacauugacugacuuucaaauguuaaagaugccuugcacauuugauguaaaucucacuugauugugguacaaaauuauuauuuauguuuauuauuggaauugauucacuaauuuuuguuggggauuuucaauuauaucuacaaaaauauuagauggcaguuuucuuuuucuuuuucuuuuuuuaaauagucuaugccucuggcuuuaguauuacaauaacguucauaaugaaugaguuaggaaauguauguuuuuaucuuugguugugcaggauugauauaauuucuucucuaaauguuuggaaaaugcaucaguggacccaucuagucuuugcauuuugagucugagauuauuaauuauuaacacaauuuguuuaauagauauaggucuaccuucuuagaauuucuauuucuucugguauggguuagaagaaugugcuuuucagggaaucagucccuuucaucuaaacuaucaaaagucauuguucauaauaccuguuuauuaaucuuucaauacccaugagaucucuaaugauuucugcugcuuucuguauaucuuuauauuccucugguauggagucagcaaagcaucacaguugaauggaaagcaauacaugacccuggcauaagaugaauaaugaaaaugacauaccuagcaguuaguacugagaucaauagggaaacagaauuucaucaaauccagaaggaugucauaguaucuaaagaagaagggauaauuacagagucucugagacccacagaagaaguggaaagcuagagcaaaggugaagagaagugaaaaaggagccuuuaggugccauucuguauuccagcugcauggcaagcauugucauuggccucgguggcuuucuggugcauuuuauugauugaaagcaucuacuaaggguagauauuacucaaaggauggugccagagauggggcuuaauccauguccacaggacccagggucccacaugcuguuauuguaaaugaucucuaaugaaagcagagccauuugguuuauuuccaagaaacuaaaguauccuaaugagaaaacaugccaugcuugugcucuguuagaagugggcuuaggaggaguucuuuuccucuggguaauauucccacuuccuagcacuuagaaugcacuaaauaaaaccaaugaaauggaaagcugugugauaaaugcauauggcuagauggaaaagaaaaagguaauugaugaaugauaauaaguuuguuagggaugaaguuuucuucuguacacuacccaggagggaguuauaaggugguacacuauaaaauuuuuucaguaagauuucaggacaaggacugggaguggagaguuugaauuggauaugagggguuuuaaaugaagguaguguauacaaaauaccuacuaucugcuaagacuucgaaaacaaaagaugccucucauuuguguggaagagaaggcugugaacuuuccccauaaaaaccagauagugaguauucaagcuuauauaagcuguacuugaucaacuauuuaauuguguuuuacaaaaauauucauagauaagaaguacacacacacacacacacacauacaaacuauaugucaaugaugcuuuagucacaaagagugguuuauagauaguuuaucauucugcuauauuucucuugauuauaagaaacaaguuacagaucucucuccccccaccccacccguguguguguguguguguguguguguguguuucuugagcauacaugaagagcaaagaaaacccuaacaauuuuucaaagaaaagauucaaaccucugagguaaacacugcaacugagcaaggacaucugaaaaggcacuuguucaucuuucagaugccugagauuggaggaggaaauuaaaaaauaaaucuguaccuuaaauugaagagggaaaaugcaagaaauucagagaaugcagauuuaugaagugaaacuaaguuuguugagaaacaaagacaggagaaugggggaggcaaggaggacaaucuguaguacauagggaaaaaaauaaaggaaguccaagugauaggaaggacaaagcuuuaccagcugugcuaaaaaugggagaggugggaaggcuauaaauaucugcggcggcacggagaggaggaucaugggaagaaauucucuuggaauccugaacacuacaugauaucaugaaguggauggagacaaggguuggcucacucacaccuaugacacgucaacugaguaagugaguagaguuuggggagcuucaauaacagcucacuccagacuuuauagggagggucuccuugggagagcgagauagccauuagaaaaugugugcucacucuucagcaaacuuguccuagaucagaaauucagccagagaugagacugaccccuggagauauucagugugaauugauggcucucaccuuuccuuuggccuguucguggacccaucagacuuuaccaagaaccuguccuuugcuccugcaugggucauucaccagucuacaagguccuucaagagacuuuauaguugauggcacauucauacaggaaggcucagaggagccuguguccucuucaggacacaagaugggcaaggcagaagcaaauuuaaaaugcagucuaaaaguucaguucuguucuuucauuuuacaugcagauaaaaucacaauaggggaauaaggaugaaaauaaaaauaagugcuuauuauaugagaacacauauuuucauugugacaaaauacauacagcaccuaauuaccuuugauuacagcauauaagauuguacaaucaugacaaauaguucuagaaguuucuaauuaucccugaaagaagguuucuacauucacucuucccuccagccuccaacaacaacugcaaugcuuucucuugcuuuggauucaauuauccuggauauuuugcacuaauggguugaaugauauguaugcuuuuuguuuucuuucuuucuuucuuucuuucuuucuuucuuucuuucuuucuuucuuucuuucaguaauguacuauuuucacaauuagucuauguucuaugauaaauccguaucuauuuuggaagggggcuggauaauguccuaacauaggaguauggcagagauuauuuauccacuguggacacugggcucuuucgaaauauuacuuguugggaaucacccuguuucagguacuuuguaaaguucuguuuauuuauuaauuuaauuuaguuguauccaugcgcaguugcagagggaaccaccguacuuaucccacuucauguaugaaggaagagauaucaggucaaugucucccuugugaugguguaucagcuuauacaacuaauaggaauuacuuauagaggguuguacuuugaccuacauuuccuucuugauggaaaagaaaaauguucucuuugcagucgcccccaacuuauucugcagugagacacgucaugugcuacugguuuccuucugcaagguucaaaccagucacauaugauguguuuauaaaaagauaaagagauauaagaauauguucuauggggauguggugagguaugggggaaggggaugccucagcaggcccaugccaaggcaucccuucccccugaggguccagcaacaugacggcauaguauagaauagaguuuauucagggcuuggggaggggaguuaggaggguaguagaggcagagaaaggcagagagaaagagaguagagaaguagaggauggccauggcuaugaacagguggagagggggaagggaagagggaagggaagagcccaagggagcaagaaagaagcaagugggaagcaagaguaagagagggaggaaggggcaagcagccgcuuuuauagugggccaggccuacauggcuguugccagguaaccgugggguggaauuuagacagaaugcuaacaauauauaugugggguauuugguguacauuaguuuagacaaauccgucuguugaauaauggaaagaaucagagaagaccuggagauuguguuugaagaagccaccauguguuuuaguaauaaauaugcagcauaacuggaaauauucaguaacagaauuaugaauaaaauaggagacaccaugacccacacuacacagcuguggcagaugauggugcagaacagaauaaugacgugacaaaacacuucgccuuguccccucucccagucuucagaaggaaggccuugucagcucuguagguaggaaaacugaaauuuagagacgauuaauaauccccaugggacccaaagcuagaauccaaccaacaccucuaaccuaaacacagcugcauuuuuaacaaaccaaguagaacauaacacaauuuucucagugaccuauuucugaguagaaagauagugggcacuguuuuugcuucuauuucuuccuuguucauauucucuacaaugccuuggguuacacuuccaacugaauagaagcagugcagggcugaggagauggcuccaagggaaaaucucuugcucgggcagccugagagccugaguuucaauacucaugccugggcaccuccauaaaacuggguguguuuacacccagcuaugaucccagcacuggggcagaagguggaggaaggagggucacagaggcuuacugcccaucagcaaacuucuggguucagcaagagacccugucucaaaguaauaugauggcacauguccaaacacacacaagugcaugcacaugcccacacucaugcauguacacacauacauacauacauacacacacacacacacacacacacagagagagagagagagagagagagagagagagagagagagagagagagaaacagagagacagaaagacagaccaaaauaauaucauuaaauuaauuuagauuaaaaagcaauaaacuucuuuuagaaagaaaaagaaccacaggggcuggagagauggcucagugguuaagagcacugccugcucuuccagaggaccaggguucaauucccagcauguagcuacaggagaugacaaccaucugugacucuaguugcacaggauaugaugcccucuucuggcauuuuaaggcauugaaugcauguggugcacagacacauucgagcaaacauuaaugcauauaaaauagaaauaaauacaucuauaugaauacaaggaaggacauuaaaccucucaugggccacaguaagauauacggaucuaaaaaucacaugccaggcacagagaaguaaggaagcuugaaagucagaguuuguauacagucugugguuugucuccuuaucauauccacauuugagagcuauuagugggugcugaccauucuuccucccuaaagaaacauuuucacuuuguaauuaguccugcuaauuugagaagauaguuaacaaaccaugaccaaacauggccagccaguuauaguccaguugugggugacggugacgcuggaaaagugagacauuugguuauucaaaugauauagcucaauccucuugacacacacccagaaauccucagcuauuauuucagguuauugcagugagcacuggcccggggccugcgucugucuguacuguggagccucacagaggccuugagaaauaagcccccccuguaguguuuauacaaaaacaauauuagcuugucauuguugcuguugauaggaacaacuucaugaaaacuauucauugucuccaaggacuugguugauguuugauuccaaauuuauuuccccuuucaagucgcaucuccuuguuuaaucagcagugaugugacuccacaagagcuguaauauugucaucauuuccauagaaaccgucugcaaagcuacaaacagaggcuuccacccucccugcaggcugagguaggaaggccagauggguuauaaggaaaaaggcucuaagugaaccauaaaucacuuggugggggaagagauggugggagaggaaaucacuuuagcagaagaauuguguuuggugcagccguagccacagggagaaaucccccaagaaguggcuaauggugugggcagcucuccaagguuaacgucuggaguagguuacuugcugggccccuguacugaggaagcugcagacaaaggauucuuccucugugggcugcugaucucacaguccacuggccacaggagagagagccuuaauguccuggucagccugauguguauaaagauagagucggguguaagagcucgcaucugucuggaucaacaccuuucacaugauugucucaucacgccugcauaguaucccugagggcaagguguucuuauuccuguuuuacaggugaggagacuaggcgguucucccuccuucuucucuaaaucucccugcccuuuugacuguuuuuagggccucuuucucacccccccaaagcugagugaggaucaucugugucugugaucuugggugcaucccauuaauaaugauuauacuguaauaggaauaaaagcuaacuuuccccccauuggccugggaggguaaacuuugaguguaacaucuuuaacaccugacuaucaccaaauuaugaaugacucaauggcccucgauguauucuucugauaaaggaauaaauagaaaguucccaguuaauuuauuaaauugauugucuuuguagcuguaucugugagaguuaagaaagugucuaguauacucaagccgccaagaaauauuugaaugggaaagugaaugaaucagccagcggauuaccugcuguuaucaguuugugacaucuagcuuuccuaguuauagacauauuaccuuggcugguaggaguucauugucaugucuggccaggcaauacuaagcucacaccuuccuuuccuuagcuugauauuguuugcuuuuagaagggcaacccaguauaugacagucgucauuuguaacugacagucaucccagccugaugcagagaacacuaguaggucugucauccaggagaacaggggagaagugcuugcauuauucccuggguaagcuuggccaaauccuuucaucuucauuucccuuugaaaacagaauuacuugaguucagcaugggauuacuacagaugcacaccucucaguuguuagaugggggucuuaggauauuaucacaguugaucucaaauucauagguugaacugauccuccugccugggucucaagauuaucugugacugcggguacaaauucucuugcccaggucauucccucucuuuagaagaguuaucagagguagucuauaccagaaucucaaugaaugugaagcuuccucgauggagacccucccugccgccucuuugacauaaucuaccccugccccuaagccuugcucuuugaggaaauucacugggaaacauggaccccagcacauuuagcucggaguguucucauuuugucuaacagaacaaauuauauuuaagucauuuguuuaaggcucaagaguucuguagacacuggaacugagcccuacagcugauugagcagccugaacuggugaaguauacugccuuuuccaacagacaggcauccuaguggagaggaaugacuuacaauccaagguauacauaguaaauuuacaaacucuacaaaguucuugacauguuaauuaacuuauugcaggacucugagggacuauauuuuagagauaaaaaauuaagucuuggcaugauuuaguagcuugcuuaacuuuauguggcaauuccguagcagaacuaagaucaaccuuguucugucugaaaaaaguuauauaucgauaccuauaauguauugucucuccaaauaucgaaauuacuaucaaagcaggauacacauguuacuauuuuaguaaaacuaucgacacugauucauuucagcaacuguguaucagccaugguccuugcuucuuguagcaaaaaugucuaucucaacucucaugggaaaaucuaaauuuaauagugacccugauggccacuggcuauacagcauugaacaagaagguucauauaucugugucagucuguguucagucaaaaaaaaaaaacaaagccucaggagcuucagugagagaggcuucaacucagauggcugauaucacauaucagcacagguacaaccagaggaagcagcaaccauccacaguugagugagcaaagagguaaagcuacccuugcagaaugaaugcucagguuucugaggaggcagcgccacccagcugccuaugguccaccugaaugggucugagaaaaacuaggagagaauccagaagccauuguagguguagacuacaguguuuauacaaggcugaugauaccaggacagagaaaccaaggauccggcuucccuuucuuuggccugcgaaucuaugcuuuugcccuuuuagauauagaagcuaauaauacaguggcaaagcuugagccuaauacaaauuauaaagagaguaugggcuuggagcugacugacaggcacagagcauccauagucgcuagcuaucacugauaccauaucuguaaacaguggauaauacuuacuccaucagacucuccuagaagagccuaugaaaugaucacuccaugucuugagauugguuucaagugcucacuaaaggcaggucuuugaguuucuccuuaugcuauuugcuuucugcaggaugcacugccucugcucauuuuccagugggacucgggugucaggguugcugagggauuaucauaccaucugggaagcuguccuuucuaagccccauguguugagcaggcuuaggccucagcauucgccccagucaagaugggagccuucuccccagagagauuuaauuaguugcuugucagaacagugccgauggaugaaaugccugucuuagaucagaccucuguuugcucugaugugggauucuugguuuauuucguuugucuuucuucuuccucuucuucucaaaauaaagccccccaccuuucuuuucucucaucuccuucuguccuccaacaagauaaaauaccccucauggaguuagcaagauucuuucucccaggcaacugcuuugagcucuagagcuccauggaacaccuccccaggauaaacuaugugggccaagacugucuaucagccccagcaugaaguauauggauguaaauuguaaaguaggcacagccauuguggacuucaagucucagcucaauauuuaguagcuuuucucaucucugagauccucauuuuuaucuucuauaaaaugauuguacuaguuauacaauauagaaaaagaaaaggaaauauuuguaacccuguacacuaaacaugacuuuuuuaaaaucuccaggaagugacuggaaucauugcucguucaacauacuuuccuuuuuguuacaaauuacuauuugcucagaauaaaauuugauaauuuauauauauauauauauacauauauauauauaucacaaauauuuacugcucucuuacaaaugcuagguacuagaaacaauugaugaagaaaaauuaacacacuucaaacccaacuucauaaaaauaacuuuucugcccuuaagguucuaacaguuugaggggcaggugaaggaaaggcuggccaucaaccuaaugugauagacauugucauggcagugugcaggggccacccagaggcccacuggcagacagauagagaccuaagccagaacuuuggggauagagaaggaggucacucauaaccucauugcccaugugagauagucuugcaagguacaggugugaucuauggugguagggaugcauauuauagggaacguaguguacaggaucccaagaagauaucaguaaaagauaaaguauggugugcucaggaaccugaaggcacaagcuaaucaaaaggcaaagccagaagucagcuagagccaaauuuucagaaccuuauggagcaugugcaaagccuuuuagaugcucuucguggccuuccuuccaaagaugccaccugguucccacaucacacuucauuuauucagugucauuugucugaacaauaauuaaaugucuccccucuuccuaagccaccccuuauuuugcugagagauacaauacacccagacuaaaaaaaaacacacacuuucuagucuccccuacagauacagcaaugaacucaauagaaaucccagccagcauuaguauauacuggcuggaggguaggugaaauuaaacuguggaugcaugugaagguucaugaaccccuuccaauaggcuggggaauauaaagauaaucugaaacugugagagaucuagagacaugcuagagaucuucagugaagagccuagaauaaaucauuuauugaaaaguauauauuuuauaagaauaguaguuaaaggaaagaacucagaagacuaggaugcaagagauacaagauuggguccuaguuuaaaaggccuaauugucguucuggauaggauguuaaccauuaaacaggacagucccaugacaaaauagagacaaggccucuuccacagagacacugugaucauucaauaaacuacaacagugacaguagauggcaugaauugcuuccuguaugcccagcaguuuuagacauuuuguaaguaucauuucacuuacaacauaagcuuuuauaguacccuaguagcgcuccuauuuauagaugaagaaaaugaaauggaaagauuaaauaacuuuuucuaggucguaaagcuucuagacagugcauuuuaauuaggauugagcucaucacucggaaagcauuuugauauaauguaaaguacauagauaugcauagaagaucugaaaaaaccauuuacauugacaugcaacuuuuaaaguaaauaauagacgcuaauuaucaaccuugcgucccauaauguuuggugucucuuuaagaugucacugguugucuuucaaagccucauaugauuuuaaaauuauuacuccuugcacauaauucuucauuucucucugaguaccuuuaauaucaugcuuuucuuuaaagcucuacaauguuaguaauggguuagguguuuugcucuuucuucucugaauccaacacaucugaagacucaggaagugucauuggcugacaugaucucagaaccccucuucauccuucuugggacuccuuugacuuuaugacagacagccucucuaaugcccacauccuuccaccacuccugugucugucguggagaggcuuaacuagucauauuuccauuucagcucacaaauccccucuucagaugcauauaaugaucuguuuaaugcuuuuaaaacaagauguccuuguuuagugugggagggucucugugggcauugcugccccugggcugaagguccugggaacuguaagaaagcaagcuacaggagccaugaggagcaagccagucagcagcacuccuccauggccucugcaucagcuucugucuccagguucccgcucugaguucccucaguaauaaacuguaauguggaagugugaacaaaaucaaccuguuccuccccaggaaauggcguuaaucacaacaauagaaaacauagcuaaggcauucucugauccuuauguauaaaagcugcacuguagauauaucaagcgggguugagcaucucuucucuacauauuggucaguugugaacuauaauuaucucaaucuccugaaaaacaaacaaacaaaaagagaagaaaagaaaaagaagagaagagaaagagaagagagagagaagagagagagaagagagagagaagagagagagagagagagaaagagaaagagaaagagaaagagaaagagaaagagaaagagaaagagaaagagaaagagaaagagaaagagaagaaagagaaagagaagaaagagaaagagaaagagaaagagaaagagaaagagaaagagaaagagaaagagaaagagaaagagaaagaaagagaaagaaagagaaagagaaagagaaaagaggaagaaagagaagaggaagaaagagaagagaagagaagaaagagaagagaagagaagagaagagaagagaagagaagagaagagaagagaagagaagaaagagaagagaagaaagagaagagaagaaagagaagagaagaagagaagagaaagcugcuuugauggugggugagagcuauacuuaucugucugcuugaggaccuauauuuagcauauacuuaaaaauuauacugacuuaggaaaguggcaguuguaagugauccucuagcaacuauggguaguuggcuaguuuacaguaccagacauaauccucuccuauugagugagccuuaauucaauuagauaccaucaccacuaaguuguaaguuucccuugcacuguuggaaagagcaugugggacuggucacugcugucuacagacuuuacagcuagguaggccuauugcuugcuuuucucccuugucgucuuuuauaaaaauccauauaugaaauacgcauguggagagcaaaaggguaagucgcauuaccacgaggagugauaaugguccccucaaaagccauagccuagugagcaaaaauccugugccaaggagaaaccucccuuggaguaguugucaauauaagcuauugcuguuauuuuugauugccuuaagaacuuagaagugauacucuguugcugaagaccccacacaccacacaccauguguacuuuagacacuugggacacaucacaucguagacacuucaggacuuggaaaaaccaagcugaaauugaccugaaagccccuucccugaugacugacucucagugccugaagauacauggagagugcaucacuuuaaguacauugacuuuaucagcaccuauguuuuguuuuauaaaguuuuaaggaacuugauguauuaaauauaccugauaaaucuugugaacucacauuaacuggauuuuuuuuuugaaaagauccuaaugaucccugguccuuuguuuugcauuguaguagauaacccagugguuucagccauuguccuguucauuguuaacauuaauguuuuacuuuaggaacuccugaaaauauaacuaacgccugaauuugugugaagguuugucccauguuauccacugggaagggacuuucuccauaacaauccaucaagaagaagagaaagaacauggaccaaguuauaaaaaaaaaaaaaagucuucauuuaugacaucuuucuagcuuauuuuuuucuccucccagagaccaaguuuacacggaaggcucuguuucaucucuccugguuugguaugaacaaaaggaccgaaucuuucuacucaacucaucaggauuaguaucaauuauuuuauacucacaauaauuuguccuccaauugaacccuggauaacugaaauucuauguaaauucuaacaaaacugguuuguuucuucuuuuaucacuagaugauugaggaaauaauuagcaaauuauacaaauuauagaguaauuuguauauuuuauuuaauuuugaauuuaaaauguaauuuaugacccccuaucucuuaaucaauucuaacugcaacuccaccacuaguuuuuuguauacuaaauaaagcaaauaaaaucaaugugccucaauuuucuccuuugagaaauagcccuaauaauauuauuagcuggagucuuuggaaaauuuaauaaguuguuacauguaaagcauuuagacaaguucuuagauuuauguacugaauaauuuuucacuauuauuacuuuugaauaguaauaacuuuaauauuuacaaauaguuaucuguagaaugguaaacucauuucuuuauuuuugaggaagugugcauugcugugacuuugugaucauuuuuauaacagaaguaaauuaacuucuuuaguuuuuuuucugcaguaauucccucuguaaaacauuuuaaaauguugucaauguuaagccaccuuucuuaguuugauaauaugauaagauauguuacuuucuccuuuuguuauuuuaauacucucauucauucuuugagacuaucauacguuuguacauuuugaccagaugugcuccuuacaaccuuccuccaacuccuccuagauccuuuccaacaaagucuacucccaauuucauuuccuguuuuaauuuuaaacccacaaagucuaaguagaauuguuuauaucacugggacguucaccagaaagugggcauccaaccaggggccacacuccugagauaaaaagauacuuccucuccuaguagccaccaacugucaauagcuugccaguagggguacaguuuguguacucuccuccauccaggcugaucaauuuacuagcuugaucugcagguaaccacaagugccagagcuucugagugcuacggcccugucacgugaagaagacauuuguuuuacccuaguuuuucuuaaauucuggguuuaugaagacuuucuaccaccuuuauaugauaguccccgagccuugccauggaaaggcauauaucgguauuccuuuaggacugagcacacuccauagacaaauuuucucugcauuucaaauacugauagauuuccuuucuauuuggauuaguguugagucucggucuuuacaaagucauuuacuguuaaagaaguuucucugguaagggcugagagcuauacuaaucuauaugcauuuagaaggcauguggauacuauauccacuuugugagauaauaauucuggguucucucuuagugccuaugaccuuucuagccauggguuccuggccaugguuacaagagaacuagagcaggccuuaaagucaauugaaugaugguuaguuaaacauguagcuuccaugacacuaggcaauaggauugcuuuuaucauuuuuucguuauacugguuuuccugccuuuaauaugaugccuuuuaugauuguuuguguguguguguguguguguguguguguguguguguguguguaguauggauuuguguguauuacagucuacaguuucauuuauuaacuuauauaaugcaauuuccauucaauuauauaaugugcuuggagccaguccccucacacccaucuaucaucacauuccucccucccuccucaguuccaucaguuccucuuuguuccccuucucuucacuccuaauuucaagucauuuuuaacacaggauuccaugcaucuagagaaccuagaaucaacaaaugagaggagagucgcaauacuugucuuucugacacugacuuuuaguucagauaauaugaucaucuucaguugcauccauuuuccuacaaauaccacaauuucauuuauauucauggcugaaaaacuccauggugaauauaaaaccauucuuuauccauugcuuaguuggugaacauacaagucgguuccgucauuuagcuaaugugaauaaugaugccaugaacacugauguguagugucucugaguaugcucacaugaagucuggguagagggaggaggaggagaagggaggaauacccagagugguggaucuggguuacgugauaguucuacuuguaguuuugugggcaacuucugaauucauuuucauucgaagcaguuugauuauuuugacgacgcugucuaacucacacaauagcaagcaaugugaagcuguuuugauaaauggacaauuuuuauuacuguuuauuauugcauugugccugauuaccagaauuuaaucauccaacuacuuacgaacauuucccguguuucacuaucaugaguggauuugccauggacauuuuuucugugcagauuuuuuuuuaaacaaauuuaacuuuuuaguuucccuggaacaaaauacccaagaauauuauuauaauuucaauccaacuaccauuguaagagagauuguaauuuucauauauauaugaauacauauauauauauuuucauaaauauauauaauuuccuuuuaaucacuuaaucuaugaaaauacaguaucuuuuggguguugagauauucuacacuuuuaucacaguauuuguugcaaaauucugugaggcuauguuaauacccaguaaacuaaggaauuuaaauaggcgugcucuaugauuuaugugauuuuagcucaauaaagauguuauuuuaaaagguuauuacaagggaauaucuaauuguauuacaaaauauuuuucguuccuuuagaaaauuagcaauguaguaagaauuuuauuauguggcaugcauucucuacaagguuuuguaugcaucaauauauguaucuaugcauccauuauauguaauucagucaucauaaacacugucacacugggucacaacauauauuauuaaccacagugauguuucagcaccaaacuacuugaauucauaucccaauucaucacucaguagcuugucacuuaaucaaugaagacguccagaucucgcucuguaaauaagaaugcugagauugccaagcugcaugaggguucgugaaauaaugcccgugaagcgcauagaacacugugcaaugccauuagcauuauuacauuuaugaagacacauuccuuuagcaguguguaauugaaugguaacaguguuaugagacagugagucaugaguaugaauagaagaugacagcuuugcacugcaugcaugaagagcaagagaagcagcugacccuuaaagguuccagcuacacagagauacugcuuuaccgcacauacguguauacauuuccuccacacaaagucacgugguaagucugcuauuuauccucgucuuauaagagaagaaacaaucucaggugaguuaggaaaacuccccaguuucaaggagcaaguauuugauguaacuaaaaaaaaaaauuagcucuuucugcucuccagaguccacgguuauccucuuccauacacaaaauugauugauaugagacucauuuuaaauacuguaacuaacaugacacuaaguuuuaaaaacuuuucuucccucuuuauuugggaaauagacauuaacacuucaacuauuuuauuuaaaaaggaaugucagcccauacaucugucacacacaugccaguggcagcacaugagacguagaggaaggaaggauugugaguucaguauuauucuuaguuauaaagcauauaaagagggggugggagggagggaaggugaggggggaugggggagaucccuaaugucauggagaaagaagcccaaagauuugcaacuguuuagaaguugaaucacaauuugcaaauagguaaguccagagugggaaaaaaugauuuuucagaguguccagaaaggaacaaagacauauuuuuugauauuaaaacaguauuccaugccaaacucaauucaaacauaaacagaauaaagagauuuccaaaugaagaaucagaagggagaauuaacuacaaugacaugacaccaugcaaccacuucugaaguuucaucaccuuugaauucaucuuugugcucucucuuuuucuucuucaaacucuuucucuuuagaaacugccaaguguuguaauggaagcgaaaggggguucuaagagcagccaauuuauugagaaggacacaaaggaaaaguuguuuccuuuguagugagccucaaagcuaaguaucccaccccucagguucauggaaaaacuuggcuacaggucuccucuggaaggaauacucaaagauuuggaagcuuauuuggaaaauuagaucugucugauccuggagucauguaggaggcagaaucacugcucagucucacuggugacuggccuuaugaaugaagagcucuggaugacagcccacgagauuauucucagagcucuaagugcccugcuucauguguuggcaugcagugauuuaucuuaguuuguuuuauugugagcaauaaaaacagggucuguuucccauuugguuaaaaggaaaaagucuuggguuauaccaggggcuucucucaaccaugagaagugaccuuaaaauuggcugagaugcuccgugaaaaggacaaacuguaaucugcaaguuccgggaggaugcugcagaggccagcuucagaugugucucauuuugcauugcuaguaauggcuuggaaagaagccauagaccuauuaggguaauuauagccacagaugaagcuaacuaagauggugugauagacaccaauaggaaagaggcagagcagagcaagcuaaggagguaagauguugucaggaaaugaacaaaugagaccagccuggaacgcuggagacgagcaucugaagaaagacaugaugugaaaaccagaaggguuuguucucucugucucuccaucucuucuuucuuuccuucuuuccucaauuaccucuuuuaucuuuuucauucuuucacuuuucuuuguuuccuucuauuuuucuuuuauugaaaaguguuuuuaaaaaaaaaagaaaaguguuuuuauuuuccauacaauauauuuguauuauguuucccuucccuugacuccucugagauuuuucccaccuccccucccauuuggauccauaccuuuucugucucuaguuagaaaauaagcaagcauccaaagaauaauauuuuuuaaaauaugagauuuaaaaaauaaacaaaucagaacaggacaaaacaaauaaacaaacaaaggaaaucugagucauucuucuuagcauuagauuccuuccuggaaaacagcagugguaaauagacauuuaagcacguauuagagucagacaugccuguagaacaauggggggaaugaacacuaaaaguugguguucauguauuauuguuguuuuucaagauacauuuuucuaagcacauucauuuccguuaucucauuugaucauaagcccugagaggcuaaaggaaaauaaggaauuauuuguugaagaaauaaaaacgggcuaaguaggauugcuuaaaauaaaaggguuuuguuaccaaaacacaggacuaaaaucugaauugcuuaacuccccacucuuuuccuggucucuugccacugcgcccuggaucucaacacagugauauagcacugaccucuuucugauguugugcauaguuuugcuuccaguuaaaaaugaguuuaguauuacuguacucuugaguguggcaggaauuuacucucaccuucauccuacccaucucauugggaugaagcaagguagcauaccaagguugauagccuuugagugugaagcucaagccuuauaacgaugcugccaacuggaguaacaagggaugaugggcaaaccaugggccuuuuccagucucaugcugucaggcuaagugagugggucacuaacaucagguaggaucaguugcuuucaaaaucuaaaagaugaacaacucuacagaaagcagauagucagagauggagaccaugaagccuaagagggccuggcagagagagagagaaagauggcauauuauaauuucuccccuagaaaacauuucuuaugccaaacaagcacuuuuaagcauucuuuuaaccuuugaaaaauuaauuuccuuucuauuuucuuauguucuugcuaagagcauuccucucuuaaggguggccuugacauuuuuuccuauagguaacaaugugugaguaucuccgucaaccuauuucuucuuuucugugaauagcagauuaaaaaugagugugaaagugucuuugaauucugacaauaacaucaugguuuuuugcugccucugugugugugugugugugucugugugugugucugugugugugugugugugugucugugugugugugugucuguguguguguguagugcucacaagguuauaaugccuccauuuucucugguaaauguauguuggucaguaagaguaagugccugacaaccuugccuaugcaaugacucuuuauuccuacucccuaugagauuacccauuaacuggccagaauacaaccaaucaaauuccuaguuguugugaauuggagccaagagaugcucauuuuauuuuuucagagugugacuggauugaagaaauacagaauugucaaauguagaggagaaggagcgaaggacuguagauaauaaagacacaagagcagagagcaugaugagcaugaugagcaagccuccaacaaugaagcacagacugagucugacagauacugaguucugcuuucuugcuacccaugcuugcgucuuucccuauggccugcucuuucuuuuucuuucuuucauuuuucuuugauuguuacuuuaaacguuuuauaacaaaguguuguuauuaacacaacagguuaauuaacccgcauccuguuacuacacaagaaaguccauacaauauauuuuucagaucuacagacacggcucagugcauaggccuucuugcugcagaagaaugaugggaccuaaguuuagacccucaggaccuacauuaaaaguuguguaaucaugaacgcucucauaaucccagugcugugguggggaggauagaagacaaggccuugggccuuguuuguucaagaccucucuggguucaaugagagaucuugucucaaaggaauaaggcaaagugauauaacaggacacuuauauucucuucuagcauucacauauauguaucccacaucuauacacagagacacacacaaaccacaaacuucccugagucagaaaucaacuaaguuaucuauguauagauuuaaguuuauguauguuuauauguacucauucuugcacaaaagcacuacgaauuuauacuuauucaaagcuauuauuuaccaaauaucacauuggugaaaacaugaguauauuagauucuauagugcauacagugacuacacugauguauaaacagaccacuaacacccaaggaguccaaagaagaugcuuauaaaaacauauaacaacaaucuaccuuacaguuguaacacuggaggucaacagcagcucugaaaucacuggggacacuauagauaagaugaauaccuuuucagaagagauaggcugaagcugagacuuaagcuuuguuuggcauuuccaaggucaaaaauggugauaaucauuccagggagaggcuaugauuugagcaaguaccugaacaagaacagcgggaugugguuacuggaaaacagcacacacuucaggagugaagggaaaagcucggaaaugaguguaggucauacauagaaacucauauaucauauuaaagaucuuggacuuuacccugggagaguugacauaggagugaguugggaugaggcguuuaugaugagaucuuguauagugauuuccucugaguugauugagccaagugagaggagaugucaccagcugaauuuuuccaggaaggagaugcaaggaaaaguucuggaauuuaucauagacuuguuggguguuccaaguucuuuuggaagcauaaggcacuacuugagagugcuuuaaaguugacaucaauguaaggaaaugaaagaaaaaagaugagggcagaauuauauaaggguagaauggagccucgucugguccugcaggggauuaaggaaagaggagagccuuguagucaaaagcuagcccuucauucuccaagaaagaucugagcacuggaccaugaggcucaccagauauauggaauuaggguccauauauucauuuugguggacccacuucauagguaguuacaugaaucagccugaagcucagggcagagggauguucugaauauaauaucagugaugagagacuguguggccuuuugggguucuuguauccuuugaagaucuaaauaaaaagcagaggcuucccugucuccuaaauggggcugaaauaaauacccauggaauuucuggguauuugcugucuuuuauuugagaucacucacugaacaacaucaugcaaugcuuucauuauuuaaacuaauuaguuaguuccuggaagcauccacaagaugucaggaccuauccuuuaauuuaucuacauuuacaccacugauucaucgaaccacguuaucaucauuuuacagaagaguucuuuaaaaagauuaucuggguuccuaccacagucacuacaaggcaaggguagaaauuaagcagugaucugugugauuagcggaguuaaaguucaugucugagcuccauggugggaaccauguguccccauaaugauggcucauaaauggcuucuugccaagaagggaggaacacaaagaggcucuguccagggacuuuauugaaaccaucccaugacaucuuuuagugauguaguauguugcugggaaagaugauuuuuggcacuggacagacagacccagagucuggaccguaaggcugaaccacaggcugcuagauuaaaaguagucuggcagccauauagugacuugaagggaucuguucccuccucccacucuguggauccuggggcuggaauucaggucaucaggccugguagcaagcaaccuugucuuucgagccaucucaccagcccuguagcaguacuuuuuuuuuuuucuuuucaaaacuacaacacaagugaucugcaaagcauuugcuuaagaaaagaauguaaagucgugaagugaacuuuaauuuuaaugacugcugaguuaaaguuauacagcuguuauaaaaaccagagcugcguaaagagaaacucagcuugauaguagcaaaauauuaaguauagauuuaaguuaaauuuuuaccguaaauguauuggcacucacuggcuucccaauucucuuucuaaaccagcaguggagcugguuaaaacccucaaugugcuagaauaaacaucugacagacgagcaucuuucacgcaucacuuuccguuauguugggaguaccccugcugcugugugaacaucagugucccuccaaaaguuacuuaugcaaucccugcacuccaugugauaguagacaaagcuggggccuuagagaaaauuaucaaacuaugaggguucuacuguaaggugugugguuagugcccuguuaaauaagagguugaagggagcuaguggcccugccuuuuccacccuagaaggauaacaggaaagggcccuuaccaaugcagacugagagauuauauuuauuuuggacaucuggccuuuaaaaaacaugagaaaauucugugguucauaaauuacccaauauaagauauuuuguaacagcagcuggaauaaacagauaauccccaugaaagucugaagcaagucaauuguuccuauugucaaacaauugcuucuauuguucacaggcccugggggugguuuagagauccuuguaaaguuuuugcagccaucagauagcagaaauccagccugguuacuuuuaacaauauauaguaacgcucuguacucccgacacagaacguccuuaucaaagggugcuuguggcugugaagacagauuaagauuugccuggcccuaggaagggcaggggucuauuuucuauucauucacuauugcugcggcuuucaaguccauucuuaguuauagcuucuguguuaauuauucuucugcugugaaaaaaaaaacaacccugaccaaggcaauuuauagaaacuaaagguuuauuuggcuuacuccaaccaacaaagggacaagaguuugucuuuguggagacauggcaauaagcaggcaugguggcaggaguaggaggcugagagaucacacuuaaccccaaacacaaagcagaaguagcaaacucaaacugggcaagguuaugaauucucaaagccaccuauacccucuccaacaauaugcuuucuacagcaaagaccuccuaagccuccccaaacagcaccaccaacugaggagagaaaucaaauaucuaaaccuagagggccaucucucauucaaaccaccauaccucucugauauaacuaacauuauacauuuucaaugcacaacagcacaucuuucugguuuccaaugccugguaucucaugcuuacaucagcauauccauucaguuauuucacccauuuuacagaugagacaaguaggcuuauaagacuuuucagguuguugauuccaauggcaaaauguugagaacaauuuagaaacauguccuagguuuugucucuuguguccauaucauuaaggaaaaaguagugaguagaucuuuaaaacugcuaaagugcucugcuugggagccugugguuauuugauguuggguauccuggauacagaaacaucucuaugaggaucagaaaauggagguaacuaacucaguaaugaaguaauuguuuauuaauaaaacauguaugcacaagagaggccugauuuuucaguccaggcucccuagaaauuuucucagcaucaucugucucuggaguaacucuuuccuccccuccgcuucucugaagauagggagccagaggcugacggggcuuuuagcgcuagagcauuuacuguagcggaguacaggaaaugagagagaaaacacagagccuaaguuccuuccuggagacagauaagaaaccuggagaugagaacuggaguugcagcccugugcuuugccuggccugcuauucugagucuguauucaggagcgacacucauggcuuucauccaggagcgcacuguuguguguguggaggguggaguggucugaauccauucacuggguuuccauucacucucucgaauucauucaauggagcacgcagcagcuccugcauaucuuaugaaauaggcuguuacaagacagcaucaucuagacauucagucuugugauuuagggucccuauggguagaguguggugucccagggaggaggcauugccaugcagacaacuugcuucuccucuacauuugaaggagcauuugcaauagaacaauauggggucuaaaaauggucugaugccagaaacucaaaugacugcaaaccaggcagguggugugaagaaauggaagccagagcuuuuuaaaggaacccagcaucagaaauuccaguuaauugaagauauguuacaccagaugggagggaggguuggcacgucauguaugggugcuaauuuaucagugagaucaaaguugcuagguuucuacauuuuuuuagaucucuaaauacuccaggaguggaauaacauacaucuuuucucaguacuugggaggcugaagcaggauaauugcuaaguuugggaguagccuggacuucauagaguggucauacaccaaagaaaacaaaaauucaaaaucaauaagaaauauaaaucugaauauaaaauguauaaauuucaaaauacugcuaaauaacaaaaaaaugugucauuccuuuuagacaucugaugucaaucuguaguggaguugguuagauuuucuaggaagcagauucugaagaccggauucaagaagcugauuagaggucuuccuggagucacccucuguggaagggcagaggaaggaagggaagagcgacugggcagagggacaaguucagccaucaugcgucucaacugaaaacuuccucugaagagacagucacgccuuaaacuggaauaguguggaggagccauuccugcugugcuuacauuagucagucauuggaaaaggcugcccuuggugggcaauuuugaaaugacuuacacaggccacuuuacagaaaggguuguugacagcugagggggaaaagcuuccucugguaggauguuucugucugaaggaucuagaaggagcaucagugccuguuaaagauaagaggcaaggccagugcuucacuguggaagcuguucccccagccuccaguacuuacuucuuugucuaaauucugaaagaaacuacuucagguucuagaugucuccucucuggauugucucauggccuccccuccacagcuggccuuaggcuacaaugaugcccaguguugucuucuaucaaccauuccagauucuccucucucuuaguugggucaugugucuuaccugaugucaggaaccagaugcuuugagaaguuagagcccugcuuguccauagagccaucaaaguugggcaacuugacaucacccuguccccaggguauagcagaagucagaaauuuuccugaaagggucuuacuaugauguuggcuuucuuuucuuuucuuuucuuuucuuuucuuuucuuuucuuuucuuuucuuuucuuuucucuucuuuucuuuucucuucucuucuuuucuuuucucucuuuucuuucuuucucucuuuucuuucuuucuucucuuccuuccuuccuuccuuccuuccuuccuuccuuccuuucuuucuuucuuucuuucuuucuuucuuuuuuucuuucuuggcacaaaacacagguagagguuucaacuuauaguacaguaguacccuuguucuguccccugguggaaauauccuuugauuaaaaagacacuaauaaccuagaauugcaaaaguagaaaguauacaucuuccacuuggguucugggaaugaagguaaccaaagccuucuuucugcuuugguucuuaaaacuguuuuuggacauauuuauggaucuuacaucacuuaaagacauuaguaucaaaugugcauuguuucccagaaguuauugcuaugucuuuccuauacauuauuuuagaauaauguaguccugugguauaggacacaacacaugaccaugaggccuuucuuacaaguuauuggcuauuauccauaugugugguuaugaugugauauuaugugggauuucaugccaguacauaagucauuccugagauccucauguaguggcaucagugacacccuagaaacaggaaagccaaguccauacuaaaaacaauuuauuuccauagagaugaaucacucuuaucuucaguuguauucaauuugcaaccaaguaguuguuugugucuuugccagaugguagcauauuugggacccaaccaguauuguucucuguugcuggcagggugaccauugauugcaacaguagcuggguuaguauucaugagugggugcuggcuccaugcagaaucucuaggccugucacugugucuacuccacugauguuucuauucuagcacugaugugacuaaugacaguccggcuuaaugucaagugacaaucacuuugucuaccuuacuguuuagugccucuuucugaauggaucuucucuggaagauaacaacauccaacauauaauauaccuucacuucugguacccauccaaauaggcuuaaaugcuguuccuuacucuuuugaucuuucuuucuagguuccagucaacacugaucagguacacacacacacacacucacacacacacacacacacacuauauauauauauauauauauauauauauauauauauauauauauauauauguauauauauguauguauauaaauacauaaauuuucagguauauauauauauauuaauuucacucuacaugcuaagauaaagcaaacccaugugucuucuuccuccacuuucucauugugagggacacuagagccugcagacaggaaggugcuuaaguacagcaguggauggcaugagaaaggaugaccuuuuccuuuggcugacuugugccuggcagcccuccucaugaccaguggauauccuuccauugguaaugaauugcugaugcgguuaaauaguuguuugaugccucugcucuaauagaaccugguucaugaugggcuucuggcugcauggucucuugucgcugcuaaagcuucugucucuaccggugccuaauaccauccaaggaucucaguuucaauuaagguauuuuucucaugugccagagucagaagcauauaauugaucauucuccuacuagaauguauccagcuuccaagugggcaucuccuaccauccugauacuggaggagucguuaggucucauugccauaguggcaggcuguguucgcauugcagcuagaucaugcuauggagccuguucuuauucuagacacaucacucaaaggagaaauguuuuugaaugaguggguuuuaauaauuuuuagggauaaaauaaguggcuucuaaaaccuauagagguuuaccaggcuuuuaaaaaaagacaauguugcucagugcagugaaucaaccccuacucuggagauacuggguagagaagcuuuggaaacuaccucccugucucuagacugcacauaccucaccaaagccaccaaugcacuuguagacuauuacucaguuaguuagguuuguauuaugucaucaauaaauugcaccauuuagaugcucaaguuguacagcagccuggaucuuucaugcugagucagaaagaggcauaguuaauauaaucugaguacaagaguguguaaaguccuuuugauugaucuuuccaacagaaaaauccccauuugcuagagcaauggcucuacacgcaugacaaugugcuguagacaaacuccaucaggcugcacgauaacccuacccuuccucccuuaacccuuuucaacuacccucucccaugaccaccucuaguagccugucuguguggacggcagagugaguacacgcaacaagacaauuucuguaagcaaccuccucagauuuaccuaucugccugucucugugacugugcacgccagugacuguggaagagccaucugcuuccuagcuuaggacaagcuuccacaugaacaccaggugucaccugugcugucuauucaagaacuuuauggagcuauuuucuuauuucuuuauugucucuuuauugauucugacauuugaauuauaaaugcauucuucuuggcugaauuaucaucugcuugaugugcuagcugcuccuccauuuccuucccuuugcuuacuguaaguccuuugaaauacuuaagcugggcacuugggaggcagaggcaggaggauuucuuaguuugaggccauccuuaagcugggcacuugggaagcagaggcaggaggauuucuuaguucgaggccagccuggucugcagagugaguuccaggacagccaggacuauacagagaaacccugucucaaacaaacaaacaaaauaaaauauaaaaagagagaaagaaagaaagaaagaaagaaagaaagaaagaaagaaagaaaggaaggaaggaaggaaggaaggaaggaaggaaggaagaaggaaagaaagacuugucuguauuagauaucugcauauucuacuuuuauuuucuucugaaaggacucuagggagauuuuauccaaaacaacagaaauccugcugugacacauauagguauccaguaaauauugugccaauaacuuuuuaaggaaugcugggaauuagacucagagcugugcacauuuuaggcugguacuuuaccaguaaauuaaacaaaguaaucuuucaacagcuaaauaaaucauuaccuauaaaacacacacacacacacaaacacacacacacacguacaugcacacacauacugccccacauaacacuguaaggugacuaguaaaaugcucguguuggaguugcuguggucaaaguagguacucuggucaaugucaguguaaucuuagaaguuuuucucccacugagaaguucauuuucuauuucccaugacuuagcuucccucuaaaugugagcacaucuguuuuccgugccauggaaaacaccacacccugacaguggcuucacucucucacgcacacuuauugcuucaccuucucgagcacugcugcuuuaaaagacaccuaagauucuuuuuguugaagauuuacuuauuuuauguaugaguguucuaucuacauguacaccuacauaccagaagaaggcaucagaucccauuauagaugguugugagcuaccaugugguugcugggaauugaacucaggaccucuggaagaaaagacagugcucuuaaccacugagccaucucuguucacccaccuuuucagccuuuacuuacacauuuaauagcauuaauaaaugcucacagacacauuucugacuuuccucucuauucucauucuuuccaccaauuuccagugcuaauuucaucuguuugauuggacuagacaugaaggaaaguuugcuuugcuuugucuugcuuugccuacuaagguucacaggacuaaacugacaggcuaauuggaaaagagacaugcucauuuauuaugugcacggaggcaguugugaugcagcuauguaccagcucuauguaauucagaucuuguguacccugauuccacaggaaaggcagauaauagggacugcagaccauuuuuaggugacuagugaauaauuuuaggagaacuaaauggguuuggagagaacauaauggcuaaggacaaagacugcaugaugugcagacuagaagguggauguauauugggacugaaauaggcaugugugcaacaaggacauccagacaaaaugacagacuucagcgauucuuccuagcauaagaauuucaucuuugauuaauaaaauuucagucaggagaauaaggcaacuuucugucccuugauaaaacuaccuggccaggcagacagggaacuuugcagaacguuuuccaagccuugccaacagggaagaagcaagcggaggccucuguuuggagauagggccugaaauaucuugacccaucaaagcauugggaccuaguucgcugaaccccaacagcauccucaccuucauugaccugcucaaguggaaaaauauuaacuguaauccuuucucauaacguggucacaucuaccagcgaguauugaugguuuuacuuuaaaaggcguccaauaugagacuguguuucucuguuccucuguuaucuagguacaagccacagcagcaucucacagagccucuggugagcccaauauguaaauuucucuccaaacucucagugaauugaaaugacuuccucuuccacuuccuaaugucacccaucuccaauguaccggcaaccauucuaaaugcuuuauaaauguuauauucuuaacuuaccuccuuagaaugaaagaugggauuuuuaucugguuuguuuccauuuuuuguauuccucuucccuuggaaucaucacugaaauucauuaaauaguuguugaauuauacgauaagucgucauaaaaccacuucacugugagauagguuauacaaucuucaauuuaaggaaaaggaaaaugucuuaguuauggcucuauugcuaugaggaagcacaaugauuaaaggcaacucauauaaaagaaagcauuuaauugaagacuuacaguuucagaagguuagccauuaucgucaugguggggaacaugggggcauggugcuuaagaaauauauaagagcuguguaucucuuccacagucagcaggcaaagagagacacugugccuggcaugggauuuugaaaccuccgagcucacaaucagugacacaccuccuccaacauggccauaccuccuaauccuucccaaacaguuccacuaacugugcaccaagcauucaaauauaugaguugaugggaggcauuuuuauucaaaccaccauggaaaucaagguucaagaaguagacgugaacgggugaagaucauagaaacaggaaaucagcacacuguccaauggccuaaucuccuugugcuucugaguccaggucuuaagcaauacagccuucuggaccccaacccaugguuuucccuugauagaacagaugauggcuugacaaacagagaagcaucauagucuggguggauucaaaggcaaaaccugaccauauuugcuaaaagauugacaugaaggguugagacuugacugguggagaggagccaaggaugaagacaaaccuucagucugagcaaggagacuagaguaaaccauugacuaaaguuucggguguggcagguuuggaaccaaaauucaauuucuuugggacuuacacuaagucucuauuucuauguguccaagugucucugucucacaguuuccugagauacucaaaagccaaauccugcuguguauccaaggaaaagcauucugaauccuucuguggaaaacaucacacuaauuccacugcuuucuuggccagacacagaggcagccugaauugaugguugucuugcuuuucauauuccuggaauagccaaggaagccuuuuuucuucaaauucaucccgaaggcuuuauuuuaagaaggaggaagaugauugaagggguagcauagcagaagaauuguuuguugugugguucuguugagggcagcagcuugagucaauuaguuggcuauuauacauuccugggccugaacugucaaagcagucuaaucccaggaacucaccacaguuccuacugagcuuggccucguacguaucaucuugaccucaacagguuuaaucaacucuugugauuuaaaacagcacacguacauagcacaugaucaccaaguaguuaaaaaauaauaauaaauggcaggaaucuagugaagaauguucuuaaucucaauaacaacauccaaggugauaauucaaauguaaggaaggcaaagaaacccaggaagugaacaaaaaugagagaaugaaauagggaggagaauaaagaagaagaggagaaggaaaaagaggagaaggaggagggaagggaggagaaggaggaaaaggaggaggaggaggaggggcgggaggaggaggaggaggggcgggaggaggacggggaggggaauaagaauaguaguaguaguauuuaagauuguaaacauuccgaauucaccuuugauuuuccuaagcaagcuuaucaagaucucuuccaguaagaguuaaguuuggguuaguaaaauccaggagggacaaagacagaaacagagacagacacacacucgugcgcacaaggcacaaacacacaggggagggggggggcaguuuuauagcauguaguuaauucccucuuugcucuaaauauagcgcuucucauuugcaugucagucccagaaugcuuugugaucucacaacuccagucuagaaucuuuagcaucuauguaagagcaaaccacauuuuuauggguguuucuugaccuaggcuuuucuuucucuaucuuuuuaaauucuuucuugugucuugcaaaagaauucaagguggugaccuuugcuuggcacuccuccuccuggccagaaauaaacuggaaauuguugcaacuuuuccuuugaaaacugcacucaguccaauugccgugacuaaccggaagccuuuggauuaauuuacuagggagggaguguuucaggcgguuagugugcccuuugauuaugugaucaugcuacaucauuuccggguggugaaaacagagguuauggcauuuggaauccucuuucuguaggugccuuuuauagcuguccuguugcaagaaaaucuucaauuuauugacaagaugucaagaaguguaguuagagggccugccuauaguaaugucaaugucagaucccuaacagauugaaucauacuuaaugacaugcacagaauuccuguuuaguggaacauuugggcugagaauuggagagugggggugguuaaaagagacuuaagauuuucuauuuuuuuucuuuuuugcauaguaaagaaauuuuuggauauuauuuaaauuguuugggauuacguuuuuaggaaagucugccccaccccauugcuguuuagacccacccaccuacaguggccucuccaguuucucuuggccuuuucaaguagcuaaaggacauaaugugucccaauguuucaaaagccaccuuuugcccuuguaaauugucuuucaacaauaaacucaggauuucucgcugcaaaccccaguugguuucacaaagacagcaacauuggcaaaagaggucccacucacaaauccgugacuguccagcacaugugcaggguuucuaccuucccugcugcugggguuuucucugccucauaucgacagagcagcacaaugccuugacuugcaagagucagacagagaauauuuuuaaaauacagaguacgagcaagaaagccacgacccucacgcacacucauuuaaaagugaauuuacuuugcauuguuaagugcauauguucaugggcuaggagcaccagacaccgagucagacugcauacagucuguccaggucucugcucuuccaggggcugugucugcuguuuacaaauauccuaagagcagcagaggcgccgcccagucuuugguucuaacaaaggcggcggcaccacgcucgguccguuaguggcggaggacugccgagacccagaguagagucuacugccauuuccuuuuagaaagcauaguucugaagaugggagacugguguaaggauuggugggagacuuagguguucagaggggcuuggcccugaaggcuagggaaccacuaccgcggcuucaccaccggcugcagcauccuuguccggaaaagucccucgcgcccucugguggucgaggagcaggcugacuccgcggagcuggcaauagagggagggguggaguggagugagggguuaaaaaaaaagaaaagaaaaagugggugaggcagaugcaaagaagaaaaucaauagggauaagagagaagagggaggagucucagaucagccauuccugccuuacggggucccagcuggcaccacaaaagaaaaagaaaaaaaauaacaaaaaaagaaaccccaagccgggcgugaacgccaguggaggagggugcgaguggcggggggcgggucggggcgaagggggacuggggagauuuacuauugucucuggcagccgccgcgggagcccgggaggggggcggaggcgagaggaggcggcagcaccggccggcgcaccauucgcuccaccugaucuggggcgcugugcgcugagccaggcgcgcgagcagcagcaguagcagcgaggcagacauccccugcagccagaaucgccaccauguccuaccagggcaagaagaacauuccgcggaucacggugaguccgccgguggcuucuugccggccacgggccggguggcuuggaugccauuggcgugcccggucgggucccccgggaaauagggacccggcgcgguccgggugcuggagugcggcggucaguccagacggcgcagccggcgccacgcugaugcagcgauccugggguuugaagaaaucaaaacaaagaggaaaaccuuaaacacugacgcagagaacuucggguuguuuguccuuuuccaccgccgagagcgcauggcucacggggcuccgcggaaccaagccucgccgggggcggggggguuucuccugcagcuugaggugugcuuuuuguugguguaucuuuuaugucugguagggugugagagaugacaccuuucuccacugguaguuggcagccggaccgcgccccucuccuugcuccggccuuacgguuuugaucccagcgccucggagagggcgcuaugggugccuggacuacgagcccugggggauacccuucuucaccacacauagguuugggugugucacauuugagacucaauagcuaacaugcaaugaaaaacgauuaacuuuauuuccaccuuaauuguauacccuuuucuugccauuccuguuccuccucccagagaaaacugaguuugcagagaacauuuuaguuugcagaugcacacggacgcaugcaguguccaacugccauugugugcuagagugaaccgucgccagcugacuggugucaugcuccaagugugcaauuaggguggggaagugccuuuaucagcuuuggaagggaucucuucaccaggucccagcuagguauccuggacaaaacaccucucccagccucagauuccucucugaugaguugauuuaaugaccugaauaguggggacaucuggcagucuaggauagcauuaaaacaacaaaagcaaaagccaauggcauuugcuaguuuagcaggaagcaguaugguuguauuaagauguagugugugugugugugugugugugugugugugugaggaauggguggcuacuccaucuuugcaaggggaacaaaggaagugauaacuggccucugggaggcucugcagcugccccagggcugacuucuaccugccaccuacuuaacucuuaggggaucugccuagauuuugccaggagucugagucuagcacuuucccuuccuccguuuuggaaugccccgugcaacugcagugaagaaccuuuuucaugcccgaugacacugcauuguuaagugacuuauuccuguugcagcaucucaccuucagcugacaccugagcccccacuucgcuaugugacaauugcaccccaccccuaccagcuguccaccugaucccggggaagaaacacuccccagggagaagaguugagcuggcuagggauccuuucgccuaagaggcuuugggcuuaaaggauguacuccugagucacuaccugagaacacucacucuccauccuugagaaaacaaugugugugcagcuucaacggugucaguguuugccuggugccaguugucugugcaaagagauguagaagguaucaccagaaagaaucuaaucagaaucucagcuucauuuuuauauugguuucuuuaaugaagugguuaggaccacauacaucucuccugcuacugcagcuggaggucuguugcaggccacuuauuuauaccuaaugugcaaucuugccaaaucuccuuuuggggacaggcagagaaccauccccugccccucccaauuuuuuaaagacuucagucauucuucuuacagauccagucugugacauggcauugaggaccacacccauuccccccgccccccccccccagguaucauuuaagccaccuuuaaggaacgauaaagacauuuaggcagcacagccugccuuaagauacacagaaacuguggcuaugcccugcccuguucucaggacugagcuucuaagggguucccuuuugucucugcuuggaugcucucccgugggguacuugguucauuuucagugugccucccauucuuuucucugugcaugggcguggugcugcauacagcccuugcuggaagcuggaacugcagcuaucuccagcagcuggaaagggacuggacagugggugugaaugucuucaagccaggcugucuggcagucauuguuagaauagggcagaagacaaggugggccuggcagggggcagggcugggcuagggggguaaggaauccaugucuagauuuuucucaugcuuuguguuugcauuucugugaacagggguucuuucuuagaauaaaacaucucuccauauuuguauggcuauaaaagaugacugucuucauacuacaaguacuaaaauaccuuuucuagacauagguaaaaauauaaaaauuuggacagaccucuacauagauugaaaaugugauuaaagauacaaagcuaacauguguucccuacucuugauauugguucauguuuuaaaauacaagccuucuaaaauccuaauuaaaaauccaacccccuguuuuuucuucuguuaaggcagccccacccaguaccucaagugucacuauaggcuguagacugaaggaggcagucuuccccaggccugacccaguugucucucuagauacugccuuuugcaaccauuuuugguugggaauaggguuuuuguuuugcuuguuguuuauauugcuuuucuccuuccacuugcucuggcugcucuuccuaggugagaacacuuccacucgcaagugugcacuuguuuucuuggggggcaggaaggacugcuuccucugguggaucugggaaggggcucuccuugugaguuguucaggcuuggaucuuauuuugccuucucagggcagcaagugaaccaaccaucuuuuccaccugaaugccagcccuugauucucagugucagagacgagacauucuggguggcucaacagauuaggcacaaccuucuagcuccacugccucacaguguuaggcucauaguaccuaaggaauaucaguuggguauuaugucuacacagugcugggcacauaauaccuaagacauaucaauugggcauuauauaugcacaguguugagcauauaauaccuaaagcauaucacuugggcauuauauauacacaguguugggcacaaaauaccuaaaucauaucaacugggcauuauauaugcacaguguugagcuuauaauaccuaaggaguaucaguuggguauuuugucccaagauuguguacacugcaugcuuuuccaauuuaagccuugaaucaauaagucugacaguauacauauccauauuuuaaaaaaauucaaaaaucucuuucaucuauuauauucaaauaaauauguagcauuuggaaugguaucuaccauaucaauuuuggagguaccuuuuucuuuuuuuuuuaauguuaacagccaguccuuuucuuucucugauauaagcuccacuugaaacugacuacaggauugggaagacuccuaaaguguggguaccagugcauccugugcauuuucuuaucugagcauugacagaaaaaccacuucauaguuuagagccuggaauccugggcauaccaagucaguacagaguugcacagugagaguugagaggaaaagcuggaaaucaagccaauggcuuauccaacuucaaagucacuuuuaugcagcugcugccucccagaggcacauaaagagcucuagaauucauucucucuucuccuucauccccccuccuccucccuccugcucccucucccuuucccccucucucugccuccccccccccaccccugccacugacuacagagagguggcuuuucuuaaugacuaaugaacuucuguaaauagugucuuguagauaacuacaucucuguuuucuaguuguguugccugugugaucuuuggacauugcugagaucauaccuaagaauaccagcugccaguuuuaauauggagccuggagccugagcucugagcucuuguuagaaaggggacuauugucagguuguagguuccauggcaauugcuuuaugaaaagggguugggaguguacagugaacuuguggagugccuguggucuucgggcugggggacuagacuugacuucgaggaaggagccagugcacucugucccuccccaaaugcaugcaccugugugucccuggugcuucaguaggagucacugcaugggaagaaaguauuaggagguaagaauuagaguucagagaccaaacaaaggagucagccuaucaaguaaggugccauagaagggaaacuccagagggaaagacggaccaaaacucucaaacacuuaggacugggaaguauuugagcuaucugauuguggaaauggugaugcaggucauaccugggguaucuguuuuguuccuuuauauucugagcagguaugccacaauuccuagccaggcuauucuuucugaagaauaagcaaaaugccucagguguaagaaaggcuuugaguacaaaguacaauacuuuaggggaauuccagagagauuucugaacagaauuugaaacuuaucuggcuuccaccaccagcuugaaacaaacaaacaaaugcaaaaacaaaaaccaagaccuuuccuuucauuccucugagcuguuggaagguucaauaaacuuugaccccugaaaauggucugugaacacccggauguguuagauaguaaauauuuguuuauaagaucucaauuacgucucagggugagcauuaauaaaggaacauuuggcaacugugugguaaagagauuuuccugggaaacuuugaaaauacguuuucaaacagaaaaaauaugaaagugaugucauagaauguugaugauuuuucuugccauagucaugugacaacagucuauagaauugcgccugucauucauuucugacaacaggauaagaggccacuagauugccuaucgucagaccaagaaaccuccuaaauagauuugcacacuacuauuuucaguccuaaucagcuuccaucuagagcggccuaggaucaauccccuucccagcagguaguuuacaacucaacuucuaguggauuuucucuaucauuucuuccaaaguuauagaaauuaaauuaaaguugaaaaagaacaaaacccccuuuguacccuauauaacccuuuguucuuuagcuauuggcguguuuuauagaaccauuuauaucugcuuauuacaguuaaaagcugcaaaaugucaacaaaacuaggaaugugucccuaggguacaaaugugccuguuugauccagccacuacucuuaacuagaagggaacaagaagauggaaagcaucuucagccacuagaugauguggauggaugagcagaaaugaacaccccuacauccagugaagcccccauuugguccacacacacauaguuucacuuguccucaaucuucccucuggccaaugaggaacaaguguagucaaagacuggaaaacagccuuccaucaaguuccuauuugaugaaaucaaauugacacaugucuguguuaaccuaugaaguagacuugacaccaaauuaaaagcucaucggugaaguagguugagcccuuccaccuuauuuugagacacgguccuuucauggaguagauauaugacuucuuucuugaggaauguguccugugaacuagcaagaggaagcuaagcaugguggagcuguuaaaauaguucacuaagugagagacugagcacaaacuccuagauauaucacauacaccccccugaaggcugcaugaauuaguucauguaguuugcuacaacucucaugcauacaguuacagcucacuauugcuauuguugauccuagggaagggaucacaaagauuaccucauuuaacugaagucacauggguaaaaugaaagguccugggguuguuccaccaagaggcaaguuuccuaggcaagaaagcaguaccauggguacacaugacuaguccuuuucuccucaccucuaauccuauagacccagcagcucacacaucaaauauuugcugugggggugcaaggcagguuggagaugagcuggccaagugcaggaagaacauaacuucaggaagaacagcuggguguaugcucuucuaacaugguuccuucagcugucagaguuuccuucuggcuuuugcccaggagcuuguaccaguacaggaugggaaaguagaugccauuuucuucuuccugccuugcuuagaugagagucugaguccccagccccccccccuucucauucucugucccuguccuuuucccagacagaagcaaauucccauuuguccaauucccauucagccaaacagacacacccagcacucuuagccagaugaaagugccauaauagaaaggcccagaaaccuauuggagaugucuggaauucaaagacacauuccucauggcuuacuuuuuguaugccugugcauaugucauagaaauacuagauaauaagaacugaaggauaaguugucccaugaugauaauacaucuuacacauccuauaagaguacuuaacucuacacugagcuacuauagccacagcccagacuuuauuugaagagaagcaucccuuagagaaguaaagagccccaguuguggccacaguguaagaggccccuggaaggcaguacucuugggucugcccuugcuucuuauuuaucagagacuuuaggaaaccucagaaucugcacugacaaacagaucuuugcacucccugauccccaaggucccugcuaaugcaaaugacaucaggagcaagcauuuuccuguucuguuccacauucacauagaagaguuauaaaagcucuucucucccaugaagaaaguguaagcaggggguaugcaugagagauggcaucagcucagcaggaccagccaacggacucugguugcuuuuuaccuuuaagaucuuugccuuuuucuuaccuaaggaguagacuuagcuaauagccuauaggagagggcaguggaguaauaaugagggauagacccuuuucuuuaagcagagcuuuaggucauugaaaaugagcauuauuaaagugguggcaugauucauuugcugccacugcuaugucuccuucagugaaggcugccauugauaaaggcacaaaagcgacaauugccccccaaaucuagacuaggcaaacaaacaagcaaagagaaaacagcucugagacugugcucgcuagagcuuuuuuggcugcccguacugauauuuuaaauaugauggcugcuguccaauggaaauagcucucuucucaaaagcucaguaacaccauggacucugugugaggguaucagggagcauccugcaccuaaaucuuugaucagcacauauuagguccucuguuuaaggaaaagaaaacuccauaagcaaugcugaaugaauagauacauuuaacauugaccugcagcauuaacuucaauggggaagaugaccugaaagaauuugcuuuugcuccugaacacuagccucccuuucacugacaccuuuugagaauauucauuaagacuucaagauaagguccaauuguaagaaacugccaucaagucacugagccaagaaaaauggcacauauuaacagaacaaacagguuacugugggacagagccugcucugggcaaaugugccagaaaauccucucgcauuuacaccucuuucuucucuguccaugucccccccccccccccauaucuguguacccuuucugagcauguuuuaggggucaacuuggauacuucugguuguaaacagaggcaucauuucucuuacuguaaaugauuuaaggaauucauucagaucauuaacuuuucuuucaaauaaaggaaauugucaccaugaaucuuugaaccugaauacaauauaaaucugaaugaaugucucugucucccuuuguacacaaaccaugaacucguuaggguuauuagcagcaaugaagcccacuggcacaugcacagcuaauuuugucuuuuaggaauacuggcuaggaaguagcucauugcccuacccgcccccauuagaguuggacacucagauagaaaguuuuaaaguuuccucauguguuuucaaagauuuucaguuuugcccuacgacaauugucaucuuucucugagcuuauauuuggaucuauucucggaguuagauuauuuacuaaaguucauauauuuguuaacucgguucaccaccgcaacugaaugacaagaaccagcaacuuguugggaaaggaaggguuuauuuuguuucagaguuggauucguaguuuauguuuucaggggagggaugguggcagacagguccagggcaguuagagccugaagcuaggauguuacaccuccucacauccuggcaggacagaagguggagagggagaaauaccagccuggaccaggauuuuucauuuccccuguuuuauucacucuggaucccagcccucaggauggugcuggccagccacauccagcccaggccuucccaccccagguacacuucuccggaaacacaagcugagaugugccucuagaugaauuuaaacccagagaaguuagcgauucagauuaaccaucacacuuccuucuuugguuuucagaguacagucagucagagcacauuuuaaggcgcucgggucagcaugaaccaugcaguggcaauaagucuccgguuuuugcuguaacaaaauaucuuuagaaggcaacuuaaaaggggaaguguuuacuuuggcucacaguuugagaggauccagucugucaugaaggggcagcauugcagcaggugccucccuggugaugggagagauugcucaccuucucacauccuagcaaagaggaagcagaggaugggaggagacaggaccacguuuuaaucccccaaggccauccagucaccccacacaugagccuaugagggacauuucaaaacagaauauuuucgucuugauaguagucauuggaucccuuuggucaacagaagaaggaaaagcaugggaggucacuguauccguggaccuagaacauugaaaguauuuguauuaaggacuacaugcaugaugaugaugacgacucuguaauauaaccagaugcaacagaaacauuuugauauuuuucuguuguugaauuacuaguauuucuugaccacuagcuaugugaagauuuucacagaaacaucuaaugcagauaguauauauauauauauauauauauauauauauauauauauauauaaacauuaguuuuccaagauuagguauuuauugugugcucaccuugcucucuuauauuaagcuauuucauucaguaucucacuuaauccugaaaagaacuugauuagguagagucccagcagagaucuuucuauucuauuguugggagaaaacaaaaaaacaaacaaacaaacaaacaaaaaaaacaguaaagauuaacccauuagugcacaugagccucaagcgaccaauuucaaauuugaguuaucugacucagaacucacauccuuaacuauuguacaguacagcaccaccuuacuuucauaaugucuuagucaggguuugcauuccugcacaaaauacaugaccaagaagcaaguuggggaggaaaggguuuauucagcuuacacuucuacacugcucuucaucaccaaaggaagucagggcuggaacucaagcaggucaggaagcaggagcugaugcagagaccauggagggauguuacuuacuggcuugcuuccccuggcuuguucaccuugcucucuuauagaaacaagacgaucaacccagagauggcaccacccacaaugggcccucccacccucucacuaauugagaaaaugccuuacagcuggaucucaugaaggcauuuccucaagggaggcuccuuucucuuuucucugugauaacuccagcuugugucaaguugacacacaaaaccagccaguacacauacaacaguuagaaaaaaaaucucauauuucuggagacacaaaauuuugucucuuucaaguccacacuguaucuucucuuguuuuccaggaggcauaauugguauaagaaauaugcagagcagcuaauugguaacccuaccaagcaaggggguugguucaguagucacuguuuuguauucagaaguuuuccacccugcacacucagagcaccagucccaaccugucuuacaugaauaacuuggcauggagguggaccuuggucucauccccaaggcuacuuuguaaugaaauagagaaaauaccagcaagagauuuuccuugacaaugggaacuucacuuucugacugagauccuauacugcacacuauuguagccaagguucuggagguguuuggguuucugugucucugaaaauuuccuguaaucaaaauaucccuagagcuaucauugaaagcucagugauucuuuaaaggugaggaaacaacgacgcaauugaguaauguuuuuccccauugcagauuauugaguauuuaaacugaaaccuuuuuuuuccauaaaaaguaguuguagaagaauuuaugaaagguauaaauaaaauaaaggcaauaaacacgggugugaaugaaauuagcaagaacuagccauugggaaccuuauuaacaugucccauaaggauuuuuuauguagugucauuuuuuaauuaauuaauuuauuuauuuauuuauuuauuuugagacaggauuucucuauauagccccgacuguccuggaacucacucuguagaccaggcuagccucaaacucagaaauccgccugccuuugccucccaagugcugggauuaaaggcgugcaccaccacuuccuggcuuaugugucauuuauuaaaacagcaccacauguggguucauguucuuuacuguccacauugucuuucuacaauauauuauuacaauuuuaaaaauauuuuuccauaaaauuguuuuuaaccuguucaguauauuaucccauugcuuaaagaauccaguuaaauuaauccaguuguuuuuuguuuuuuaaguuugaauugucucuaagaucuuucuuaguuacaaaaacugaaauggcauucauuuuaaacucuagguuuauauuugagguuaaauggaaagcuaccagguggggagaagaauaauuugucuagucacucagcucacaggucucaggacacuagaucugaaucuuaggcuuaccuggaaucucacuauuguggucuucacaacauuuagccauuuuucuucaugaaaaaaauaaauaaaaguucuuuucucuguuuucuuccccucuccaaugagcacauuuauuuccccaucagggcccuuugccugccuuucugcuuucuuaguaucuguggaagugcgcaguguccuggaagcugagguuccacagcuggagagagaauuuggcuggcuuugccucgccccucuccucacaggcuuaaccuggaagcuuggaagcugguuuuuauuuuccauuuucucuagguuugcguuucuuuccuuuauucuuuacaggaaaucuacauuugaaaccauccccuuuuugcccccagaacugaucugugcuccagaucuuugggagaucauucuguguuagggauguugauaauucagaaauggguuucugcuuuauccaacaagacagacuuaaauuauggacugauagagaggggaaacaucaagccauuuuacggcaacuggauauaauguuuugcuucuagagacuuaguucaggguuauucccaauggagauacauuuuguguuucagucccuccuggagccuaucacagauccuuuuggcuacaagaauucauaggacagcaugcuuugcucggguaaaggcaggaagacaaauguccugugauuccagcuccuuuguuuauauacuuuaaacacuucgggucaugccuuuugccaaagguuuuacauuuuuuccuuuaaguggcauuuccccuugcucgauuuggggacuuuugccccccccuuuuuuuucgguaggggagaggagaauguuagaaacuaaacuggucccaacagagccauacacuggcuucccaagaaccaauccuucauauguauuucuacuuggagacaggaucauuaaaaugagaaucaagucaaaagaagccauuccgagccagccuccacccaaucugaauaaaauaacauaaacauacauacacaccccaccaccacaacccucacccccacauacauacacaggccagagggaggccauuuauaaacccucggaagaagagaagguggugcaggaacucagcagccacaccugcuggcccauaaccucagaccugcaggcucucacagggccacacaggaugaagguuaaagucagagaaugagaacauuugaacucuuaccuugugacaggaaucauuauuuauaagaaauuauauuaagagauggaaugauagucaaaccucauagcaugccuggauacagguauuaccagccuuacuucauagauagugacuggaggcuugugguuaugguugcugauagaagggggcccaaauuuaccuucuugucugaccuuaagccuucacuuaauauguugugcccuuuuccagugaagaugcucaccaggauguaaagaacacuuaaagaagcaaacaacuccagagccucagugaacuugaagccaauucugagauuagauaaguuuggcuuugaauuuuaguguuaaaaguaaggugggggacuaucagcagacuaucaguaguuggguuucucuagaguuuagacuuccaaaaaaugaggggauacauaucuacuuguaauaaagaauuugcauccauagugacagauccaugacccugaagacaucugacccuccaaaagagaaugaauuaccuuugcuaaagcagcaagugaaauccauacugacaaaucaugaggagaaauccuauuuuuccacaacauaguuuagaauuaucucaacuagucugaagauuuauuuuacuuguauugaaauaauaagaugaugaacaugcaauuaaugaaaaccaagaagaaaguagaaaauggacaggcauugcucccucuugucuguggcuguggugucugcaaauagagagaugcuugcugagauguguucagcuugcuuuaucugccuguuggcuugacuucugcaaacuucagcauugcaaagaucuucaaaccagacgcuggcuccagccuaguucgaggcccucaucuuacugaaagaaacccuccuuagugcuccauugugcucauuccuaaauuuauccuucauggcuaaucauggugccccuuuaacauauagaccaggccaaguaacugucuugaugaaaugucuucuuuaguaccacaaauaaagcccaggcccuggcuccagaggcuacaugugcccccugcugccacuggcuuccaguggcuuugccucguauccugcuuguccuagguuguguguuugccucuagcuuauaguguguguguuuccucuugucucaaagugagcaugggauuuuuuucuaagaacauaccauucagaucuuucuuuacugacaccuucguauauguaccuucuuggaaaauaaucaaaaguaguucuacucucucaucuccucuggcuccugucuucuaaauuuuccuggucucugcugagauucuaacaugugucuagacccuuguuuguuccuuccuguuucaaucaucauaguggaagauuguuuuuuguuugcuaucauaucacuagauauauuuggcaaacaucaaacaaaggaucagguguaagcaugaauaaaacaucacacugccccuugccuuuaaacuaaugugcucucucagguuaauugguucaggagcaucaaggaaaaaagaugauacaugaagacagucugugggaccauuuagaaaagggaaccagucagaggcagccaaggagccuggggagagcagugugugggggaaggaggaggaacaaauuaggauaaaacauacugaagcauguguauaaaaaugccauaaggaaacacauuagugauguaaaaaaaaaaguuaauuguaauaagaaaaggccacuagacuaucuuuucagugauaacagagccauaucuacuguauguuguguguugucaaagcaagggcucuuggucuacccuuaggagugagauuaggagugagacuuggaguggugaggaacagggagcacuaacagaugugugucugagaucauacuuggcuauuguuuuuagacacaauuuaauacaccucccaguguauaucugcuguguauagaacguggacaacuauaaaguuaaaucugaagcauuucuggcgagaugugcaucacaagggcuuucugaagaacaguuccaaaagguuguucucccacaggcuaggaaaagagaauguuaaguaaugaccuagaagagggagcauagcuucauggcuuuguggguaaggaugaagucaucuugucuuuaaauaugggggacauaugccuguaauguuagcauagccuuggccaauagaaaacaaucuauaaugcucugguuuuugccacuuguuccuagagucggaggaguuuguugaagaugaaggaagcuuugucacaaguucagauuauuuuuacauguggcuuccuuuguauuuauuuucagaguucauuucaguccaggccuuccuugcucucaaaguauuuauaauuuucccugucaauauaacuuggggaaguuuggggcaagugagucaggauugccguugcuuuaauaggccccuuucuggugaaagcaaggcugcggguacauagagguuuuuaagccaguuagaagacagagacuggggauuacucaaggccauaauacauuuugugugucaagaaaggaccacagaaagcauggccugauaucccacccuaaguuucuuuguaauacuugugcuaugugcucuuugauugguuguucagucucugagaacccccauagacccagguuaguugacucuguugcucuucuuaugguauucuuuuuguuuguuuguuuguuuguuuguuuuguuuuguuuuguuuuguuuuuugagacaggguuucucuguguagcccuggcaguccuggcacuaacuguagaccaggcuggccucgaauucagaaauccaucugccucugccucccaaguguugggauuaaaggcaugcaccaccacgcccggcuucuuauaguauucuugaccccuccagcucccucaauccuuccccaacucuuccacaagacucccccagcuuuuccuaauguuugucugugagucucugcaucuguuuccaucacuggcuggguggagucucucagaggagaguuacgcuagacugcugucugcaagcauagcagaguaucacuaauagugucagggcuuggcucuugcccauggaauaggucucaaguuggccauugguuggccauucccuuaaucucugcucugucuuuaucccugcacaucuuguaggcacgacaaauuuuggguuucucuuagcuuuucucuaacauaagggauuggacugucugucaagaaaaaaaaaaaaaaaaaaaaaagcaaauaccugcuuuuauacuucuuacccaguaaguuauucuaccaauaaaaguggacaauuuacaaacacacacacacacacacacacacacaccacacacacacacacgaacuguucuguggucuuuacuauaaaauaguuaaggcuacuucuucacugaacugaaccagacuuuuauuuaaaaaaaaaaaaagugaaaagucaaacuguuuuucgagaauagagaaaagagaggcaaguagacaacaaaaccaauaacuucaucccgagauguguguucucacuuuuaaaggaacugacauuuguugaauaucuucuguacccagaauuuaagaucacgguggucuuuugaggacaauaaucauuuucuugaaggccuuccuuccuuccucuguuaacccuaaacucuggcacagacccauggcuuggguucuuagacugcagagaggaugaggacguguucuuuguacuccuguucagaagagucaagucugaacguccaaguuacagcaagcuugagcccaucucuggccuuggaaacugugccuuucuccaagacccuuacauccaggcccugucccuggugggagccgggacacuacaagcugugccuucuauaaaacguuucuaccaugggacaguuuuagggaguugcauaagucagugguugcaugcuuuuagccacaauucccaggaaguccccaccaacucuuaaaguauaaucucagacuuggaaaaggaucucuguggccucuacaaauugcugggugcaaucgccugucauuugaaggugccgcucacauauucuaaggcccaagccugcauuucacuuccgggaauuacaguuuggcuggcuuucagaucuagugaaaagguuucuuguuucugagaggcagugggcugagaauuuaccaggcuucccugccacugugaagacccagccacaggcagcugucugucagaaacgauuaaagaggagaaucgccucucagcaaaggaguagggaccauucauccacacagcauccacacagcaacaaaggcaagacaucacuugccagagucccacauuucuaacaaucugucaccauuuguuguuuuucuauggacuuaggaauuuccagugugcuaguaacucaagucuauccauggauaucauuuuccuaaaucccaaggccccauuucugcuucaugucucuuugguuaaccaaugccucaaaauuauuauuccauuucguaucucacuuguauuacucucuugccccucugcauuuauugaugagaaucuuguguugaagaguggugaauuuuuuuuuuuuuuuuacaucacuuccucuccuucagcucuuuaggaaucaaacuuuccuucaugauaugcuagguauuuuuuaaaaucuauguucuucaugucacaucagcaaucaauucaaucuuuauccauuuuguaauuuuuccauauaaaauuucuucagaaaauuauaaagugccuuguauauuuugcaccuaaauagugcaaguaguuagagaguuuuggcuguucuucauauugccuucugcaucccauucuacuacaaacaggauagcaaucuguuucuccuuccagaucuuccuccugucuacacaaaagcaugauacacaaauugugaucucuaauccuggcuguuaauuugauuacaucugggacuaauuaaaucucaagaauuuggcucaccuguuagguauuuuuuuuucuugauuaaauuuuauuugaggaaggaagaccuacuauaaaucuggaucauuugagguuugaaaacccacccuaaauuugcacuaauuuacauguguagauuuaacuauucugugaauuuugacaagaauugcauucuauuuuuuggguccaacuguaguguaguguagcuuuuuuuguuuuguuuuguuuuuuuuguuuguuuguuuuuguuuucucaaaauauagauuugacuugcuuuggcacacaaaauaaauaaacauaaaaaauaauuuggggccagagaaauggcucaggggauaaaagugcuugcugauaugcaugauaacccaaguuugaucucuuggauauaugguggaaggagagaacugacucccaaaaauugcucucugaccuucacaaucaugcuguggaguguaugucacacacacaccgcaaauguaaaauagccuuguggucagucacuuagcaugcugaaggcucuugcgauguucccaguauuggaaaaauaaaacaaacaaaaucucucaaauuaauaaaaucauauuuuauuccuaguaacucaugccaugguuuuaguuacuaaguccuagcucauuguuggauguuucuuguucucuggcuucucucucugcuucuuuucugcccugcuccaagcccugggcuuuaugccccgcauuaagcaucuccguugcuuccauacucuccuucauuuaucacaugguaucaguaggagacuugagggaaagggacagagaagucaggguauuuuucccuccuuaauuccuccuggggggccugacguggcugacuguauccggggaaggaguauagcucucugccacacagcccucaacauacagcaacccuuuccaguucuaggaaccacuuccuccucugucaccuucaaggcugagugguuacaaguucugaguucacgcuguuggcaggcccuggaugugcguguccagugaacuuccuuaacccagguccauacuguaucagacaaucccaucauuaaaugcugcuuaauaacucaaggucaauguuaaccuauauuuccugcucuuuccugacugcuaaggcgaccucuagacuguccuuuucuccuccugcuggcugcuauuuuaaggguaguuucuuuaucuccaguauaaucauucugucaaccuaauucuuuuuacaauuuuuuaagucugggauuaaacuucauauaucuuucuggaaaaaaaaaagguuucuaagagcuuucuauuauucacagaauaaaucuugaacucccuaaguguuugccucccaucucuggccacuguuugaacaaucuugguuucaggcauccacagcugguccucaguuuccuacuggaaugcauuucuuacauuggaaaccaauucuccacugacuggcuaagugaggucagacugugaguucaccccaucaauugauggggaugaugaaggcacaucaguuagcauuuuauugcaguuuucuugagccaaaguauauaaacuuaugaccauuucaacaccuaacaaauuuccaguaaaaguuguaaaucacaguaaucaauacugucauaaauuaguacuuccgagucugaucaggaauuguucugaccauaccuguguguucaaaucagcaauucaggcucaugucagacaaggccugugugaguuuuuugaucacuacaaaacucucucucucucugucucccucucucuccgccucucccucucucuaccuccuucccucccucccuccaucucccucucuccccccacuaauaacauuguugauagcaguccaguuucugacuggagucucucccuuugcagaacgcaugacguuguucaucacagagucccaaccaccaugcaaagccucagugugccacuuuugcccacucaacccccugcacgcccaucugcuggcacucgcuuuuacucucucuaaucuugcccuuuuuuguuuucacucugcauuuuuauuugugcuccugaguuacuuuaauuauuguuucauuucugccuauacccgacacucuggcuaaucaucauggaagccuuuguuucaguacugaguuauuaagcuuguuuguccuuaaaaucaaggccaaggauggacuuuuguguucauuuccugaugacauaggcccaaugcugacagaucauggauucugcucaauagcauccuagucccauuuccuuagaaaacacacacacacacacacacacacacacacacacacacacacacacaggggaggggagagagacagagagagcgaguucaccuauaguacauggguggguuugaaauucucuaucuggaacagaagcaguagaaugugcguauguuauaaaaggggugguacuagaaugcuuuuacacaauaagugcuggaucgcccaauaauggcccucuguacuuggcaauggcuggaacccccauagcugcucaguucaugaagccagaucccucagcuguuuaaucucacgcagaagaccuagaagauuccaaaagagucucugcucuucagucugcuucgaaaggaugaaaaaucugggucuaacugaagcuuaggauguauucaccaucaagaaacaaaauccggcaggcaagcgagaccgauuccuuccuuagccauccuuuaucugggugguccauggaauguucuucccucucuucccuuuuccuguuaguuaaacuuucaguugaucuuuucuggucauucucaaagaugugucuuucaguugacucuggaccuuaggaaguugacacucaaaaugaaucaucacaaaauccaagagacaauacaaaauccagagcagaugguuugaagccggucgucaaagcucugaguuuucuugggucuuuccuggaugucccaguacgcucugagagcaaugugcguuagaugguuuaguguugugaaaacagcuaccuuauuguugugcuagcaucugugaguuuagcuuuucuccuaguuuaccucuauggcugugguaaauaccaugacccaaagcaucuugggguggaaaggguuaauuuggcuuaugcuccuacaucacagucuauuauugagggaagucagggcaggaacugaagcagaagccaaggagaaaagcuguuuaugacuuguucucccuugagguucaagcucagcaaucuuucucauaccucccagcaccgccagcccaggcacgguauaccauacaccaugaaguggacccuccugcauuaaucaucaaucaaucaaucaaaaaaaaauugucccacaggcuugccuacaagccaaccugaugguggcauuuucucaaccaaggucuccccuuaccagaugauagauugugucaaguggacaguaaacuaaccagcacagcuuuccucuacaucuacauuuaaaaaaaaaaugauaaaguggaagucacaggacaguaccugcggucguauuuacaaagccuccacuuacagguuaucuugugcccaacucuccauuucaccauuagucucaugccuaugacauaagcauucucaucugugcucuguagauuaugaauguguguuuaaagagacuacagaugcagcccaugcuucccagcucccugagucccgugcagcucuggaaagugcuguuagugugugugucuguccagagagcauuguuuccaguuuccaccaaucaaacacccagugaagccuauaccauguuuccccguuuuggcuugaaauaccuuauuuucugaaaaacuacacuuauucccuauuuugguccuuacccuuguccucucaagcagacugugagaugauucccccauaauuuuuuaucucaagagcugccuaauaucugagaagucucuuccguucuacuuuggguccugcucuuguuagcccauguuaacauauauucuuauugguacaucuuuguuccuguaaccuuuauuagacuugccuauguuuuagugcagcaauaguauuucaaaaaauuauauaauaauauauaguauacaauaauauaugauauaugauaugcaauauauaaacauuuaauuauauguuuauuaaauauauaaauaaauguuuacauauauauauauaauuuacugccaggcauaaacccagcauuugggaguuagagagaggcagaccuuugugaguuugagaucagacugguuuauguaguaaguucuagaacagcuaggcuauguaaagagaccauguuaacaaaaaacgaaaauuaauuaauuaauuaauuaauuaauuuaaacacauucauucuugcauuuguauguguuuauggggaggauauuugugaggaaggagcacauaccaagaugugcaagaugaaauuagaagauaauuuuagaaagccuauccucugucugcuauguggauugaaugcaggacauuaggcuugguggcagauuuuuacuaaugccaccauugugccaacuccaggcuuagaauucuuguuacaucauuucccuuuuaggucaaggggaaaguaugguacuugucucuuccuaacacucuccauacacuuagcaaccuuugaagugaaauagucaacugaggccaucuucuugaacacucuucaaggcagcugauuacagagggaauuggaguguuuuagcuacauguaucccuauguuuacuauuuggggcuuaaaggcauuauauaaggauaacauuaaguagauaaaagcagagauucaaugaggauaugccaagcaucaugaaggagggguucaaaugacuucucugaccauugcagauccagcugaccuacaagaaugggaauuuccucugcucugcccguccugggcuagcuagcaucauucccuccagguuucuuuacccugccugaccauccucuugagcuuauccaugucuagacucccauugaagauugacuguuaucaaggagcuaagauuaaagggccaucuauaguucauuccccuguccacugugaccugggacagaccccaucacucaucaagcccuuugauaacuacaucuucaaaaugguugacaugaaguucuggcaagagaagaaugcaugcggcuggcuuugauguucaagucccagagacagccaccacgaccugguucauaccccugucagcuacugccuucuucauccauuuucuucucuucccacuuuuauccauucagggccaaacccaagaugauaaaugaaagcaguguuuuccauauauuguguacuccgcauagugggcuaugucuugaaaggggucucucaaguucacuuacauccagcaagccucugagguccuuuguguguuuaaaugacaagaaaguguguuugagacauuuaucccuaccaguuuuggaguuuggaauagguuaucccgucaaacugugcucuagcucagggaagacucagagcuaagaacuuacauugcuccugauuguccaucuucauguggagcuuuuuguuucugugucucaaagucgauugucacccugggcccuggaaacagauccgcgugcugggugaagagcgugggcaugagccaguuucaaguccucaccacccacucccagucccugcugaaagggaguagauuccugucuuucaugagggcugaguugccgaggaagaaugaccuggaaggaccaugggaacuugcccuguggggguggguuuauaaggagacgccuuggcugcccuugguaagaacauagaacagcugcugagggcaggcuggggucuagagacuaugaaauccccuacaugggaaggucuguuguauuuugauuaaaaaagugcuuguucaacacuuuuuuuuuuaaugacaagagcuuuucagugugaaugauaauaugaaagauaauuacucacaugcacugggaauuuaguguucaagcagagguuagcacuucacagaguuucccuccaaacccuuaccagaauuacaagaagaugacaugauuguccuuauuuuacaggcaaagugauagaaacucagagagguaaagucacuuguccaaucccagcuaguguaagccucucgaaaggaauuguauucaaauuguauugagcaugcucaaugcuuagggccucauugguacccuuuucugaauccauucccacccaccgaccaugaauuaauagaacuaacuuagagaaccagguucucucugucugucugucugucugucugucugucugucugucugucugucugucugucucugucugucugucugucucugucugucugucucucucugugucucugucucucugucucucucucucugucucugucucugucucucucucucucucucucucucucucucucucucucucucugucuagcugcugcugcuuaggggaagaacaucaacaagauuucauccaucuacuuuacccaaccugaucuauucuuaagggugaacguguuuuuaggaagugagauuuaauugcccaaaugggaauuuauuuaaaauaaccaccugugccuucaucuacaugauaaaaagauccaugucugacaaagggacagauugacaaaggagacuugauuuugaaaaacuaauuuuucuuucuaaguuuucuuuuucucuucaaggaauguagcuuuuuauucucagcaacugggaugccagcagaguguagaacacacagaguuaaguacuguucucuggcugaccuaauaaccagaagggaguuaugagaaaggcucuggcuucaacuggacaugucuucauugcuguagacagaggcagcacaugacauucuguauacuaaagacuagaggagaaagcugucaaacaauagguccuuuaggcuugaguugcggacuuaguccuuucuuucucuacccuacuuugaauuagccaucacuccauucaucccucuccuuagcaacuuuaaaucuucuuuuauauuauucuuccuuccuugcuuucucucguucugucuucucucacuugcaauuacuuucacaaacuuagaauuuuuaguuucucuaaucauuacuaaacccuaguaaaagaaaaaaaaaaaaacuuuuaccacacuuuaaaagcccuuacuacccuggcucauaaaucaauucccugauaaacugcauuaacaccuuugggccauaaggggcaggucuaaugcacugauuuauaagcagaggcugaaaguuaauggauucccaaaguuaccuaccgcagagaucuggucagcaguuuaaacacaagacucagacucuguaucaaagaagagaguccugccacaaagagccuuugacauagaugugauuauuuuugguacaguagccuggggggaggauuggugcugugccaaacccggaccacuccauuugcuugcacuuauaagugccuuacucuauugcuuagaguaaaucaccccugagugucggucccgaucuggaaaauaggaacuugaaucugucucuaacauacgguacuuuaaaaggcucuuaguggaauuaacacagauauacuaguaaaaguauaaauaggacugauauuagauguauuaugguaauguacugagguacugagauguucucucucucucucucucucucucucucucucucucucucucucucucucucuccucucucucucugcccuguccuuuccauuucugacaccaacccuaggagguaaaauagguauuauuuauauacuaugugauaaugaaagaaaacaaacuaacaaacaacugaaaaaauaaggcucugagaggguaaauucuaacucaaggucacacaccuguggaaguguuuuuuuguuuguuuuguuuuguuuuguuuuuuuuguaguuuucauaguaguaguaggaaaacaacuagauccaaacugaccaacaggccgccuaaacuccugcugggcugcaagacacuaaaggagcuuagcucaugguggcuaagcagacucagcugcuaaugucaaacuccauuuugaguauagauacuaaaguaguuacuuuucuguugcugagauaaaacacugaggucaaaagcaacaguuuauuuugguuuacaauucuggagggggagaguccaaaauggugggggagacauggcagcagguggcagaacaagaagcggaaagaucauaucugcaaaagcagacacaaagcagagagagccaaguggaaguaguccaaggcuauaaauuauggaagcccaccccaugugacauacuuccuccaaggcuggagugaauccccaaacagcaaacagcaccaccagcagggaaacagguguucaaacuccagcaucuccaguggauaguuuucagucuacaaccaugaguacccuucaaauuagcucagaaaguucuggaaauaucccaauuauuuguuuauccuuauaugacaaagauuaggcauucugaacuagauugugguugcucagcuaacucagugccaggaauacaaaaauacaaacccacaacccauauauucuuuauuggcaauaacaaucacagaggcuggguuuguuccuacuguugggguuugauucuguguaguugugaggcuaguccgugaauucauaacaaacauuguuuugugugcaaagaugauaagucuuaccuggcuuggggguaaccaguaguuccacucuuuauaccucucugauagaguuucuuaguaucaauaucaacauuugccuuucaaauucuuagugucuaauaguuuuccuaggcuucucuucauaauggagccuuuauacaugggaucagagugagucaaguggguugcuaugagggaaauagacagcaaguugaagaauccccagggaacguauauuuuugugaccuguugguucaacguuugauguuucugcucugcauaauggacaguaagaguaucaauagcaacacuuauaauccauggaucaggggcccugcugcuucccccaccaaaaacaaaacaaaacaaaaaacuuauaucagguuuaccacuugucauuggauucuguuuagagucuuccucauuaagccaguuuaucuaauuaccauuugaagagugcccaaugaugugaucccaauuggguugauuccucuuggguccacuacugcucuccuugugcagaacaucaaggcuacccagagagcaauuaccccuuugccaguugucgaugcuuguccaggaaagugguucagaguugagaaucuguagguuauuccuguuucauaauuuagguagaauguggcucuuuuccaaaaagcggcucaccacauaggugaccauguguaguuuaccaugaugauuacuucuucaggaagcugcuacaggaaaugcuacccuccuugacauccagaacuggguuuuuuuuccucacuuaugguauugcucugugucuuggcuauaggcuacaggauauguuagagucauguguagaacucauaaaauacagcuuuguagaugagggcaggaacugggcauggauaauuugcucauuuuugcaauaguuuggaagcauagaccuagagccuucucauaauuuugcaguauuguuaaaagcugaaauuaaaaaaaauauuuaaaauugguuuauuuauuuugagacaaucuuacuauaucacuccggcuagccuggaagcugcuauguagacugggauggucuugaauucacagagaucuaccugccucuugcucccuggcaugagacuuaaaagcaccaccaccccuggcucagguuuucucuucaaagucaaacaguacagucaagucauguaauuuguaagguagaugccuuucuaccucauucuaucuacauugacgagauagaauccuugucuauaucucagcccucuuucaugcauuugaugaacauauaacagcucuggaaaaugaagucugaaagaucaaacgacacauguucccaacguggacagggcugccugccggaucaagagacaauaaaccagccucuagagaacaugagaauugugaagaauuaauugaaguagaagcugguaaaauuugcccuagagucaggcaagugcauuauuuaggcuaacggugugacaaagaagaugguuuuucgaugccagaugaacuuggaaaaaagcacugaggacauauuugcaagggccaugaaguccgauauauaacauaaucccguauuuauagaccuaacacuaagcuaaauacugggcauugcaggaucagaaugagggcagacauguugagagaucccagaacaagagagggaauagauccugugugguggggccuccuuuucuaccuccacguagccucucugcuacacauguaaaguguuucuaacuccuuaauuaaucuguguguuugacaagucugcuccccuggugauaagacaugaugaaacuucuuauucucaugcaacaccuggaagcagaaguuaagagguaauuuucuguaucccacaugggauccuagcgucaucucccauuuucuagucuugaucacagcuugcauuacugcauccggaagucauccgucaaugggacuuucuucucugaaccucucuccuauuuggaagcuguauucuccaacaggggacaggaagagacauuaaaguaaggguagcguuaaaugguucugaccuugacccuggucuauccccuaagcuccaugcaguggagaaagaguaucaucuuugaacacugagauguaaaacugcauuuuccacuuuacccguguuccuuugcuuauaaccaucccacgugucucagugcauuuucauucaaaacuuaaacacuuaacaguccaguaugaguagccgcccuuucucccuaaccuuaucuuguuccacucaccuccucaaacauaaagcuuuugcagacugacuuuccucagcuuuucaaagagacaaguacuuccucuaccuugaggccucaauauauauugucccuucugcaaaaauucuauauugccaccccauguagauuucuuuccccuuacuagaccuuucauaguuuguaucugaacuaaucacacuccccuguggccuaugacauuaaauccacauuauuuuauaucagcucuuuauuacuacaccccccccuuuaugguccaugaagacagugaccuccugagucuuuuauacaacuccauguuccccaucuauauaauaguaaucaauuauuugcugaaucaguggucagauggcuggauggacagagggauggacggacggacugauauagacggaugaaugaauggaugaagugaaggucuguaaguugaauucuucaucaaauccaaucaaaugguagucuuuauccaugccauagcucuguuuagccagucuucuggaauauuuuucuaguccaugucuccucaaaggcacagcucauaacauuaaacucaucuccauccauucagugcaaucugugaucuccaguacugacaacaauuuauauuucucugauauacagaacauauguguguuuuguaaccaacuaagagcauauuuuuauuauuucacauuggaucacuuucaaauuucaucuaaguuuuuuaaugaguuuaucuuuuuaugauucaagcaauaagaaaguauauucauucauagucaaagaauaucauauaauuguaugaacauguucuuaugaaacauuuuuaauaccauagauacuaaaaaagaaaaaaaaugcaugaagaggauugagagauacugacuauaaugaagcaaaucuaaaucauacuuucuccccccucccaaguugaauaacuacaauaauuuuugucuuuuuuccaucaaugguucucuuacucuuuacaacuucaucagcuaacaaaauugcgauguaacuagcaugaacugaguguuucauuaagaccauauagguaauauaaauauuccuaaagccccaugacgacagcuugcagacacaggaagugaaacacuggguugguuugaauuauaacuggauccccaucaaauacagcacauucaaaugugcaaugcacugagcacacagaggugguuuaccaaguguguuccugcugaugacucaaagagccaguuggaaagacccuggcaacauacccuucccugagguccugcgauagugacucaugucuuccuucuuuuccagagugaccgucuucuaaucaagggagggagaaucgucaaugaugaucaguccuuuuaugcugauauuuacauggaggauggcuuaauaaaguacguacaugaaaccuuccacuuuuccacuucuuuucucuuaaggaagaggcuucagguucauauagugaaaacucggaauuuggccaaaagaguaaauucuuaagacaucuuugugcacauuguacuaaaggggaugccauggcucauagaagauuggaugauguuaucccuguccuuaggauguugagaagugugcaugagugauagcauccugaaaauaugaaggcauaugacauagguucuaaggugauaucaggguagucacagacuuuuuuaucuguaaggcuuuacauuagagaaaauacuuaaaaguaaacuugacaaaauggcuuaaaagaaagagcaguuacaaauagggcauacauuuggggccuauuuuccaaguacauucaucgcgaaucuacaguuucucaguggaauaacuugcuacuaaagaaguggaggcagugaauguuuauguaucagguuuuuaaauagugaauuucaaaacaggauuugaucaacaccguauucagucauaaacagcaagcuacaccaucauauuaauaagaugcuguauaugucuacauucauccuguuagcaggacuccuucuaacgucaaagcauuuguguaaggggguggacacuuguaugucacauuuuacagugggcauugcaugcucaagucaacauuccucaguccuugggaccuuauagucuuuuaaaagaccagaggauccagcauuaucaggugguaucaauaccaagaaccaaauagcaggcuagaugaaauuuagagggaacaaucauuaauuacaacagcugauguuuauugaucccuaauaugcuuaauaguauuuugugggcuuggcagggauuaacuuuuaaucuacacagcucuacuagggaauuauuccuacugaggaauuauuacauuuuacaaccgaaagaauugggguuugaugaacucaaauaauaaguuggccauugcugguaacuggcagaaccaagacugugaauccugguagcuucuauacuuacauagguuagucauggcugccagcagaaaaaaaaaugaucacacaggagauagaagcugagauguuagagaucgcuguagucuuacuucguguguuggagaaacguagaugggacccaucugcuucagauaggauauuacacuaguuauaaaaaugaguagaaaaaauauaaaaauguauauaaacacacgccacauggguccaucaguucuucauccucuugguucucaauuucuccuggaggaaaaccuaagaaaaacagaaacaggacugggcaguaucuggacuaaaguagaauuacagucagaggcugcauucuuuccccucacaguguguuuugaauugugguggcccuggaauggccccauggugaugugguggagcugaacucuuagacaugucaggaacacauuagcugugaaccuacaguuugcuggucagcagugggguggacuuuuuacuaccccaagagaauuuggggggcuaucuacagaagggaaaauaguggggcacauaugugcccaagguaggagauauuuaguauuaguauaaacugugaauccuagguauacuaugagggcagaccuggccagaugucuaaaucaaagcuaaaaaauaaaauaaaauaaaaaguuaggcaauguugcaaccaguggccugcaaacagccuuguggggaauaguuaucacauucuugugagaugaaccuuugaaacucucauuuauguauucaaugaguuuauucccccacucuuuccugggauguucugaagccuucgggguuaccauaauuacuuuucuuugucuggagccucuauugaaauacugaccauacaaaagcagagggugugggagagagcugcauguuugaugcuguccuugugcaucugcaacaaggcauuauuagcugaucagggaaugguggaguaagaaaaagaaacuugagcagguggugauucaagcagacgccuuugauuagggcacagaugacuaaguccccaugccuguuguuguaccaaguuauuaucuucuguugcaccuaacagucauuuauuucucguuccuugucauuuuccccagugugaucccacaccaauagagagaaaaaacaaagugaaugaaauaauggaaauaguuauauaaaaauaugagucacgcacugacucuagacauuggcaaucuuuagauuucaguaccaaaccauaacacagugccaugcagaugaugcuggggcaguaguuuuggauacacagcuaucugucuuugcuuagacauccuacgcucgucuugaggaucgcuccauuuaauuguccguuguuccacugucucgucaggcaaauuggagacaaucugauuguccccggaggugugaagaccaucgaggccaacgggaagauggugaucccuggaggcauugacguccauacccacuuccagaugccuuacaagggaaugaccacaguggacgauuucuuccaagggacaaaggcugccuuagcgggaggcaccaccaugaucaguacguucucucguacugcccagcccuguggguuugagaaaggugucaaacacugcccucugaaaauacggaaauuauacacacuucucucaguuugguucauggaagcuaugugacccugggugugggaaaagcaggaaaacugccaacuuccuguaguuacacaaaggacguccaugaacuuaauguuacugaaaacaaccagagaaagauaugucugaaagaaugaucauugagacugacaguucuugggagauuagugggucucgguggauuuagugcuauugggucuuugcuauauucugaccaauuuguaucuuuaagauuaggaaagcugugagcgguuucuuuuauuuuucuuuucuuuugcuucugguaauuacuaauuccagagaaacuugggaaauugcauguuauuggaguacagaacugauaguauuucaggcaguccuuccuguuccaaggaaucucaaugaauuggguacuggcccagaguuagccucaaacucagacacagcacuauuuacuuaacagcuuauucuucuacccacaggcacagagcagccugagccagaauuacagucugucuugaccuuccuuuugacugaaccacuagcaggguucaacuuuagcaaggccauaaaaggugcaguccagggaggccugagccuuuccccgcaacugauaaaaggaagccagcugacuucucagcagcuuucugcccaggaaagcccugguguccuugaagacaguauugauguagcuggaugcauuaugcuuucccaucagugcacucgggcucuguugacagaggaaaugcgugguucuugcuuugguuuggcuggcugccaucugggccaggaacugggccuguucugcaugcuuguaaagucuugucuacuuggucuuucuccaugagcaaaggagcagagagcagaugggagguuuaggcgaagaauaaagcuuacaaggagccacagaugcauucuugcccuuuauugauaacuuagaaacucuagaugugugcaaggcaaaggauccacguaacccuauucacugcuggaguuucuuacuauggcaguuuccaaguucacagcaggauccuaguaucugugccauauuuaaagcugugauuuuuuuuuuuccacuaagugguggaucacgaauguugcuccaggcagucauuugcucacauucuaccucagcuuuuaaaaugggugucucucgucacucugugaaaagugucucuauguuuuaaacuaaacuucucaauuuuuuucaaccucggccacuuucgauuuuucauuuucguaaaugcaucagcguacagucuagauacuaaaugcugcugacagcuacaacuuaucuuccuaggcaugaggcuuaggcaugagaguaaauugagucuggucuggaaaauguccagaguuuugauauauauuucgaugucguccucccaaaagcugaaccaauuucacacuuuaacucagcuacccguuguggcccaggugaggguagagcuuuugcuaaaucccuacuauaacaaccacaaugauuauuuuuuuaaaauacaaauauaauuuuacuuaauaucauuucucuuaauuuaggcaugguguguuuuguuuguuuugagauauuaggaucuugcuacacaggcuaggcugguuuugagcuuuuagugagccacccagguguugggaucacuaccaugccuccauuacuguuuuaacuuuuuuucuuuuuuacuuauucacuuuacacccugcucacugccccucuuccuggucacccccucccacaguccuuccaauggagugauagagacaccaacccacucaccaaacucuaaacccaaaauuuauccugucuacaagaaaugcagggacugaggaucgagcagagacugagggaaaggccaaccaacaaucagcccaacuuaagacccaucccaugggcaagcaccaaucuccaagacuauuaaugauacugugguaugcuuaagacaggagacuaacaugacuguccucugagaggcuccacccagcagcugauucaaacagaugcagacauacccacaauuauuuuaaaaauauguaucauccaugguugcagagaaaaguggguuugaauucagagaaacuuauucuuguuagcaaguucaugggcuuugguuacucaugccugcuauacaucuagaacuucuucuucuauccagggaagagaacacaacuuuggccauuaauagugacucagagccaguagucacaacauaaaaauagcagguagucaugaggaguuaacacuuaauaugcgccagguaucagugaagcaccuuauauaugcauuuugcacuuagucauauggaaaacucagacggaaaaauacaaucauaacguguuccccaucuacucuacacccauuuuuaagaaaagaaaacugagguuucagaaagcuacuaauuuguuccaaguccccgaguuaaccaagcuggaaggagcaggaauagagacagggagaccaaacuguuuccgagucacccauuuugcccucuguccuucaguugaccacgugguaccugaaccugagucuagccugacagaggccuaugaaaaguggcgugagugggccgaugggaagagcugcugugacuaugcuuugcauguggacaucacccacuggaaugacagcgucaagcaggagguacagagccucagcaaggaaaaaggugagucaaagcacgcgcuccagccucgucucucugcugccuugucugcgucucccacaacaucccgcccgcucgugggagucacuccucgaguuccgagucucgucccuuaagcaugagggcugugugagggacuuuuacuuuguuccaggcacuuuccuuuuucucuauguaacuuuacuuuuuguaggaucuucgugggauaaauauuguucgucacuuugaagcugaaaaagcgggguaucgggauaacugcuugaggugacauuucguaggcaacagaucuacacaaggaugaggcuuuucaccuccauggauagcuuaggguuuuauugcuaggauuaaacacugugacaaaaaaagcaacuuaaggaggaaaggguuuauuucaccuuacagcugcuagcccaucacugaagggaaucaugaacucaagcagaacaggaaccuagaggucauaauugaaguacggagcuugaagaagcaccucuuacuggcuugcucaggcugccucuuauagcuccuaggacuaccaucccagggauggcuccauccacagugagcuagaucuucacacaucagccaucaaucaagaaaauguaguacagcugggcggugguggcgcacgccuuuaaucucagcgcuugggaggcagaggcagguagauuucugaguucgaggucuggucuacagagugaguuccaggacagccagggcuauacagagaaacucugucucgaaaauaccaaaaaaaaaaaaaaaaaaaaaguaguacaggcuugcccauagguagaaacauuuucucuuuugggguucccgcuuccaaaaugacucuagguuaaaucagguugacauaaaacuaaccagcacaaagcaucaauaccaguuggacaaaggaagaaauugagacaagguaacuaguccucucugaggucacaugccuaacaauuugagaacaaaguuuucuaaccucgaucaguuuuauaagaucaaaauguuaauauuauauaauaauggcacauccuuaagaaagucuaagacaugccuguagcaaggauagauugacucuacacuuaguaauaaaaaaaaugcaguguguguguauguguaucuggcagggggcccucucauugcaaugaugauuuugguuccguuaucaucuuaaauucuuguggucucuucuuaucuucugaucauuagacacuguacacccacaggaacacacauacuuaugcaaaugugugccaugugcucagcuuuguaaggugauuaaaaguccugcccaguccuugagagcacaaacaagcaauuagccccacccuccuucucuguugcccguauaacagagcaucauaacugcaguagaaaauucaguggcuuuaaggaaaacacagaacuugggucacuccaaggaugacuuggaggcuuuuguaaaugggaauauuguggaaaaacugcccugagcugacccacgcugaguagggacauucuugaacuauaauccacuguuuggcuggagagauugugggcuaagcugaccuucaugguuaaaccaaaauuauuuuccuuuccucaaaaugauuuucuguuccaccaucccaccuacuuauucauuuugguugaaaaaucaaauagaccuuuuccuauaaugcugaugacuuaugaaaacacaaggcacaaauucaaggcacaaauugugaucuguccauucugugaacucacugaagccagguuuuauaucuauauuuugugucuacauuugaaauuuagauagcacugugugaaagagugauucuucaaacugaguguauuagucaauauuccaugaccacagcaacucaugaaaaugaaacauuuccuugaggccagcuuacaguuucagaggucugcuuccuuaucagcauacugggaagcauggcaccacacagagagaccuggggcuggacagguagcugagaguuaggugauuggauccguagguaguaggaagagagaaagacacugaaccuugaauuugaaacuccaaaccucacccccauugacaaauuuccuucuaaaggccauaccuacuaaauccaacauggcuguaccuuaauccaguuaaguauugccacucccuagugacuauucaaauaauucagcccaugggaagcauuccuauccaaaccaccacacggaguauauagucuauacccuuuuauuauaaaagucaugguauuuuuagaugaaaaacuagauuuuucuuucuuuaugagagaggguuucucuggagccuugacuguccuggaucuugcucuguagaccaggcugaccuuggacucacagauuguugccugccucugccuucugaguggugggauuaaagucaugugccacuaccaccugguuuauucuuuaaacaaauuguagagaauggaggggaaauaguauacuagaaaaaaaugugcauaugugcuauguuugugugaaugcauguguacaugugcuguguauguauguacucaaaaguauagguuccaugacagaaaauaauauaucauguaagugcaugccuuguacuacuuacaaacagauuuuuagggaggauauaggacuuucagagauuuggcuuuuauuuuauucugauacaaagccuuacuggguggccagauacuuuuuauguagcccagccuacuggcaaaacucaugggguguaccaagggauaggaaggaaaauucauagcaaucugccuacccaauaauaggauuagaagcuugucccaucuccagaccuaccccagaaguaguuuuaagguuaguuuuauugucuucuugcuccucuuaggcacagcagccugcagcuuaguauauaacacucagucaccaaauagugaaauacacgcaccccaauggagaccauaugcuugccucacagggacuaaacgccuuuaaagcaugggcuccuuuaauggugaacuacuuccuuaugagguggggguuauuuucuaauuuacaagggaaggaaacagaagcccagaagguaagcgcucccgggugauugcgguguggugguacauucagguccuacgaccccuggugucuaugcgcagcugguauguuagugcaacuucuugguaucugcuuccucaaacaauaucaauuauugaucuccuaaacucugcaaugcugggaguugggguuagcaaaagaugcaaaagggagacaccauucugucaagacacuauuuacaaacuauggauuuuacagaacaagaaagggcaugauacgauaaaaagcauucuaaaugucuucacuucuuuuggacaggcacuuaagucaugugcucagggcgugugugugugugugugugugugugauaaacaugagaaggugguaguuaauaauuaauauugucuuuuuccugacauuuucuguuuucuugucuggcaggcguuaacuccuucaugguuuacauggccuacaaggauuuauaucaaguguccaacacagagguaacaacccauuuggcugugugguuuggauggucugaguggguuuccuauuguugcugaugacccuggccauugggacaugagucucugugguuacuugugggaggucacugugccagguuguauauugaagaccuuguaguaauacuucauuuuaaagaaaguuauggguugggugccuauggcaaagcagagaggugcuugaauaagggaaagcuguugucugcaaaacucuuacaaaugcagugaaaauaugggugucucugccuuauagaaucaggugggcuuccugccaguuguacccgcuuggcugucauauuugugccaguuuggcuuuuccuggaaaaucaugaauguacaugaguuuugauagaccugaaacaaucgugggaaaugcaagcaauuaguacucuugacuucuugguggagaguaaggguaauuuugucuugaaaggcucaggguaagaguuugaauaugugcauuggcuuugaccaggcucuugggagcuguuguagcacuuagugaaaagaauucugguaccaugucuaagaucaauggaaaauuacaccauuagaucuggaugccugagagaaugcuucuuagauauuggucuggacuguaugcaauuccugacaaaucuuuuauagagacaaagccuccuaaaaugucuuuuggacuacauuccucucuguuuuaagacaguuuuaguccuggcuuuagaaacuggcauuuaugucaagcugcuaaaggagccugugaugcuguucauuucuguuuuagcucuaugagaucuucaccugccugggagagcugggggccauugcucaaguucaugccgagaauggagauaucauugcccagguaacugcauagagugagcauucugggugagcaugggucugcauaccauccauuuccucucuucagcaugacuugaaugcccccaaguguucaugacucugcuaacauaaacacauugcuaaagacauaauccauacucaaaaaagcuuacaguucugggcucagaauuuacuuccaacuuuggggcugcagagacagggggaucaucaaauguucaagauaauuagaugugauagcaagcuuuuuauucuuugcucgaagcaguaggccucaguucuugaagaauugaucuucagccaggcagugguggcaaauaccuuuaaucccaaucccagcacucuggaggcagaggcagcagguucucugaguuugaggccggccuggccuaaaaauccaguuuaagaacauccaggacuacacagaaaaggacucucaaaaucacaacaaaacacaaaaacaagucuuacuuuucaaggucagguaguaguguauaccuuuaaccccagcacuaaggaggcagaagaaagguaggcacugugaguuccaagacaaccaaagcuauauaguaagaccuguuucagaaaacuaaaacccaaccaaacaaagaaaaagaaucuucagauuaaugucaccauaaauccuguuacuacauguauagcuuuuguuuauaguuuaucugauguauuuuucacuuguuuuuaauuuugaggcagcaacuucaacuuagauauuuauuuaguuaugaagugaagacaggaaugucuaaaagugaccuucuaaguaagucuucugucccuaaaagaguuuacaucuagaaauguuugacuggaguagaaagaagagagugucuguggucuugguuguccuuuuaauugcaucuggaaucaauaaaaccaaauuccugagcaaauccacgcacagccccccccucccucccuucccucuuuacgcccucccaucccuacgcccccuccuuuaccucuuacucuucuccucaccccauacccauaccccuucugagauagcaucuuacuaacuagcucuggcuggucuggaacuuucuauauacacuauacugguccccauggaacucaaaagagauccucuugcccccuaccuccggaaugcagggauuaaaggugugugcuacuuuucugcacugaccacaugacaugagacccucccuaaaugugggcggagccuuuuggcucaacccagauaaaaggaugcgcuagaagggaaauuucgcuuuucggccacuugcgcucagucuugcuggcaaguuuccuugucuugcuggucgucgcuccuucacugagcucguugcgaguucaacaaagucggaagacugcacaacauagcacaacaggauuccuuucagcauucugcgccagauugagccugugaaguccagauucgugcacugaacaacucugggauugccagccucgucggaguaagacagacacugacuguuggacuacgccgaccacguccuuauuugugagggcaaggcuacuucuacagaguucaaggcauggaacacauaagccauaacuauaagcccaauuucuacaacauggaggaccccgugauucaagugaaaauugaggaugaacaagagguaagagaugcagaagagaacagcguuuuccaugaauaugcucuagacuucguggacaaccccgaguaccagggcauccugaaccaaccgggugauaugaaccuuauggacagcuuggaggacccugugauucaaguggaaauugaggaugaacaagagggaagagaugcagaagagaacagcguuuuccaugaauaugcucuagacuucguggacaaccccgaguaccagggcauccugaaccaaccgggugauaugaaccucauggacagcuuggaggaccccgugauucaaguggaaauugagggugagcaagagggaagagaugcagaagagaacagcguuuuccaugaauaugcucuagacuucguggacaaccccgaguaccagggcauccugaaccaaccgggugauaugaaccucauggacagcuuggcggacccugugauucaaguggaaauugagggugagcaagagggaagagaugcagaagagaacagcguuuuccaugaauaugcucuagacuucguggacaaccccgaguaucagggcauccugaaccaaccgggugauaugaaccucguggucaacuugaacuucuaccuugugggugacgucgacuucucaagccaagggagccgucaaaguccgagacagcuacaguuggagggaugggagaccuuaggugccagagcuccacagccacagccacagccacagccacagccacagccacagccacagccacagccacagccacagccacagccacagccacagccacagccacagccacagccucagccucagccucagccucagccucagccacagccacagccacagccacagccucagccacagccucagccucagccucagccacagccucagccacagccucagccucagccacagccucagccacagccucagccucagccacagccucagccucagccucagccccggcgcacucgaccacggauccgcagaggucucaccaccuggcagcugagcaaacuggagagcguuuuccaagaaguucaguacccugaugugaucacgaagaagggccuugcaaggcaacuguaucugggagaaucugaagugcaccguugguuuaagacuagaagauccaaguauaggagaaaucagagacuacaaauucucaaauguacccuugagggugcccaaaacaccuuugacuaacguuuuuggggaagcccuggagugccauccuaguccaggaguaaccuaaccccuuucaacaaugaagaucugaguauuaagaaagaaaaacaaguuguuaguuugagggugcccaaaacaccuuugacuaacguuuuuggggaagcccuggagugccaucuuaguccaggaguaaccuaaccccuuucaacaaugaagaucugaguauuaagaaagaaaaaaaaguuguuaguuugagggugcccaaaacaccuuugacuaacguuuuuggggaagcccuggagugccauccuaguccaggaguaaccuaaccccuuucaacaaugaagaucugaguauuaagaaagaauccaagaacacaucaaaacaaucauccauccugaccaaguagguuucaucccagggaugcagggaugguucaauauacggaaauccaucaacguaauccaguacauaaacaaacucaaagacaaaaaccacaugaucaucucguuagaugcugagaaagcauuugacaaaauccaacacccauucaugauaaaagucuuggaaagaucaggaauucaaggcccauaccuaaacaugauaaaagcaaucuacagcaaacuaggagccaacaucaaaguaaauggugagaagcuggaagcaaucccacuaaaaucagggacuagaaaaggcugcccacuuucucccuaccuauucaacauuguacuugaaguccuagccagagcaauucgacaacaaaaggagaucaaaggggauacaaauuggaaaagaggaagucaaaauaucacuuuuugcagaugauaugauaguauauauaagugacccuaaaaauuccaccagagaacucuuaagccugauaaacagcuucaaugaaguagcuggauauaaaauuaacucaaacaagucaauggccuuucuguacacaaaggauaaacaggcugaggaagaaauuagggaaacaacacccuucucaauagucacaaauaauauaaaauaccuuggcgugacucuaacuaaggaagugaaagaucuguaugauaagaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaauucaauucuuaaacgaauuagaaagggcaaucggcaaauucaucuggaauaacaaaaaaccuaggauagcaaaaacucuucucaaggauaaaagaaccucugguggaaucaccaugccugaccuaacgcuguacuacagagcaauugugauaaaaaaaaaaaugcaugguacugguauagugacagacaaguagacuaauggaauagaauugaagacccagaaaugaacccacacaccuauggucacuugaucuuugacaagggagcaaaaaccauccaguggaaaaaagacagcaucuucaacaaauggugcuugcacaacuggcgguuaucauguagaagaaugcgaauugauccauuccuaucuccuuguaccaaggucaaaucuaaguggauuaaggaacuccacauaaaaccagagacacugaaacuuauagaggagaaaguagggaaaacccucgaagauaucgguacaggggaaaaauuccugaauagaacagcaauggcuugugcuguaagaucgagagucuacaaauggggccuaauaaaauugcaaagcuucugcaaggcaaaagacaccgucaauaagacaaaaaggccaccaacagauugggaaaggaucuuuaccuauccuaaaucagauagggaacuaauauccaauauauauaaagaacucaagaagaugaacuccagaaaaucaaauaaccccauuaaaaaauggggcucagagcuaaacaaagaauucucaccugaggaauaccgaauggcugagaagcaccugcaaaaauguucaacauccuuaaucaucagggaaaugcaaaucaaaacaacccugagauuccaccucacaccagucagaauggcuaagaugaaaacucagcaguaucuuaagaguggaggaggugagcuaaguaugcaauuuccuccgccuugugaccaagaaagcuaauuagugcagugauaugcuuucuucccgugucucccccacccccaaauuuaaugaaaucuuuucacgucgagggaaaucaccguuugccugaugaacccaugggugcuagaacuguaaacccuccccucuuuccauguguucagcccugcagccaguggccccagcucuuccucuguugccauggaauccaaccuccuccuuguauuucaggccuguagauacuauagggccuguagugucauugcuugguuggagaauuguccucucuguggcuacucagugcagaugcucccuggccuccacuucauuccaccucuuucugaccuuggaaaggucuguucuccauaaggaagaggaauuggggcauuuuuccauuuggauguguuucuagugcauauuuauuagauuaggcuugagcugaagauuauaucaugucaucuaaaugaaggcagcugcuccccucagaguuuuccugcucugcuucugcaaaaaagaaaaaugaaaucuccuuuggguacaaacaaggacaauuuccaaaucuuccaaauugccaagcuaggcugagcuuucuuaaaugacacacugaggaauguccuuaaacccacagagaaauguaucucccacuccucauuauagaagcuucccuuugcaguggacagaggcaaucacggaaaauugcacugggucaaacccagagagguucugccucaguggauacaccuacaacagagcuccucuaacccucaaggaccauuagaggaaucagaaagguuguaagaaccacaggacuaggaaaucagcugugagccugugucucccagaaacaacugggaaacuucacccacguuaacaccaccuuauagcugucaaaacagaacccaggcaagaacgcuaauagauaugauaaucuagaagaacaaaaucucauggggccucaacucuaggcaaagaauuacaggccacaaaugacuauugaaaacaaacgagaauuagccuuucccaggaugagucggugacugguuaucuaauacaaauuaguuagcccugaaauuaugugcauacaagccccuccaaaaagacuccacagguugcuuauauguuuuugcuguuacauauauguaacaauuauaauuaaaaaaaaaaacgggcuaacaggucaugcuuuugagagggagugagggauggguaaaugggagggguuggaaggaagaagggaaagggaaaaguaauguaaucauauuugaauuaaaauaaacaaaaaaaauugaaaaccuauuuacucuguauuuacuauauuccaagcaaaaacaaagcaagggucacuuccucauuggaauaggccacagcugugcugugaccagaacagugacaucauuauuguuaagauguacucaugggagcaguguguuaagagugaccuugaccuugauaaacuugacaaucuggguuaacacaugugaccagaagaugguuuauacaaggcagaagauguuuaauuauaaacuuuaaccuuuaugugccuuguaagggaggacucucacuggagccuggcagaaaauauguccagauuucaaucaaugagaauggucgauuuguuuguuugguuuguuuuucugagacaggguuucucuguguagcucuagcuguccuggaacuagaucuauauaccugaacagccuugaacucagauaucugccugccucugccucccgagugcugagcccuuggcuuucuguugauugauugauuugucuggaacaauuuggcccacccucaguuaaucccuagacacacccagaaguaugccucaaccaaucuagucuccuaggugaucacaaagucagucaauuguggguaaacuguuaggguggagguaacuguuaaccugucuagcuugccauuuugugcuaucacuaaugccauaaggaaacuuucucacauguuguuacugcuaucacuaggauguucugugcuuugcugugcuuggaagccaaucacaacagaagucaguuagaacugcuuuguauuguuagccacaauaagcuuggaccugaaccaaccacucagccacgcauccugcaccuguguaugaccuuuuauggucuuugccuuuauaagcugccccugggaugggccgcaacauaagagagacaccugaaccuauuuagaauaagacuuccauuuugaguaggggucaaauaaaguuuaaauucccaagacgucucugggaacugauaccucacuugacagaaagagacaugugugcggguaacugacauccugguuggcaaguugagacaugaacuuuagacaagguccauacuguuaugacaugaauguuagacaagucaaguccccagcuucaguuaaauaccccaaccaaugugagcaggauaaauguaaauuaaaggcuuguuccucaggaaauccccuaucucuaaauccugauugguggaauaauuugacacagaucucuguagauuucaggcuuaaaaaguccuauaggauuuugacucaaggucacaguugcccagucugaccugaggcccuuacccaucaguuuuggggcaauguucaauaaacuaacccuaucugacugagaucaguguucugugauuugugaagugauaccuggaucucaacagacugaccaucaagguuaaucaccacauauaggaacuucccuuagcaucccccugaauuugaauacuaacaacaacacaaaaaaagaggcugaagaauccuuuuaauacucucugcuuuguaguuaccaggugagacuggcuuguuucaucugucaacucucuugcauuuccaggaucucccaggccacaaggcugagauaggagcuagccuuaauaauuucaggguguaacugcagacaacagcagcccagggcuccuuccaccccuaacuguguucagcagccaucugcuucuccauaaaccuuauucauugggauaaaaauaguaggagucagccaugagaagaaacaggccuuucugucacaccuauaauguaaauaggauuuuagcaaaacaguaacucagguaauaguauccagaggcaugguuuuucuuucugcuugaauucugaauucauucaucuuauucauguauuuaaaauacacaaaccuagaggcaaagcugauauuaaaaugugaguuaucagaauuugaaacuguagcaucucauuaggccagaauagaguuggaagucugcaccuggacuaacagagcccagaugaguuugauagagaaggcaggugaccagaggcugggggaucuggcccuaaaccuuaagcuacauggccuuaauccaguuacuuaaaucagagcacagcauggagcagaugcucaacaccuuuuguugaauagaaauaaaggaaagauugaaccagccaccaagucaggcaaggagauguucccagggagugggucugaaagaggugaagaagugucauuuuacugguaauguagauaaaacauggacacucuuaucaaaugaucugccuuuuaauaauaauaguaaaaagaaaccaguuaaaaauuuaaagauucgacuguauugcuccaaauguggagaugaauauuugcccaacauauaaauuuuauucuuuucccccuugaaugcauuuuagcccagagcauacagauauuauuuucccaaauguuggcugaaagucaucuaagaacuuucuccacuuuguuucucuuauuuuaggagcaggcacggaugcuggaaauggggauaaccggcccagaaggccacguucugagcagaccggaagaggugaguuuuguuggggguuggagggaggggcaugcagcaaaaagccaagauggcagugaggguuguuuucaucaguguuuucugggagacugguugucacaguccuagcgugucacucacuuuauagcaggaauguuucuguuuggcccugccugagccauauccacacauaguuuagacacaagugaggcuggaagaaugugauagaaucuaugauucaaucuaucauuguugggagacuucucacagagaccucuucuggcuagaagguggaagagagaugcucaucucugaccuacgguugcuuuacacuccuuaggccuucaguaggagauccgugugucucagucuuugcuaaucacgccagauucuagagaaauucuaugcacuuuuuuuuuuucauauugcaaugagucuuuuaaaacacugacaaugugggaaggaggacuuuucacagucaauaugccuagugauucuugucucuuaugucagcaacugcugcuggcacagggcucagagcuuggaauuacuugcccaccuaucugaaagcaggguuguucugaacugccaccuugcaugaucucaacccccuucuccuacccccccuuugucaauuaagcuaauccucuauggcaaauuccacugaagaagcagaaccuaaacauuaaguucuucccuuaucucuucuacagcauucaagaauuuaaauguaacacagauauagggaaaguuuccuauuacaaugggguuauacauuuuuguaagccaaauaauacacuuguaucaggugcauccagauggagacguagaauguggccagcuuacucgaugcugccaguugauacuaucuguaaauuaaugaugaacauuccaguuacacacaacauuccugaaaaaaaaaagugcccuaaugauuccagggucuuuguaagaaacauuuauuccugacagugcuaacuccagguguuaucucagguauuauucaugguccugccacucaagguacuggcauuguauggauaaagaaccuaaaaguuagaggucacccaugggcugaucauguuugaaggacuggaaaaucguuuauguaguguuagcuggccacaguggucaacacuguuugugaaacuggaaaugcuggucucuggagggcuaggcuggcaaaacagauuccuuuagacacagccaggggauuucacagcaaagucuauuuuuguuccuugguuuguuuuuucaaccuugcuccacccccaccaccucaaccuuucccagucccuucuccuuuuuaguaagaaggccacuuagcuguaaaucucuccagcuccagaagcucuuuugaguaaaguugaaacgugauguaaccuucuaaagauagucacguugucgaagugcagaaaacccuucggggcugggagggagcaggaucaaaggggccagggcugaggucauggggcugcugaaguggucagcaaagguaugaagugaguauaggaaaaggcaaugauuuuucaguucaaagccccccuccccaacagauguaaucucaagugaugcuguucagaaagcagacaauaggcacugagcauauucuccagugugcaguaucugggcgccuaaagggcuuuaccuguaccccaaagccuucuggagcauaccaguuccucaagccggcugaaucacagucaccauggagugacugguuugcauuaugcagccucuagacaucuguaagccauuugaggcauauuuguuuuucaaguauuggucuaugcaagcuaacccagaaagucauauccauaugaaaaggaauggcagcugauucaaugaggaauugucacugugucucucucucucucuacuucaggcugagcuggacuggcucgggauuugggcaagagcagacuucucauugcucagaaacugugaccaauagucacaccaauggccaguguuccaggcacuaauugcucaaagggauugguccuuucauccuuacaacggcuccagaugucaggacucuuugguucccccacuuaggcaggaaagcagcagcacugagagguugugaggucuaccugagguuaagagaacaaggauucacucucagucacccaagggagccugggcucucccacaucucacuuguuuaaucaagcuaauaaguaucccucgugggucaagugcagcuggcuuagcuggcauauuugaaagcaugaacucuaaaguuggaguaggcuaaaagagaucaguaauaaaaacaguggcugugcugcugcgaagcucgggaauuaccauaauaaggaaucauacauagaacuaacccuuugcugaccccauagcugcaggaaaugucuugauauccuugccuuucugauggccuucagcugggguugauaggauugugcuuucccagagacucugcccugagguugggaaguaguggcuuuguugggggguuggccuuuaugccaacuauaggagaggagaaagguacaaugacagacagugcccuagacacaguccuaggcuauucuccuccuuuguugagggacagagacacagggaagcccaggaacagaacagggaagaugaaucccagaagcagauucaggcuguguaauuucagauccuccuggguuguuccuagccucaccaaaguaccuuaucaccaccugucguagaggcagggccuggaaagggugaggggcucugcuuuacugaucgcugggaauuguuuuuguagcuggaagcugaggcuguguuccgugccaucaccgucgccagccagaccaacugcccccucuaugucaccaaggucaugagcaagagcgcggcugaucucaucucacaagccaggaagaaaggugauuugugcucccaggauggugaaucucccacugcaccauguggguuuucccuuccucuccaggcugcccaguguaguagaaaccacaucucuucugcuccuugccaugcucucuaggaagcccugucuacaacuggaguuccaagguuucuuccaucugccaaauaaguaaagugaagcucaggaggguuaagcaauuugcccgaaauaaaaaugacagcacaaauuaauuucuccaagauuuaguauaucuucuacucacuuuccauccguucucugucaguucacauuaucugagauucauaaauagacaccccccagccaauauugugauaauuauagaagucaaagauccaggucaaaacuggcuuaaacaagccaucaacaaguaaaguauugguuguaauugggguaugguuagcuuggagaguuuccgcaaugacauuaguacucuaacauucucauccaccguuuucuuaguucguuuaucucccuggugguuccucauucaguauuaaccaugacagaaauagaugauaccagaggguaucuauuguccucaauucccagugaagggaacaaugaagaaguggcucaagcaagcguuuaagaauuugugauuaucuugccugggaacugugugcaucucugaaucaaaggcugucccagagacagcaucaucuggccaguccugagaguucaucgcagggguguggucccucuaccugaucauucaggccaggacaaguuauuuuagaaaggaguggaauggcuuuuacacuguggucuucaugacccagggcucuguccuccuugccuuucugccuucugcugugcuguccacgguuguuaauuuaaccagggcuugcagugucuugaacuccuuguucauagguuuuuauuguuauuuauuuuuuuuuauuuauuuuguuccuugucuuuagugauaggcucuugggcucaguguguuugagaaacuagagaugugggcugugcuugauugugaaagaagauuccccaggcaggcaugccucguuacuguccugugcugaugaccaucugguagcagagagaccuaagaugagugauucaucagcuaagugauccugaggaacauccaugccagagugacuauggugcugaggggcaguccaguugacuucuggccaaguauuucagcucuauggcuuucuggacucuuucccaaugggagaggaaucuuucuagguguccaaaugucuuccuaguggugagguucugaguauuucccacuuuuccauguuuauggacaaccugcucuuuuaugucucagcaguuagugauccuacuccccuggguaagaggcauuugggagaaccaggaaagcagucagguucuccuugcuagaagugaagucuggauaggaagaggggaaaggagggagaaaggaagaacaggagagaccacuacacucacccuauccaccugguaccuuaaccucacgugcccucugcugguguaucccaugugagcucugugcucagaauaaccugaugauggaguguuuucaggugagaaauacuucauauucacgauagaaacuuccgcccauuagccuucugacuugagauugucugguaaggaggacucacacagcuguucuuccagggauaaggggauguguaauucugggacaaaauaaggggcugcagauacugaagcuaugaacaucuuuugggcaacuguucucagggagaauugagaguacuaccaacagggagauggaauguggcuuccuuguggauuuguucugguucaauuuccaaaggaucucaucaucucucaccugugcugcuuaagaccucugcuucccauaauuaguauaaaaaaagcuauaacuuaaggcuggcagggauggggggggggugucccucucuauaaaagcacuugugucaaagaacaaggaacugggccagucucuucuacacacacacacacacacacacacacacacacacacacuguguaauacagugaagcacugacaugaauauuauaaauacugacuucuccaacaacucuaagacaugauaugggcauuuuuuaaaauuuuauauauuuuuauuacguauuuuccucaauuacauuuccaaugcuaucccaaaagucccccauacacucccccacacuccccuacccacccauucccaauuuuuggcccuggcauuccccuguaauggggcauauaaaguuugcguguccaaugggccucucuucccagugauggcuuacuaggccaucuuuugauacauaugcagcuagaaucaagagcuccgggguacugguuaguucauaauguuguugcaccuacaggguugcagaucucuuuagcuccuugguuacuuucucuagcuccuccauugggggcccugugauccauccaauagcugacugugagcauccacuuauguguuugcuaggcccccgccuauucucacaagagacagcuauaucaggguccuuucagcaaacgcuugcuaguguaugcaaugaugucauuguuuggaggcuaauuaugggauggauauggcagucucuagaugguccauccuuuugucucagcuccaaacuuugucucuguaacuccuuccaugggugauuguuuccaauucuaagaaggggcaaaguguccacacuuuggucuucguucuucuucaguuucauguguuuuacaaauugucucuuauaucucgggaauacuaaguuucugagcuaauauccacuuaucagugaguacauaucauuugaguucuuuugugauuguguuaccucacucagaaugaugcccucuauguccaaccauuugccuaggaauuucauaaauucauucuuuuuaauagcugaguaguacuccauuguguaaauguaccacauuuuuuguauccauuccucuguugaggggcaucuggguucuuuccagcuucuggcuauuauaaauaaggcugcuaugaacauaguggagcauguguucuucuuaccgguugggacaucuucuggauauaugcccaggagagguauugcgggauccuccaguaguacuauguccaauuuucugaggaaccaccagacugauuuccagagugguuguacaagcuugcaaucccaccaacaaugaaggaguguuucucuuccuccacauccucgccagcaucugcugucaccugaauuuuugaucuuagccauucugacuguugugagauggaaucucaggguuguuuugauuugcauuucucugaugauuaaggaugcugagcauuuuuuuucaggugcuucucagcuauucaguauucuucaggugagaauucuuuguuuagcucugagccccauuuuuaaugggguuauuugauuuucuggaguccaccuucuugaguucuuuauauauauuggauauuaguccccuaucugauuuaggauagguaaagauccuuucccaaucuguugguggccuuuuugucuuauugacggugucuuuugccuuguagaagcuuugcaauuuuauuaggccccauuuguagauucucgaucuuacagcacaagacauugcuguucuauucaggaauuuuuccccuguacccauaucuucgaggguuuucccuacuuucuccucuauaaguuucagugucucugguuuuauguggaguuccuuaauccacuuagauuugaccuugguacaaggagauaggaauggaucaauucgcauucuucuacaugauaaccgccaguugugccagcaccauuuguugaagaugcugucuuuuuuccacuggaugguuuuugcucccuugucaaagaucaagugaccauaaguguguggguucauuucugggucuucaauucuauuccauuagucuacuugucugucacuauaccaguaccaugcauuuuuuaucacaauugcucuguaguacagcauuuaggugaggaauggggauuccaccagagguucuuuuauccuugagaagaguuuuugcuauccuagguuuuuuguuauuccagaugaaauugccgauugcccuuucuaauucauuuaagaauugaauuggaauuuugauggggauugcauugaaucuguagauugcuuuuggcaagauagccauuuuuacuauauugauccugccaauccaugagcaugggagaucuuuccaucuucugagaucuucuuuaauuucuuucuucagagacuugaauuucuuaucauacagaucuuucacuuccuuaguuagagucacgccaagauauuuuauauuauuugugacuauugagaaggguguuguuucccuaauuucuuccucagccuguuuauccuuuguguacagaaaggccauugacuuguuugaguuuauuuuauauccagcuacuucaccggagcuguuuaucagguuuaggaguucucugguggaauuuuuagggucacuuauauauacuaucagaucaucugcaaaaagugauauuuugacuucaucuuuuccaauuuguauccccuugaucuccuuuuguugucgaauugcucuggcuaggacuucaaguacuauguugaagagguagagagaaagugggcagccuugucuagucccugauuuuagugggauugcuuccagcuucucaccauuuacuuugauguuggcuacugguuugcuguagauugcuuuuaucauguuuagguaugggccuugaauuccugaucuuuccaagacuuuuaucaugaauggguguuggauuuugucaaauguuuucuccgcaucuaaugagaugauuaugugguuuuugucuuugaguuuguuuauauaauggauuacguugauggauuuccguauuuuaaaccaucccugcaucccuggaauaaaaccuacuuggucaggauggaugauugcuuuaauguguucuuggauucgauuagcaagaauuuuauugaggauuuuugcaucaauauucauaagggaaauuggucugaaguucucuaucuuuguuggaucuuucugugguuuagguaucagaguaauuguggcuucauaaaaugaguuggguagaguaccuucuacuucuauuuuguggaauaguuugugcagaacuggaauuagaucuucuuugaaggucugauagaacucugcacuaaacccaucugguccugggcuuuuuuuggcugggagacuauuaaugacugcuucuauuucuuuaggggauaugggacuguuuagaucuuuaacuugauccugauuuaacuuugguaccugguaucugucuagaaauuuguccauuucguccagguuuuccaguuuuguugaguauagccuuuuuuuagaaggaucugaugguguuuuggauuucuucaggaucuguuguuaugucucucuuuucauuucugauuuuguuaauuaggaugcugucccugugcccucuagugagucuagcuaaggguuuaucuaucuuguugauuuucucaaagaaccaacuccucguuugguuaauucuuugaauaguucuucuuguuuccacuugguugauuuugccccugaguuuauuuccugcugucuacuccucuugggugaauuugcuuccuuuuuuucuagagcauuuagauguguugucaagcugcuagugugugcucucucuaguuucuuuuuggaggcacucagagcuaugaguuuccuucccucuuagaaaugcuuucauugugucccauagguuugaguauguuguggcuucauuuucauuaaacucuaaaaagucuuuaauuucuuucuuuauuccuuccuugacuaagguaucauugagaagaguguuguucaguuuccaugugaauguuggcuuucuauuauuuauguuguuauugaagaucagccuuaguccauggugaucugauaggaugcaugggacaauuucaauauuuuuguaucuguuaaggccuguuuugugaucaauuauauggucaauuuuggagaaggucccgugaggugcugagaagaagguauauucuuuuguuuuaggacaaaauguucuguagauaucuguuaaguccauuuguuucauaacuucuguuaguuucacugugucccuguuuauuuucuguuuccacgaucuguccauugaugaaagugguguguugaagucucccacuauuauugugugaggugcaaugugugcuuugagcuuuacuaaagugucuuuaaugaauguggcugccuuugcauuuggagcauagauauucagaauugagaguuccucuuggaggauuuuaccuuugaugaguaugaagugucccuccuugucuuuuuugauaacuuuggguuggaagucgauuuuauucgauauuagaauagcuacuccagcuuguuucuucauaccauuugcuuggaaaauuguuuuccagccuuucacucugagguugugucugucuuuuuuccugagauggguuuccuguaagcagcagaauguuggguccuguuuguguagccagucuguuagucuaugucuuuuuauuggggaauugaguccauugauauuaagagauauuaaggaaaaguaauuguuuccuuuuauuuuuguuguuagaguuggcauucuguucuuguggcugucuucuuuuugguuucuugagggauuacuuucuugcuuuaucuagggugugauuuccguccuuguauugguuuuuuucuguuauuauccuuugaagggcuggauucagauaugggcauuauuaucauguuguuuugaaugaagaaaugcaugcaaucagcugggcagaucaguauccaaauuccaauauaauugagaauguuacuucuccaacuucuauuccuaaugugguccuaaggaacaguugguccucucaaggaugcauuucuuauaauugucgaguguuuuccuugaaucuuacuucuucauuucucugucaaucuuuuucaacaccaccccauaagacagugauguguaugucaauuauugcuagucucauauuuuuucuguaguagauaccacuaaccagucauggauaucuucuugugaaacuagacauguuauuagaauuuccccuagcuacuauuccagugaacuguuaacaguugauugaaguugaaacaaggcaaaaccucuuuauaauacugguugcaaaaugucauagaacguggcugugcaaacucuggagacagaauguagaaaaaaaagaaagucaagggucaguuccaucuuaaugcauuuaauauuacugggucuccaguuccgagacacuguuugucacauugaaaaaugcauagucaaggaaaaccaugauuaaaauauaaaacagcagcaacaaaaccguguauccuacagaauggguuuuacccuguagggucaaaucuuguccuuggaccaggaggagcuggcaguccccagcaacgugaaacacacuugggacuuugggccucuacaguggaagaggguagacaggaaaggaauuaguauaggaaagaugacucaucaguuaagcaucugccaugcaagcaugugcaagcugggcgugguggccuacccugauagucauagcucaagggauggagacaagagaaccccuggaccuuacuagcaagcuuaccuugucuagucagugagcugccaguucagugagagacugccccaaauaguaaaauggaggacagagaaggcauccaauguuggccucuggccucuagacccaugcacacacauguauaaguacauucccaaaugauuugcacacacacacacacaaaauuaguauuuauugaguuucuaccgugggccagaccugucauguauguuaaguccuuucagaaguuugggaguguaaacaaugccaucaguucuaggucauaaugcuuugacauuuuaauguguccuguaaucacauaaucaguacauaguuuuauuuucuuccugucaaacauaaaauugccucaaagugugaggcuuacagucagagcuuauaacuagugacuuauuauugugaacauugauucauccagucauucaaaacauuguuuacauuuaauagagaaacagaccuaaaauaaaacugggaauagaaacuugaaccccuggguugccucacuccagagacacagucuugagcaaaguuauaguucugauuagauaugcuggaccagagcacuacacaucucuuacaaaccugauauccacuccuuccaggaaauguggucuuuggcgagcccaucacugccagccugggaauagauggaacucauuacuggaguaagaacugggccaaagcagcugcguuugugacauccccaccucugagcccugacccuaccacaccugacuacaucaacuccuugcuggccagguugguguuggaaugccauguauucugugggaucaucuugggaccaccugggaugggggcuguaguaguauuggucuaagugguagaugagugucugcagcaucaaauucuccagcagucgugaguacagaaaacuggcgcuucuaccucacaguucaacugaugacacaguuccagugugaaugaugguucuagcaauuaaugccuaacuuggccaagcuugggcucucccuugccccucauuuuauguccacaauuuuaugagugaggcaucauuuuauagauuaagcaacugauggucagggcauuuaaaagcucuuugucaggacucaaagcauugucacgaugacacuuagucagcaauuauagggagauuaaaaaaucaggccacuggucauuugaguccuugcauguuuaguuucuauuuguauguguguuuauauaagcgugcacacauaagaguucaugcuugccuguguaucuuuaugugcaccucgugugcaggugacaucagaggccagaagaaguuauaagauagcauggagcuggggugagagccaguugugagccaccugauaugagugcugaguaccaaaccuggauccucugcagcaagagcgagugaucauaaccacugagccagcucuccagccuucaucugagucuuuguaauuggccacagaagacaugaucugauucuaguuccucacuuuacggauggguagcagcccaaagaggacaggaaacuuagccaagaucacacagcuuagugggagauagagagauuacaaaugaagacaugauuuuugguuacucaguauuuuccagccaucucuccuaaacaugugcaacuuuaucuuuuuccagcggggaucugcagcucucuggaagugcccacuguaccuuuagcacugcccagaaagccauugggaaggacaacuucacagccaucccugaaggcaccaauggcguggaggagcguaugucugucaucugggacaaggcugugguaagggacugagggaggguggcccagguagaacuauccaugaaccaaaucaaaggcucaggcacuaaucaaacuaaaaccugucccucagggaauccuugaagaguauguucgggguauaggugaggucuacaaccucgugagauguccauggguguugcaggauguuugaccacgcuguguacaccaagauuaaguuauuuacugggaaaaccuguuuuuccuuguguggcucagcccuagcauacaacuuuaauccaagagcuuucuguuuauuguaaacaggguuaaauaaagucaaccauuggucaagaggcagaacaagcaaccagaaagggagugaacauagggaaaaaaaaacagagagugaauacagaggaugaauacagagagacacaggaaguagaaaggauggauauuugguuugaaggguuauugagaagucauggaggagagcuuaguuuuggggcgucagcuguggaugaaugucaucaaagggucaucuggauguuuuaucugccucccugagcuagcaggcucuuaccccagcauuuggcuccugccucuuuauuagcaaaaucaaauguuugaaauuucguuaaaaacaacacagagagccagguggcucauguaacuugggaauucaccuacuaggaaugacuucugccgucuagaaacucuaagauagcuuccauacacaccauucugucauccaaucucaugaucugugucuaaaggauagugaacccauucuuuguguuagaaaagcguuauaaguucuuuucaaaauguuggauaugacgcuuugaaauggcaaguaauucaucugucccuaaagccaccaagucguagcaggagcaucccacauugaaggcuugugaacaccccagccuauaaaagggauugacucucagugucccuuggccaaguagcaauuuuucccccugauuaagucauaaagauugaugaaagaaauagccauaucaauuggacauaguacuaccggaggaucccgcaauaccucuccugggcauauauccagaagaugucccaaccgguaagaagaacacaugcuccacuauguucauagcagccuuguuuauaauagccagaagcuggaaagaacccagaugccccucaacagaggaauggauacagaaaaugugguacauuuacacaauggaauacuacucagcuauuuaaaaaaaugaauuuaugaaauuccuaggcaaauggauggaccuggaggguaucauccugagugaaguaacccaaucacaaaggaacucgcacaauauguacucacugauaaguggauauuagcccagaaacuuaggauacccaagauauaagauacaacuugccaaacgcaugaaauccaagaagaacgaagaccaaaguguggacacuuuacccuuucuuagaaaugggaacaaaacacccauggaaggaguuacagagacaaaauuuggagcugugaugaaaggauggaccaccuagugauugccauaugcagggauccaucccauaaucagcuuccaaaugcugacaccauugcauacacuagcaagauuuugcugaaaggacccagauauagcucucucuugugagacuaugccagggccuagcaaacacagaaguggaugaucacagucagcuauuggaugggucacacggcccccaauggaggaguuagagaaauuacccaaggagcuaaagggaacugcaacccuauagguggaacaacaauaugaacccgagagcucuugucuuuagcugcauauguaucaaaagauggccuagucggccaucacugcaaagagaggcccauuggacuugcaaacuuuauaugccccaguacaggggaaugccagggccaaagagggggaguggguggguaggggguuggggggguggguaugggggaccuuugggauagcauugaaaauguaaacgaggaaaauaccuaauaaaagaagaaguagccauaucaauaaagacacuccugaagauuuuaguaaaaaucauauuaaauucacuguccaguucccuaccuauauacagugccaguacagugucucugaacuaacuaaugcuuccuucaucuaugugggcaauccaguaagccccuuguuuguggaaauuuaaaggcaggguuugaaaguuaauucuuuccauacucaggcuguuuguuuuaagaaaagagaaguuauaaucuuuuugucucuucucucaugugguugacuuuugucuauuuuugugagcaaucugucuuuauggauucuuuaucuuacagauacuaucucuauguauuaaaaauuaauauaaaacauacaugcugccuaugaugcuucugucaauaugaagccuguaacuaauccccuaagauuaagucacucgugauaaucauaguugacuuacuauaaagaggauucugcuauggccauagggcaaaaaaaaaacaccaccacacacuucugaaaacauauccuuaucauuuagcaauaauaccuugagucuuuuaauugauaacaugauacauucucaauaaaggaaccucagacaaauacauacauuuuuuuuaaaaaaacccucauaauucuauaauacagggauguccacuaucaccaucuaagcaagguuuuguauauguauccuuugagcauacaaauauacacauauacuugaaggaggagcucacacucacaugguuuuuacuguaagcucucuuugaucuuuuuuguaauugguagaaguaaaugcuuaaguaaacaugaagauagcuagaaaaagugcauucuuuagggaaagucuuaagccacacauuuccacauuuucccugugaaguucauacugcccagcugacccuccuggauagauggaaucuggacucacuaccuuuguauuccuuagucacuuuguucugggcucagaagccuugcauccaauagauagagcuucccuauuuccuggugacaggcccaguuaugcacucuuuguauuucaauaggccacggggaagauggaugaaaaccaguuuguggccgugacaagcaccaaugcugccaagauauucaaccuguacccucgaaaggggagaauagcugugggcucugacagcgaccuugucaucugggauccagaugccuugaagauugucucugccaagaaccaccagucggugaggcaaggguuggugggauggagaauguguuguagagcugcuuauaggguggaccaaucucagagacucagauggucugcgguaauaaucuugcccugaagagcuuuuuuauuuugucugugauucauuuuauuuugaaagcaaggucucaggcucaggcaggcuucaaauuugaauuguuaauaacccuauuuuugucucccaguuucuggugugacaguaaacacucccauguccaguuuacccuaacuuuuacuggcauaagaaaaccuuaaacuauuuauuucuuuccccuguuuuccugagugagguagucauucagggaugagggcacagaggcaacuccucucugaaggcuugaggauuacagaggcucaaacagacuuaguuuugaacgaaaagacaaaugucccucauuauccacuccgauucuccuacaagguugaaaccaaaacccaacuuuauggcccuaauuacuuggucauaaaaauaauaucugaagugguuaugugccaagcaucuugcuuccaguucacugaaucucaugaccaguggacacugucuggguggguacuauuaucuucuuuuuguaguuuugccaaacuucuagaagugcagagaaaguauaggauugaguacuggcagugcuacucaaaccuagcaccaaccaguauuccucaccgugcaguguugucuuccugcugaacaagagaggaaggaaguuagaaacccuacucuaggucggaauggccuuugcuucuaaaucaaaagguguuauggaauuguguaccagcaggggccugagggucaugugucauugaauucaccacuaagccacuaaguacaggcauacugugcaaugucccuggggguuuuguggcugaguuugugauaugaccagcaguggaaguagaauucaaauuagugaaucuuaaaaggugcaaggcauuuugcuuugcucgagccaucccucuccaggauaugucagucuccugcuuuuuuuuuuuuuuuuuuuuuuuuuaaaucaaggcaggcagguguguccugagcuuggauuggcuuuacuaugugacucuguuccugguagcaccaaaggaggaucugaaacauagacaauaaccccauucuucuuucuucucuuccuacacccauggcauggcuuuguccccauccccgaaccuagguugccgaauacaacaucuuugaagggauggagcugcguggugcaccucuggugguuaucugccagggcaagaucaugcuggaagauggcaaccugcacgugacccagggggcuggccgcuucauucccugcagcccauucucugacuaugucuauaagcgcauuaaagcaaggaggaaggugaguaccaaugagguacagggguuagaaagggagucucaugcagccccugggauucugaggaccaggcuuccucagacccucccaggcaaaaccauagcaacaguuuggcccugaagcaaugaugugcagaauucaaaggcuucaaagaggaugucuaaacaauguuuagccaaagaaaaacuucauuuccccaaauaauucuuauacauuauuauaguacuucaguuuaaacuuuauaugccccaguacaggggaaugccagggccaagaagcgggaguggguggguaggggagcagggccgggguaggguauagagaacuuucgggauagcauuugaaauguauauaaagaaaauaucuaauaaaaaaaauaaguuaaaaaagcaauuaagauggcacuucaaaaaaacuggaaauauuugauguaaugauaauauauuuucauagaaaaacuguucccaaggcuuaaaacaacaacacguugacacccagucaucucucuucuagcccacccaaaguugcuccauuggggaaaaugccaacagcuuuuaaguacauauaaaauaucucuccuuccuuccuuccuuccuuccuuccuuccuuccuuccuuccuuccuuccuuccuuccuuccuuccuuucucccucccucccucccucccucccucccucccucucucuuucucuuucuccuuccucccucccccacucucugucucucucucucucugucucucugugucugucucucucucucucucucucucacacacacacacacacacaaacacacacacacacucacacacacacucaacugaaguaguuggggugauuuaaagauggggacuggggacgagguauuucacugaguuccucuucuccccucuccagcuuccagauguucuuggaacucuucacaacuaagcuaucccagacccuuagauugggauagcgguguaagauuugagcuuccuacuucaguuuuuggcuuacuagaaaagaaaagaggaaagaaaagagaaaagaaaagaaaaggaaaggaaaggaaaggaaaggaaaggaaaggaaaggaaaggaaaggaaaggaaaggaaaggaaaggaaaggaaagaaaagaaaagaaaagaaaagaaaagaaaagaaaagaaaagaaaagaaaagccaaacuuccccaguguagacauugacuuauuaugauuuagauucuggaaccagagcaaugccauggcuauaguguugcuagaugaggaguacugauuccugucgcagcccucaucccaugaagacaagggcacugugcuugguggcugcacagaaggcagggcuagggcugcacagaggucucacccuggugcauccaucccuuucagguccauagggacgcacacccucacugccucacuuguggcccaugaugugccagggguugcaugugggacugcuacugccgggguggucacaucaugcuugucacacaggucauaagugccaugugggcacagcauauuucacaaggcuuuaaaccccagcccuuggcauaaucccagcccaaaacacaaaguugauugauauugcugacugacuacccaguccccaccuaguuaacagccaaaggucaauggcucgggccacagaaacuuaguauaaggcuuugaagcccuaacuugaaaaaagcucugaaaagccuugggugguucuucugugggaucuuacuauggcaguguugugacuucaucuuagaccccuguccuuucuacuggcuacacuccaacuguccuaauaguucuucauuccgccaugucccuacuuccagcuagcugugcuugcugaucccucugcugcuucuguugacauccacaucaaugauuagcauccccucagccauuugucucuccugaggcugacauggucauuugaugcucuagaccaguuguucucaaccugugggucucaaaugcuuuguguguguauguguguguguguguguguguguguguguguguguguguguguggagggggcuuaaauggcccuuucacaggggucaccuaagaccauugggaaacacagauauuuacauugugaucuauaacaggagcaaaauuacaguuacaagagagcaacaaaaugcuuuuauguuuggaguucaccacagcaugaggaacuguaugaaagggucacagcauuaggaagguugagaaccacuagacgguucuagacagaaucucaugucuacagaggccuuccuggauggccucuacccucaguuucuuguggcacugucgcuucugucacauccaugucuucuguuuccuccuggauuccucuccacacacacuuuucaccgacacgauuacaccucccagagcacauucuacacuguuggguccuuugaauggaagaaugaauggugaccuguuucucuggcugcagauggcagaccugcaugcagucccaagaggcauguaugauggaccaguguuugacuugaccaccacccccaaggggggcaccccagcuggcucuacucggggcucucccacucggccaaacccgccagugaggaaccuccaucagucaggauuuagccugucaggugaguggaaugagcuggggaagggagggaagagggagaguggagggagaaaccagcaucccuaggcuacaaccuaauccugcaaaaucaagguaaaugcauuucacaagccagugcuuguguccccuucaaggagaugaugagaacugaggacaaaaaguuuuccuaaucagcaaguggcccugguaagaaaguuaaacaagguaccuucaaguuagaggucagguucaaaugauagcaaauucuacuuagaggucaaaccuaacugggagcaggccaauggggcugacuucguuaugaauggauaauggucuucuacaccagcgugugagaaguacgguguguauguguucaagucucagugcacauaaagcucagacaguuuucauguucuuggagccgaguuuccccuucacaguaagaaugaugcagagccagccucugccgacuggauguuuacccuguguuugccauguuuacagaccucaccuauuuccaaaggucucuuuaauauaaugcuugcuuaauuguuccauaguugucuuaaaguggggggagauaaauacagguguacuuuccuacaguggaaaauauacacaugagggaggcaagguaacaagauaggaaagacauuuaaaggugagacuacagcauauagagaaaguagguggggugggggguaguagaaggagcagagaccauggaggaaaggcugugggagaccuagagagaaauggaggaagagaggcucaauguuuccagguaacuuugccaagcauuugagaugauucccauucccaagcaauuaggggcguguucaccuuugucuguggucuucaugcauucagagcuccuuuaucaauggaaccaaguacacguuagcucuucuaccuguguaaacaggggaccauggccccucuaaccuccuggccuugggcaggugaccucuacagaaucccucugucauggaacaaugaauuuuuuuuuucucccaaaccacaguaguuagacuguaaaacauacaacaguccguauaaacaucucuguguucucacagguaguauugaugaauuuagcaccagacugacucaagggaggaaguuggcuuuuccuaucaagaaaguauuuuuccaggacucggguggggguggggggagagucacgauuaugcaugauuugguguuaaguuucuugugcaccaggaaaguacuuacuauuguucacucuugaaaugacucauuuucucuuucccccauauaucucuuuccccuuguuucucuuugggaaauugucuucaucugcaggcacccaaguggaugaggguguccgcucagcuagcaaacgcauuguggcacccccuggaggccguucuaacaucacaucccugaguuaagcccucccaaagagggaggcagaagcaagaagaaaaaaaaaaaauugaagccaaaaugguacaccgauauuuaagaaggaacgugaauccaugcaguugagaucuaaagaaucacuaagccucaagccuuauguuucccaauguuaugcucgcuugccuagcuuuaugaauugcuuugguuucuguuuuugcauacucucaauuucuuugaaccccacccccaccccacccccacuuacaugcaugcgaucagacaggccacuaagguagauucugcauauuauaguguugagagcguauguagcacugcaucuuacaacaaggggacagacaaagcugggaugucgagaaaaaaacgaaugaaggcacgaagggccuuuggaugauuggguggugggagcccagggcaagauggagggcacaaaggggcuggggugggacguguacuagggagguggguggguggggugagcagaagggcauuguguguuguauuaugauguguguuaauuuccauggaggauggucacauauggcaguggugcuccaucacaguccccugggaucugcagagauggcaggaggucuuuggguucuggacuuugucauguccuuuccuaguagaucuuguuuccuuaccauguauugaaugacagaauccagccauuucuuccaccugugaugccaguugcuugcucaggccucuuucuccuguggcuuucuagucuucuauucccagcugugaagaccacacacagaugaacaaauggacaggucucuucuucuuuagcuucuuuggggcucuuccaaggcugccauggagaaugcagccccagcucuauuuaggggaggacagguaagcuuagacagccuuccuuucagcccuggggagguacuccccacccuccucucuagugucugcaaacugaguuaggaccauggcagagcuagagccaaaggcuuccuuugcucauggcgaauggcuaaccuccucaucccacaccugagcgcauuucccgauguuauuucuuuugggagagcugacuuucucuauuguuccuaaacuuugcucccaacaguaaucucugcuuccgagggagaguacagcagagauguagggaacccagcuuugaguagcaggagugcacuguauaaccacauuuucaaugcuaagccaaguguuuccucgucugcuagcagaucccaggggcugggauaucacuuuuuaauugguacuaaaucucuagggugauauggauaaagcgacaugaugcaguuuucuuggugugcaacacauaagggcagugggcagcagugguagccucccucuuugucugucagaguuggaagcccguguuccuaucacaccauuuccaaaaucaaccgugagccagauucugugagcaaggcaggggggcuguagaagccaagauacucuuccugcaggaaacgugguagugaccuuggcucagacuucugugcucuagggacccacucggugagaaauaucacacugcgcauuaaguacucugaagagcagagcaggccucguacaccuucgaaguacuuagagaaaacuccaucucugccugcagguguuguuugguuuugcuggguuuuguuuuuuguuuuuuguuguuguuguuguuguuuuuuuuuuuugagguggggaauuucuguuuauuucauuuuguagagcuggacaauugaguccagggccucucaaaugcuaggcaaaacucugucacggugcuucaucuuugcuccccuuacagcccuggcuguaggcugucauaaaauuuagaacuagagaaauaugaacaguuuggauacauaaggauuuggaaauugccgaggaagggauuuuccugagaaagcuauucuguucuaaucuugaaaaaaggcuuucaccucagaagaggaaucuugcuucuuuaaagcucucauggugcuuucauuuuaaaggagacuuuagaagaaaaagaauggaaugaaguuuugaguuacaauucaaauuuggggaucaauccaggaacacagaaggacuuuuauacgcaaagggaguuugccagaucugaagcuuguauacuaaauaccucaaaagcuaggcucggcagcagcauagguuguaguaccaucuguggccaccagaugggggaagagacauguaaaugaacuguaauucugcgccuccucaacugugugguuccccaugccugagcccuuccagggucucucugaucaugaaaaauaaacuccuuugggucauuugcacugcacuuggcauuuccaaaguguaccacugugccgaaaccuuauguuccacucaaguguuccuuuccugugcaaggaacagcuucuugaaguccucaaggugggcaggcgccaucucaggaugcgucucuuucuucauucacuaugaguagugcccaagccucguaaauccugagaaucccuuggcaacuccccaacuguuuucuuaacaugagaauuuuucuaagcaacauguuacuugagcuacaaaucaaaaugcaaauugcuucugcuucacaggcagacagccgcauuccagggugggagagcgugcugguaccaucuucucucaaguagcucugucaucggggcuuuccaccaaguccccucuaagaauacucugcagucuccaaacgccaaguuauugcugagcccccaauggcaaccuauugacauucuuucugaaagggccacaggcgugagugguugaaacggucuuucuggagcaauuaaaucaaccuccucaguggagaaauuuguuacuucuaaguuuuuuggguuuuguuuuguuuuuuaaucuaguaggauuauagucauccucuaaaauggccuuucucuaacuucaaaguccacugguucuaugggucauuucuuuaucaagauaugcagaggucuaucucccaaggccugaauccuaacucuggacuccauucuaaucauucugcucagucccuuccaagaggcgagugcuugccaacguugcuucuugccacaagccucccagaucuccuccccuuagaccgucccagcuugaguccugaugcagucaugcauuccucguaauuccccuuugagacaugguguguggguguucaguucugugucugguggcuauggacagacagugcgucucccugugaccugugcuagcugugaggcagcucggauauggaagagcuguuugguuugaaccgugaagaaaacuguguauugaguuagcugagauuaaagaaacaaacgaacaaacaaacaaaagcucaucacgugacuguuaauguaaaccugguuauuaaaauaauuauaaaauuaccguuacuguuc

SEQ ID NO: 8909 - RNA, 5209 nt, Mus musculus
cuuuuuuuuuuuuuuuucaagacagcuuaagauuuuauugucauuuccauucuauucauuuaccuuucauuggguauuuuaaacacuuuauaaaaccaauggacucaguugauucucuccuguggucccuggcugagaccuuagauauacccuuuuuucugggcagaccggcacccugaagacagcccuacuagacuacaucaaacguugccgcccuggagacagcgaaaagcacaauaugauugcccugugcuucaguaugugccgggagauaggagagaaucacgaggcagcggccugcauccaacugaagcugauugagucucagcccugggguaagugcagucuuaggagucuuaggagcucuggggagcaguccagguggcagaagaugacaguucacagaaacauuugaaccuuaggacugaacaugcuaaggugucauccaccaaaccuaggaguuacauucuauuagggcauauauuucucaccagccuucacccgagugaacacaccugcuugugaauauaccuaggauguuuuucccaucuagccugccaucacugaguggaucugagccacugagcuuucuaacaacuguccuuuauucuacagaggaaagccucaaggauggagcccaacuaaaacagcuccugcuuaaagcccugacucugauguuggaugcagcagagaguuacgccaagguaaccaguguuauucuagccuggccuccagccuuggcaguacuaggaauuacuuuggcuugggcucuuccagcgaagagggaguguauaaugaauuaagcaaaggucagagaacagaagggacgguaacaauaaaguucucccuuccugugucuccuccacccuugucccucaggacuccuguguucgacaggcccugcacuguaaccggcucaccaaguugauaacacuacagauucacuuucucaacaguggccagaauacaaugcuuaucaacuugggccaucagaagcuaauggacuguaucaugacccuaccucgguucuaccagguaagaauacucgggcaaguacugccagcaugccugcucauccugugguguuucacucuuggccccaggggcugagucugaccuuucagggcuaguucucccaauuuagcuauuaguaccaugcggaggcaaugugagauggaugugugugcuuuuagugauucaggccaaacugaggucuucacaaaugcacuacuuaaggcacacucccagccacuacugauugauauacaucucuaacacaugauuugggcaaaggauggagaauuuugauguuugucaguuaugggucagguauccuuugccuauccucuuaagucuuuccagauuguguucuuggaauggucuucccagagaucaguucuagccuuuaaaauaaaagggacuggccaggcauaguggccacuucuucaguucccaguacuaaggaggcagaagcagcggcagacagaacucucugaguuuaaagccagccugguccacaauguaaguuccaaagaagcaaggcucuuacacugagaaaccccaucuugaaaaacaaaaaauaaaaaguacuaauguccuagcaccagcuuuucucccugcuccucacacaguugaguuauggaaauaauucacaucucagcaguuuugcuguccauuguaaggaagacuaaaaacaaguuacugcaugaguuuuaugggagggaaaugccaaucaauaagacuuuaaacgacccaagacagagcauuuagcacuauguucaucauaacucacuguguguagaacugucucugacagucaccacagcccaggcucuaacggccccucccaccaugcccauccuuugcaggcuucuauuguagcugaggccuaugacuuuguuccugacugggcugaaguacucuaccaacaagugauucuuaaaggagacuuuaguuauuuggaagaauuuaagcagcagaaguuacuaagacccaauauauuugaagacauuuccaaaaaguaaguauuuaaacuugacggcaaucccagcaguugccucagucagugcuaguguaucccaggacagucagggugguuuaaaaaaaaaaauguugcuuaugagccaaaaacccuagcaaaagugccuuuuacaguaguacuacauuuaguauguggguacacguauuuaucuuuaaugaaauuaauucaucaagacccaauacuaguuugacaauuuccuaagcuacaaaaucccaaccucugcagauaguggugguggaguugaucccucucauugacaauacaguauuuaaccuguacuuauacaucuuuuguguagauauaaacaacaccagccuaccgacagggucacagaaaaccugaagaaguuacuuucauauugugaagauaucuaccuguauuacaaguuggcauaugaacacaaauuuuuugaaauuguaaauaugcuucugaaggacccucagacgggaugcugccuuaaagauaugcucgcagguuagaagauuggaaaggcgccugauugcuugcuuguaccuauacagcucuaagggauguucaauccuaauaaaguauuuggagaucuuuacccccauuugaguugaaaagcccagaaauauaccauacugcacuagucguuuguggcuguagggaacggaggaaaaauuaguauugagaucagaaguguuuuguuagaguggcuucuacaucagagaaacaauagugguuaaagaacgccuguaccugcagguuccaguuucaaagcaauuuaaucuuauuuacacaguuaaggaacacgugauacauuuucaugaguuagaaacugaacuuucuauaauaaaauaguuuuuauuucagugucauuauuacugcugaggaaaucuuagcccuugucuaccuucaacaguauuuacuggaguuauugcuguguagucacaccuccuacuaauucaugucauuuagaugguccuguucuccacuuaguagucuacagagcuuugagauuccuauugccuauggaagagaaaucaaaaacauuuuuuguucugauugugaaaaccuggggugagggguacacaaguuuggguaaauuauuuaagauguaauccaauuuaugcuuacagcaauaaacuuaguaacaggcuccauuacuacaaauaaauaguccuagguacuuaauugagccuuagcaucuaaacaacaaaauaauuaagaguaggaaggcucuguaacuguugaagacacaaacauucaaagcugugacuacaucaagcauugauuagcuuuagugaguagagacccccacccaugaguggcauucuguacucucaacuaucucuugggauauaacacaaaauuuaaguccucacaauagugauuuuauuaaauuaguugcuuuauaaaacacugcagaugucauaauuguuaacauaacaauuuaccaaacuguagguaacuggugcaguuugcugagcacguuuuauaaagaaaaggaaacgccaaaacccuguucaaaguuuucccacugcagccuagaacauuuguuucucagacacuugaaucaggcaaacagaaacagaguucccucccccauaugaaguccuccaucaauagaaacaggcugauaaauaacuagacaggcaaugcacuggagaguccaccacuugcacuguaauaauggagaaguuuaccuucuucagcuuccaagucggaggguuuuggucauuaaaaucuuaaguaucaaacuaguacuuuucagccacaguuaucuucacucugagauaagcagucuucuucacacguuuuuaauauccucaccucaauuuuaagacaaagcaauuuuaauacuaggugcaucccacaugcccuugcugcaaacugcuuuucucgacaaguuaugaaguaguucaaggagguacgguuaaggcuguauuacugaauggugcugguaaauacuacacuuuuuuuuuuugucauguugcaaccuuuguuuccaauuuagugacugcugcuauggaaucggauagcaacaaugacaacauuauuagguuuguuuuguuuuuaaacuaugauuuaguagcaacugagguucccaauuuuaaccccuuggcaacaagauccaaguucccucauuugcacauuagcaccugagugucaagggguuaaguaaccagcacaaagauacugcacuucugauuguagcauuuggcagaacugaaaggaaaggagguugugcuacauguugaagggauugugggcaaagaaagaagacagcagaagguaaagugucacaugaagucuucauagucuuguacauagccuccuucauauccaccauaaucugccaggucgucuuucaugguggccuuuaaucccccuccaggaaccacgccuuucuucuucuuuuuggcuuugcuuugcuuuucuugcuucuguuuuucacugcagagcacagucaaugaguugguaaucuuuuucaagucaucaauuuccaaugaaauacagacaucccgaacuaaggcuuccaaaaaacuggcauaauauagugauuuuucauauuguguaauuuuaucuuuuaguaacuuuccaaacucugugaagucaucucuugaagauggguucauagcaucuauuccauaaacgguauuauuaacaccaaaaguuucuuuugcuaauucaaggucugacucuuccuguaauuucuuuagccggaguuuaucugcuaauugcucuucagguguuaguacuuuagauucuucagguucuucuaaccucuuuuuaauuucuucuugccuuuucuucugcugccguucuuucucuuuuaucuuuucugcuauuuuuuucuucucugaaauuuuuacuucugguuugacuucugcuuccucuuuauuuucaucaucaucaucaucccaguuauccuucacguccucguccucguccucgccuucccagcgguccccgccggccgugccgccgcccgcgaccuuccgcaccggguccuccauagagaacguguccgcgucccaagagucugagucccccgccgccgcugccgccgccgccgccgccgccgccgccaucucgaaccgggggugagcgugugugaugggaagagcugcgaagaguuagcgcggcagaggugagucacugggcuggcucucguuggcccgcgcagggcaggcugggacaguc

SEQ ID NO: 8910 - RNA, 780 nt, Mus musculus
aguuacagagcggagagagugaggagucugcgucuggcuccugcuuucacagccauugcaguacauugagcuccauagagacagcgcuggagcaagcgagagccggacaggcacugggcgacucugugccucuccgaggaaaaaucaacuaaacaugggcaaaggagauccuaagaagcugagaggcaaaauguccucauaugcauucuuugugaaaacuugccgggaggagcacaagaagaagcacccggaugcuucugucaacuucucagaguucucuaagaagugcucagagaggugggagaccaugucugcuaaagaaaaggggaaauuugaagauauggcaaagggugacaaggcucguuaugaaagagaaauggaaaccuacaucccccccaaagggagaccaaauagaaguucaaggaccccaaugcacccaagaggccuccuucggccucuuucuuguucuguucugaguaccacccccaaaucaaaggcgagcauccuggcuuauccauuggugauguugcaaagaaacuaggagagauguggaacaacacugcagcggaugacaagcagcccugugagaagaaggcugucaagcugaagaaguaugagaagaauauugcggcuacagagcuaaaggaaaaccugaugcagcgaaaaaggguguggucaaggcugaaaggagcaagaaaaagaaggaagaggaagaugaggggcagaaugaagagggugaggaagaggagggagaggaagacaaagaugaugaugaauaag

SEQ ID NO: 8911 - RNA, 898 nt, Mus musculus
cauggcugacuagaaacccaaggaaggagucaagacugagaacaacgaucauauuaauuugaagguggcgggacaggauggguuuguggugccguguaagauuaagaggcauacaccacuuaguaaacuaaugaaagccuauugugaacggcaggguuugucaaugaggcagaucagauuccgguuugaugggcagccaaucaacgaaacagacacaccugcacagcuggaaauggaggaugaagauaugauugaugaguuccagcagcagaguggaggugucuacuaaaaagggagccugcuacuuuacuccagaauuuuguuauagaccaagaauacauucucaguuagaaagccacaauuuggucccgccacauccugacuacuacaguauaguuuucucucuucuuucauuucccuguccccauuccuuuauuguacauaaaguaacugguguaugugcacacgcauagugcucuuuuuuuuuucuuuuacuuuuuuaaacuaaauggccaauguucuguucugguugacaucagauagagauagucugggggaaaauacuggguuugugaaaauacccccuucuccauugguggcauguucauucagcucuuaucuuuauauuccaguaaguuauuuugcucucauuguuuuaacaaaagaacccaacaauaccaaauccuugcauaccuuguucgacuggagaauuuuaguguuuuucauuuaucauuguaaaaccaagaacaauuuuauaacuuuuuuguauguagcuguuacauguagggcaaucugucuuuaaguagggauaaauuacucuugaacaaaaugauccuagauaguuuucccuucaagucaagcaucuuguuguucaaauaaaugucuuguuuaaaaugaa

SEQ ID NO: 8912 - RNA, 1227 nt, Mus musculus
auucaaaguguaacuuuuagugguuuauuagagagcgauuagucaguauagcuaaguuuaaacacccuguccaagggcggcgauuauucagucgagucgucgccacgguauuaauuggcagucagaugacuaccaggccccucacccagccacugcagucuggucucgauaaggaugcuuggcgucugcgcauucgugacccgccuuugcuuugugucuguacugcaggucuggaggaagaggaaaaacagagaagccggcagucugcgcuggcuaagcagcccccagacccuggaacaagccucgucuacaccgcuaaaguagcccucggaccuacccacucaggcugcuggaccgccugagcgucagagccccggaccuggcggccaggggcgccagccccucauguucgggagaacgugcaaaugugagcgggcgcucccggggaaagcccuccgcccccgccagggggacccgggaagcccgagcgggcuccuccccggacgccggggauccccuccuccggccccgcccccuccuccccccugccccggcgucgcgagguuaacccugucugcgccguagcgcucucccguaguagcgacagcgccgccaaucccaauucuggaacucggggagcuaggcgacagggacagaucccugcccugggucggaugugaucucucggaggccaagcugggcauccggcucuggcuuucucccaacgcuuauacauucgcauaggcagucgccaaacuuuuuuuuuccucccuucuccccaaagccggugcccccgcaguuacuuggcuagcagccugcagcccacucucggcaggacgaugcgggagagagaguggggcgagcaggugcugccuugcagcccuacaaggcuagagggcgggagaguagcucggguuucucccugccuuggcgccugccccaugaccaggguggccagacaugcugcagugucccaggcaggucauucgggccagcauguuccgcaccagucagggggccgcggcaguagagcaagagcaaucgcucucucucccaccucugcagcccgccgcugugcauggggugggguggggggcucagucuucccaaccgugguaccagaugcacgcgauccgcagauggaauuccugccuuggagugcccugaccccggccggagccggccuaagcccccagggguuuucauucugcagguuccccucccaac

SEQ ID NO: 8913 - RNA, 2731 nt, Mus musculus
ugguuuuuugguuuuuuacacauuuaguuaauucauaggcaacauggaacugcuaaccuucugggaggaguacauagacuuuuaucuucuaaccuuucagugguccagccucugcccugauuaauuaggauauuaagguacccugguauguuuauagugugccuacagugguguucauaugcauacuucugugggaauccaaacccccguuagucaaaauaaaacccaaggaaucccggaauuaaaauagaggaggccuugcacagaugguagaauaacuuaucaucacugcucgcagccacucacuugugcuuuccuauugccaccaaugcauucugcuaagaagggaaugguaugucucuaacucugugacaucauuaggcacauaacuguuuuucuccccgcuuuguaaggaaaggacaagacuagaauuuuaaaauuauucuuuguaaagucaauggaaaauacagagaggggaauuauauuagagcuggcucacaaagcaggaacuugcuccuuggagcucaguugcuuccuugacccagggccaacgcaggagcuccagccaggcgguuguacuuucuuucauucccuguacaagagaggccccaagagagacucauauucuuccucuguguuuccaaggcccagcuagauagccacuuucccaaaggacucaauuggauagaaagugugcucuccaaagcccuucaacacacuaagccaauauuacuaaagcaggcgcagcaaaucaugcuagucuauguugcuugaguaugauagacaacuuuccuuucuggguaugagaagauacaugcauccaaagauaaagggcugaagauggaggaagaguaaguauguccauguguccuaaccaugcuccuucuuugcuccaggauuuugugugccugucggugaaaauaccuaaaguacagcuacauuugauuugccuuuuugauuaauuuuccaaugaaaaacuccaaagcaugugccaacgaaguuaguaauacagucccagaaccauguggaugugguggcuauuuaauuuauuuggucaugugcuucaaguuauauaaguacauccacacuaguaugggauaccauguggguauuuauucacugcaaaaucuuuuaacuuugcaauagguuucuuuuuuuucaacaaaauaguaugaaaacaaucuuucuagaagcaagaugcuuucaugaaaugucccaaaacaaguggcaaaucugccugaugggacauguuagccugaugaguggggcacgugggaggugcuuauaugaguucuucagcuggcugcucuggacagugugacagagccaccccuuguuacucuucugcuuccaucagacauuuccuauucucauccuuuucuuaccuuuuaaaaauaugcaauguggacauccaaagcagaugaauuugaugugauccaauuacauucagaaauguaugacuuuagcauugcuggguuuccuuugcuguggggggggggggauacuugaggcuuaugaacaauuacagcaggguaaguucauuuaggagggcuggguugggcuacaugauucuaaugguacgcaaucacuugucauguuaacuccauuuuggaagauguagaguaacauuuugaaagacagcacacagggcucgauuccucagggccaggccuucccugcccacuguuuagacucagggguaucucagcaucaucugccaagcacugccugaagcagaacuuccuagcuggacaaaaacucgcaagucauuugcuagagcuugucuggcuuuuguuccucuccgcuucucccugggagcaauuuucacugcucucuccucuucagccagccaucucuagcucaacucuuucucuuuuccauauuuuauggccacuuucccagcaagugaccucucuagccucugaugaugcuaaacucucuaggccagugcccucuuuuagguaauguguuugucuuuuugaaucgucacucgaugccaugaaauguucucucucuaauucucaacccuuuuucugauagcagcuuuaacucuuucauucuucugucucaaccauggauccaucaaucaacaugaauuugucuagagccaaaaagcuaaugugcauaauuuauauuagaggggauucugaauagcccccgauauagaaaagacuugcucccccuuccaaggaaucauugucccuaucacucuaagccuuuauuuccuauuauucccuugaacaccaagugugaagaggccaacaugacuuuaugcacguucuuccuucugaacucugguuuaagaggaagccaagugcuuucagguaggcagaguguaguagcaacaaaagauggugacgaauugucuagugccaaucaaugucaagaucccgcagggucuuccagcugacgaaucgagcccccagugcacaacugaacaccgccuuauguuaucuuguguuccggaauacuucacaguuucuuuucuuuuguuuugucuuuuuauuucaacaaaaugaaaauagagcucggaaguaaguugugugagcuguuccuuucaacauuugcagaauucucuacuggcugcaugcacccagcagauuccuuuauuugugaauuuugguagucugauugcugcuauggaaaugugauccaaaaucaugaucuuuuccugugauaagugaaguucacaaggaagaaaucaacaucuguuucuuaaucuuuuugugga

SEQ ID NO: 8914 - RNA, 713 nt, Mus musculus
ggagucuaaaccccgcaggucagggugacggccccggggucguaaggagugcguucuggcucugcggcgcccugguccauuucacuuuuucugagggcguucccaaagugcgcgcgaaagcacggagaccagugacgcucccagggaacugaaguggggaucaggagcaagugcgccgcagggagcacccggagcgguacuucagggccagcgcgagaucacucccacuccuaccgccaccccuaaccaggcugggccuaggggaaguucuuggguggauccccccagucuucucccuugggcucuucaaccuacucuuccugcuugguuuucccuggucacugagcacuuaaaguauguuccgguuuuuacucaacccgggcuuggcgccucacgccacgcaggagcccggugucacugggacagccggggggagcagggauugcaucccugggugcuggccaaggauuggaaucaagauacugcggcaaagcccccgcccuagcccagcucacagccaccuugugguuccgcaucugaagagcguggacagggguucagaaaugccccggcagccacaccaagcuugcacuggccaagggucuagaugggcgcauuucgccugcuuccugcgcaccggcagaacagaacaaggcagccugcuacugucgggggcaaauauuacuagguaauuaaagccacugcuuucuuga

SEQ ID NO: 8915 - RNA, 25481 nt, Mus musculus
uaggcgguugcuggcggcggccgccgcccucccucgacccaauggcgcggcugcggcgucaguaaugugaaggagcgaacuggcucguccggcccccgggccugcagcccauuacaccauccgccacggcagcugcugcaacgcgaacggcccgggagggagggugcagacagcuccgcggggcggggcggagcgagcagcgcggccggauucauuccuguggggcgcggggcauggaggagcugugcggccgcaggcggaguagggcaucccaggcgacggggacaacgguuuccauuugaaggggcggccggaaccggagcagcggucggccggagcagcagccccggggcagguagcgauggccgcggccuggggccgggcggggaggccugggcgggaggaggcgucggggcagauggcgggcaggcggccggccggggucgugugggccgcgggacccugggcgggcgggcgagcggcuggaagggguggaggcgaaggugacggagggcaguuguggccgcggagcccggggcggcuggggaaguuaaaggcuggaaaggcgggcggauuuccugagcgccucgcguaguuugaagggaagaaaagccuuuuccggcgaggucuuagcgugagcaggccgagaguuggugcgucugaccuuuuuguuccuugucgaaacccauccuggccaccaugaggccucccagccucgcgcccuuggcgaguucgcugcagaugcaaggaagaaaccuuucggaacccgccgcggcuccugccccuuucgguuacucgcuacugggcguguacaaggcaaaaccagaacaaagcugggcuggcuagagccggacacgaggaaaccaauugccuguaguguuucauuuuccgcacauugggaggaacugccucccgucgaaacauuauguauggucuccgugugaacccuuuuguauuuugcuuucgcacgucuuuuggaggaagggggaaggaucguuccgaguacggcauuuuuuccuuuucuccccccacccccaagauuagaaaauagggaagcccaaaucguguuuuuaccuuuacauuguaugcaaaaauccuaaaacugcuuuuauuaaaaaaauuauauauuuuuuaauucucuaguucggugcucugcuucuccgauguuugaaugcgauaggaccaaaccuccucucuguguuuuauauccguucugggucucagugacuaacguugaacuuuggcuccuguuacuugccugcguggagaguuaagcuggagcucugcuuugaacgauaaauaaaagcuuagccucgacgagacauaaauggaucuaaagacagcgguguucaacgcagcgcgcgauggcaaacuccggcuccucaccaaguugcuggcaagcaaaucgaaagcggagguuuccuccuuaaucucggagaaaacaaauggggccaccccacucuugauggcugcuagguauggacaccucgacaugguagaauuccuucuagagcagugcagugcuuccauagaagucgggggcucuguuaacuuugacggggaaaccaucgagggggcccccccuuuaugggccgcuucugcagcaggacaucugaagguuguccagucuuuguuaaaucacggagcaucugucaacaacacgacuuuaaccaacucaacuccucuucgagccgcgugcuucgauggccauuuggaaauagugaaauaccuuguagaacacaaagccgauuuggaaguguccaaccgccaugggcauacuugcuugaugauuucaugcuauaaaggacacaaagaaaucgcucaguauuuacuugaaaagggggcagauguuaacagaaaaaguguuaaaggugaguucagcuuugguuuucuuuuguuuguuuuguuuuaagcgacugccucuuauuuucaggaaguuugguagcaauuugcagcauuguuguugaguaggccuacauuaacagaccuguguuuacuaguauuaccuuccaguauuaccuugacucugauacuugauagugcauuaaacauuugugaugauaaacauuucucucuucccugaagguacagagcauauuaguggcagaagagcuguccuccugguuacaauuugcuccguuugggaauauagugaaauauguuguuuugaacuuuuuuaagucacuuuggaguagugagucacuaucuuauuuauucuagguaggcauuuucuuuguuacucugucauagaagacaagaccacacugccuugaaagaauuaaaucugaaagagauauguguucccugguuccacauacucgaggccaguagaacaaauaguuaauguagccagacagaaagugaguuuucaagacuugcucagggcuuaaacagcuaaauagagacuaggucaagccaguguggauuugcuggcaacaauuuaaggacuuuugucaggaagagcuuagguuuacaguucaguguaauuuucaaggauuguaagaaacuaaaggcaguagugauagguuaggaauucuuucauccuuuaaaggagguuuucucugcacaauuuugauaaucugaagaccuuaagcaaaucggcauaacaguagaauacuucacuaccuaacuuuaaaaaacuguuaagaguuaagaaaagccugcgucaggcuaagaguuuuucaaacaucacuuggcuugcuuuguuuacaaugaaaaauaauucuuaucccagcauucuagacuucuagaaguuccccauauuuuauaguuuguaucuuuccuuuagagauagacugugcaccccucucucccugcuuugccuuccuuugcuguuggguggcaccucaccuugaguguguguacguccauguauguaugcauguguguguaaaugcaugugaguguguuugugugucuguguacaggcucaggugcaaugagaacugugguuucuuuaaaaauacagaauuguuauagaaacaugguuuuguuuuaaucccagguauagcauaugggccuguuuagauuguccacagcagcugacuaugguuugccucaugcucuaucuagcaggggccugauuuugccagcuacagauaguuucugcaaauguaugacauuuggaauucaggggacucuugaaaggaucuauaaaugcuaaagccccaagaggggcuauggcggcugcugcugcugcuccuccuccuccuccuccucuugcugguugcugugcuugagguuuguugcauuuugucaaguggucguguggaaacagacaagaagaagaaauugaauaucuugacuaccaagaucaaacuugucccaaggaacuggacuccccuaaucagcaggaaguagcuuaacaauauugaugcccccuuucucuucuagccuucuuuuucuccuacccaguuuugggagguuggaauagggguggagaagggugguggaaaaagggauuugacaaaguaugaaaagccuggcuacaugcguaucuuaauccuagauuaugccauucaaucccagcaaacauggcuagcucauucuuguuaauguauauagucaauugauccaggacugcugcuaugaauauucuugaagaaaaugguguauuagcacacuccugugacaauaauuauaguaugaaugccugucuagggugaauuguugaagcaaaguauguguugagaugaagguaaacugcuauggggcacuguuguuacugagcauguuuauaacagcaguguuuuuuuuuuuuuuuguuuuuuuuugaaaaggccuuauaaaaaugauauaagaccauugagguuuuuuuuuuuuuuuuuuuuuuuuuuuuuuacuugaaguuuuucagagcaaaugugaaacuguuaaaaaaaaaaauccugcuacucagacaguccuuccagagauaguucuaaauuuuauacagacaugaguaugcaguuuuauuuaauaucuuguucuauaaccuguuuuuuaaauuaguaaauuauuuuaaaauucuuauccauagcuccuuaguuuuaagcacugcauacuuuuccuuuuuguacacuaguuagauguucugguucauuuuuacaaaaauaaguauaucuuggcugaauaguugauauuauaggauguacaauauuuuuaguaauuuuucuuuaucauuuuuaccuuuuacuaaaaauauuuuuuuuucucuuaaugcaucucaguuaugguuucucuuccucuacuacuccuaguucuaacccaccucccucccaucucuaucuacuucccucauuagaaaacaaauagguaacugggcaugguggcgcacgccuuuaaucccagcacccgggaggcagaggcaggcggauuucugaguucgaggccagccuggucugcaaagugaguuccaggacagccagggccacacagagaaacccugucucaaaaaccaaaaaaaaaaaaaaaaaaaaaaaaaaagaaagaaaacaaauaggcuucuaagggaauaugcuauacacuacauuauacuauacuaugcuauauuguauuauacugcagugugauaaaacuaacacauuggaauugaacaaaaacaaacagaaggaaaagagcccaagaacaggcagaagaaacagagacccacuugcuuaucuaccagugaaucccauaaaacacuaaacagaaagucaugauaauuuauaugcaaaugaccugguguagaccugcgcaccucccguucaugcugccucagucugugaguucaugugugugucagucauugauucacagggcuuuguuuucuugcuuguccuccaacccucuggcucuuacacucuuuuugucaacucuucccuggaguuccauggguccugagggaaaggauuugauggagacaucccauuuagggcuguguguuccaaggucuugugauccucuccauaaugccugguuguggauaucuuuauuucuuuacacuccugcaggaagaagcgucucugaugacagcugagcaaggcguugcucuauuguagagcaggauguuguuaggagucauuuguuuguuuguuuaagacaguaguauuugguuuuacccuaggucccuguacuauccagucucggauucuugguuauccaagcaaugucaguuauggguuccaucacaugggguagaaccuuaagccaaaucagauauugguuaguuagccccacaaggcuuuguaacaccauagcacuaacauaucuugcaggcaggccaccauuguagaucaaacuccuuagugguuugcuugguagggugcuguaucuaagaugcuagaguauagggugugggcucucggccggcagggcuugaccucucccuguccagugaguuguguggaugcugucuucagaaugggguccugccugccaccagagugcggggagcaaccuagagccuuggcaacagcauggguuguuuuagggauucccacguacccucugaccaacaacucaguuagauguuauuuaaucccaguacuagaaacuucauuuaauaacaagagauggccagaucgggcucucucgccuccauuaauuggguauuucauuccguucuccuucaugcauggacauuuuagggaaccucuccuguauuagguucccaugcgaccccuuaaguggcccuuaauucuagcugucuuuccucaugucucucccucagccucuucuccccuucccugcccacuccagccuccuguucuagcccuccuauccauccaugguuauuuacauuuaugacuauuccauuucccuuuccugaugagauuuaucaguccucccagucccuuacucuauaccuaaccagugcuucugcagugagugccuugguguucauugauacagccaguauccacauauaagcgaauagguaccacauuugucuuucugggucugggguaccucacucauguuucaugauuuuauuucuuuugauggcugagugauacuccauuguguaacugugccauguuuucuuuaucuucuguugcaggacaucugaauuguuuccaauuucugacuauuaucaauagaacagcacaugaaugugguugagcaaaagucucugguaggaugaagcauccuuuggguaucuaugcccaagacugguguauauacauggcaucuuucuguaggucauuucucaucuuccugagaaucccacacugauuuccauaguggcuguacaaguuggcacauggaugaauggaggaguguuccccuuacucugcauccucaccagcauguccuuucacuuguuguauugaucuuagccauucugauggguguaagaugaaaucucaaaguaguuuaaagaacuauauauuugcuggguggugcacaccuuuagucccagcacucaggaggcagaaacagguggaucucuuacgaguuugaggccagccuggucuacagagugaguuccaggacagccagggcuacacagagaaaucaucucaaaaaacaaaaaagaaaauuugccuauuuuucuaauugagcuuuacguugauuguggguuuucaaugauaaacaaauguuuuuguaagcauucuuuaguauuuuguuuguuucuaauugucuuuuagagguaggcugaugaaacagccuuuuuuuuuuaauaaaaaaauccugguuaagaauguuuauuuaaauuacugcuuaaucauagcaauauuaggaaugcuucaagauaacuaaaggggagaggguaaaauuaugaucccauguugaagcuuuuugguauuuguuuguuuguuuguuuuuugguuuuuguuuuucgagacaguguuucucuguguagcccuggcuguccuggagcucacuuuguugaccaggcgcuggccucgaacucagaaauccgccugccucugccucccgagugcugggauuaaaggugugcgccaccacgcccggcugguauuuuguuuuuuuugauuagggcuuuuuuuauuuaucaguuuaaugauguccauauuauugaaagccaauugggguaaauuuaaaaucuuguuuuuucuucuuuuuucuuuuguuuuuuugagacgguuucucuguguagcccuggcuguccuggaacuaacucacuuaguagaccaggcuggccuggaacucagaaauccuccugucucugcuucccaaguucugggauuaaaagcgugcgccgccacugccuggcuguguuuuaaauucuuaagucaguggagaugugaguacgcuaguauuugccuuuuauuuucuaagcuugauuuagguacuucuauaaaaaaaaaaaaacaauauaugcugcacaggagaaauguaauaauagauaacccauauuuuugucagcucuuucuccuacugugugauuauuuuugagugauucaaaaggaauauucucuuucucaucaucauaucaucauugucacaugcucuguaugugaggaugugugugcuccuuuuuuuuuuuuugccagaugaucugcuaaguuauauuuuucuugguaucaacaucugacacgucuuuuuaagaagacaaguaaggaaauaguuguaccaaauguuucagauaccuucaguuuuaaagccauacacagaucagaagguuuucuuguuuuguguguaccuuuuugugaugccacuucauuuggugaagugauuguuuauggaugguagggacagauuccaguguguacacacccucaucugcccguccucugauccugaagcauuugauugacccuuagauuuuugggugagggcaugggaaugggggcuggggagagacaguggugaucaaaaagaagaacuacuuaaagcugauguggggcuggaagaguagcagauuugacuugguagugaagaagaauuuucuuugaauuuuuagcucuaccuuaaaaauaauaaaugcugaugagacuagagguagaauccgacagauuuucucuguaguggugguggggaccucugggucucaugcaugcuaggaggugcucuauuucugagcuacaucuucguucuaguuucuuagaacagauuauaugucaugcauuagaaaguguucuuaaaaagaugacccagucacuuacacuuggucggucuuuaaaugccugugaguuuuucauuccuuuacuuuuuaacaaguaguugacuauuaagcuuuucuauuacuuuuuaacaggcuguuggcauuuuuugaauauguuuaagugguggaauucauucauuuguugagagggcauuaucaguaagacaagauaccuauucuuuuuuuuuuuuuuuuaaagauuuauuuauuuauuauauguaaguacacuguagcugucuucagacacaccagaagagggcgucagaucucguuacggaugguugugagccaccaugugguugcugggauuugaacuccggaccuuuggaagagcagucgggugcucuuacccacugagccaucucaccagcccccaagauaccuauucuugaacauugccuuugagguuugaucucagagacaaguucauaagcagauacuauuauauaaauggaaagaacuuuaucccuaacagcagaacuaccuaaggaggcaugccguggguuucuucuuuccccacagcagucuauaaagagagaaaauucuucagauauucaggaguaucuccaguuuaacauaacaauugacuuuuaaaaaccauuuuuaaacguuauguuuacuuuuugcuuauguguguuuugucuguguguaugcucugcauugugugcucucagugcuuguggaggucaggaguauuggauuccccuggggguggugguacaauucugagcgccaugugcuggggauggaacucccauccuuugggagggcaaccaguguucuuaaucacugagcccucuccaggcuguaacaauuggcuucugagauaaauugguuccuauuuaaaaccaaugaucuccaaaucuggaaagauuauauuaauccccagaauugcuacauuugucucaguacuucacauuuacgaucuucuuuaggguuuuuuuaauguguguguguguaugugugugggggaucuguuuuguuugagauuuuuuuguuuguuuaugcuuggauuuuuuacuuugcugcucucaaaugaaguuacuuaagccugucaugucugcuuuuacauccaaaccguuaggaauuuagcaguuaggaauuuuuguauauauauuuacaguauauuauacuggucuuuguucuuguuggucaaaauauauuuuacuaggaaaacaagcguuauugaauuuucagauaauuuuauugagaucuaauucacauugaauuauuuaaaacauacaauucaaugguuuuuuuuuuuuuuuauuuggugugcuuaaugaguuagauagcuaucacugcaauuugucuucauccugccccaaacuugagguucauugucuacugcauuagccucagcgacuacuaaguuucuuuccaucugucccugugaacccaccugugcuagacauguguucguucagugcagguguaacaugugucucuggacaugcuucuuucacuuagcauguguucaagguuuauuucauuguagcaugucaguuucauuuuuauuacuaaauaaugccuuuguauagcucaaugguucuuaaucugggucgugaucccuuuugggggcucaaaugacccuuucacaggggccaccuuaaaccauuggaaaacauacuuacaaauacucuaaauuuauaacaguagcaaaacgugcuaugcaguagcaaugaaaaugacguuauggcuggggaacuccacagcaugaggcgcuguauuagggcuuguauauagauagcaugagggaggcugagagccucccucccauuauugcucauucagcagcugaugagcauuccauuauuuuauuuucagcauuaugagugauaccuuuauggauauuuauauaaaaauuucauggauauauauuaauuucuaucaggcauaugcguuccuaggaauugaaauaagguuaccgaggucacuaucuacauuugaggaaguaacaggauguuuuucagagcaguugcauaguuuauauucuucagaauauaggaggggccgaauuccucugcacucaccagcacuuguucuguuuaaaucacccaacccauucuagaguugugauuuugguucauaguuucccgugacuaaugaguuaguaucuagucauaugcuuaauucacguauugucugccauuucuguaucuuagugucuucuauuuuuuuauguuuuauaauugagcuauuaauguauucagcauacaagucuuuuaucauauguguguguguauauauauauauauauauauauauauauauauauauacacauacauacaaguauuuuucccauuuuuauggaucauuuuucacucuugaugguauuguuuauagcaauuugaauuauuuugaaaauguuaaagaauauccauuguagaucaguuguguaauauuugacuuaacaagauaguugcuuauuacauuuuuauuuauuuuguauaaguguguaugugugggcacacagauaccacagcacaugugugauggucagagauaaaguuacaggguuuacuaaaauuguuuacggcuuaagaacuuuuccaaggauuaaaaauugugaccuaauuauaauauauacuauauucccacuuagacugacuaucaggacacagugggacacauaagucuaucccuuuauuuugauuuaggauguuugguagcuugcugauagcauguauguuuaagcauagcauuccauucagaucgggggauuauaggucuguaccugguccagcuucccuccuguaucuaaugagaaagcuuuugguuaugcucacaacagucaugccacugcugcauuagugugcacauuugccuggcaggucacuguuaucccuggagguuauaaaguggguagguccauugaugacuucucucccaacaggcuucgugguacuuucugguaccuagaaagcuacacaucagggagaaagcuuucaagucaauuccagcuugauugcucuguguucuacaauagugaugugucaucagaaauagggucuuccuaucuggcuccugugggcagccuaaagcaguggcaauugccuguauugguugggggcccuccguaaccucccuuauucauaagggugguagccccuugcuagagauuuucauuuauuagccuauaccuucuaggcuauaccugcauugucagugugugcaggauaucuauguuuaaacuuuuuuuaaaguuauaguuuuaaguagcuuuugaaguacuaagugaaguacuaaguugccauaauuauuuuuuauacaucuuuagguuugauuaauccacucugaaacucccucuccucugucuccucuacaccauuuccuccuuaaaccuuuaacccucaguauuauuccaccucucucuacuuuaaugucacguguucuaucauccccuuaacuguuaagaaggugcuaauuuuuggcacuuguuuauugagguauaauuuacauaaagccugucuguuuuaguaaauauuccuguaauuuucagugagcauuguuacugccauauaaauguaagaacagaaauuucuucuuuucucuuugcaguuaaccuucuuucagacccuagccucuggcagucauuggucugcuaucugucauugcuguguuacaggcacuguuuaaguagugaauauuuuaaagcagcacaaaugccuaugacaaggaaauguuuaugugaauuaugacauaucuccuuacuuuaacuuuuauuguaaaaucauuaagaacaauuaggcaauaucaaugugauuuacagaggcuaugcagacuugaaacuuugacauaauuccaacauacaggugaaaagcaugaauagauguuuauacugaauauaaccuugucaaaauauaguauacaaaaagauuuguagaaacagcacaaaaauuauagcugaggaaagugaaauaaaaaccuuuacuauauaaaaaugaaauucaagucugugaguguuguugguacagucuuaccuguuaauuuaacaucucuggauucuuuuaugcuguguggcagaguucagaggcuaagacaguaaaucuauaaaccuuuuuaaccuauaaagccuaaauauuauggauuuugcuagcuucuagguuagacucuuaccagagaugcugagaagcaaggccagagaacaugauggacaugguacugccauguaaagucugcucccauaguguaccuguguccacuuaaccaaauaaaauacuuucuaaaacuaaagauuuuuuucuaaaugcuauagugguuucagaaucuuggagauuuucugcuguuguugaggaguaagcaugaauuaggaauaugucauugguugaacuuugaauguugacuaccauuagauacagcauucacaagcaucguguugacaugcuuuuaaaauggaaucucagauugcaaccccauaggaagaauaacaguaucauuaaccaaaccccucagagcucccagggauuaaaccaccaaccaaaaacuauaccugggccagucuauggcucccucuauacauguagcaucuggcaucagugggaggggagguccuguggaggcuugaugccucagagaagggauguuagaggcacgaggcgggaguggguggguagggggagcacaauuuuacaggcaaagaggggaugaggugugugugggagggguucaugggugggagacugggaagaggguaacauuugaaauauuaacaaauaaaaugauuaauuaaaaaaauaaaauggaaucccagaagugaugucacugagguggcauccacuaauuuuuguguguagacuugaauuuagcccucugccucacauuguuaaacuuaaagauuaagagacaacagcuaauacauuuuaagaaaauaaauauugcauuaguuuugucauuucugcuccccccccccuuuaacauuugcuacuucuucuggguuuaauucacaacuuuucuuccuucauaauuucuugauaugguucuuuuucauuuuuucauauucacauauucugaguuuaauguacuccugauuuuuucuucccaccacaauuucuugagauugacuguagcuucuuuuaagccuguuuguuuguuauguguucaucuaaaaguaucuauuacucugagcacaguuuugauuauaagaguuguuauuuaguacuuucguugccagucagauaaaguuaucuuuuugugugugugugugauuuuuuuuuuuuuuuuuuuugagacagaaaccucuguguagcccuggguggcuguccuggaacucacucuguagaccaggcuggcuuugaacucagaaauccgccugccucuuccuccugagugcugggauuaaaggcgugcaccaccacuguccggccuaaaauuaccuuuugacuuaguucuuugacucauagacuauuuauuaaaaugauacuuaaauuuugaaauauagagauuuuuuuuaauguuacugauuuauuuuauguuuuuuugagauacacacaggguuccugguauccuggaacucacucaguagaccaggcuggccucaaacucagugguccauuugccucugccuccugagugcugguguuaaaggcaugugccaucaguggaaagcuuuaugucagucuuuugauacucuuuaaaacuuacuucauggccuacauuauggucaguauuuguuuguauacuccauguaucuuuggggaaaaauauuuuucuucccugauuucugucuuuauguucaggguguguauugcgugcauacaguuugucuuggauuuuuguugcaauuuagucuguuuuccuucuaguaggaccguuucauuuauuucuguuuaauagcauauguucuuguaguuugaguuucaucugcuuccuuuuagguuuucccugguuguguuuuuuguuuguuugcuaguuuuuuuuuguuuguuugauuuuuguuuuuuuacuuuuguuuuuacccuuuggauuacccuuuauuucuuuuuauuauucuauaauuuaugaaaaaauuguguguauccccuugcacuguuuuuguaguagcucacauuuaaugcagcuuuggcccacauuuuuuuuuuuuuuuuuuuuuuuuuuuugguuuuucgagacaggguuucucuauguagcccuggguggcuguccuggaauuuauuuuuguagaccaggcuggccucgaacucagaaaucugucugccucugccucccaagugcugggauuaaaggcgugcgccaccacugcccggcuuuuggcccacauuucuacucccuuuccagcagcauggccucagguacuagggcgggcuauugcugccaaguacuuuacuuccauauguaguauuucaaacucacuagauaugguugagaaagcuguauuuaaggagauuuccccuuuugauauaugaauguucaugucuucugguuuccauguacuuauuccuuuugcuaaaaaauacuccaaagauauuuuuuuccuaguaacaaauacuuuaguuuucuuuuucaucuacaguguuuguuauuuacauuauccaugauguggcuuuaucaugagguacaaccugggaguucuuuucuguuauuucacugagauuccaugucucagcuuuuguuuguggugacacucucgcugcuuuugaucuugcuguguucuagcagagaaugaacggaaccuuccuauggguuaaugcuuuucucuugaacuuaguuuacacacacccccacuccuccaccccgucccauaucaaacccuaauacagguacccuccacuuaaauuuuuggagacaaggucucuccuuagcuuugagggugucaaguaggcugggcuggcuggguagcaagcucuaagacucuacuugucuuuuuccaccuagugcuggguuugcaagugagauccaccacagccagcauuaucuauguaagguucugaggcucacacacauuuccuugcuuauaaggcaagcucuuuugagcauugagcauucugccuagguuccucagaucauuguuuauugucauucaguguacagaagagaaaauagcauacaaaccagcuggaaaccaaauagacauucuaaaacuaaagaaauuucaaugugaggccuuuaaaaauggauuaccccagcagacuagagaaguugugaacuaggugggucagaugaaaauacagcgagaaaaugagagaugggaaaggucuacaagagacaauagaaacagggccaagaggucagcgugcuuaaagccauaauuccaaagcaugaaaagggagccaacagcaguauuuaaggagauaguuugagaaaaguuucaagcuaaugaaagauacaucuuacaaaacccaagaaggauaaaggcaaacacaaaaaggggguucgucagauuggcuuacagagcagaggcugggggguuaagcaguggcugucuuagugugaagagccgcugcucaguccaggaagcuggauuggagccucuggaguucaacuagaaauggggcccuggggcauuccgggagagacacugauuuucagucugucuuggaggcugaagagauuauuugguugugguguuggugugggcugauaguagcagugguagaaacaagauagauagauacccuccugaacaaggggugaaaagcaagcagccugcucuucccgccucggauagcugggaugccaaccagaaggugcucuccacucggguuggugugaggauucagaccccucacuuagaccuucccagaauaccuaaauagacaugcccaaaggccucuugaaucucgguguaaccaccacagcaccugaaggauguucccucuggcuuccacagguacacacucauacacauacaaugaacacacaugauuugagcugugcuguaacaauuugauccuccaaguaucaauauuugcuucuaguauuugaguacauguaguaacauccucaaguuauuuuauuaaauuugauuucuuuuucugugauggcuugucuguuuguaguucaauuuugcccugucgaacuguagccucaaguagggaacaaguuuccacagcucccuucccaauagguugugacugcaguugucuccagucugaagagcaagcuguugagacacccgugucuucuaaaaccagugaagaccauuaggaaaauagugcccaauacuaguuuucuuucuaauccuggauuacuuuguuggcuucuaagugcuuuaaguaaaguuuuagguuuaaaucuguugcuaggcauggugggacaagccuguaaccacuaaacucaguaaguacagaugggacauaaacaguuugagaauagccugggccuguaucaaaauaaaaacaaaaaugaaggaaggacagauggacuagagaaaaugaaaacagguugguuuguuuuuuuuuugguuugguuuguuuuuuguuuuuuuuuuguuuuuuuuuuuuuuuugagauagcguauugucuuaguacuuaguacuuaguacuuaguacuuagcuggcuuugaaaguacagucucccaccucuacuuuucaagugguggauuaguacauagucuugagugauuguacugcuuugucacugccauuacuagacaaaaaaaggcuuccuuuuaucuuucucuuuuaagccagauuuuuuuuccugcacguagcuguauuuagauuacucuuaauuuuucaauaaaugcaggauuuuaguucauuuaaaacugacuugcugcauccauauugacuuuaugauacucucaauguaaaagcaguggcaucuaagccuuuucuucugguuuggguuuuuguuuguuugguuugauuuauacugucuguuuuguuuguuugguuuugauuuauacugucuuuugggggggugugaaaacagggauucucacuucagaaucauuugaaauguuuugaaaauguacuuagaguaguaguaguuuuuacuuaauugaaauuugaaacaaaugacaaucagcaauuaaccucugagugccuugggugguuuacaaacuuuguuguagaucacuaaaucugagacagaauaaacagauucuaaauaaucguauaguacuuaaagauauugugggaaaggaaacaagaucaacuaaugaaauguuucaaaguccuuguauguaacaacuuuuaaaaaucacuuuaaaugacauuuucuuguuuacuaguugaucacuaguuaccacuaguugacugggugguuggggugugugccauggauuguguguggagacgagaggcccacuagagagucaugagucagcucuuuccuucaaccccauaggccccuaggauggaacucaucaggauugacagcaagugguguuacuugcaaagcuaucuuuuuuuauauuguuuuuuugagacagaguuucuugguauaacagcccuggcuguucugaagcuuacguuguagaccagggugaucuugaauucagaaaucuaccugcuucugccucccaagugcuggguuuuaaaggcgugagucacuacaccugacacaaagcuauauucaugguuuuuucuuucuguuuguauauaugugccucuguguguacauaccauggcucauguguuuguagagucucuuugaaguuuauuguugguuuugguguguguuuucuguaugugccaggcuaguugguccacaaacuuucuggaauucgguuuccaccucccaucuuaguguagaaacccugggauuucaggcuuacacuacuggauugacaugguuccugccgguuccuuccugccggucauagucagcucuucacacaugguugucaagcccuuuaccaccuccgaggcucuccaacccccaacuuuaauucuaaaguaaauuuguuauuuaaaguauuuaucuucaaaccacuuccugcuguacauacuuuguugcagguccccaaaagcacccugauauuugaaggugacugacuagaauaguacucaugggugagacgauuauagugauaccauaaggagacacagcuaaucauaaggggaggucaagggugaggucuugaggggcaugugcaggccucuucauccuuucuccuuucacaaagagcauucgucaucaauaaugagaaaaaugcauaguauuuuggcacagggaaacccaugacagauugagcacuuaagguuguuauuaaggacugggucacacagguaccuuuugccuaacuacaucccaaacuccagacuccuggacaaaaaccaacucuuuaacauaaaugucaugacuacaguuugacacagugagccaccccucucauuuagggguucugcugguguagagaacaaguuuccagaugccggucugaggcuaaacuugugaguuaguucucccugagaguggcaguuuuagccugccuuguuaacuuucuauaaacaugcccagaaugaugcauugugaacacuuccuucaacauuguauauccauaccaaagaucugcuagguggcuuugcuucugauuaucaaucaaaugguuauuauugcccuuauauauaauauuugauguuuaugucauacuguuucuauaggcuauuagaaacaugccagugccuuuugucaguuuuaauucaugugagaggugaugggacaguauuagggaaauaguacauuuaaaucaauauuuagaaaauuaaauuauaacagaauuaacccauucucaggauuuuguauauauccuuugagggguuacaucauaccacccacauauuuuucaggucuuagugaacuuguuuuuccuaugagagcaguguuuugaagaauaugugaccaauauuggcuuuaacaguuaagacucauuugcuuuucaggaauuuugaaaaaaaaauuuuugucccccacuaaagucaaguggaagaaucuuaaagacuagauuuuccauuuauaaauggagaaacugacccagaaaucuaaaaaugacuuacuauuuuauuuuuauuuuuuugguuuuucgagacaggguuucucucuguggcccuggcuguccuggaacucacuuuguagaccaggcuggccucgaaaucagaaauccgccugccucugccucccaagugcugggucuaaaggcgugcgccacuacugcccagcgacuuacgcauuuuauuucagucauuguuguucagagaauacuuuagagucccagaacauucgcuuugauuugacuaugaaugaaaaguuccaggggccguugcuuaaaggagcuuuaccuggcaacucuggugcucuguuguuuuguuuuccuuuucauacuuguuuuagucaaguuauucaggaaguuuaauaaauauuuccuucagguccugcuguguaucaggcaggaauauuagaugcugaagguaacuguuugauccuuuguaauuguaauaugccuuauguuuggcugagaguugacugaacuuuucuuggagggguuacauuauauauauccuggcccuggugcuucaaaguauguucuuuccucucucuucaaggcaacacugcauugcaugauugugcagagucuggaaguuuggacaucaugaagaugcugcuuauguauugugccaagauggagaaagauggcuacggaaugacuccucuucucucagcaagugugacuggucacacuaauauuguggauuuucuuacgcaccaugcccagacaagcaagacagaacguauuaaugcucuagagcuucugggagcuacguuuguagauaaaaaaagagauuuacuuggggcuuugaaauacuggaaaaaggcgaugaacaugagguacagugauaggacuaauauaauuaguaaaccagucccacagacacugauaauggccuaugacuaugccaaggagguaaacagugcagaagaguuagaaggucuuauugcugauccugaugagaugagaaugcaagcgcuguuaauuagagaacggauucuugguccuucucaucccgauaccucuuacuacauuagauauaggggugcugucuacgcugacucuggaaauuuuaagcgaugcaucaaccuauggaaauaugcuuuggauaugcagcagagcaauuuggacccuuuaagcccaaugacugccagcagcuuacugucuuuugcagaacuguucuccuucaugcuacaggacagggcuaaaggcuugcugggcacuacuguuacauuugaugaucucaugggcauacugugcaaaaguguccuugaaauugagcgagcuaucaaacaaacucaguguccagcugacccauugcaguuaaauaaggcucuuuccaucauuuugcacuuaauuugcuuauuagaaaaaguuccuuguacuguagaacaggaucauuucaaaaagcagaccaucuacagguuucuuaaguugcauccaagaggaaagaauaacuucagcccucugcaucuggcuguggacaagaauacuacauguguggggcgguacccuguuuguaaguuuccaucucugcaaguuacugcgauacugauagaauguggugcugaugugaaugucagagacucugaugacaacaguccccuacauaucgcggcucugaauaaccauccagacaucaugaaucuccuuauuaaaucaggugcacauuuugaugccacaaacuuacacaaacagacugccagugacuugcuggacgagaaggagauagcuaaaaauuugauacagcccauaaaucauaccacauugcagugucuugcugcucgugucaucgugaaucauagaaucuauuacaaagggaacaucccagaaaagcuagagaccuuuguuucacuucauagaugauaauuugauugugcuucagcaccguuaaagcacggagugggaacaguuguaaugagcacuguugugauaacaccagcauccauuagcuugauaucauugcucccauuggcuaaagcauuguaagcaucaaaugugcaggguugguuucccaguguuuaauauaaauauaccguauaauauauuguugugaauuauugagaaaugucaugucauauucaaauuucuaaaauugucugccaaaggccauucugauuuuguuugcuguuggguguuugggacagaguuaacuguuuuucagugaugucuauauuuuacuaguaugugaauuuuauacaauuggaagucauccuccccuggcucccacuucugucuucaaguuuugccuguuuccacuuuuucucccaaaccauuucugcuacaguguucccugaaccguuggguccaugcuaagucauaaaccuuauggacuuguuuaccauuugcaguuaccauaagugcuuuaucuucucuaugcaccggcuuaaacugggacuguuguguguuggcauauucucuaugcagcaguuggucaacuucaacucaaaacacuguuuccuuacguuccguuccggaguccauuucacaaacguacucucagagcaugucgcuuucuagaguugccgguaagcuguucgagcucaagcuuuuuaaaauuuuauguuuugguuuugcuuuauuuuuucacaucugagguuucuuucuucaguccacagaaaauuuuguaugcuaaauuugggaaacaaaucuauuacaagucauuaacccaguugaaauuuaggucugucaucuuaggcuagcgugcaguaaaggaagaccuuuguagagugaacugccuuucauaccgcuccagcgucgucuccggcgucguccugcuugugcugauggugugacuagguguaucgaaucugcuuccguuuaaccucagacguuaucacacagccuaacgacucacauugagcucucagucaugaacugcagaccacuuuuaguuacaaagaggcuagagcaugucaguggcaugaugcuugccaagccagcccuaggcaucuaagauaauuacgguauuuuaguaugcgguguacugccauaggaccagaggucaguaacaguguucuuucuuucuugcuucagguuuauguauaucuguuaaagauaacgugcaugaauuacuuuaucucaauuauuugucacccuauuaaacacaagagauugcacagugauuucuguccccuuaaugaaagcgccuccuucuguucuccucuuccccucccuuccaccucccuccucccagguccccccccccccccccguuuuuuuuccuguuguagauuuguuaaugcugcagaaagggcuccuuugacuuaagagaagauaaguggaaaugaaaaagauucagguaaucacucagcacuuuaccguaauucaguagaaucuacaaugacugcuacauugcccuacauaugucauaaagaauuuguucugaaugaaaagcuucuugauucuagcagagagucaauucgccugugaacuucacgaucugggccacuuggauuuagggaugacauuuuauucugaggguugaugaacugccacuuaaagaauuacauauaaugaaauucgucuuuauucaguaaacauuuguaauggguaguaaauaaagaacauuagacuuuucaucaaacaauugagguuuaauucuuuaaaauguauccuuacucauuuuacuacauuuuaaauuacauuuuaccuuuggaaaauggauuaguuaucaaugggcucuuaaaaucguugauaaaaaagguuuuacuguguuuuuuuuaccauggacaagucugauaaaauauuugagcugcuauauauaagaauaauaugucauugagacauauccuaacaauauuuugaaauuaucucucucuaaugggugucgugagaguuaucuaugagugagccacuauuuuuauuuuuauauuuaaaaagaaaauaaaacuuguccauuuucaugaaucaucauugguugauuucacuuuuuggguaaaagaugauaauuugauuuuaggguuuaaugucuuucuccccucuuugcccagaagagucuggcuuacccgcucauagagcagggcacaucuucacacuguuuuacacaugcacuggaauuuucguagcccuguaugaauaaggauaucuuugcuaguggcuuccuucacuacgaauagauaacagaacugguucuuacuuagucuugaaaacugcagcauuguauugcagucaggaugcagcucucccucuucuguuugccuucuccagaaaugucccuuggagcucuugaaaaagcuguuuaguagcucaaauuagcauugaauuuauuuuagagugaauugguucaggagugcaaccucagauaacuguuagggccuucaucagacaugugugagaccgauuaaaauaaaauucugaaguuuguguuuuguuuuguuuuuuuuguccauggugaggaaaugaucuaauuguacucacuugaaucaaacaauauacaugguaguauuggcuggaauuaaugugcaggucucaacauuguuucuccagaaauacuucugaauuucagacguucuacaauuuugaucauuucuguaaaagaaaugguuauuuuauucagauaccagucuccuuuccaaaugcaaaugaauuauagguuuuaaaauguaauuuuuuuguccuuacgucugacaagcauaggccgagaagugcaagauaacuuuuacccuuaaugauuuugaaguuaagugauugcucauuugcaaaaaaguaauauuuuuuaaaagcccauuuacuaugaguugagaaauuguuauauuuggaacagguuauauuggaaauuugacuuuuuaaaacucaaauugcccagcaaaucauccccucaguuugaaugcacagguguguuaaucucugcaaguaguucccagcaggggcugggugaggaauaucuaucuuauacccugcucaacagcaccauugcuuggaacuugaaccacuuuaaaguuagauacuaaggaaacuuaguaucucaggucuuaguagcauagauacuaagaaacuugaauugcuggucaucuuuuuccuuuucuuuuuccucuuuguguaucacuaaacgacuaguuucucuuccguuuguugguucccauuguguauuuuuuaaaagaaguacuguauccagaugccagccaauaaauugucacacaauggaaaaaacgauaugccacagcauuguaagguuuaauaaaauuaaauuugcaccaaacuuaagugugcucucauuaacucuuaauuuuuggugaguguuaccaugaaauauauuccaauggauuccuggauuccuuuugauaacuucagcgaguuagaacuuacccgugccauuauuacaucgguaauaauguggcaucaguaagaugacuuguguacaguuuacuguaauuuuuuuuccugguaaauacauaggaacuaaagucugggaaaacucaaugaagaguacagaggauggcuuuuaauguguucuuguccuuaauaguugguauuauuaaaaacaugugcagugauauguguauaaugaagguaaguuuucuauacuuauauuucaauuaauauaauuuaaguuucauucccugugucuuaaguuaucuaauauaagauuucaauuggccuagaaaguuguucauaguucuaaacucaugugguauaaauuuggaagaauccaguguucuagacuuucacuuuuggaucaaauucuguuuuaagggcuugaacaacaaaauguauaugucaggaugcuguaccucacaaugccaucuuucaugguuuuaucugugcugauggauagaauaguauuguugaaguuugggcuuugggaauuaagaggaauaauuaauaauugguuccuugucacaggauuuucccuguccaauuacauuagugcagaagaggccugugauuggacggggaaagggaagacagagcuaagaguggcugagacagcaucuuggaggagagagggaggaagauagcagcugauguaaaucagcauggcuaugauggcugcagguuguuaugauaucauaaagguuagaauauugggauaauuugucaaaucuacaguucuuaagugccauguuacuuuauguuuagcauaaaugguccauuaaauaagauuuccucauuaaauuacagcugcauauuauugguacgugaguuuaguuguuuucccagcgagucccuuuaaagaaggauuuaaugacaaguggcucuguagugcagucgagauguuuuauuauuucugugggugggaacugagagguacacaggauuugacauaaugcuaaaacuggaaauggaaaggucauccagucuguuauguuuaugaaucauaacauuuuucuguaauuagucuuggugagaguucuaauagaagauaaucaaguuaguuuauuguguaucuguuuucuuuuucaagcucuaggauuauagaaaugagccugguuaaaaaguccuccuucaccca

SEQ ID NO: 8916 - RNA, 11698 nt, Mus musculus
cggaggaaacggaagcgucccggggccagccaacucuccggagggguacguggucagauggcugcucacggaggcgcgucacggaagcccuucauaacucgcugcgacuagauagcgcuccauacucgguuaauuaccguguuuccaacauacuaucuaccuggacugcucccuagacaucccaaaaauucacuguuaaucccagucccaccuccuucaugacgcuuccugugucaaggcccaaccccuucacgcugcuacgucacuuccgccgccgccucucagcaagcaaagaugucggaagauucagagguugugcugcagcuccccucggcuccuguaggagccggcggcgagagccuuccagagcucuccccggaaacagccaccccagagcccccguccucggcugcaguuucgcccggaacggaggaaccucccggagacaccaagaaaaaaaguaaugucaacauccguuagugggcgggggcaggagacuuacugcuguuucuaggagugguggcucgcgaagaagcaaaagcuaaagaggggcgcaucgcagaggugcgcuuucuacucuuagacuugagcaaaaguguuagaccugaggugugugacguggguaacguuuacacggcugucugaugaacccaaacuguauuuagaaaugcaaaaggaaccggccagacgacugccuggcccuaaaucgggguuuuagagaacagcccucacuggcuuuugagguucuuuuuaaguggaaagguuacaguugauugaaaacagcaagauaauugaauguuagcgucuagauagaagaguaggggacucaggucugaaguccacguguggggaggauaagugucaggauacaucaugugaaaggggcgucaucacggguguucgggaguuuaggaaggcaaagaugugggcauacgucaugggguuauaaguucagcguagauucaaaaaacaugguuuguaggauacuuuagguuuuuggaagguauggagacauguauaccgauguguggcuccuguucggguuucacaaaaguggucugacagcaccuuuugagugcuuaggugaaccgagugguuccccaucauucgcaccuuuuacagcuuuuggucuuugaaggugggagccaagugggaucucaguagguccagguacuuaaacacaagacaggugacuggaauaaaaauuugaggugacaggaguaaccaguggguuacaacccacgaguuugggcgaguucgcuaggggucugccccaacugaauauuaauuuauuuuuuagaauaagaauaauaaaaaacuggaacuuuggauacugcagaaugcuaaggggagacuaaagguguuaagguguuugcuaaguaguguaaugcuaagguguuaccuuuuuguuagcuuuucaugccuuauguaagucauugaauuacuugaacuaguuguccucaaccucuguauugucuuagaguugugcuugccacuggaaaguaaaggaaauucagauuaacuugcacugaacacuguggaguuagaguugacuauaagaaaaaaaaucagcaaguaaacauauuucaaggacaagguaaacuuuguccuuaucuguucuccuuucagagacauaacacguagucucugcuccuuaaucucaccaccuuguuauguugccugggagguuugucucccagcauugcuggggcugcaggcguauggagcucaggaguagaacauuucaaaaggcccacaggcucaauccccagcuccacaagaaagaaagaaaaacaauagacugacugugcauuuggaagaacucugccauguauucauaguguacuauuaugaguauucagaaagagaaccacugcuguuaacuuuaaaagaaaaaaaucccccccccuuguuuuuuucuccaguuaauuacguggagcugauuuucagagguuuccuuuaagguggagacuggaggcuugagaguggugacauacauuuuuaaucccagaacucagcagccugaggaaggcagaucacugaguucaaggccagccuguguucccucaaaaaaaacaaaauaaacaaauaaaaauauaaauguaaaauuguaguccuuuuuuuuuuaauagauguauuuauuaugaguacaccguagcuaucuucagacacaccagaagagggcaucagaucccauuacagaugguugugagccaccaugugguggcugggaauugaacucaggaccucuggaagagcagucagugcucuuaaccacugagccaucucuccagcccaaauuauaguccuucauacugaugauugcuguaccagagagagagagagagagaaagagaaagagagagagagaaagagagagagagaaagaaagagaacuagagaaugagaaauaguccaagauauugccugagaugacuguguuuguuuggaucuauauuuuccuauuuuccuuuuuuuuuuuuuuuggacagauugaaauucuguuuuuauccuuauguagagaauuugaugagaagggcccuaguggcacaguauuaacagacuuaccuaaacuuuugaauaccagugcuaagauccugcuuagcaaaagauuucagcuugguuacuguauauauuagcuguucaccaauugaugcgaaccuguaagcaggcuucugagguacaagcaaaucauuuggggacugcagcuguaauacaauaguuauuauuaucauuauuauuacuauuauaauaaacacuucucuagcuuccugcccucugguucuucugucuucaguaguacaacuuggugccuaauugccaccgaguuacugauugccuugggguugagggaacuagggacaaagguaugaagacaggcuaaucacaaucaucuuucuuccuuuccaacuuauccaggguucccaaaauaaugaaaggauacugagacugcucuuuagaaagauaagcugugugauauguuccgggagccuguauuuuauuucaguguguagaccagcccaccugccuuugccuccugaggcuaggauuaaaaaccuacaucaccaacaccugccuucuggaaacaauuuggauaaauugaucccaacuuugaauacaaacaacuggggcaagugugguagcaguaguacagcucuuucuggggugcuuuuguuguagcucucucuuaaagggacauaagcaucuaauuaaggauaccagucuuggcucacauaucuuuuuuuugaaucuuugaaacaucuuuugaguccccaauuguauuuuuucuaaauaguaauagauuauuauuauuucauaauuaaguauaaaaauugguauuuacaaaaagccauaugucacuacuaugaaaacauuuugauguguaucaauacuaauauuaauauuuguucguaauacuuuguuaaugaaguugggguuguagacacaugauuuuuauuuuguacauuuuugucaacuuaaacuauuagccaccuuuauaauguguuuuuaaacagcuauguaguaaucuuagcgcucugacuguaagucguggucuggguacuguugugcacgcacauuaacucacuuauggucucaucaaccuugugaggaaguagaugugugguaggguuuugagagugaaagauuacaaagcuuguagcucuaauaagugacagagccacgguuuggaccaaguuuggaaugugucugcucucuauaauaaacucugucauaaagcaucucacccuuuauuuuauccaucuguguguguauguugaauauauaaauuuacugcuuuucccuguaaaaguguaugcuuugaugaaggugacauccuuguaagugaaucuguguaaaucucaagcuuuuuaagacucuaaguaguauguucuugagucaaggcauaucuguauguuagauguguauuagcauauugcucuccagaaagguaggccaugccacagugccacagcagcaucgccugacccuucacccugcuuuuacgaaacaccaguuggaugggagaaagggcgagagguuuguuucucuuggcuguuuggguauuguuuuauaucauggccaguuauguuucuuaccuuuagaauucugcugcgccaaagugugucuuaaaguuuaauccuauagggagaacuuuguaggaucgaggcauaaaauaguggaagagucuaauauuuuuaugucucugacguagcuccagagugcuaauuacaugaacucuggagauaaaaguuggccaucgcagucucaucagaugucucaguacaguugucuuuuuuuuuuuuuaaaguugacauccugcugaaggcuguaggagacacuccuauaaugaaaacaaagaaaugggcuguggagcgaacccggaccauccaaggacucauugacuucaucaaaaaguuccuuaaacugguggccucggaacaguugguaugaugacaguggugacuguuugccaugggaacacaugcacacaaagcuacacacugcucuuuuucuccuuuccucucauuuguggugagaccuauguacuguaucagaagauacuuugagaagcucuggaaugagagaaauuuggauucaccuugcuaccuaaaaguuguuuuuuauuauuuaauguuuaucucaagcuuuguaagacucuggggguugggauguucaugcagaggucagaggacaauccuuggaagaggguucucuuuccaccauguuccuggaacucucucacucggaucaucaggaagugcccugaccuguccagucagcucagcucgaugacccuugacagugucuuuguuguuacuaucacugcugaccaggauuuuuuucguuuuucaaagcgcgggguuuuauuuacuuuccucaaaauaucacugaauagucaugcauaaauauuugucauggagcauuauguccucuguauguuagcaaaguuugguguuuacuuugauucuguuauuacuuuuguccccauucaucggguuagcaggguaucuuucaccuacugucugccuauuucacaguguaguauacgguaagcacuguauugggaugguauuuuuaguaacagguuuguuucuuugaagaaccuuggguacagugccaugcuucguuugccauucaucuuguuuuguuuuguuugagacgguuuaauuggccugaacuucaccaaguaggcuagucuggcuacccaguaagucucagagguccaccugucucuagcuccacagugcugggaucacaagcauguucuaccaugccuagcuuuuccuggaauauaugaagguuagaacauaagucuucaugcuugcauuucaagcacucacaucauuuaacaauggagacauuggagaaaugcauuauuaaacaauuuuguucuugugugaacaucuuagaguaugguuaugcaaaguaacagaacauuacaugaaaguaggagcuuacagggccguaguauguagucccucuguaacuaaaucaucacuaaaacacagcuaugcuuagcauuauguauuacuugguauguauuuuaucuuuugaguagccccaugagauaaaaauacuuuucuuuucagucccauucguauacauaggauaggcuuuaaaauguuauuuguauuuagcuccaggacuuuuaacugcuucauucaguacugaaagagaaaaauuuaaccaacauuuauuguuguauaaauaacguacuguuuuguuuuguuuuguuuuuaaagagaaagaaauaagauuguuaagcaaaaaacgacuuuauuauuagaucuggaggugaauguuggauguuacauuccacuuuccuucuauuuucuaaaaaauaguugaucaaaagcaucucugguacugugaccuuuugcuuuaauaucuuuaggaauuuuuaucuuuuauuguggcucagugggauuuuuuuuccccuguuuugggguacucucacuguuuagacuggccuugaauccuguggauuuugguauaguguuuugaauauccuugcaaaaacuauuugugaaaaauuacuuaaaauguauuuaucugggggaauagaucagucuauaaagugccuuccacuuaacaaagaugaagaccugaguucagguccccagcauuuaaacucggggcccuguacucacauauguaaccucagugcuggggaggggcgacaggagguccugggucucacuggcuagccucccuagccauuggaugggcuccauccucagagagauccagagaggcucugucucaaaauaauaaagcaagagagccaucaaggaagacacccagugucgcucagucucucucucucucucucucucucucucucucucucucucucucucucucucucucucugcugugcacacaugugcacuugcgugugcacacacacacacacacacacacuauuuaaaagugucuuaguuauuacaaaaaccugagaacaaagccuuguauuuuaggauagcauuuugaauacauuuuuuuuucuucuucccuauaguuuauuuaugugaaucaguccuuugccccuuccccagaccaagaaguuggaacucuauaugagguaaguaacacccacugguaccaugucuuuuguauagugugaguugcuaauucacaauaucuuuaagagauagcaugccaucuuaauuaucaguguagaaagagaaccuuguuauguugugaacgccuucagaguaaagucugaagauuaauaaguuaagcuuaaacagucaagaaauaaguucuguuuaaaagucauuguuuucuuagaauuuucaucuaaucuguaucacuucugcauuauucauuacugucuauaguugagcacuacaaaaauuugauuaaaaugcacuaaaaugaccuuauucaacaguguugcuuccuggcaguaaucaauaauaaauaugcuagcacuacugggaaagagcugaaaguaccucauguucagagagguuguaaagacaaaguauuuaagccaugcccaagguacccugguuuuguugaauguuuauaaauagugauauaugugauaggaagagacaucuuuugaaaacaguaguauguuauagaacauacuacauguauuuuuuaaauguaugagugcucugacugaauauacaacuacaugccacaagagggcaucagaucccuuuauagauggacaugagccacugugauagcuuggaauugaacccaggaccucuguaagaaaagcuagugcuuuuaacugcugagccaucucaccagcccaauaggacucuuuaacagaauuaauguuuuauauguugucuuuuucuucuuuauaguguuuuggcagugaugguaaacugguccugcauuacugcaaaucccaggcauggggaugagccagaaaugaacaacuugauauuuucacagaagaaaaaaaaucagagacauuucggugcugugggaagagacuuacuaucaaauauucagcaugaaucuguuaggaccuguguuuauguauaagaaaacaucauagaguauauagacuaaugaaugagauuugugucaccauaaaaucaucaugagagauugacguuagagugugccauuacucccacacacuccuguuccaggucacguuagaaaggagacugaaguuguauguggauugcaggucucaggaugacugaaggcauuuacuugguuggcacuauguuaauuccgugauaagaacuaauuuacugaaggguuuguguuuugagguaauuuaguuuuuuugcuuauucaggggaccucuauuugggauauagaauguuuacauuuaucuguauugcucuguaaaaaauagugcacugaucuaaguuguccgguagagggcagccaguuggcaaaaaggcuugacaguuuucauggcuuugccaggugauugggggcaagacuguugaaccuaauuucuaguuaauguguaauccggaaagcagcuguguugacacacuggaggaugugcauaguuuaaaauuaaucaugcagggacacaguuuuacaaauugugagcagaugagucucagcucuucaguccugucauuucugguucuugcgccucauccugggcauugugauccauaccugcugucucagcgcucaggacaccugagcaggaagagugaaccaggaguccacaacuagacugcacugcaaaagaacuuaucccaaaaagauucuagagcccuacccaguguggggaccacgcagcaccaacuuacccaucucccaacccucacuucucgucucuaugugcuuuuaguuuggguuuuguuuugguuuuuuuguuuuguuuuguuuuuuuuccaggccuggggaucauuccccuugcuugugcacucaaggcaugggcuuugcugagcugcaucucuccagcauucauugaguguucauaauguauuucccaaauugaaaguauucagagcuaaugguugaaaacuaguauccaauuuuauguguauuccgugccaucacauacacacaaaaagagugcagcugucacuggugauguuagccuggcuauugcuugagcuaacauuugaccuuuuucuuacauauuuuaucucaaacuuuuuuuugaagcugggucucacuauguagaucugccuagccuggaacuugcagagaucagugugucugucuaugccuccaaagugcugagaugaagggauagcccaccucacucagccccacagcagucuuaaauuccaaccagaagcacacauggcagcacuccuagcauugaggaaguggaaacaagcagacugaaaguuuaagacugugugggcuacagagugagauugucucaccucugggggaaaaauuacaguaaaaugcuacucuguuguuguccugcuuuugagauugacugugucacucaggcugaccugccucaggcuccggggcuugcagcugugcaccacugcaucuggcuccuuuuuaacucuuuagcuagagugugcucuagaggagccucagccaugugagccauggaagaagcuguggaacaacacggugcagugcugaccacuugucuucugcgcaagagugugaauuguggacaugcccuuccucagcaugccuugcagugaggucaugcagggaauagucacagagcacuguggacaguggcuuaugcacaguacagccuuaggaaaacaccuuauaucuugaaaacugggccguauuauuuaugaacaaugucagugggaaagaaaaaagauguguucuagcuuugccugguaauuggugacugaaagaacauaguaguagauauuuacaggagaaguauguugaauuuauuguuggcugguauucauucgagaugacagaaugcuuauuacuucuaugaaaucaaaaauaaacuugaauuugaaacauuuuuaccagaauaacuuauugucacauaaaaucagaagcuaacuaaguauguauaccacauuuguuuucuuuccccaggagcuuugaggacuguguagggcugucuagcacucaggaaauuuuagcauacuauuuaacaucgucuauuggucuuugcccaaauaguuuugagcggugacguuauagcacucugagagccuaaagucucucagaugcaauugaaguuuaggaggaagggaagggagccuucaguuuauuuucaguguuccauguguacaaguggaguaaugccacacucaaugucacugcagaggcacagcagcacacugaguacauaagacacagguaaaaagccccacaccugucuuuaaaauuaugcuaaggauuucauaaugagauaggugugugcgggggggggggggggguauguguguguauuuaggacauaaaggaaguuaaaacgugauuuauuguuaaucaaaauaagauuggguacuuccuggagucugauuccucgacauuuuaaccuuaaagggcuucugccaugguuacuaaccagaugagaaaacugaaaauuguaagugcugccucagguuacauaacuuuaguuaaccaguucacuuguguaacuuaacagucgguagcauuacauuguaagaggauggaaauaagaaugaguagcuuguggggaggucccaguucguguuccaaguauuauaugcuggguaagcuguugacaugaaaaaaagccagcugcaagccacuuaguuuuuuggguuuuuuuuuuucuuuuuuuuuucuuuuuugguuuuuugagacaggguuuuucuguguagcccuggcuguccuagaacucaccuuguagaccaggcuggccucgaacucagaaauccgccugccucugccucccaagugcugggacuaaaggcgugggccaccacacccagcuguugcaggccacuuaguaguggggaagauguuggggaaacuuuggucuuugucuaauacuccccggagcauuuugcagcuuuguggcuguauuggauuagucgcucccugguuugcuguugaucuuuguuuuaaggcuucuccagggacucacuaacacccucacuccuccaggacuuuuugaacuccaaaaaucugugugaaacaacuccaggagagucccuccucacaagaacacuuagagaaagccagcacugugacagcaccuagccucaugcugccauggcacaaaugcacccugcacucaugauuguggggccuggagagggaaugucgucuauuuccuuuuagugaccuaaguaagagugcuuuaacuucaaaagcagcagaggaaaucuuuagcuucugugcagcagaagggaacagaaaacacuuggaaugcauggggagauuagcauucaauauauggauuuauuuggggugaggcaaacacaauaggcaaaaagaaaaugcaggccuggcguaagccccccacaccaaauaauuaaaaggugagaaauggcuaaugagugugagaaggccuugggugguuaacaacucuaaaugucaguaaguaaaagcagaccuugguggucugguggugggaaguaagccuugcuguccuaggugguuggaguggagguccuugcuuccauuuuuaggggauuguggugccaguguccccccccccccaaaaaaaagccucagaaaugaaguguuaacuuugauccaugacacuugcaguggaguaagcagguuuucuuauuuuaagccuuaaggguuugaagguguugaggguuuuuuuuugggggggguuccccccuuguuuuuggaaauaaugggaagugaaaaaaaaacugacuuuacuuguuuucuuaguuuuagugcaugaaugaucaaacaggaaaggccaugcuguaauucagacauuuaagauuguguccaucccaaggauucuugcacuuaauguuucuccaccuggaaguaucuccaagacaaaugcaccugacaccugugcuccucccugcucaagcugcacuguaaggaagucuuccccgaacacccuuuaaauuagaaacuccucaguccccagcuuccccugcuuuauaugucuccguuguauacagaugcugccagugucuguccgucuccaugugcauugcugugccugaacccuccucuuagacuguaaaccaucugaggucagugacuuagaacagggaauucagauucuauggacagugcuuggcuguuugaaauguucuccauuugugggcaaauuguuuucagaacucua

SEQ ID NO: 8917 - RNA, 12420 nt, Mus musculus
cguucucugcuuccugacguggauacaggugaucagcugucuccgguuccugcuauggugggcgguaucccugugaauuguaagcaaaaauaagcccuuucuccuuucagucacuuuucucaggguguuccaacccaggaacaaggaaaguaacugauacaccaagggacccuaaagagcccgggguuucaaguguagcuuguuuugucggaagcucgcuuggccuguacaagacgaaggucugacuuggucucuuuccucagugauaggaggccccgaggcuucggcagagugugaaacuugucaggguuuaaaagcaaacacugcuuauccuccgucgauaauuuagccaucccgacucacaaauaagccacuacuucaucuaaugcucaacggaagagauggugaucagugucagagaaauauaguaguagcauucuaaugcagcuuucuaaaaaagaugauuuaaauggauaaaaucgauuguaacggacugaauuaugaauaaauucaauauauuuagauauuuuauuacaauuaaguauauuuaauaggugguggcacaugccuuuaagcccagcacuugggaggcagaggcaggcggauuucugaguucgaggccagccuggucuacagugugaguuccaggacagucaggacuauacagagaaacccugucucgaaaaaaaccaauauacauacauacacacacacacacacacacacacacacacauauauauauauauauguacauauauauaugcauuuauauauaauauacuuauaauguauaauauuuauuacaugcauuuuacauauaaauauauaauauaccucuggcacaugugcuuaagacaagagucucuuccucuuguacucucuaccuggaaggagguggacuccucaagugaccucagugugacuuucugguuuccuuccaggcuucucuaaguacugggauuaaaggcaugcgucaccacugcuuagcaguguagugaaauuuuaaugaaggacuuuauguggaauguuaguagaaggaugugcuuagcauguaacagguucaguaaacacaagauucauaguguguguguaucuguuuuagacaggcaucacuauugugucuagacuggccuggaacucaaagugauaacuagauuagccuugaacuuguagagaucuaccuaccucugagggcucauauuuaaggcaugugcaccacaccuggcuauucacaggcuauuacugagcacugacuguuuugugagcuuuggcuucccguggguaaagagaaguguaagcagacuucaaagauaaagaccuaaccaaauaagaaagugccuuuaaaaacuggcccugguagcacaugucuuugagugcagugcuagggaggcagaauuagcugugucugugaguucaaggccagccuagcuaagccagagcuacauagugagaaccugacuugagcaagcaagcaaacaaaacugagcugacuuagagagggacaaugguguccaaacaagcuugccucuagagcgaccccagccuccuguuuagguugaauacaagaacucagaucaggauguggaggcaccauguucccugcaggaagucaguauucucugcaguaaacugucagcugcucugcccaaggagcuuaaggaagcaggugagcucugcucuggcaaaccuguucucguuccuauacugagaccacaccauccucugagggcucuagaucuggaucggcuucaggaguacauuaggcgucuagacaaguccuuucuuugacuuggcucauguuuuagaucuuuuacgauuaaucugacacgaugcuagggcaaaaugcaguguggguuaaacugauuucgugugcuuuuaaucaaauauaugacucaagaucugcuggguguccagccuucugcuuggaaaugagcuucuuccauagcugggacaaugcuaagcugggaccuuuuaauuuguguagcccugauggugggaauggugacugcagguucuugggaaaggcuuuuauugcuuguaugugugucgggaacugcauuggcaggcagaguuucaguuagaaguuaguggaaauaaauacaguuuacuuacuuguauucaaagaccacccuguacugccugguuaggaacuuucuaccuuagaaaaaaucaaacaagggggaaaagugaguucugaccauuuuaguacuuucaugaaacguauguuuggggcucauaaugauauccaguuacaauuuaguggcuggugaaauuauaauuccauuuuuauuuaucugaagcauguaaugaauguaaauagcuuuaaucauuacuuaacacccucuaguaucaccuggugagagaaugugagaaaaaccuaggucaaguuggcuugugagcggauuuguggaggauuaucucgaucguguucacugaggugagaaggcugcccacuaugggugacaccauuccauuggcaagggauucugaacuguaaaagaagagaaaaagcaagaugaguacaaacauguguaauuaauuccuguuugcuuuuuuuuuaaauuggugauacaacaucucaagcuccugcagcuaauuucccugcuaguaucuaacaugaaccugugauuaaaaaaaaaaaaaaaaaaaaaagccuucuccccuaaguugcuucuguuagaguauuuuaucccagcaacaaaaaugaaaauaggaacacaaaagagcaacuuugccccccuaaaguauuuguggggacuuauauuucauaaguucuuaagaaauuaauuaucccuggaccuuuugaaucccauagugcuucaggaaaagcucuugccgguagagacaucucucucucucucucucucucucucucucucucucucucucucucuuucucucucucucucuuuuaauuuccuuuaagaaggguauuuguuauaaagaaaauagagggcuugggauuucauuuggauauucuuuugaggaagcacuuaauagugcccccaagagaaaagauucuuagugaaucaggaaaacauuuugggcuggagagaaccccagggcuguaagugugaagcuucaguuaagugagaugugcaccagcagccagagguagcagaggaugugcaccagcagccagagguagcagagaagucagguggcuuuggcucaugugcuguguguucaggugagccugggcaucuuguuagagacagcugugagggcccuucccugaucacgccagggaugugggacagaagcagugaggaaucgaauuuagggacguaaagguggucagaauguguucaaugaaugcggauggaaagaaaguauggggaacaggucuaagaugagccaaccagauuggauggggaaaauauguaucucauuuuucucucugauauuucuucgucauguccuaaagugggauugggaacagagaguuuuauaacuacacagauuauaaucauauuuuaacaguaaaaugaauaggcuucacugugggguuucucgagauacuuacauaauuaacucuucugccuuuuucucuucuucucuacugccucuccucuggcucucuucccugauccugauaucuugucauccaugugcacauccuggcuucaccuuccuccugcuucuccuccuccucuuuacuuaucuauaagagaacuugggauauuugacuuucuggguucuucaguuucacccauaaugacauuuuuccuuggggcugauaauacuauuguguauauguacaccucauuaacuguucaucuguugacagacauagaggcaguuuuuaaacaugcaaggaagacuguuuaaggauauuguaaacaaacaaaacaacccagcaacaacuagaacucaguuugaacucaguugaagcaaaaggugaaagaguucuuaauggguuggauauacgacuagaaaaguacugggaaaguugggguacuuaggggugcugggcgguaggaugugugaaggacagugaguucugaguuugcaaauaccuuucucuguauguaacaaggacacuugcauuugguaguguccuugaucaaauuuggaguccuguccucucagguagaacggaagaggauaauucacaauuacuggggauggauuguguuugaagaucuuacuuucccaccccccagaucuccagagagucagcgcaaagggggaggcgugaauuauucacccccuuuuuaaacaagagggugcucugcagcuucgcccacuccagagccaucuuugauccuaagguugguaaaagaugccaccuggaagagaaaagugucauuagagcagugaggggaggaggacgcaggggguuaagagugacuggggagagggagccagccuuucucauggggugaggcuuuggaugugagaagagcaggacagagaucaaaaggcagcccuaggguggcauacuggcaugggugacauuguugugcuucauuucuuuccauuuuuuuuuauaguugccaaaaugacugaaccaucacagaagaacaacuccacucaacaggagcucacuaaccacuuguuuccagagaaaagcagucagauuggacagaagcaacugguauagcacacagauuuaaugauucugugauucgaugaguuucuaacaucgggugucugagguguuuguggacacgaccgaaggucagguggucucgggacuucucaagaaaggacuuugcuguccagcugcugggauugucugacaaauuuccucuucccucugucuuagcccaggguucuguguaacacuaggucuuggccucacaguagaguacuugaaaagaaucuagucaaagugucugucucuauuuaguuaacacaucugcauuuuguucuaaauacuuuguguggauugauucacccaagucuuaucacaggauacucuuagcccuauuuaacaaagaaugagccgguagggcucagagaagaauucaugcaguuuaccuaauuuacagugaguagaaccaagaacagcagcaggcucaucugcuguguucauuccucguuucuugauauggaagcgaacaggaauugagagugcuggguuuuacacuuuucauagcuauacauacccaaguguagagcuguugcauaggguaggucuggaaaacaaacuaauguaccccauuacaugaaacuuuacagaaaugcugauauuauucuagauaggcaccuggacuacuauuaaacucgcugcgaugaagaaagcuuauuacauuggaagcgucccuuuuguuucuaggaauugaauuuccaguggaaucuagccugugaacuuugaggcuacccacaguguuuucuccuaaaaucuuucagaagaauguuucuuuuccuaugauaugucuauuacaugcuuagggaauguccucacgcuggcuguagguuacagguauagauagccucagcacuaaggugcaggauugccacaaguucaaggccagccuuggcgacacagugaauucuaagcuagccuacuauagugugggacaugucucaaagaaagaagcaaugauagcaaaaguaaaaagucacauuuuuauuuuuaugcguagauccaugccugccugggugugugugucuguaucucaugugcacaugccugguaccggcaaaggcuagaggaggcuauugggacccuuaaaacuggaguaacagguggcuuugagacaccaugugagugcuggcaauagaaccccauucucugcaagaacagccagggcucuaaccacugggcucucuccagucccgagucaccaugcugauugaaguaucugguuuuuugucuucacagucaggccccauuuuguuuguaaauacaaaacauccccuaaacaaagacuuuugaaaaucuccucuaacacuccacaaaguuguccuagcaagauuucucuugcucaaaucuggcuuugaucgagaggaaacucuccgugccacuaucucuguugcaaccugauggugugugcaacccagggcaggacaugguucugagacccauuucauaaguccgaauugggcaaggaggauggugcguguuguggcuucuugugguuuugacaucaugucuuaggguuuuaccgcugugaacagacaccaugaccaaggcaacucuuguaaggacaacauuuaauuggggcuggcuuacaggcucagagguuuaguccauuaucaucaauggugggagcauggcagcauccaagcaggcauggugcaggagaagcugagaguucuacauguucaucugauggaugcuaguagaagacuaucuuccaggcagcuaggaugagggucuuaagcccacacccacagugacacaccuacuccaaggccacaccuccuaauagugcgccucccucugccaagccuauucaaaucacaccuaguauggguuucuucaguguugggggaguaccauuacugcucuguccuuaugcccaagaaaagcuggaguuugcuuugucagguuugcaagguuggcuggugacucgcagguaagcaaguguuuuguucccucuugaaguuuuuccacauuuuuguuauaugcccuuuaugcuccaucuuuagcaagaauagccugauuucagaaaucgcuauuuugaugagucggggcagucgauuaugaaagaaugaacacaacuacuaagacacuuuguucauuucacagcaacagauagaacggcagcuaaagugcuuggcauuucaaaacccuggaccucagguggcagauuuuaaccccgagacaaggcagcagaaaaagaaagcgcggaugucaaagaugaaugaguacuuuucugugaaguacaaguaagaucuucauguauuucauuguugggauaaauuaugcaaugggcagauugcacgcauucuccuugauucuuaaagcaaaguaauugaagguuacaucuccaugcuuucaguuuucuucuauaguacacgaccccauaggucuggauguuagcauccuuacacuugcugagagcagggugugcuggcacauuccuggaucgccagcacuugaaugcugaggcagagagaucccaaguucaaagacugcguggcuuacuuaggaaaacuguggggaauggggguggggagguaucuaaaucucaaauuaaaaaucaccuuuuagggcuggugagauggcucaguggguaagagcacccgacugcucuuccgaagguccagaguucaaaucccagcaaccacaugguggcucacaaccauccguaaugagaucugacucccucuucuggagugugugaagacagcuacaguguauuuacauaaaauaauaaauaaaucuuuaaaaaaacaaaaaacaaaaaaaaaucaccuuuuaaaacaggguuuuguacuacuaaaacaaugcuuuuaguagaagaguugacuaaauauaacaaagaaguaucauuaaacggaaaaauuauauaauuguaggaauggauuugggauauugaguaaguaccuaacugcaaccacugcuaaugcccugggauauaaaauaccuggagauguagcucagcaauggagcacuugccugcaugcacaaggcccuagcgucccacuucagcugggcaaggaaagaaauuacaagguagggagcuggaaggaagaaugguucagcaguggggagcacuuccugcucuuuuagagcaccugagaugguaccuagcaccuagcuugagcagcucauagcugccuggaaauuuagggaauuuagggaaucuggcaccauuuuucuggcuuuugggaggggucuacacacacacacacacacacacacuuuaaaugauuuauaugaaacaggaggagugaaagcuaagcacuucuauuuugaaaauuugagauuuucaaguauuucgaaggugauggcauaagccaucgcuaggaugguauuuuuuuuuaaauuucuuuuauugaaaauagauucuuuccucagcugggcgaugucuuuaaucucaguacucacgaggcagagacaggcagaucucugaguucaaggccagccuccgcuacagagcaaguuucaggacaaccagggcuacacagagaaacccucucuggaaaaacaaacaaacaaacaaacaaacaaacaaacaaacaaaaaggaaaagugcuggguagugguggcgugugccuuuagucccagcacuagagucuguaaaaauagauuuuuuucucauacugcauauccugauuauaauuuccccucccucauuuuuaugcauaaaauaugguauauaguuaugcugaucuuauauaauugcuuuaaaaauaaaaucuagugaauucucauuaaggagaagugacaguacaauacaauauuuguauuuuuuuaaacuaccaaacaaaaaugauuaauauguauuguuuuuaauuuugugaauauaugaaugcaagugcccauagaguuucagaucucccugaaacuagaguuacaggugauugugagccauccuagguggaugcuggggacugaacucaagugcuguagaagaacaguaugcgcucuuaauuaaccacugagcuuucucuccagucccauuuaugcauaauuuuuuaaaaccauauauaucuaaucauauauauauacuuuaaaaaucauauauauauauauauauauaaaucauauauaucaauauaagagcauaccauagggagaaguuugauaaauucaaauacguuaauaaugucuuaauuagaaggcauuccugauaaugucugauuacaaggcuguuaugaaauauguggcaagguaugccccugaguaauuacuccaugcaacagaucugauauaaaggguguuugcuggguaagggagaggugugagggcccagagaagggguagaggcagacagggcagagccgugaggucagaaaagagggucucguagaggacagaaagggggagaggaugcugggaacagagagaaagcaggagcaagugucuguccuauuagacacagcuaacaccuggcgcacaguaaugacaucaguuguugcuaggucacugggaggaaccuagaggaaucuccuguaaaacaggcaguuccucccccuuccuuacuuuucuaggaaagggggaaaggaaggaaaugugcuauuucaacugaacaggagagaggagggguuaugguugggcacaaagguugcagaaguccccacugugaccucagagugcagugcuagccuuuggagucauggugauaagcgauacaagcugcucccaaggcuuauaagcagaucugcuuuugaaggauuuaaugaaaguguuuuguuuugagugugugguaaaguucuuguuaaaguccuuucacucguggggcugcuguagaguuggacagagaaagcaugggguucuaaagaccgagaugcugccccucuggcacugaacacguagccuucaguggguucuuacagugcagacuccugccucuguuguucuccauccacacuagggguaacguaguccuaaagaaacagaagaggcggcaccuggaaccuuugccaauagucccuccuccuuuaaugauuaugguauaguaacugaugggccucaucuugagucauuaagaaagguaguaguuuuugcuagagugcuuuuaagagggaggaggaguacaaaaucaguagaaaaaaaugugaagugcacgaagccccugugcucacggauaagcucuagggaaaccaagaauguuuaacaugcagaguucucuccucaguggaaggaccugguuuccauccagaauuccaagggugggugugguuaauagcuuggugaccucuucacuaucuguauggccaggccauaccugauuccuguucccacaagcaggacugauucuguagggccaggccacaccuucccccacccuuacaaacaggacuggggaugguuuauagccuugugaccuuuguaccaccuguaugacagagaccacucuagagccuccuccagacccacgcacaggcagugucucuguagaauccaucuucacggaagagguaacaugcuuugaaaagaauuuugaaguaauuaugccuuaagcuuuauuguacauaugagaucauguuauacugggaaacuuguaauuuacuuaaauacaccuaaaauugucuaauguuagacucuagaaguuugaaccaacacugacuacugagcuguguugaaccagacuccccucuugccucauuacauucugcuggcuacgguguugcagggacccccucccuaacaggaaaauaccuucaacaugcugauauuuuagaggaaaauguagaacuguguuauggggaagcaucagccagcuguucagugcuuuuagacggaugguuagaugcuccagaaaugcuggacaaccaaguuguucucagccacaguccuggcugcacucccuggcugaccaucccagcuuaccaccgccgguucacacagcagacucuuucugauaacgucgcugagaguggguccaugcuccugacaugcugugcauccucuucucacggggaggauagcaggcuagcucgcucacagcggcuccuucuuugcagggugaugaagaaguacgacaaaagcggcaggcugaucuguaacgacguggaccugugugacugccuggagaagaacugccugggaugcuucuacccgugccccaagugcaacuccaacaagugugggccggagugccgcugcaaccgccgcugggucuaugaugccaucgucaccgagucuggcgaggucaucaacacccugccauuuaguguuccugacuaggagauguuaugcauagauucacggcuagauucaccccucuccucucuccccucuccccucuccccucuccccucuccccucuccccucuccccucucgccucuccucuccccuccuccccccugcuccccuuucucucugccugcgugugcuuugugugugagggugugcauuuguuuguuuugaaacagggucuuauucuguagcucaggcuggccuugaacuuauggcaauucucuugccuuagcuucccaaguuguauuaauuuagguauaguacaucaugccuggcuucuauuccuucuacaugcaugcaugcauacauacauaccaacaaacauucaugaaugaauguauggcccuauagagaauauauuuuauauauguacacuuuuaagucaaacuucuuucucuuggauacguguuggugcaacagauggcuguagaccagacaaucauuguauagacccucucagcuuccucagcuggugaccacaggcugcaagaguggacacucaggcuuccucauuagcagcacucucaacucugccuugaagcuacaccucucccuucucagggugucuggucgagaacaccguaauuuuaagguuugcagaacucugcaucugaaaagcuguuaccuagaacauacaaccaaauguauguuuuucuuagaaugucacauauuacuaagaaaagccaacuuguucuuuguacuguauaucuuuagucuuauuuuuuuauauuuuaauguucaacuuaaauuugguaauuacaauauuuuuauuaccaaacauucauauuguacuaaauuguauauaguuuacuaaauugagaagcaaagacuugaauaugcuaaaagucugugacuaacccauuuccuuacuggaucaguauuucaggguuuguuuuuuguuuguucuuuaaggaaguuagccuucagugauacccagaguggcuuguauguuuacuaguuggauguauggaugggcagcugacagaaagcaugacguggcuggcuguguucuaacauaugguagcagguaucuggaaaguugaauucggccuucuauguacucauuucuuugugcucaugugcaaguguguguguguguguguauguguguguguguauaucuuuugugaacuuacguacaucagugcaggugccugcagaggccugcgauguuggguucuucagagcuugcguuacuggcuuuuaugaaccacuugaaaucagugcugggaaccaccaaacuuuucaagagcaguaugugcuuuaaauaacugaaccaucucuccaacaccaaauguacuaauuuuccccauuuugagucagaguuucuuuuauguucauugucuggggggcucgcaaauccucaguuacuaacuuaaggucuguacugugacucaauuuacauuugaaacgauuucccagaugauauugaugucacaggccugggggccauguaugaaaagcacuucuuuaaguuacaguagauauguaaugcaaggaaguauuuaaacagugggacuuagugacuugguacuauuuuaaaccaccaagaauucuguuuuaaauaaaugugaaguguugaaagcugggu

SEQ ID NO: 8918 - RNA, 260569 nt, Mus musculus
agcugcugagggcggcggggccgcggcugggcuggggccgcucuggugaggagcagcgcggacugccgcgcuucucgggcugugcggcccaccgacccggcucgggaggaucguguggacagcucgguccccgcgggccgcgccccggugagcggacgcccgccggcuuuuaccugggcggccgugacaggugcagagcgagcgcggcgccgcacucgcuccccggcccgccccccucaggccucggccgcccggcucgggaugagccgcgggccccgaccgaacgucugcggcuucgggcgccuggcaccgccgcggaggagcggccgccgccccuagggggaaggcgcagggagacggcugagcacgggcaugagcuggccgcggcggcggcugcugcgggacuaggacgccgccaugaaccugcaccaggugcugaccggcgcggugaaccccggcgaccacugcuucgccgugggcagcgucggcgagcagcgcuucacggugagcgcgggagaggccgcacggccuccgcuccaggcagcgcgguuuggggcuuaaaaagaaagaaagaaaauguuugacugacuucuucuggccaaaguaguuccuccaaaauguuagaagaaucacgacuuugggguucgggggaucagcgaugauuuucccgcugcauaggccuggaauguggaauucauuuacauucaguaguucggauuugcugcugcugcugcuuuuuuuuuucaggucaagguucuaaggucaagucuuuguaguuaaaagagugggugucuuaaaaugguuacugauuauuaagcuaguuuaaaugacaauagaaugaaagcggcgccuuucuauuuauuuucccuuaaaaguucaccgaugaaaaacuuugccaagaaaauagucuccauucauuccucacguccuuugaguuacuuaggcaacggccuuguaguccuugaaaaguuuuguucgagguaauucccgaggguuucaccuuugcaucuucagccugucuccuguuugcuaagggcaaguuaagcuuuagccagugugacuugcuugucuuuucuauucuauuuccagcuguuggaaaaaagagagucucacauuucugccuucguggguuuacugacacuuuuccaucuuaguuuagcuuuucuaauaguuuuaagucacaagucaguaguggaugucagaccucuagucugaacauauuuauagugcugauguguuuagcuacaacuuuuuuauuaaauguaaaauuuaauuuuguacaacuaaaacacaaacagcuuaacaugccccagacuuagaaaucuuaauuucucucucucucucucugugugugugugugugagagagagagagagagagagacucagacuuuuguuagaauaagcaguacucagcauuuaaugugcuuuaggcauuuaaugcuuagacuguacuuuuagaguugugcuagccugugacuucccaguggaguggcacaugacacuagcacuugucaagauucuaauucuugauguuugccuagucuaaaauucucaggggaagugaggggaggagaucccgucuucgcauuugucaccccauagcuggauagugcuaucucuccuuaaggaaggaagcauugccaacgagguuucacugaaugucuuuccagugagagauucuaggauaaugauguauugucauuuucugccauccccuaagcuuaaugagagcuuucuccaaggcaaauaaaugcuaagaacuuuugaaaaaggcauucugaaugcacauaaggcaguguggguacuucaaagcauguauaaauugacagcccgucaauacaacuacaugcauuagucuauaaaauauaaaaccuuggcaaauugcuuucaugcuaguuuuuaggagcuaaggguuaaauagcaaccauauacuagcauguaacuuguugcccacuucuguuuuuaaagucaguuuuuccuuaaagcaagcugugaugaccuuccucuaagcugguuguagauugcuucuagauaagcauguaaucacauaaguuauacacacauuuaucuacacauuagauacuuaaacacauauaauauaacuacauuaguuugguauacagaucccaggucccuuuaauucuggcgacaguuuaaagauuaugguccugcuuuuuccuccugcagccuucuggaguuccauuucagcaaguuucuugcgcuuacuuuccugaauaaaugggugcagcucauauuucuuugucuuugcccauuuucuccuucauguuuaugaacagucuguuguuccuuccuugagauuuguuuuuaaccuuuuuuggaagaaugucagugauggcacugaggaucaaaucaggucuguggcauucauucuagucaagcauuucgccaagcuccacccuccccuggcuuuugaauuuuuauuuuauuuuuauuuuuuuagcaagagcaaaauuaaugauacauaauguacaaaggauuaaaaucuucauguugcagcuguaccugaaguauggacuugagauuugcagccuccccuugaaggcuucuuucauccgugguggugcuucaugguuucucuguagaugcguccguguuugcaguucuucccuuuacacacuugcaaguagugcaauacuuauguugaaggauuuccaagaucaagacucugguuccugcuuaaaguuuugacagacuucaaauugaauuugaaugacaauuuuuauguuuuaaaaugcgcaauuacuaauauagguuagcauaucaaaacauucaaauuuuuuucccaauuaugucaagugccaucacacuaguuuggauuugcccuuagaaagcuucuagugggcaaugaccgugugacuccugcuuucggaauuccuuuauuucauuauuaagcugucuugcuuugcuuaaguauccucaguggcuucauugugagugccuagacaguuacugagguaauagugauacuuaguacuugagucauaaccugguuugguuugaagcaugguucuuuauaguuagauugcuuugugguuuguuugccugcuuuuguuuuuguuuacuuuuuaaauuuugcuuuuguuuuuauucuaaggaucaagccagugggccuuaugcauaugcuuacaugcuauggaagcuuucuauuacugaacucuguccuuaacacugcuuucacuuuuucuuuugaggcagggcuuugccacacugcccaggacuccagcacacagacacacaugcauguacacacacauacacacacacacacacacacacacauacacacauacacuauuugcugacuagcugaggccauaggucauuaguugguuuuuuuguuuuguuuuguuuuagcaaguucucuauuaacaucuaauuuuuuuuuuuuuucccccgagacaggguuucucuguauagcccuggcuauccuggaacucacuuuguagaccaggcuggccucgaacucagaaauccgccugccucugccuccugagugcugggauuaaaggcgugcgccaccacacccggccaucuaaauuuuuaaaaucaucuuuuaauggagcucuguuugguguuuguuaugugaaaugucaacucuuaauucaauuaagguuauaauucauuguaucuaauucauuuaguuuguauuagaaaguacuuuauaaauagugguugauuugaugaguggguacagaagcuuauugcaaugcaguuaauaauugcuuuaauaauuuagauuugauucucaauacaauauuuuuacuaaaaguccuugaaauuuuaacacaguucauuuguuacacauuuuaucaucaacauaaagugaggaauuaggagacacugggugucuuagucaggguuucuauucuugcaaaaacuucaugaccaagaagcaaguuggggaggaaaggguuuauuuguucagcuuacacuuccacauugcucuucaucacuaaaggaagucaggacuggaacucaagcaggucaggaagcaggagcugaugcagaggccauggagggauguuacuuacuggcuugcuuccccuggcuuguucagcuugcuuucuuauagaacccaagacuaccagcccagagaugguacuacccacaaugggcccucuccccuugaucacuaauugagaaaaugccccacagcuggaucucauggaggcauuuccucaacuaaagcucuuuucucugugauaauuccagcuugugucaaguugacacacaaaaccgaacaguacauuuggcccuuuaucaacugacacacaaacacaucacuauuaaaccucaacccuuacuuucuuauucauccccaagaucuaaauaacuuuaaaaaguaccacagucuuuacauauuaaaaguuuaaucucuuuaaaauauccaguaucuuuuaaaauucaaagucuuuuaacugugggcuccacuaaaauacuuucuuccuucaaaagggaaaaauaucagggcacagucacaaucaaaaguaaaauuaaacuccaacugucuaaugucugggauucacucaugaucuucuaggcuccagcugccuguacuccacugcugcuguuguucuuaguggucaucucauggcacuggcaucuccaaaacacugcugucuuccacuguaaggaggcuucagcaauagccucucauaggcucuuuucauggugccaaagccucaguuucuuugcaugaccccuucaguccugugccaucaguggcaacugaggccacaccuucaccaguggccuucugaggccucucacagugcucagccuuagcugcucuucaugaccccuucaugccuucaaaaccaguaccaccugggugacucuuacacauuaccaaguccagccacagcacaagguauaaccuuggcuaugucuggagcacagccucuguccucucagaaaacacuucccagaagaugucaccuaaaugaugcuggucucuucuuaauccccgauaauuucuuagcuccagcuaaucagcauuaguaaucccaguaauguaaaguuuucucuuuaguaguucugguaucuuguuaaucacagcugauucuucaguccuggcuaacuaaaaccacagauucuucacaaucaaaauagcaacagcucugauaagagucuuuaaucuucccuuugaaauuucacaagccaggcacuguucuuaacauuaucuuccaagcuccaacacaacaucccacagaauacuuaacaucuaauguaucuucuagcccaaaaguuccaaagucuuucuccaguccuccccaaaacaugaucagguugccacaggaauaccccacuccugguaccaauuugucuuaggguuuuuauuccugcacaaacaugaccaagaagcaaguuggggaggaaaggguuuauuuguucagcuuacauuuccacauugcuguucaucacuaaaggaagucaggacuggaacucaagcaggucaggaagcaggagcugaugcagagaccauggagagggauguuacuuacuggcuugcuuccccuggcuuguucagccugcuuucuuauagaacccaagacuaccagcccagagaugguacuacccacaaugggcccucuccccuugaucacuaauugagaaaugccuuauaucuggaucucauggagaagcacuuccucuacugaagcuccuuucucuaugauaacuucagccugugucaaguugacacacaaaaccaguugguacacuagguacaucgggcaaaacucuuuuccuuguuuacagucaugcuuaccucauucuuuuugugauauucugugaguguucuaauccugaccuauuaauagcuuuuguuuuuuggacggagaaaaugcucaguuuacaagacacagugauuuaaaaagagacaccauuaauuagaaucuagauuucuuaauauuuucuguagaauacugacauaaaauaaaauaauacuuuuccuuuuguaauucauccauacuuagugcugacaauguacacuuccugaguauauuaccuucagugguaagaaaccuaucuuagaauuccaaacugauaaauuuaaaugauccauggauuuuucacuuaaagauuucacacucaaauucauuguuuagacucaguuuuccaccuuguuuuuguuuguuucccuauuucaguuaccuuuugaaaauaguugcaaguucugucugccugucuuuuucuuuuuuucucuuuuuuugagaccagguuggccucagacucagagauccuucugcgucuuccauugugcugggacugaaggcaugugccacugccacccagcccuagcugguuuucuaagcuugaggcuugguagaaucaucagccccuccuccaacuuuguuuuucaaguccuguugagucuaccuccuaaauaguuuucagaucucuucguuugucuuuaucucuacucccucaaugaaauagcccuuuaaccuauguccuugaaugcaguuaugcauaucuucaguuuaaugcugccagagcagaaggcaaauuaagauaagugugaccucuuuggguauuuuaauaaaugucucuagucuccugccaguuuugcuguagaacugccuucuuaaacuugagguauaucuauaauauucacaauuugcacaguaggaauccuaaauacuuuguuucucuuacauccaaauacuuuggcagauuuauucaaacaacuuuuucaacuccugcuuuuguggaaaaggucuuaauauuuaucugcuccucauuccuaaagccuuagaguagaagucucuagucagauuagucuguuccuccuguaauuaauuauuuaauuuugagucaaggucuuuuuauauaguccugacuggccuggaacucacuauguugaucaagcuggccucaaacucacugagauucugccucugccucccaagugaugggauuaaauguaugugucaccaccuauggccccuauguuuuuauuuuuaaacuguagccuaguucuuuauuucugauauccuuugucauugcauucccaagcaauuagagagguagggaguaguaaauacaugagaauaaguaagaaaaagagagagccugggauggaaucaacugcucuaaagacuaagcauguuuauggucaggugguccuucuuaagaacagauuccugcaucuuuggauuauauaguguuagauauguuugauuuuaaauggaaaaaagaacagaaggaagagcauugaaaggagagggaaggaaacaggcaaaagugccugagauggauuuauagaaggauaaucacguaggguauuuucauaggaagaaaggaguuagggacuuuauugcaaguguaguaggaaacuaaaauuuaaacagugauuauaacuugauucaguaaacuucuucagaagucauuuuggggcagggguugaaaacagagacagggauuuaagcaauuggauuguuaacaguaggacaacagacagaugauuuuguuacaaauaggaugaggacauucaacgaagaugaaagaaaugcaugugaauuucacaugggguugguuuuuguaguugaguuauauauaggaaggaaagaaaauaguuguaacaaaggcugucucagaggcaguuaaaauuuauguuuuaaacaauguguaauaccaguuuuguacauacuuuuugaaauguuuaucauuuuuauuuuaccuuuuaggccuaugcaucuggaugugacauuguaauacugggaaguaauuuugaaagauuacagaucaucccaggcgcuaagcauggaaauauucaagugggauguguagacuguucaaugcaacaaggcaagguaaucuugugguaacauguagauuuuuaucagaauaaucucugaaauaucuaucuccaagacccuuccaaggacaaagcuauacauuucuuuggcucuccaagaugaauuuuggagaaugucaggaauucugguggugauuuguuguuguuugaaaauauuuauuuuuauuuuauguguaugccugaguguauuuauguggacucuguaaggguggggugguagggguggggcacaaccauggaugucagaagaggguuuggaucaccuggaccuggacuucacaggugguugugagcugccugaccuggauucuggaagcagaccuaggcccuuuacaaaaguagcaaguacucuuaauugcugagccaucucuucaccugguuuugacuuuugagacaaggucacacuguaaccuagcuuguccuagaaaucacaaugcagcccaggcuagccuugaacuuucugcaguccuacugucugucucuugaauguugagauuauaggcauaaacuauuauacccaguuaggaacuccauuuuuguguaauuuuaagauguaguauaaucuuuacuaaaugagauagaagcauaguacuuauuauuuauaaacaucugaaagcuuauuguuuuggcauuggaauacagaauugauaaaaaacuaagaucucuugagauguuaguuuccuuaaaauggaaaaaaauagcauuauuaucaaaagacaaaucauuugguagucauuuguagguagacuuuauucuaguaacuucuagaaaacagaaaggguacauaaacuaaaauauggaauuaaaaacuguuagaacuauguauaugaaaaguaaaaauaguaaguugaauaaauaauaauaaaauaaauaaauagaaaaaaauaacagcaaauacaacacagcauaguucuuguugauaucucuguggaguauccugcucggcaucauacuaggcaacauacauuccuaaaaauagcaccaaguaaguauagccgacuaggcuuaguuauaugguuuuugagacaagaucugccuaacuuggaacuugcuuuguagaccagguggccuugagcucacagauugucugccuuugccuccuuagugcugggauuaaaggcauacgucaccauguuagguacuuuaugauacuauugauaaaagguguuucuaugucagucuuuaucuauuuguuguacuuccauugucuuuugucacuuuauaggucuucuuuucaauguaguugcaaauaucucucauauaucugccucuuguuuagaccuugacauguucuucuuuuuaggauucuaaaacugugaggauuuuuuuuucaugguuuuaguguuugcuugucuagcucuuuaguucuguaaucuuuuguuauuauuaaaaacuuacuuaaauauccagauucauagagcuaaguaauguuggaaaugugauagcuuccagcaaaagcuuuucaugaagauucacuaaguuauacaauuaucuagguuaggaggaaguaauuugauuuuaugaucaaacuaauaaaaaguaaguuuucuuauuaauagguagugcuauggucaaagcccuuuuuucuuaaaguauuaggaagccaggcaugauggcacauaucuguaguccuagcuacucgggagaccuaagcaggaggguuucuugaauucaggaguucugugcuguaguaugcugagcccaucuuguaucuggacuaaauuugauauccaucugguggccuccuaggaauaggggaucacaggguugcuuaaggauaggugaauaggucuauaaaguaucaggaagaaaauuuuuuagguucugguacuaagguacuucugacugucuuuaagaaagaaaacacuauuugaugucagcaacauauaucauuaacauuuuuucuuuguauaaccaccaaauuagucugagagacuguaccuguauauuucuuguuuuuuuuucagcuucaaaacuucuuauuaucuuggaaaaauucaaauuguucacaauggcaugaaucauuguauaauaaggcucagaccuaucuuuuagucuuauguucaucauucuguuacaaagaacacuucuagcuaaguuggucaugagucaccuguaaauaacuguauugauaauaugccuucauuuuaaaauuggauggauacuuaauuuucaaaaccaacucauacuucgggcccaguauuucuuagcucaacacagugcagcugauuuguguauucuauaaacucaguuuauuuagcauacuuauuuugaauuuuuguauacaugauauccucaucucuuucuuuccauuagaacauauuguucuuuuauuuaacucuacauuuuuuuuuuuaaucugguugauuuggaacuauguagaccagauuggccuugaacucacagagaucagccugccuccaccaugcccagcugacugccuuauuuauuuauuuguuuauuuacuuauuuguugccuguuugguuuaacuuuuguuuuugagauagggucuuaacuguguaucugaugcugaucuaugauucuuuucccuuacucuucuaaauucugagguggcagguuugugccaucaugucuaguugauuucuaauguuuugauaguuucauucaagcuaucguaguugcugacuuacaagaaggaauuaaauauguagcucauuuucaguauacuguguaaguaucucuguguaagagaccugggaucaaauuauguguuccugcccuccacaaaauaaaaaacgaaaaaggaagaaauuucaaaaacauaaauguuaagaauuguacucauuguguuuauaaagaauaggucuuguuuuauuuuuauugaguuaaauuauuuguugggaaaauuaggaacuccaacgauagauaaccuuaaaacucauuuuaaaaucaugucagaguuuguauuuggcaaagacuguauuuacaugcuuccucugugaggaaauaguugucauuauuauacaugcuaagcauuuuauggcuguucuuuucauuucuugaccauaggacuauucaaaagaugguguuauguguauuauaaaugcagacagagaagucucugagugugcauaaaaaagguagcagugcugggguucuaacaucaugugaugucuucuagauugauauucuuaaauacugaugggugaaaucauaugcuugcauauuuuaaauauaacugcaauaguuauuuguucuuuugaucuauagguauuuuuaauuuauauuuguuuuucuuuuuaaaagauugcagcauccuaugggaacguuaucucuguuuuugaaccagucaguuugccgaaaaaaaggaaaaacuuggucaguauuuuauuauuuuucuuuuaggaauugaaauagaucuaguaugaaagaaucaaaaugaccauacuaaauauaaguuauaaguccauaguauaaguuauggacuauaauugaagacacauguuaaguucaauuuucauauuaaaauauaauuaaauuuuucauuagaauugaauuagauuauauuuugucaacaaaauauaaaguguucuguuuuccuucuaacaguuuuauuugauaucauauaaagugucaauaacuuaaaguuuggaaguuacuuuauugcuacugucagaaaccauuguugagccaagagauaccuuauuauuuggucuauacagcaaucuuaaguuuucugccuuuucauauguuuauucauacaguuacaugauuuguuuucaguauuacaacauuuuuaggacuuucuuuuuugcuuuuauuauguaauacaguugcugucagaugaauaaaugcuguucuuuauaaggaaaguauauaagaaauuagaaaguuuguuaacuagucguuuauaaauauugggaguauguacuuagauuucauguguuuuagugcucuugaguauaacaggccauauucuucuccaugucuuuguagucaccgugaagauuaaaccagugauuccuaagccacaugaaagcaucagcauggggaacuggagggauaggcuuagaaauuguagaacugcugucugguuuuuguuuauuagauauuuucuuuauuuacauuucaaaugcuaucccgaaaguucccuauacccucccccuacccugcuccccuauccaccuacucccacuucuuggcccuggaguuccccuguacuggggcauauaaaguuugcaagaucuaggggccucucuucccaaugauggccgacuaggccaucuucugcuacauaugcagcuagagucaagagcuccuggguacugguuaguucauauuguuguucuaccuauagggcugcagaccccuucagcuccuuggguacuuucucuagcuccuccauugggggcccuguguuccauccaacagaugacugugagcauccacuucuguauuugccaggcacuggcauagccucacucgagacagcuauaucagggucccuucagcaaaaucuugcuggcauaugcaauagugucugggucugguggcugauuaugggauggauccccgggugggguagucucuggaugguccauccuuuagucuuagaacuguugucuguuuuuucuguugcuuuuacuuaugugaacuuaauuuuuuucuuuuuuucaagauaggguuucucuguauagcccuggcuguccuggaacucacuauguagaccaggcugggcuggagcucagagaucugucugcucugcuucaggagugcugggauuuugccaccaaacugggcuccuaugcgauuuuaauagagaccaccuuaugacccucuuugcucaacuuugaaauuaacugggauuuguucauuuuugauagaguuguuacaaggaugauauauuaaagauaagaaauguagauaauuaagugguguuuuaaugguggaaauacgcuuauauaacuucugaucauuuugagacugcuuuuauuugagacaauacugucuuauaaauugccuuuucucuauccugucccccuuacacuuuauuggucuuuuugaaacagaaucuugccauguagcacaagacaaguacagaacuuacugugaguccagauuagcucugcacucccaguugucuugucucggccucugaaggguuguguuuacaggcaagugccguuaugcugagcacucaugagcauucaguuucaugaagagcuuccaaaauucucucugauuucuguuagcaucuguggauuaucuaguuuauccaguauuagaagccuuuacugcugcauuaaauaauugacaguacuaaacuguacuuuuaaaguguuuauuacauuuauuuaacugggaagagaccaccuguggaggccagaggacaauuugcaggaauucucucuuaaaagugguaaugauacccccuaguuguaauauguguauauagugucacaugauuuuuuucuuuuucuuucauuuuuacugauuuguagguucaaauaaaagaugguugaaagaaugggaaaguuuuauauuaaggaaguaauauaucuuagagaugagagauugagaaagauauuuaaauuaguugauccuuauauacacacuuaaaguuaaauuuuagacuuuaauaaaauacaaauaauguaagcaauguuugguauaaaauauauguuuacugguuauuuauacuaagaauagacuuuuagacccuagcagcagguagucugaauagucuuuuaaaaaaauagucuuuauuaucuaauucagugauucucaaccuuccuaaugccgugaaccuuuaauacagcucuuuauguuguggugaccccuauccauaaaaucauuuuuguugcuacuucauaacuguaguuuugcuacugagcagugucuuaguuccaaaggugaugugaaauauguguuuccugaugguugugacccacagguugggaagugcugauguaacucauauucuccugacauaauuguauuguuccuaaaaacaacugcauuauuaugagcacaguaaacaugacauguucauuuguuuaaaaaaugcuaaucauaauuagcuaagugacuuuuuucugauuuuaggaauuuuauagucaguggcagaaaaguggccaauuuuuucuggacucaauagcacauaauauaaccugggaucccgcagguaaggaaauuaacaagaauaacuagaacaauuuuaucugugugacaguggugaguacaaaaguaaauaagacaaauugugcccuuuuauaauuuauauugaaaugaaggcaauacaagcucuaguaaaugacaggacaugauaaaugauauacagaauaccuauuacuuuugggaaaagauacuucucucuggaaaauaagauuuuguugaccugacuuuugauagauuuuuaacaauuagggcagaauagauuaaauuaauucugagauaagauuucuguauuaugcuauguauuugcauuaaaaaauacaugucguagggcuggagaggcuggagagauggcuaccaguuaagagaccugguuauucuccagaugaucccauuucuauucccagcacccacaugguggcccauaagcaucuguaauuccauucuaaaggaugugcacauacaaaauaaaaauaaauauuuuauagcagaaagcagcauuaauuuuucugcuuauguuuugugggucagaauugcuguaggguuuugugggauguguaucucuuaccuguguguuauuacuuuuaaguagcauguagaggaaccaagaaagacuuugcauaccugaaccuuuggcuaauuuuaguguauuaccuuuguucuucauguggucugucucucguggucucuacagcugaguaguguaauuacacggcuguuaacauuugaaagcgagaauuuaagcuacaaauacuccuacacccuggccuuuccuuaucagaggauuguuuuguugugguuguuucauucucuguucaaaagaagguaggaguccagguauucaagaaagagacaaccacaucccauucuucuaagguguaugaaaauuauuuugcagggguccuuguacagacuuuguacacguuucaguuaauccuuacaacucuaaaaagcucugaauauaagaaaacugaaauucaaagauuguccaacuagacccaauuugcauggcuaaguaaaugaguuaaauacauuucuaaauuucuguccuaaaguuugugcuuuuuucuagacuaacacuuuuuucucuuuuuuugcuuucuuucuauuuuuuuuuuuucaagacaggguuucucuguguacccuuggcuguccuggaacucauucuguagaccaggcuggccucaaacucagaaauucaccugccucugccucccaagugcugggauuaaaggcaugcgccaccacaccuggguuuccuuucuuuuuucaaacuuccccuuccuccuccuccuccuccuccuccucuucuucucacuccccuccuugcuuucuucuuccuuccuccuucuuuucuuccucccuucuuccucccucccuuccucuuuccuucuuucuuuccucauugcauuuuaugaggguuuugagcauacugaaugagagauuauuuccaagaguaugggcucucucccagugacuauaacacaaaauaaagugucuuuucucucucaggaaugaaaaccuguagauagucaagcaggggugguuccucauuggcccugccccagcuaccauugucugguuagacuccccaagggaaggguacaagauucauggaaucauucccuccuauaguaguugacagauccaagcucuuaaauuauucuuuuguuuuuaauauauauauguguuuaucaagauuacauuucuuauuuauguguacguauguaugggugugcacaugcuauauggggaucagaggacagcuuggaggaguugguucuaucuuuccaacaugaagauucugggaauagaacucaggucuuuagaauuggaagcaaaugcauuuacccagugagccaucuagccaaccccaaauuauucuuuugcaguuucuuuuuuagguacucuaucguacuuuauaguauuauaagaaaucauugaguauauaucuuaacucagugcuaacaacuuacauaauaaaugcuguucauauauauguauauuuauuuagguaaucgucuuuuaacugguuccagcuguuugcagcuuugguguaacucaagaaagcaaacugaagaugaaaauccagauaaaacagaucugaacuuuggaaauuggaugugcauuuggcauugcaaguaaguaauugacuagacaguuuuuacugguaaaccugucuuuuuuucuucuuuuuuuuuaacauugguuguauauaugaguuuuuuagucuguucacugugaacagacauuagggucaaagguuacaauaaauacauagguugucagugaaauggcuuuacuccauagaugcuugcuacaaaggcuggugaccuaaguucagucccugaccccaugugguggaaggagaggacugaguccuccaaguuguucacacacccauuugucauuuaugucauguugcucuuggacaagaaaaauauuguuuggauguaaggaaauagauuuucuaaaaugacaccaaaguuauaaagugacaagagggaaaauuaauagguuugacuauccaaauaaaacauuucucuaauaaauaaaaacuugaggggaaaauagguacaguucuggaguuaauaccuucuuuaaaagugagauuaguuuaaaaagacuagaucacuaguuaucaguagugagucaugaagacugggcuuuacuuuuguguucucugccucauaugaagauaacuacuggaagagagacuucagaguugcaguaugaauaacuaauggacauuuuaagaagcaauuaacuuauuucuaaauaaaaaaugugaaguguucagaaagaagaguaugaguaacauuaauagugaguguucaaaguauauggugaauuguugauaauaacacuagauuauuaauauuuuuucuaggaauuuauaaauauagcuuagguuuaaauuuuguauauuuugauuagcauuuucagguuucugucauucaacaaauauuuguugguugcauaaaauguuucagguaucuguaaaauuguuugaauguugcauugaacagauaggggaaguccaguguuagacaaguaaacugaaauagcaggauguuaaauggauuucuucuuacuccaucuucuaugaagugauaguagaguguuauuaggugccaaaugacagaccuauauauacacuaaaggcagacuuauauacuaaguuugcagaaguguuguagguagaaacacguuaauauauggaaggagaauagaauuuugcauaaaaauuuuuagaaagacugggcuuucuuuuguguucucucugccucauauuuauagaucaagaugugaacuuucagcuguucgcagcaccgugccuuuguuuugcuauuugcuuuuaaguuauugaagcggggggggggggguauggugugugcuuauucuuuccuauaguuguauccaaagauuuccaugaaauaaacugagaacauaaaauguacuuugugcguuuguaagaagggagggaagacuguuaaaggucagagaaugcaauaguaacuuagaauaggcaugauaacuauugauuugauacugugucuuauuaagcaaguagaaaagccugagaauagaaacugaagcuuaagaugucuagagaacaucucaaaguucaguuuugaccacauuccuuauuagugaugugcuucaaacacugagaugaauaagaacuuugaagacaaaaguaagcaagguaaaugaaagagagcugaaggugacauuagagaaucauccugaaagaaaugagugucauugaggacaaaguucccugugugugaguguuuaacuuguggcuagagugacaugagcagggcauagaaugauagaggaaguuguuuauauggcaucgugaggucauuucaggaagagggaacugucuugcuauguugcucaggcaaucuuuuauacuaaagugauccucuagccucagucuucucaguagcuggaaauauuggcauugcugcuguccuaguuacuuuucuguugcaguggcaaacaccaugaccaaacauuguuguuuaaaaaauauauuuuggaguauaagagauacauggcucuggaaauuagguauccagaugaaaacugaaaccaucucucauauuuagagagaauuugcuauuacuuggguguuagacuugucaagguuuuggggguuuuuguuuuuaacaauuauuacuugugugauucuuaggaaaauuuuuaaaaaugguuuuugagauaggaccucaccauuacagcccugguuuaccuggaguagucacaguguaggccaaguugguuucaaacuugaaguauucuuuauucuaccuuuugaaugcuagaauuuccugcauuugcaagacuuggaaaucuauauuuaaaguuucucuuaguaacuacuucguuuuuggaauauucuaaaaguuaagagccaggagaaagcucuaguaaaacaucugcuuagcauguacaggcucuggaguucaccccaacaccaaaaaaggggaaaaacaaaacaaaauuucuuaacaacaacaaaaacuucgugugaaccuuuagagucacuagugguacucugcauuuccagcuguguuagaaacaggccugcuuaaccugguauuuaaccaaccugagccgcagagcaagacccaccucauaaggggaaaaagcguuacucaaaguucuguaaucaugagaaauugcuggaguuuaauuuggaaaguacugguuauuuugagucuacuuuccuuggugauuaacucucaccuuuuuaauuuacagaacugcuucccagguccaccuaaugaaauuuucaccagauggagaauuuuuugccacugcuggaaagguaaauuuugaaaauaugugugucuguuuugugucugugcgugcgcacaagcaccaccauauuguuuuuuauggagugagauggaguuguuuauucugauugaaguucaaaaauggaaccuaauacuaauuucuuuguauucccccccuuuauuucccaaguuaaguacaaaugaggguggacauacauauaauacuugauuucuaauauuuuguguaucugugaauggguaugugugguugugucugucugucuugucuguaugcaugcaugcagaggacaguuugccagaguugguuuucuuuuaccaugugugauccaggacuguuagauuuuuuuugaaaugcccuaaauaaaauacuucuacaguauuaguuauuaaaugauuuucauuuucaauauuuucuuaaaaugauaauuuaugaacggccuugccaucuaucucgguuaucuggauugucuauaauuuggagauaguauugcuuucuuucuguuugguuugguuuguuuguuuuaagacauggucuuccuauguuaccuuggcaggccuaaagcucacuauguggcucauagauagcuuucuuucugccucuuccaggauuagaggggugugccaucaguuugcaacuaguauugcagucuuaguugaauuuuugacuuacgagagaauaaaaccccuuaauuuuccuuuuucugaauaauguuugugguuauauggucacuagaugcuuuuugguuuuucuccuuaggaugacugucuucuaaagguaugguauaauguagaaaacuggcgaccagcuguuacgucuccagauaaaaauucagaaaaacaaucccaaggagaaauugacuuuucuuuuguguaucuggcccauccacgagcuguaaauggauuuuccuggcguaaaacaagcaaauauaugccgaggucaguguuuucaccguguguuagagagcaucaccaacuugaacugucaguguuucacuguguguuagagagcgucaccaacuugaacugucaguguuuucacuguguguuagagagcgucaccaacuugaacugucaguguuucacuguguguuagagagcgucaccaacuugaacugucaguguuuucaccguguguuagagagcgucaccaacuugaacugucaguguuucacuguguguuagagagcgucaccaacuugaacugucaguguuucacuguguguuagagagcgucaccaacuugaacugucaguguuucacuguguguuagagagcgucaccaacuugaacugucaguguuucacuguguguuagagagcgucaccaacuugaacugucaguguuucacuguguguuagagagcgucaccaacuugaacugucaguguuucacuguauguuagagagcgucaccaacuugaacugguuuucuuacguugaaccuuugaagauuagaguaauagucgaugauugugccaggcugcacaugucuggauaugagccaaguaagauuaaugcuuagcauaagagccucaaagugaauuugaggccaagauaauuuauuuccauauuagaugucuuugucaugcaguucuacacaguuuucuuuccuuuguuuuguguuccauuguguaucuuauacagauugcuauuuguguagguuuuuuuuggacaguuaccacccucauuuguacuugcaguugaauccucugguauccuuuuuuaaaacaagcaaaccaaaaaacaaaauagcauuuauugaaguccuuuucuucuuuaaggaaauagaguuaauucuugaaauuaucuuuccuugaguuggguauuaguuuaacccauaggagcucaguuuaacucauacgagcucaaaaauaugucuguuaguauuuuuuucuuuucuguaguccuugaaaaacuaccuaacauagaauuuuuauguguucuuugaguagguuacauagauuuaguaaguauaucggcaaaucugucuugaacuccguggagugcagauuggguugucugucucaccuuuuugguucuguugagauguucagguagaacugugguuaugcgcucacaucauuugucggcuuuauuuugucccuugggaccaacaggauguguaccuauuagaguguuauuguccucauccuagcccuccauuccaaguuuaguggagaaaagaaacuaggaaaaguacugauucugcucuuauuuuguggccgaguccucaagcuaagagagagugaucugaguaaucgguauugccagcagaaggaaccguaucgcagguucacuuaaguucuaguucucuugccuacauacuuuaaaauguguuuucaauaaaaugaucucauuguguauguuaauucuuauuuuauaaguuguaagugacuccagcuugaucauuacaaauuugucuuuuaaaccuaucugaagaaaacuauuuuauagaaacuaauuucuucugauauauaauaaaugaauauacucauuuuuuaaaagauuuauuuauuuaucuuauguauaugaguacauuguagcugucuucagacacaccagaagaaggcaucagaucccauuauagaugguugugagccaccaugugguugcugggaauugaacucaggaucucuggaagagcagucagugcucuuaaccacugagccaucucuccagcccaaguauacucauguauugaugcuauagccaucagaauacuaaacaggcuuaugcauuacugaaguuuuguggacugacuuagcuuaaguugcgauggagcugaucacagugaagacugaaacagauagcagaugccuaaaacugggacauuuagggguuccugcaaauagcaaugaaguaauaguuacucuccuaccuuugggccauuuuauuaaguuacccucguucccacucccucucccucgcccucucuaauguggcuuugaaggucaagcuuaggauacauacuccuaagaaguggaagcaggaggaccacaggcucaaagucauucuugcuggagaguccauuugaggucagccuggacuacaugaaacuuuaucuuuaaaaacaaguugaaugcagagauucuguugaauuuagaaagaacaguagacaugucuguguaguaagcauauucuuuacauucccuccuauggagggagcaacagugucaacaggccagacccccccaccaaccaaagacuauacauggagcagcccagggcgcuggccacauauguggcagaaauuggccuuguuggacaucagugggaggagaggcccuccagccugggguugcucaaugccccaguguaggggaaugucaggacaggaggaugggacugggugggugggggagcacccucauagaggugggggggggguucuucaguuucugaaggaaaccuggaaaggggaaaacauuugaaauguaaauaaaggaaauauccaagaaaaaaaaauggguagaaucugaaaaaaaaaauugaaugcagagagucuguugauuugagaaagaacaguagacauguuuguguaguaagcauaaucuuuacuauuuauuuaaaaaaugaugaauauaggccagguuguaagguuuggugacauucugcaggaaccuccaaaaguuggcuggagauaacaaauugcaaaacuaucuuaacuuguuguuucaucaguguaggacaaauguuggagacauguagucaaucacaggguugcuuucugugaguuuaaaucuauuguuuguugcuuuuauaugccgaaugaacucuguaucaauaugauagacuaaugguucucaaccugugggcuaugaucccucuguggaggggggagcaaaugacccuucuacagggguugccuaagaccaucagaaaacagauacuuacauuaugauucauaacaguugcaaaauugcaguuaugaaguagcaaugaaaauaauuuuuaugguuggggugaccacaauauaggagcuguauuaaaggguugcagcauuaggaagguugagaaacacugugcuagaccaucaagggaauaauaaacauuguaagagaagugaagaagggcagcuccagucuuugauauugacuacagauauucugaggagucacuugaagcuauagacaugcauuaagauugcugcacucuguugauuuuuaguuggcuucucucuugacuuguuuguuucucuuaaauucuuuugcuucaucugauugcuaucuaguccaccguuuaguuaccgccugcuacuuuccuuugucagugcuucuaugcuaguuauucauugacaguaugaacuuuugguauuguuuuuugauuuauuuucuuguuaaauuugcuuacuuuuaauuuuauugcuauggucuaugugagggagaaaugcaagggauggauauauauuagagggaggaaauaaguauaggcaagggacagaagaaaggaaggagaaauucaagggauggaugaguguuacaaugaugaggagugagaagcaaaagguucaggaagaaaucaaaagagugcauuguagaaggagagaugagagguagauggaugggagaugaaaacaaaacauggcccagagaggcugagaggauggugucagggcagaaaaagggaagaagcauuggggagaagaaaggaaugugaaggcauagacagaagguggugagagagcuggacgggagaggugggggaaugcacuggggaagcugaagcugacaggggaaccaaggaaaaacacugauuuugcuucauuuuucuuuuguggugcugggucuuucuaaucacaaagugaugaaugauaaggcaguugcuguagaauauuuuauuucauuccucuuagcuuucuucuuucuguuuugucuuuacugcccuccuuuccucccuccuuccauccaucccuccuguccucccuccuuccauccaucccuccuuucccuccuuucccuccuuucccuccuuucuuccuuucauuugcuaaauuaccugauaaaagauuucuuugugguaauagcuguuuauacuuuuuauuuugaggaugucauaaaaggaaauaacucauaauaaguccagaaugcuaaguccauugcuaaugauggaugugguucgaucaggucugucaugaauucuuuugcacaucacugcuuugggccuagguaggcuaagagacaauaaguauacuauaugcuuacaucaguuucuuaaugacuuugcagaaaguagcacuugaacauuaaauaguuaaaaauaauggucauucacugaauaaauaggaacauuuuauuaggaacuuuguuuuguguuuguuaauugaggaauuaaugcuugaucuaagucauugcucuuuagauguaauaaaaaucucaagauuauuguaacaaaaacuauuuucuucuagacagaagaaauagguugauaaacauuuucucuugugacaucaauauauacauguucucuugacuuuuuuauaagcuuuuauauguaugguuguuuuguuuucauguauaucucuauagugcccuuggaaaacagaggguguugaguucccuggaacuggagcuaaaaggacugggaaucaaacccuaguccucaaaaggaauagccaucugacugcuguuaucucuuuggcucucuuguuaauauuaguuaaauguuuaaauauguauagaaacacugcaggauguuucugauguguuauguaauuaguaauaucucuaaaauauuuuuauuccucagggcuucuguauguaacguacuguugacuugcuguaaagauaauguaugucgucuuuggguagaaacauuuuuaccaaaugauugcuuccuguauggaagugacugcaaccacuggugugaaccaguuaguuuaacaaauaacuuaaagagaaaugcuuccaguaaagaccgaguucaaagugcucuagaaguaaguguuuuuauuauauuauguguuuccuacagauuuuaaaaacuuuguauacaguguauuuuuuuuucuucuggguuacauaauaauauuauaaguaguaguauaucuuaggaaaacaauuauagaaauguuccuuuuaucuaaguaaagaaaauacauuuaaguacuuuuuuguaacuuaugagcuaucuuuaauuaugagauuaaucuuagcuuaaccaguuacaaaauaauggaaauaaugguaacaguuuacuuggcaaauguaaaaucugagaauucaaagauuugacuauaaaauauauuuucucuuggagcauaagguagauuuguuuuuauauucuguuguaccauuugccauuuguuaucuuucgacccgucagaacacaucuuuaguuuauaagcauugaugguaaaacucaauuuuugauguuugggcuaauugaauauagaacaaauuuugcucuuuugagacaaagucuuacauuguagcuccaggcugaucucagccuuaugccaaucauccugucucugucucuuuuguucugggauuacaagugugaaaaaccauuuuugauugaaaauagaauagaaauacugacucaguauuucuguucuuuuucuuuuugguuuugcuuuuuguuuguuucauagacaggguuucucaguauagccuuggcuauccuggaacucucucuguagaccaggcuagcuuaaacucgaagauccucgugcuucugccucugcauccugagugcugggauuaaagacaugcauuuccauaccuggcuucuuauuccuuuuuuaguauuaaaacaugaaguggcuugaaaaugauuuguuuaaacuuguauaguauagaaaacaaauuuucccccucuuuugguguuugaacagggucucauuauuuagcucuagcuguacuggaacucauuguauagaucaggcuggacuggaagucacagagaugauggcugagaauauaauuaagcugugugacauauucaguggcuuuguauauuaaucacguaacaaaaaguguuagccaaggaaucuguucuacucugcuucuuacuagcucgauaaccuuaguuacggucuauaugaauuauuucaugccaugaaauauuaaaauagcauguuuaaauuggauaccacaugagaucagauaaaaugaucucugugaaaaaugaugcuuuuuuuaaaauuggauaacuugguauaucaugguaauauucauagugacagggagcaaguugugggcaaagacaucaagcagacagaucuuuguugguacuuuauuuuuggaaaaaagggcuucauuauuuagcauuggcugccuuauuguauagaccaggcuagcuuauuguauagacucagucagagcucuuccuaccuuucucccagguacuaagauucaaguguccaucacuaugcccaucuuacuauuuuuucggguucuugauuuuuuuuuuuuuuuuuuuaacuuuuaaguucuggaaauugauuuuagauguugaaaagcaaauauggaaaauaguaggccggguacuuauucuucaagauucaaauuugauaggucaaaaaauggagaguuauuuuuuuacauguauaauuauauaaaauagcauuuuuauucauucugacaaucauaauaugcagucacuuuacuuuguuuuuauauauacagguaaaucugagaccuuuccguagaggucggaguagaucacuugcucuuguagcacauacuggcuaucugccucaucagcaggauccucaccaugcccacaggaacacaccacugcaugccaaugcacuuugucacuuucauauugcagccagcaucaacccagccacagguaauuaacuaccauaccaucuggauagguaccugugaacuuagagaauuaagcucuuaucacuucaguaaauauuuucuaugaguauaaaaaaucaggggucacagaugaugcauuuaaaguaguguaucaaaguguuucuuuuuuuaaaaaaagguaauacuuacacauaauuaauaccaccuuuauggaaaguggaaaauaaaugacuccuuugauuuuuacacuuuagucccuuucucuagaacaaaaauuuauuuuuuuuauaucuuguagaauauagucccuccuucucuuuuccuaucuuuuuucuuuacucucccccucuugccucucuuuagacagagucuaguuauauagccaaagcuggccucgauauuacagaauauucuuaagcaucaguuaagcagaaccaauuuccauggagcugaaauugcaguauugcauuuucaaagaaauauagcaguggaauuaucaguuaauuacuugaguagaauucugucuaccagagugaacucugcuaaguuaaaguauagaaauacuuuugauuuauuugguugacuguaaucuuaguuguaaaaguauucaugggcuaagaaaaauaugucagaauauugaaucaucuuuauuaaaaaauuacuuagauuugggaaagaucaucuuuaucaaauacauaauauugacagugcuuauacaccaguuaccuauaaaguuaguggcauaauuuugaaggcuccuggugagccaaggaccaggauuagguuguaguaaagcucacugguaaagugauuuucuagcauggaugaggcccuugcuuugaguugcagcaccuuagaaaaaaaaugaaauaaauuuaaaaagcaacaauauuacaagaauaacgaaagccugaauucucagaaaaugccuaggagauuauuugagagaagagcccugaguuugaauguggcaccucagcuuccuaaggagaacuaaaacuuucuuuaaauuauagaucaccuaggaaaacagugaugguuugaauaagaauggcucccacaguuucacauuugaaugccuagucaccagggaguggcacuauuuggaaggauuagaaggauuaggagugucccuguuguacuucacugggcaugagcuuugagguuugcaaaguccauacccggcuagcucucugccuacagaacaaaauguagaacucucagcuucuccagcaccugcaugccaccaugcuccccaccauaauaauaaugcacuaaccucugaaacuguaagcaagccucaauuaaaugcuucuuuuaugaaaguuuccuugucauggugucucuuaauagcaguagaacagugauuaagacaaaaucuuacaugucaaagcaaaauguuguugaaucucauuucuaggucuuauaucuuaacugugaaaguuuguugcaaaaauaacauguuccuugagugggguauuaaugcacaaaaugcugaguuuucuuuaguuagaauaucuugcuaaaagccagcaguauuucuucucuuguguacuuaacaguuguaaugccuauugucaguuaacagcauuguaaucuucuuugaauuugugucagccaaagaugagaaagccuuuuccauaacuucuuggagaagugccauuucaguuccaagcucuacccaggaacagugacauuggcaaaucaggcuuucaguuacuugcuuacucuauaccaguguagaaauuagagauaguguuaggaauuggagggaaagugacacuuuaaauagcuguuguccugcucucuugaaggcuguaaucagauguagaauagguaaauaaauaaucaaaauaauuaugcuacuguauagauauaaacaggaacucuuggauuggauacauuagaacuugccucugauaguagaaucaagggaaagguucuuuccgguaccauuuaucucuucugguauuguuucuacuuuugccuuuacuauagauaaaucaaacagauaauucuguugauuuuuaaaaaucuuuuaucauggaaaaagcuuaauuuguggaauauuguuuguguuuuuuaaguccauugcagccuuuauaguucuauugauaacaacaugauucagauuuuauugacaugauagacuugaauuuucuuuaucuuuguagcaacugauuggauuuguacuucaaaauacauaauuaaauacuuaaaaauaaugcuaaguauguaucaaaagauggccuagucggccaucacuggaaagagaggcccauuggacacgcagacuuugugugacccgguacaggggaacgccagggccaaagggggggaguggguggguaggggaguggggguggguggguaagggggacuuuugguauagcauuggaaauguaaaugagcuaaauaccuaauaaaaaauggaaaaaaaaauaaugcuaagaaauauuuuuuuuauuuaauuuuuuuucauagaauauauuuugauccuguuuuacuccccucaaacuucuuaagagccucccuacuauuggauuuuguuuguguuauguucaccccagcuccccuccaaaacagaaaaaaaccaauaagacaaaaguaccaaaacaaaaagcugaccauggagucuguuuagcguuggucaguuauuucuggguauggggcaugcucuggaauguacuugauauauuccaguggcauucccuuguagaaagcugauuuccuuguagaaagccgcuaaguaucucuuagagcugggacuuggugcccaucucccccuuucaggacugggcccccaucugccuugaauguugcagaucuggugugugcugccaaaguuuaugugagaucauaugagcaucaauccuguugugucuggaagacacuguuucuuugguguuauccuuauuuuuggcucuuaaaaucuuucugccuccucuuaugcuuagcgccaucaaccuucuacggaaggauuugaugaagacacucauuuaagacugacugcuacaaagucucuggaaacuuuccaguagacuguuuacauauggcuuuucaaaugcccuuuaguguuaguuguuucucuucauauuucccucuuuuguccugucuucucaucccuugacauuuaauuccccuauucuauuuuccccuuuaucucuccuuaacacuauaugcuauuucaccauccuuaagagaucuuuuucuucccccagguuccuuacuaauuucuaaugucugugguuauuugauuauaacacauaugucaaaaacuuaaaagcuaaaauccacauaugagagaaaaacauucaguguuuacccccuuggguucuggaguaccucacucagcauguuuuucuagcuucauccauuuaccugcaaauuuauuuuauuaaacagcugaauaauaaucuguuguauaaauguaucacuuuuucauuaugcauuuauuaguugauagauagcuaggcuguuuucaauuucugguuauaaaauaacuuuuaaguuaaacugaaaacuagauaaauuuuucucaaauuaaaggguaaguauaaugccaauaauaaaaauagaaauuguguaugcuauguuauagagguucaaaauauguauuuugucauuuguuuuucuuuauagauaucccacuucuuccaucuauuacauccuugaguuuaaaugaaaaugaagagaaauguggaccuuuugugguacacugguuaaacaauaaagaguuacauuuuacuuuguccauggaagucuucuuacagcaacuuagaaaaaguuuugaacagcccucaucugaagccaguguagaagauucuauucaggcagauuuaaaaucugaugaagguaaaguuuaagaaggaugaaacuuuaaauuugcaguccaaaauaaguaguuuuuaugaggauaaaacuaguuauuauaugagauaauuucccauggucauuguggcauaauguaauauggacuagcuuauuuaauaacuggguauggauauucuugcuuacauuacuuuuuuuucagagcuuucuguucuuuuggauuugucagccuguaaggcuugugacuuuaugacuuaaguauggauuaauggcaucaaauguauuaucucauacacuacacaacuacuuuccugaaucugcaauuuaaauauaguugauuuauauguacauuagaguugagaaacacuguaugaaagaagaggcaauuaugcuuaccacuaacaccacagugcuuuguauucaucaugcuguuggauguggagaaggaagagggcagggagagaguacaagcguuuucucugugccuugauacauaccccuuccacucuggcuacacuggcaaaagagacucacagagucccaagugcucucauuuucuagccaguuuguaagcuuuuauuuauuuuucauuuaaauuugauaaaaaaauuuguaauugccucuuuuaauaugccucauccaggaggugaggaaaggguauugagucugggcuuuuugaaagagguaaagauaugcauguucacaguccugcuagcugucugauuacuaaguuaacuucguugaucuuauuucuuguuaauacaaaaguauguuuuuucacuuuuaauuuauuuagaaagcucuguuuuaauuuguagugauaauuuuauugguucaugaacucuugcuuauagaacuggaugaugguguugaugauuuaaaaauaaaucaugaaaagaaggaauuggaugaagacaaaauguuaccaaguucaaguuuuacaccauuaucuucagccgccgucgaucaucagauugaagugcuucugucugaauggaguaaaaacgcagacaugcuuuucaguauccaucccauggaugggucuuuacuaguuuggcauguagauuggcuggaugaauaccagccugguauguuucgucaaguucagguacuguuaaucaucuaugaggagcuaauucuuuuuuuuuuaugugaaaacuuuuuuaacauguuuuuauguaauuauauguucuaacacccacuuucuuaauuuuagguguccuuuguuuccagaauuccuguagcuuuccccacaggugaugcaaacucucuuuguaaaagcauagugauguaugcuuguaccaagaacguugacuuggcuauucaacaaggaaaacagagacccacuggccucacucguuccacaucaaugcuuaucuccucugcucacaguaaaucaucaaauaacuuaaaauuaaguauuuuuaccccuaauguuaugaugauuucaaagcaugcugaugguucuuugaaucaguggcugguuaguuuugcugaggaaucugcuuuuucuacagugcuuaguauuucucacaaauccagauauuguggucaucguuuucaucuuaaugacuuagcuugccacucgguauuaccuuuauuacugacaacgucacaccauaaugcauuaaggacaccaaauguugguaaccaaaagcaagcucaugaugcuguaaauacugaagaaugcuccuuggcacaacaaaauaaaagcaacguugauauggcauuucaagaucccaaugcaauuuacagugagcuuauucuuuggagggucgauccaguugggccacuaucuuuuucuggaggaguaucugaacuugcccggauuaauucucuucauguuucugccuuuuccaauguggcauggcucccuacucucauacccaguuacugucuagguaagcacacugauuuccauuuuagugauuuagauuuuaagauacuuaccgaaagguugcauuuuaaauguuucuaaauacuuucuaggugcauacugcaacucuccuagugcaugcuuuguagcuagugauggacaauaucugagguuauaugaagcaguuauugaugccaagaaacuuuuauaugaacuuuccaacccugaaauuucuguaaguacaagcuauaugaaguuuuuggauucuuaaccuguccuagcuugaccuguucuagaauuguggccuauaauuugugacacuuguauagugauuuuaaguuuagcuccuucauuauuucuaggcugggguugagcuccuuauuauuauuauuguuguuuuguacucauggauccugcaaccaaauauguugguuauguaauaaaacaccaaggaggucauaguacauuacaauaagaguagucagaaagaaaagcagagaguuagccugguugagcaugugguccaugaguucaagucccagccucucccuccaucccucucccgagucuaguuauaugcuucuuuacucaaagguagacagaggcuuccaacuguagaaaguguugguuccucuauaguuaaaaggagcuagaauaauaagaguagaauuuuaaucuuaaacaugagaagaaaaaacccuuggcuuaguugcagcucaaggaaaucuaucaaaugucaguguaagacuuuuaccaugcuagagacccucuucuuccuaagccuaacuagugaaagccuacugucuguauuuacugaucccuccauuuagagaauauuucugcguuuuucaguucuaguguuuagaugaguuuuuguuuuguuuuguuucauuuuguuuuucuguuugaguugguuacuugacuuuacaaaaagaaaaacauuuuucuagacauaggcuaaccuugaacacccaggcuuuuuugcuucugucuccugugugcuccuguuguaggcauuugccauuaugucaggcuuauugguguuuucaaaucucuccugaggcagacgguacuuaaguuuccugcuuaggugauucuagccuaaguugccaguaguuaguuuuuaaugcucagaauguaaaaggaguagaguuguugcuuaauuauggucuugugaaguuuuuuaaagcauaauuuuauaaaacaauaucuuguaaaguguaugaguauauauguuacccacauauauugcuuuagugaaaagaggcauuuauugagggucuuucauuuguuaagcauuguuuuaacugcuggaaauuugucuauaaaaagccagaaacugauacuagaaagcucauccuagugaagcgagauagcugguggaagggaacuagcuaaaaauauauacguuaguuaacgagcaccguggagagaaacagugcugcaaaagaaagggaguaccccuuauguugcuguucaagggaaagcuuuauagaaaacacaugaaggaauugaaugagcuagauguguggcuauaggaagagggauccagaaagaagguuggccuguucauggacccugcagccaaaaugugugauuauauaacaaaacacuaaggaggucuuagugcaauaaauaaagcuaguucgaguagucagagagaaaagagagaguuagccuggucagauccuuuggacuuuugucuaaaaugacauggaaaccauugaaaauuauacucaugugauaauaauuugacguaggauuuuuaaaaauagguuacuaugaugacuuaagucccacugugcaaaaaaguagagugagggagacuaauuuaaaaagcuauuacauuagucuaggagaaaaguuaaggaaucaagaauggcaaugaguguuaauguuagaaacacugaaaacuugucaaguauuagauguaguuugaaugugaauaguuggguuuggacaggauuuuguaugugaggaaaaaaugacucaauucuaugucagcuaagcauaaaguagacuugcuaugguugaaauauggaagaauguaggacuagcagauuuggaaagguagaauuuaagagcuuugcuuuggacauacucauuuugucugacauccaagagauucaauaaaguggacuuuggauuuuagaggaaagucugagcugaagauauaaaauaaguaucugagucuagacaugguggcacaccccuucaaucccagcauucagucuagacaugguggcacaucccuucaaucccagcauucaggaggcaggcagagacaggcagauuucugugaguuccaagcuagccugguaugcauauugaguucuagucccagucccacuaacaugaaaaaaacuuaccugaaauucaaauagaacauuauuaguguagagaaacuauccuauugauggguaauuaggaaacucuuagucagggaauguaacucagugagacagcauauguuuaugaggccuuggguuucauucccaauaccacaacaaaauaaauaaauaugauauccugaaaaauugauguuuuaaaagcauugcuuuuaguauauuaagaaguugaggauagucuuucacuuugguugauauaaauuauuuuccaccuaagcuuaccaaguguugccuuucccccucuauaccuacuaauauagcuguauucgaaucauuccuguguaguuucuauuaagguaaaauccuauauuguuuauaguugaaagaaacuauauuuauaauacuugaguucaugauuuaucuuaaugaaauuuuguuuuuaggguuuuuuuuuauuauuaaagaaguuguuuuuuuuuuuuaacagaaauauguuggugaaguguuuaacauugucagucagcaaucaacagccagaccaggaugcauuauugcauuagauucuauuaccaagcuuguaaguauuauuuuucuucuauuuaucauuaaguaaaugaccuguauaugucaauuuauguuguuauuuauuuacuucagcauggcagaaaaacccaguugcuucauguuuuccaagaagacuucauuuugaauaaccuugagaagaaacgucugggaguagauaacauuuuauuggauucagguaagaagaauuuugauaugaugauaaguauuugcagcuuauauuauauagucaguaaaaaugaacuaauacaccucaaguuguauuucagguugguauuuuuaucauaaauacuacuaccuuuuucuucugaguaugaauuuauauucuuauuuauauggucugauaaaaguagcuuaaccuugccuuaaaucccaugcucaagcuauccucuugccucagccuccugaauaacuugaaaacagccauacaggccgucuccuggcuuagcuuuuuacucuuaaccaggaaauaggaaaaaaaaaaaaaaaaccaacaaaacugaaauaccacaaaucaaagcaauuaacuguuccucgguuguauguuacuuuacucuuaguucccaccugcugccuggucuccuuccaagauauuaagcuaagauugagccuuaccccuagcccaguuucauguuacuuuaaguacacaguagguggagucuguuauugccauaguaagugagugagugagugaaugcucuuuauauggauguauuacugacuugaauaauguagacaccuggcuuuucagaagcccauaauuuaaauagauagauagauagauagauagauagauagauagauagauagauagagauagcuagauaugucauuaaacagugucuuaauauaaauauuuauuaguaaaaccuggcuuuccagaugcccauaaucuaaauaaauaaauaaauaguaaugccauuaagcagagucuuaauauaaauauuuacuaguaaaacauuuauaauaaaaguuaacuuuuaauuaaauucuaccaccuaaccuuauuguuaucuuacaugaaguaaaacugagaaaauagagauaaaauuucuugguuauuuaauuacagaggcagaccaaagugcguaaaauuuuccugaagacuaaaauccgaaguaagcaauuacacuauguuagucaagucaguuauuaagucucagauaacauuaauuaauaacaugacuuauuuguucaaggauuucucuuacaauacaugguuucuuccguguuucccacuucucuucugagcagcacuccuuagagcucugcacacuggcaguuucuuauugugcuuucaguucauguuucaugguauucccugagcuuccaugaacuguaaaagcacgcuuuuuucaugugguuuuguaguucuggacauccuggccauuuguuaaaaauaaagggaauacagggaugguaagcuggcucagacagagaaaugcuugucacauagcaugaagggucugagguugaucucuagaacucauguuuaaaaagcuggacacagccguacauugguaaugccaacauugcagagacagaugcauuuugaagugagagaccugugucaacauacaaaggagagagugcuugugaaagaguuuagcaucaaccucugaccucaacacacuuguacauacuugagcaucccccacccccaaaaauucuauucaagauugagagaaaaacaaacaaacaaacagagcagauaugcuguaaaucuugucaucugcuaggaggagguuaaagaagagaaaaauacaagccuuugaaaguuaguaucugagaaagcaaacauguccgcaguagaggacaaggaccacauggcaaggguagggagcaacuuaaggaaaagugagaaagaggaccagaguguugcagaaagcaugcccaggcuuugaccaguguuugaaaagaauagaaagccuugugagauggagaaugcuuuuaaucucggcucuugugaaucugaggcagcuagaaguuugaggucagccugguuuacauaaugagcuccaggccagacaaggcuauguagugagacccugucuaaaaacguugaaaagaaagaauaggcaaaaggaaaauuccaucagacuacaugacaaaguaaccacagugcugcaugauaguuggcccugcaaguggcuacacaugucugcauccuauuuuuaauaaauauauuacaaccaaaauuuuaaagggaaauuacucugcauuacaguaaauuuugcuaugcugcuuauguuucuaauauuuucuaagaaucuuuuauuuuaauuuuuucucuuuaaaaccaaauacaugaucuauuauuucuuaaaauacucaaggaauuuuuacugauuauacuuuuuaaaagacauuacuuuuauuauuauuguuugccggaaaauaccuauggaguuauauuuuuaucuuuuguucuaucaagaaaaauauuuuacaaauacuauuaucaggguauucuuuuguuuuuauuguaaugaucaaaaauagaaugauuggucuuauccucucuuuucuuuuaauucuuauaguuugaguagcucacuuaaacuuuauuuucagacuuacccuuugaguuaguccccugauacagaaagguuuaagauucuuagaauuacuuucuaggacuacccagugagguugguuugugucugucucccccagugauugugugugguaucucgcugugaacaguuccauagugauaacuauaauagggauuguaagguuaaaaugcucaaaguaaauauuuaaaauuuagaucuuggaaaugcaacuugcauauagcauguauauaauuaaaauuucaaauuaaugcaaauucaugugcuaaugacccauucuguaaucugcuuugcauuuuaaaguuucuuucuauuaaaaaaaacuauuuuaacuucauauauuauguauaccaucucauccaucugucuuaaugaaaaauauuccugaugucaacagacagcucauguaauggauuuucugaaaaguucuaccugguugugauagaguguacugaagacaaccguucacuguuacgcaugugggauuuacacuuaaggucaacuccugucucacuggguaagucuacuuuguuuuuuguauauucagauagaccugcacuucaagaaaguauacauacacaaguagaaaacuuuaggccuuuuuuauuuuaaagaaauucauuuuuacuugauuacauaauucauuacacaauucaugaaauccuacauauuuaaccgagaaacaauuuuacaaacuaacuauauguauucuuauacguaauauuaauauuaauguauauauuaauuauucaaaguaauggguuuauuauuaccuuuucguauauguguauaguuacuuggccauauccuuccucucacccuucuucuuccuccuccuauuaucuuuucuugaaccuaucuuccuucccauuguuuauagagugaguuuugaaaccauuuuuauauacugcugauaauuauaguuuauuuagaauacugaaaguaaaacagcuuucuuucuuuuuguaaauagucacuaaugugucuacaauguuaucuuuuauauuucagcuauuuauuuaaaaguagugauuacaauacuuauucguaaaggauucccucccagauuuuguuuuuguuuuuuuauuuuauagaugaaagaauagacacaaaaauaucagaagcuaguuggcuaccagaagaacauuauuccucuucuccagagaagauucuaucuccauuuucacagaaauuccaggcuugcagagcuaaucuccagaguaccagcaaauugucucucuucucugaaaugguauacagcaaagaguuggauuugccagaaggaguugagauaauaaguguuaagccuucagcagguuuguacaauuuaccgaaagagacuaauccaacuuuguaagccuugaaugcuuaccaggguuuuaaaaaguaaauacuguaccucacucugaaguacauacaaagcaguauguacuuugaauguacauugaagacuuacuauguuuuuagguuauaugacauuugucagccaacucuauuuacuuuucuuacugcuuggaguaaauaucugaaaaagcaaccuaagaaagguuuauuuuggcuacaguuccaagguaaagacuaucaucgaaggaacuugaacugucuggucacaggaaacagaaccauacauacauggaugcuggugcucagcucaguuuacucuuuguguuauuuacuuuucuauugccauaauagaucauaccauugaucauaggaaacauauaauuagacuuaacauuuuagaaacuuagaguuuuaucauggcaggguggcaggacaguagggcagcaagcagcagcuugccuggaacagcaacugagaauucacaacuugaaaagcagaaaacagagcacacugggacuggcccaaguuguagaaaaccuuacagcuucaccuucugugacacuuccagcacagccacucuuccuaguccuuacaguucuaccaacugggaaccaagaauucagauauuccagccuccaugagccuuucucauucaaaccaccacacucuuuuguucagucuaagaaucagcccaucgaauuguuuuaccagguuuagagugggucugacuuccauuaauggaaccuaaaaacucccucagaaacuugccuagaccuuuguuuccauggugacucuaaaguugacaaaguugacaaaacuaucacauuagacaaagugaaaguuuauaggugguuacaaacauuaccccauuugccaucuauuuuaguauuuauaguaguuucuggagccaugugcuaauaagauagaccauucaaggugccugaaucaucaccuuuauucuaaggcaucauucagacugcauucugagaaugcuaucucuggaccuggagcagcagcauucugugaacuuguuagaaauaaaguuacugauuugugcacaguggcuuagugcccaguuaucuaauaagcauuucauguauuugaucuauguguaucaauaauauaaaacaaaagucuuuauuuuuggacugcuuauaaacaggaguaucucaaaguggucuuaaauucuccaacucacucauuuuauucagccuuccaagugcagggacuguagucacuccaaacuauucucaaucaccuauuuauuaaguaaucaaauucuuaugagaguaugacacuuuaucacaaacacuagguuagagaccagcaagucugauguaaguaacaaguacuguggugacuuuuguguuuucagguauagagucagugugcuaagguucuaaacagugguuaucaagcuuucuaaugcugcaacccuguaauacaguuccucauguugugguuaccccaaccauaacauuucauugcugcuucauuacuguaaucuuguuacuguuacgaauuguaaucuguguuuucugauaaucuuuuggcaacucgugugaaggugguuuaacucucaaaggggcugugauccgcagauugagaacgacuguucugagacuaccacuacagcacccaugguuuuagucauuuauucuuccauuuucauacucaaaguaucuauuugcuuuuuguuuguuuguuuguuuauuugcuuguuuuugcuacuucucauuccuuuaacugauugcuuaaaguaagaacuuuuuucuguuucccaaaugcuaucagguacuuuaaucuuuugugaaaggugaaauuuuuaggaguuggguuguuaacgauauucuaacuaauuuuuauauuaugcuucuacauauuaaagcaucaguguaaagaaaauuaaaacuagaaaaagaauaacuuuaguauugacauaauucuguuauucuucagaacagcaggucuucguuauuuaacuccaauuaaaguaaaauagcaaaauagagaaacaaagauacuuaucauugacaauuuuuuggucuaauuuaugugggaaacagguauuuguuuuauuucauaaaagcagcaugcaaucaaauccgguuuauuccuguaauucccacagcuggaaggcgaaggcagaauugcugcagguucagugcuagccuggucuacauacccaauuccaggacuucuuguguuauaugaggccauacuaaaaaauaaaaagguguuuagggagcauauggugaaagcuuuucuagggugagauuuguuuauuuauucaguaaauugucuuggaaaggauuaaaaauguuuuuauucaguuuaaaggaauugacaaugaccuuaaaggaauuguaauguuacauuugguuaaggcuuuaaaguuacauuaguuaagaugauaugugcucuaaaauaugguauagagccuuaugggauuguucaguggauaaagguguuugcuauuaggccugacaaucuguuaaucuacuguuaaucccagaacugacauucagcaucuuuccuuggucacuuguaucuuucuuuaagauguauuuuaaauuaugcauauaugugugggguaugugcaugugaaugcagguaccugugaaaggcagccugauucucugaagcuugaguuucaagugguugcaaacuucuuaguuugguuacugagagucagacuuaagccaucuggaagaauagugugaccucccuuaccugcugaacucucucuagcuuuccuccuuuacuuuuugaggcaaggucucucacugaaucugaagcucaaacauuuagcuaggccaauaaucagccaaacuaccucuuucugcccacuuauuucuacuccacaaggcuaaagagcugcuauucccagcuuuucuuuuuauaucccuaacuguuauuuccuuccuuaaauuccauuuauaugcacuucuaccaugucucuuuauuuuuaauaacccauuuaguccagucagugcugccuauauaugcacacauauggauauuggaauccuaccaaggucauuaaaagaaugauucucuguccuucagaaacuuaaccaauuacucauagcuccucaauaaggaguaguaccuagauacuaucuacucaccacugccagaauuucagcuguuuugauuuuaugcaaguaaccacgggugauuuuguucaugagugugauagccaugucauauccagaauauagcauuucacaaagcucccccuccuccagcugacucuuagagucuccugccuucucuucagugauguuccaagagcugagaagagggaacuugauaugggcugagcacacagucucuuauuagcacuuggaccaauugugcaucuuuccauagacugcugcccgcugcaaaaggaggugucucugaccaagguucagaguagccuagguuauagauauaaacagagauuuaaccacaugaccaccuaauaaaauaauaauagcagcuacuacgccuguucuuuugacuaggauuauuguaccagacaugaaaugucuuccuuuguagcagacuucagauccuaucaguaagcauuuaguuacccucgcugauaggucaguauucugacaagcaugguccagaguugucuugucucacccaguauccugcacagcauccucauacugugcaagcucaccaccauagaggaauuuuucuacucaguuuuagacugauuccucucuauccuaaaccaguguguacagugucuauuucauugugguuggucaucaagugcaucaucauguacuauuucguagacuucuaaagccuuucugacaaugacuaguagggagguauaccauaccuugcacugucauuuuuauuuaauagacuauauauucugggagugacauuguucucauauguaggauaagugcauuugaucucuuuuaaguugguuuuugacaauuagcuuacuaaccaguguguuucaugcucagcuuuucgcauggguucuaaauacucaaccucagauccuuauacuuguacaucagacacugagucaacugagccaucuccccagcccaguuaccuacauuuuuaaauaaauuugguaauauguaguuauaaucauuugucuacuauugcauauauuugauuuuauacaaugaaaaguugaguagcuguaauagagaacuuacaucugccaacgccugaagucguuaucacugucccuuuaaauuugacaaucuauuuugggaaacuaauagaauauauaauuuguuuaagucugauaaaauauuaaguuucacuuaggaauaaauuagugcuauaaauauacuucaguauuauaagacuuuggggauauaaacuaaauauuuagaagacagcuuaaugauaugucagguuaccgaaauaauaucaguucuccacucgggacuaacagucaccaucaccaugugguuuugaugugguuuucaguacuaauaagagaagucucuauuucuagugauuaguggucaacguagacccauggcugcaccaaguacugauaguaaaugguagaugaguguucaaaucuaagaaauauauuaucucccccuaaagcucagggaaaauugcagaaggaggcgggguguaauauaaaacuagcagauaggaagaaggcugcggaaugucauucugggcaagauaaauuuuuggcaauuguaggugcccauacaggguuuguauauaaaugagucucucaucaagucaagcauggauggaggagggacuguuuuccacugauagggucagaaaggggauaucauugccuucaagggcuccaaugguaauuuuaauccacuagugaaauagauggccuucuuuaauaagcuagauggaucaaaaaacaaaauugaaagccgugagccuuggaaagacacuggugaaugugaguggggagugggugguagugauggaagggagacaagagaaggugaggaguaugagggagagaaucagaauguauuauaguacaaguguacaauuuaucaaauaauaaauuaauuaaaaagaaaagauaacaaaacuguaaagugaccauuuaguacuuagauaaggauuggccgucauacuguuucucucugugucugucugucugucugccugccugccugucucugucucugucucucugucucuguguguguggcaugugccuguguguuuaaacacauaugucaggacaacuuaaggaaguugauucuuuucuuccaucaugucuguucugagaauuaaacucaagauugucaggcuuggcagcaaguauucuuacucacugugucaucuugacagcccuguaguauauagcuuauugguaucauuaaaagccagguuguuaacaucuuguguuuuuuaacacauuuucagcaaaacagcuaaaacuuuuuuucuauuuauuuauuuauuuauuauauguaaguacacuguaguugucgucagacaccccagaagagggagucagaucuccuuauggaugguuguaagccaccaugugguugcugggauuugaacucaggaccuucagaagaacaguugggugcucuuaccugcugagccaucucacaagcccucaaacuuuuaauacauagaaaauauaaguaagccaggcaguagugacacaugacuuuaaucccagcacuugggaggcagaaauaggugagucucuugaguuugaggacaaagugguauacagagugcauuugagaauaaucaagguuacacacagaaacccuguaucagcaaaaaaaaaaaaaaaaaagaaaaagaaaaaaacccaaagggggggaaaaaaacagucauuaccagaauuuuuaaugguucauuuucuuuccaggacaccugaguucaucuuccauauauccuguuugcagugccccuuauuuauuggcaacuucaugcucagaugauaaaguaagauuuuggcgaugcagaguaacgaauggagaaucagcaacaucaaagaauggaaaacuagauguuguguauguuugggaagaauggccauuacucauugaagauggacuugagaacaauaguaguguuacugucccugguagaccuguagaagugagcugugcacauacaagucgcuuagcaguagcuuauaaacagcccacugguaauaguagaucucaggaauuugugaugcauguaaguaucuuugaaugugagucuacaggaggcucauguuggauccuugagcagacaauucauuuagaugaguuaaguacaguguuggauucuggcauuaguauugauagcaauuuaguggcuuauaauaaacaggagacauauuuagucaguaaagaaaguauuacaucaaacacaaaacauuugguucacuuagauuggaugucuagagaagaugguucucauaucuuaacuguagggauuggcucaaaacuuuuuauguauggaccuauggcuggcaagguacaagaucagacuggaaaggaaaaccaggcauuuccucucugggacaguacuaaaauuguaccucuuucuaaauuuguacuguuacgaaguguggacuugguuucuucuguagaaggugccccaccuuuuccuguuucuuuaucauggguccgggauggcauccuugugguaggaauggauugugaaaugcauguauauucccaauggcagccaucuaauaaacaagaaccuguuauaucagagucauacaauggaagcacuccaucuauacuaaguuuaauaaaacaaaguaacucaucaaguucugggcuacauccuccaaagaagacucugacucgauccaugaccagucuugcacagaaaaucuguggaaagaaaaguauauuugaccccucaguggauauggaagauuccggucucuuugaagccgcucauguacuuuccccaacuuuaccucaguaccauccccugcagcuuuuggaacucauggaucuuggcaaaguucggagagccaaggccaucuugucacaucuugucaaaugcauugcuggggaaguuguggcucugaaugaagcugaauccaaucaugagcgccgccuuagaucucucaccaucagugcuaguggaagcaccaccagagacccgcaggcauucaacaaagcugacagcagagacuacacagagauagacucuguccccccgcuuccuuuguacgccuuacuugcagcagaugaugacagcuauugcucaucuuuggaaaaaacugggagugagaguuccuuaaagaaaucaaaacaguuaucaaaagaaaguuaugaugagcuuuuucagacuucaguucugaugucugauaaucacauguuagaaacagaugaagaaaauacucagcccagagucauugaccuuucacaauacaguccaacuuauuuugguccugagcaugcucagguucuuucuggccacuuacuucauucuagcuuaccagggcucaccaggauggagcagaugucuuugauggccuuagccgauacaauugcaacuacaagcacugauauuggagaaaguagagacagaaaucaagguaaaaguaaauucuguacaagauggaaagaaaaaagauaguuuuacuuguuuuuuaagaguaugaucuuacauaaaaugauacggugccuuuuuuaaaagcuaauauaaaaauuugguuuuuuuuaacacuuuuaacucugauaaauaguuuagucuguaaauuauaguacuaugauaaaguacacagacucauaacauaacucauaacucaucauuaaugaucugcuugcuacaaaagauccagcugaauccuuaugaguuuagcaaaaguacagauuuuaaauagcagaauuuaaguauuucuguuuuuuuccuucugugggaauaauccacuguaaaaauuuagagugauuaaggacuuuucagaaauuaccauuauuguguaugccuaccuagaauaacaaauauaaacacagcaaaaugagaucuuuucaucacuuagagaauauuuuuuuaaucuaagguauaaacaaauuuaaauggaaauuuuccauuauaucucaaagcuugaaauuaauaaauuuauuauuuuaacccagauauugguuaguaggauuugccauugaacuaagcuuggcccccccaaaaaaaaggauucaauuugacacaaaaauuuaauaaaaguuuuuaagaaaaauuaguuuacacuuuaagggcaucaguagugguuacuaaucuuauuugacuauguuauggguaauuuaauauguuuaaugaauauauuguuauuuuuaaucauuuaaaguaaaaaucaggacucaauuuucauacuguuagcaaaaacuauuuccuccaguguuacagcugaauccuagaaugcagauaugacuugaauccguguaguaaaugacauagcacagaaaacauaaacuccuuaaaaauaaaagguucaaaucaaaugcaguuggauuauaaagaauauuagccgggcgugguggcacacgccuuuaaucccagcacucaggaggcagaggcagguggauuucugaguuagaagccagccuggucuacaaagugagcuauaggacagccagggcuauacagaaaaacccugucucaaaacaaaacaaaacaaaacaaaacaagaauguuaauagacucuaaaucaauuuauucucaucuuuauuuaacuuuacuuacuuagucaugcucuuuucccuauaauauaaaaauugcuuaguaaaaagaaauauuagaaaauauuuaagaguaacaaacauuuugccaguuuaagaauguuuuauucuuauaugugguaguugugacauaugcugauucuacucauuuuuuaguauuuuaugcuuauaaaauuauuuuuuaaauauuuuuuuaaaaucacaaacaccuuuuuuuuuuucuggucauagguggggaaacucuagacgagugcggauuaaaguuucuuuuggcuguucgacuccauaccuuucuuacaacuucccuuccagccuaccgagcucaacuccuucaccaaggugauuuugauaaucuaaauuuacuuucccguagauuuugaaguauuaaacauguuuucugcauauuuacugguaauucauauucuuaugauuaaugucuuuggaucauuuacugacuuuuuuaucuacuaauauauuuuuucucacauaguauauccugaucacauuuucuccuccuucuauuacuuccaauuccuccccacugcccucccaaucuggaucuacccccuuucugucucucagaaaacagaaacaggcuucuaagggaugauacaauacaauacaauacaauacaauacaauacaauacaauacaauacaauacaacacaaaagauaagacaaaauuuaacacauucaaauaagacaaaacaaagagaaggaaagaaaaaauuacacaagaaggagauauaacugcagagacccuacccauuuacaugcucagaaaucccauaaaaacacuaaacugaaagccauaauucauaaucagugggcuuaaaauaaaagugaaaaagauaauuaaaaaaaagaguaauaaugucccaacaugacauuaugagacacagaaucuccaaagauguaauugaguucauuuucucuauuuucuauugaacaucuacugcugugccugcagccuacccucaagaauaguuugugucccuagugagacuccuuuggaggauacuacauuuucacuugcaaguggaugucaauuggagauagcuucuggguuagggaugggagcauguguccucuucuccuuucagcucuaggacccaaucuaguacaaacccaggcaggcccugugcaugcugccuugcuuucugugaguucaucuguguguugaucuuguuaauuuagagggcuuuguuuucuauccuccaacccuucuggcucaugacuuucuuccuccucuucagguacucugaccccugaggguuugauagcgauaccugguuuagagcugaguuugacuguuugacuauggguaucuauguuuguaucugcugcuggaggaagcuucucugauaaccgagcaaggcucuuaucuauaguguaaugucaugagaagucauuuuauugaaacauucuuuuaguaaaauauuaguauuugcuuucauccuagguccccaugcuauguagucucagguucuugaucagaaccuaaucagagucgaguaucaguuccaucucauggaguauugguugguuacuccugcaagcuuugugccaccauugcuuaguguaucuuggagucaagacacuguuguagaucaucagguccguaguuggguuggugcuuaugucuuuucuuugguagcaugcagaguacuuuuuuuuagcaaagacaauaauauauaggggugaaugcucuagcuaagugcuaguuuaacuuuucuauguccaguaguuauguagguguugucuucugcggugccaucuguuuguugagaucauagucuuggugucaguauggguuuggggauuccccuuuggccaacaacccaauuagauauagcccagucccaauacuggaaaauuaauuuugugacaagagauguccaguugagacauugucucuccauuauuugauuuuacuuagaucauacuucuuaaugccacauacuuguuucgaguguaauuuuuuauuuuucuugaggagcuuucaagugugcugcuaaguuacuuguaugagaucucucccauuuuuuuagguugaaacagugcugugaauuugccucuuagaaccaccuuugugucacauaaauuuagguauguuguguguucauuuuuguucaauucuagaaaaucuuugauucuuuuucuuaaguucugucuugaugcauuuuucauucaguaaugaguucauuuuucacagguuucugaguucucuguuguuuugauaaccaccucuaaaugauggugguacgauaggaugcauaguauuucagucuucuuguauguguugacauuugcuuuguguccaaguauguccucaguuuuggagaaaguuccuugagaugcugauuggaaggaaguauuguuuuguguuugggugaaauguuguguaaauaccuguuugguccauuugguuuauaacaucaguuagcuccaucauuuauuucugcuugaguuugucuggaucaccuggguauugggaagagagaaauugaagccuccugucaguaugugagaauugauaugugaauuaagcugugugucuuuuauaaauuuggguacccuuguguuuggugcauugauguuaagaauugacaguguccuccugguagguuuuuccuuugacuauuguagugucuuuccauaucucuucugauuaguuuugauuugaagucuauuuugucagguuuuuuuuuuuuuuuuuuuuuugcuugcaauaucuuuuucuauccuuuuauccuuuggugauguuuguccuugauguuaagguguguuucuuggauuuaguagaagaguagauacgauuauuguauccauuuuauuacuauguguguuuuuauugggaaauuaagaccacugauguuaugagaaacaaaugaucaguguuugguggugguggugguggugugguagugugcugguagugguggugugguggugugugguguuuauuucuuccuuuuuugauuugcuagcccaggauagauuauuagguuuucuugggugugguuacucuuuagcuugggguuugcuuucuguaagaauggauuucuaaauagauacuucuuaaauaugguuuuuaccauggaaugucuuauuuucaccaucuauugugauugacaguuuucugggcauaguagucugggcuagcaucuguggucccauagagucuuucaggauaucugcccagucccuucuggcuuuuagagucuacauugugaagucagguucaauucuaguaggucuacauuuguauauuacuugguccuuuucccuuguagcuuuuaauuuucuuugguucuugucuuagucaggguuucuauuccugcacaaacaucaugaccaagaagcaaguugaggaggaaaggguuuauucagcuuacauuuuccacauugcuuuucaucaccaaaggaagucaggacuggaacucaagcaggucaggaagcaggagcugauacagaggccauggagggauguucuuuacuggcuugccuccucuggcuugcucagccugcucucuuauaccagcccagagauggcaccacccacaaggggaccucccccccacccccacccccuugaucacuaauugaggaaaugccccacagcuggaacucauggaggcauuucccuaacugaaguuccuuucucugugauaacuccagccugugucaaguugacacaaaucuagccgguacauuuuuguaugccuagugcuugauuuuuauacucugaaggaauuucuuuucugguccagucuauuugaugcucuguaugcuucuuguaucuugauagacaucucgucuagauuggggaaauuuucuucugugauuuuguugauaauguuuucugugucuuugaccuggauuucuuuucuuuccucuauuucuauuauuuuuagacuuggucuuuucacaguguggcauauuuuccagagguugaggauuacaacaguugguggucucaucugaccagcucucuccuggcgggauuuggguauagagauuuguggcacagggucagcuccaggcuguugguaacaugcagaauuauagguuguuuuggccugcuuugugcucugcgagugucugugguuuucauuaauuucagccacuauugcuugagaaauuuguucuccuuuuccuccugcugguagcucaacuauacuuaauaacaaaaccacaauucuucauauucuuacaguuucauuugacuguuuugagccugcugaugacuucauugguggcauucuuguuugguugguuuuuuuaaagauuuauuuauuuauguauaugagugcucuauuuguauguacaccugugugcagaagagaacgucaaauccauaugguugcugggaauugaacucagaaccucuggaagagcagccgaugcuuuuuuuuuuuuuaauuuacauucuagucauugcucccaucccccaguccucccuccacaguuccuuauccuauuccuucucccccuucccaucucaccaggccuccccacuucgcuggggccucaagucucuugaggauuaagcacaucucccacugaggccaggccagguaguccucuucuacauaucugcuaggggccucagaauggccuauguaugguccugguugguggcucagugccuaggagcucccugagguccagauuaguugagacuucuggucuuccuauggaugggguccuuucccuaauucaaccggagggaucccugacuucaguccaaugguugugagcaucaguaauagugucuggccuucaugucccucccccacccuuaaguuugauucccaaguugggcuggucacuggaccgccauucccucagucucuucuccauuuuugucccugcaguucuuuuuuuuuuuuuuuuuuuuaagauuuauuuauuuuuuuauuauauguaaaagacacuguagcugucuucagacacuccagaagagggagucagaucucauuacggaugguugugagccaccaugugguugcugggauuugaacuucggaccuucagaagagcagucgggugcucuuacccacugagccaucucaccagccccccugcaguucuuuuagauaguuuuuuucuaggucaaaaauuuugacugguuuacuaacccaguuccucuacuugaggcccaucugucuucuggagguggacucuuugaguuuacucuccccaauguuggguauuuuggcuaaggucaccuccauugcguccugagagucucucaucuccugggccucuggcacuuucuagagaguccucccacccucuccaccuagguagcuuauuuucauucagucuccuggcucucuggccuucucuccuguucccccaccccuccaaagcugauccuuuuccccuuccucucuccucucccacacaggccccucccucccuuuggccccaugauuauuuucuucccacuucuaagugggauugaagcauccucaugugggcucuuaacugcugaguuaucuuagccccacuggcauucuuaauauacauuuugauuucuacuauuuccuuuagauauuuauuagcuuuuccaucugcuuauuuuuagugauuuuuuaaaaauaaagguauucuuuauacugcaugccaugcagucauccuuccaauaagcuuauaaguaaacagcacaauauuauugaccguuguauagcagaugccuguagagcuuauucaucuuauuugguaaaacuugcugccuaaugaguccccuccucucagucacugcaaccacaacucuacuuuuuaauuccaugaauuuuuuucuuugaaauaucucuugugaguagaauaauacauuuuaucauuaaugugauuauuguuaaauuauuaguauaauaucugcaaaucuuauuuguguuacacauugcagaauuucguauuucauuguguauguaaaucauaguuuaaaacccauucuucuguagaagcacauuuagguuguucccauaucuugacuauagugaacccucuagcaguaggaauagagcgcuaaugucucaucaaugagaagaaauuauucuguaguauagauuaaaaaugugaaaccacauauguuaaaaucuuaugacaucauuuauuuugcucaauaauacuagaaaaaaaaauguaguaugaaaagacagauucagggcuggagaagauggcucagagguuaagagcacugacugcucuuccagagauccugaguucaguucccagcaaucacaugguggcucacaaccaucuguaaugggauccaaugccaccuucucaugugucugaagacuuuuccugaaacaaagauauaaaucugaaagggaaggaaggaaaggagggagggagggagggaggggaaagaaaaagggaaaggaaagaaguaagaacagaaucaaaucugagcaauauuacauguacugaucauuagauuauugacacagauguuacacaucaguauuaaaacaucaauauggucgagcagugguggggcgugccuuuaaucccagcacuugggaggcagaggcaggcggauuucugaauuugagguuagccuggucuacagagugaguuccaggacagccaggacuaaacagagaaacccugucuuggaaaaaaaaaaucaauaugauaaaacagcauaauaacaauuguuauggguuagguuguauucuauauuccuuuauuuuauuauuucauucaauccuuaaaauuguguaauagcauaguguucucauuaugcacauuuuugauguuguuuuguuuuuuugagacaagauuucuuuguguagcccugguuguccuagaacuuaucuuuguagacuaggcuggccuugaacucagagauuuccuguuucugccuucuacguguugggauuaaaggcauggaccaccaccaccagacucucucucucucucucuuuuuuaaugaucuguucauuuuuauuugucguugauguuuggccugcaugugugggugaagauguuagauacucuggagcugguguuacaggcaguugugagcuuccauguaaguggugagauuugaacauaaguauucuaaaagagcagccagugcucuuaaccacugagccuucucucuaauccuuuauguacauuuuuuuccauuuuuuauuagguauuuagcucauuuacauuuccaaugcuauaccaaaagucccccauacccacccacccccaugaaaucuugagucauuaaaaaauuaaguaacuuucccaaggucauauuuuuuuaauaguucucagauauaauguguauguucuaauuugggaguaauaaauuguuauacuuaguuggaguuuuacuuuuauaugauugaaaggaguucuuuaauucugucugugcuauuagaacaucuaaaaaagauguuuacagagaaaagagaagcaauacugaagaaaaagcacaccacuauguaguaacagcacuucaagugcuucugauagucucagccaaacugugagagauagccauagaacaaaauacugcagcccagugacauuucccauaaguauuuuguugguucaaagaaauagauuuuaauuaugugcauuggagugguaucauuuguuuagagaaucaagaauaaaaauaacucauaguuuaggaacaauaaaaguuauauguaacuaugauaaaaguuugaaagaguacuucuuauugacccauguaacaaucugcagaguuaguaagacagauauuuuccaagggcaaaaggcuuguucugagagagccaagacugugcaccagagcaucugauuuccaguucagacuuguuaccaucacaguuuuaaguagccauagauagaauaugccuagaaauguuuucuuaaaucauaaacgcaggauuuguacuuaugaugaugguuccuuaaaauucuguccuuuccacuuagacuuuaugcuauauccaagauuuuauucuuaacauguuaugauaaaaggagucugcaaaguuaaagaauaugccauauuacucuguauuuuaagcacccaguuuguuuacuauguacccugacauauuaaaugagauuauuuggaguuauuuaugccaauauuuaaaaauuuaaaacaguuuauauguuuauugcacaaauaucauauacauuuaugaugaucauauuaaauauuugcauugcuuuuaaaugucauuuuuggcuuuuccucaggccuuucuacuggucauuuugcuugggcuuuucauucaguagcagaggaagaacuacugaauauguugccggccaugcagaaagaugauccaacuuggucugaacugagagcaauggguguggggugguggguucgcaaugcucgcauccugcgcagaugcauagaaaaaguaagaauuuauuugguuauaaaaauaguauauuucgaauacuuguuuaugucauucugucuccucuaauauuaguuuauucccuuuuguuuuagaaacagcuucauaguuugugugugugugguauuggguauugauccuggugcuuugugaaugcuaggcaagcauuguaucagugagcagacuccccagccuagccuacuuuggguuuuuuauauuuaauggucucacacugguuuucaauguauaauccuuuugucuaaaacucuugaacuguuguaauucuaaaccucagcugcuagaccuagcuauccucaaacucuaguuuuuaaucacauuuauuuacuaguguauuuccgaauuucugaaguguuuguugaaaaaaauacaguaguuuagccauauauauuuugcuaccauaaaugcuucuauuacuggaauuauguacaacaguauuuguacacuucuuuaaauuuuaacauagaaauaacacauacuaaucuuguauguaagagaaauuauuuguucacucacaagcuacuucuguaaacaauugacuacuguuucccaauuauagguagccaaagcagccuuucauagaaauaaugauccuuuagaugcugcaauuuuuuaccuugcaaugaaaaaaaaagcugugauuuggggauuauauagguaaguaaaugacugcuucccagcucgaagucacucuuuacuuuaagugaaugcguaaaguaaaauaugcuuuuagugauauguuauuagugcuuuuguguuucauacuucauugggaaaaaauuacauguguacuacaguggaagaaaccaguugaugccccuucaguuuguuuuagcauuugucagucuaaaaacauauuuucucccuuauuagcuuauucuagagacauuucccucaucaccaagaaggagggaggaaagaaguggaauagaaaaaaauuuguugagaugaauuuucaucagcuuucuggaacaugguagauagugaagucuggcaucugucagauaagcgucuuuccucuguuacugaaggacauggaccaggaagucccugaaauuguuacucuugaugcuguaucuuuuucaucucacuugucaacagcaccuggacuccaugauuuccauuguuuguuugauguccuguucaagaaugacaaucucuggggaaauuuuugauauuuaauauaaguuuccuaagaaucuagguuuuucaguauuauuuucuaucagagcagguuccauuauuugaauuuuggacuauguaagucauuucuacaugacuagaacaauauuauugaagagauuuuaauuuugaauuagcauaaauguuaauguauaaauuaucuuuguauaaguauauauuaauaaaauuuugcaugaguuuaaaggugauuuuuuucugaguuaugcuaguauacuucacuuugcaauuugaaagagaauuuuuaaauaacuucugugguuuaccuauaaaaguaaauguuuaucuaaucuuaaucugcugguaaagauguagauacauuggaauuucugaacuggcaaaaguuuuguuuccauuguuauaacuuuuaucguaacuggaucuuggugugugcagacugucuucaaauuugcugucuuucuccuugaaacuccuaacuuuaauguucuaaccggaaaagggugauuacaaaauuggauuuuaaaauuuucauaacuuucauucauuuauagaucucaaaaagacaccaaaaugacacaguuuuuugggcacaauuuugaggaagagagguggcguaaagcagcuuugaaaaaugccuuuucuuuauuaggcaagcaaagguuugaacauucugcagcauuuuuucuucuaggugguugccucaaagaugcaauugagguaauuaguuuaacuucuuuuucaaguaguguuaccauuucuuuaaacaaucuaaaucuuaaauuuuuauuuuuauuuuuacuauacuagaaauaauacaaggcuaagaacauaaaguaacugauaagauuucacaguagcuuuuuuauuuuuaccauguagcuuaugauauuuuuauauaacugggauaaagcagauuuuguaaaguaaguuacucauaugacugcacauuuuaaguauauuuggcucuuuuauuugguggaguuaaaaaauagcuuuuuaauuugaaaacuacucugauuagaugaauugaggagaguugaaguuuaagaggaauaaaauaaaauuauagguuuaauugaaacuagauagaauuauccauuaccucaggugaaauuaguuuauaaauacauguuuuaguaauaacauauauuuggagaucuuaucaguguuaauuuacuaauguagauaauaugcaugccauuauuacauuuauuacuugcuaaauuuggagauaacaaaucuuuauacauuuauaguaaauaaauuaaguuucuuccaaaagcugacuuuguuuauaaauauuuuuuauuuauaaauguuuuaaagguaugucuugagaaacugaaugacauucaguuggcucuuguaauagcaagacuauuugaaucugaauuugauaagucagcaacauacaagucuauuuuacgcaaaaaaguuuugggaauugguucuccagccagugagcucaguucgucaagcauaaaugcacaucaugaccccuuucuucggaguauggcacauuggauuuuagaagauuauagugcugcucuggaaacauuaauaaagcaaccaguuacagaggaugaagguaaggugcucuugcaagauuuuaauaaaaacguuacugguguuuucucagcaugugguccacuguuuaacguaacauacaauauuaaauauuuggucuuugugacuaaaugggguuuuguucuuucagaaagauaaaccauuuaaaacaaagaacuuuagacuuucuguuuuuaugaaauguauuaaacaucaguauuaccaaaauuuggauuuuaaauaugguaaauauaaaguguaaaaauaugaagccaauuuuuaauauuagguugggcuauuacacuuguuaaucaguuuuauaauuuuuacaagaaaaacauacugagcuuaaagaaagcuaacuuaaguaagaggugugauuagggaaccuuaaacuggccacauccuugacugguuuuuuccugugagcaguaggauagagagauuaaauguacccuuuagaacucuacuucugguuuucuuuuuuucuuuuuuugugagacauucuuauagccuacuauaaaaguacauucuucugugaauucauaaaaauggugggguuuacuuucccaggauuuuccccuaggcaggauugaacuauauguguagaugauauaguagugcauuauuuuaacaguaaguaaaguagcuucuaguucauguuguuuaaugugccacuacauaugugguuugugguacuuaggauauauguaucuuuuuaaauuaagaagaaagcuaugagacucaaguauucaagucucuuagccauguaagguaaaguuucauacuggccucuucauaauugaggggaaacaucacuuuauuaauauuguauuaaaauuuuuauuuaaaacuuacauguuuuucuguuuuuaaaaauaagugaauauuaaugcaagaucacauaucccuagaaccauguaaaucagagaaaagugauaguagugguuuaguucaugggcagugugagaagacuacaggcagagacaaguauuuggcuauaggauaacuuuaguguaguuaaaacacaggucuaaguuugauauggagugccgaagaauuagaaauuaacuccuggguuuuuagcuugacuaauagugaaugauaugauggaauguugauaaaauuaggaugccuucucaaguuagaugauauuuggucaaaggacugguugacuggcuuaaauaaugcaagucaaucaaaacagauugcacaccaaauaagcccacagggcaaaaguguuuguauuuaagugaaaacgaacuauggaacuuggaaagaagagauagagauguucaacuuaacagcauagagaugguguuuaacaucaugggauucuuaggagacagaauauagcuucuguggucagaaaagaugaggucuagacaagcugacugaagaggcagcaagcaagaaaagagcuaaggauucuacuugaagacuuuguuucacuuggaaaguaguauggccuuugguuaacugugauauaaaauauuguuuccucugagagcaaggggacucuuaugauuacauauucucaguuccuaucgugaaguucucuugauucaucaaauuaauuuacuuucagaucaagucaugaugucagccuguaauccuauaguuuuuaauuucuacaauuaccuaagaacacauccucuuuugcuaagaagacauuuuggaucaucaucggaaacauuuucaacacacaugacuuuagcaggaaaaaguggacuggcaggaacaauuaaucuaagugaaagaagauuauuuuuuacuacugcuagugcucaccuaaaagcuggcugcccaauguuggcuuuggaaguauugucaaagaugcccaaagucaguaagaaagcaaaaccguguuguagaggaucuaguuuuuuaacuaguaaagauucuucacuaaaauuggauguaagagaagacaaguguugugcugcugacuggucaccgucgcugacaaauggucuugaaucuucuucagaggguuccucagagaggcacucacauucuacccuuucuuuugauuggagccaaccgagugugguauuucaagaugacucuuuggaguugaaaugggauagugauaaugaugaagaaaaugaagaucccccuauuucaaugaaagaaauaagaccuuugcagagaaagacaguuaaagaaauagaugaauugagcaguuacacagacucuuuaagcacacuagaugaaaaugacauuuuaaauccaucagaagauauaauugcuguucaacuaaaauuuagagcauguuugaagauucucaccguagaacuucguacuuuaucuacuggcuaugaaauagauggugggaaauugcguuaccaacucuaccacuggcuugagaaagagguaguagcucuucagaggacuugugacuuuugcucagacgcagaccagcugcagaccacauuuagccagagugcagaugaaucuggaucaacugaggaugcugaugauuugcaucaccaaacaaaagugaaacaacugagagaaaguuuccaggaaaaaaggcaguggcucuugaaauaucagucacucuuaagaauguuucuuaguuacugugugcuucauggcucucauggugggggucuugcaucagugagaauggaauuaauuuuacuuuugcaagaaucucagcagguauguaccauuuuuguuuuacugugaggugagguguuaucauguaucuccagcuaauauggaauucccuauggagaccaaacugaccuugaucucacagagaucuuccuaccucugccucugccucccaaguacugaaacuaaaggcaugugccaucacacuggcagguauauaacuuugaacagucaaacagaacauguggaugaaaggagaggaauaauauaauuauuuuaauuaaaaauuuaaaagcuuuauuuaaagaaaagaauaauacauaucugaaauagcuuuugaaauugugguuuuuauuugaaauauuaaaacuugcuuuucuuuguuauaauuacguuaaggaaugaaucuuuguguguagucauuaggaauugguggagcuauguacaugacacuugcagaacagauguuuugacuugcuuaauuuguaugaacacagucuuaugagugccuucugagguaaugagcuauacuuuauugagggguguuaaggguauuaucguucuagaugcaguuguagaagcauuuuccuccucagaucauaacaauuuaaauauguacuuugagugcuuuuaauuuuuaauuuugaacacuuuugaaaguuacucugaauuacuuaaggaguagauuauaaauaaaaauaguuaacuuuuuuucucuucauuuuuaaggaaacagcagaaccaauauuuucuaacccuuugucagaacaaacuucagugccucuucucuuugcuuguacagccagugccaaaacaguaguugccaauccauuauugcaccuuaguaauuuaacacaugauauucuacaugccauaauaaauuuugauucaccaccacauccugauagccaaaccaauaaaguaaguaugcuucauuucaagcuuuuuuuaaaucagcauauauugucuagauaaaaugaugaauuuuauuuuaguauuuuuacauauuuauaagauauucaauuguauuuuccacaucuaccuucugugagaucccugcucuacuuguguauuuauuauuuuucucucucugguugcuccuuucuuuaagcaguccccuucugccuucaaguacuuauuuucugauucuaguugacuuuguuucuugaguuuaggcuuuauuugccuuuuuuggccuuaagcauucauuucccucuacagaaugauaaaauguuaauuaagccuuucuagcaaaauaaaugaaagcaccagacuagacauaguauuuacuguauuaaugauucugaguuaaggaaaucuggcuauaguccagacuuacugugcuacuuauaucuuauaggaugcuugaaugguuuuuuuuuucaguuuagcauaucaauuauuuauucuacacaaacacuugugcagcagagaugacuuaguaauuaaaggaacuuauuaccaaaccugaaaaccuucauuggcuacuuugcaugagagaagagaacagauuacuacaguuuguccacaguguguguguguguguguguguguguguguguguguguguguguguguguguguguguguguguguauuuaauuaauuacaggaguccaugcuguaucacauuauuuuuuccuucuaaaauaccuuuugcugcuuucgaacuauucugaaauagaacuggcuuuaauuugguuucauuguuggcgcauuguuuguuuugguuugagcuaacuuggcuagugucggaacucauucauucauucuucccuggugggcaacuagaugauuguaggacaacuuuauuuauuuucuugugguugacaagauuugaauauaugugucucaucuuuaaucagccagcaggcaagcccagugcauuaaacuggucucuccagagaaguagaagugauaggauguaggaaacgugguggaauaggaaaggaagaagagaggaaaaauuuguuuauaaguaauuugcaugugugacucucuuaauuauuauucuuuuguugugcagagacacccugaccaaggcagcuuaugaaagaaaagcauuauauugggugcuugcuuaaaguuucaaaggaguguuaguccaugaucauuauggcaggaaguaugguggcaggcagacauggugcuggagcaauagcuguaagcuuauauccuuaccuauaggcaggagcaaaaagagagagggagauaaugugcuuuauaugagccuuucaaaccucaaaggccaccacaauugcaaaccuccuccaacaaggccauacuuccuacuucuucuuaaacaguccaccaagugggacccagacaucccaguauauuagucugucugagccauucucccuuaaaccaacgcaguuacugugaagucugaguugcucaaggauuugcacaugguaagcuagugaauagaagaacugacaguauaguuuuagucuagguucaaagcuuaggaaguuaguuuuauuuuaaauuauuauuauuauuaauuuuucuucuuuacacuccagauuuuauuccccuccuguuccuauucccacccuccaacuguuccacgucccauaccuccuccuccugucccccuccacaaggauguccccaucccaccacacccccaccagaccucuaaacuccccggggccuccagucucuugagggcuagguacaucuuuucugacugaaugcagacccggcaguccucugcuguauauguguugggggccuguuaucagcugguguuuucugccugauuggugauccagugucagagaucuuggguccagguucauugagacugcugguccuccuacaggguugccuuccuccucagcuucuuccagcuuuucccuaauuuaacccuaggggucagcagcuucuguccacuaguugggcgcaaauaucugcaucagacucagcugcuuguugggucuuuccaagggcagucaugauaggucccuuuuugugaaugcuccauagucucaguaauagagucaggccuuggggccucuccuugagcuggaucccacuuuggaccugucgcuggaccuucuuuuccucaggcuccucuccauuuccaucccugcaguuuuuucauaccagaacaauuaugggucagaguuuugauuaaaagagcucauauaucaguuacauucuguagguagggaaggaaggaugaugaccaaaaaaaaaauguauguauguauguguauauauguauguguauauguauguguguguguguguguguauauauauauauauauauauauauauauauauauauauauauauauauauauagauauauagauauaugcauauauauauauauauuguuucuuauacucuccuccugauaggucuuccaaugcauugguaagugagaggucagccuguuuaaucagacuacugauuucagaaaaaaacacaucucucuggaaauauccuuagagacucacucagagguuuauccaaguguuuguauaccucauagcccaguaacauuuuauuucuguuuuuuucuuuguuuguuuguuguuguuguuguuguuuuacaaaaaucucagagguuuaagagcaaugagaguagauuuugccaggacuuuugaguuguaagcucaguucucacauaauacuucuguucauugguuaaagaagucagaaggccaugacuggagaaauagaugcuaacuauauacugaggagaaaauauaagucauuguugccugcauuuugccauauucaauauaagcuauuuuucaccacagguaguauugauaguagaagccaaagaaguaauuagacuucuaucuaugaauacccaucuacaugaaagacuugugcuucauaaucagauaaucagauaaucuuguauaguccaguaugcuuucuuguaccuuaaucuuauucauccuuguuuuauuauagcuacugucaucuuagguuagaauccuuuucuucuuuaaaaaauauuugacuuuacugccuuucuuccuuuuccuuuuucuaaaguuucccuuucgggugacuauaauagauguuagcauuuucuuugaccuguacauaagugaacugucauuuauuaauguggcuuauucauauuuuguucaagaaaaagcaggucgaguuuuaaagaguaugcuuuuaguacaugguucauauuguucugggaauaccucucuuuugguuuggaaagagagaauugguaguaauuguauauuuuauaauuucuaccaaagaacugaguuuuuucuuuaacauuucuaaagaacaacuucauuaggcagaaacuauguucuaagggggaagagggagaagaaaaaauagcuuucagaggcaaaauacucuucauuuucauuucauuuuucacaaaauuaugccuaauuuuuuuuuuacuuaaaguaauuauucuguguguguucuuacuuuuacagguauauguaaugcauacuuuagcagccucacuuucugcuuguauuuaucagugccuuugugguagucauaacuacagguaaaugccuucuugugaaauuuaagaucacuuucaguaaauagugggguuaucuguacguuauuaauuuaaaaguauacacaacacugcuuuuaguaacugcagaaagcgcaugacugagauguugaguacuuuuucaucuuugaaaauucaucuuuauaccuuuaugacaaaagaaucagaagccaacuguuguuauuaugauuugcuuaguugucuauaauuaacacugccaucaugcuagauacugugauagacuccgagaauuguaaaaugaacaaaauagucuuuccuuaagaucauuauuagaaacaguuaaaugaauugauauuaaauaauacaauaucauacuugagugauuaguucuauaguuugguauauaacaaaaagccugagacacaggagcaacugacgugagauugaaaauauuuucacagaguuucuauuuagaaauuucucuucauauuucaaguuucuguauaauuucuuaaaauucuuaaaauugacaugaugauauauagucuagcuuuaguucuuugaaauauucugauauuauuuaguuaaauauuaucugacuucuauuuucuacucuuaaagacagguaauauaacuugcguguccaucucucuuuuuuuuuuccuccaaaugucaugcauucuuuuaucuacugguuucauuuuaaggcaaaccccacuuucauuuucuagauauugauacauucuagaaaauucugcaguauuuucucuuugagcagaguucauauuuuagaauuuuuuugcuuguuuuuuuucuuuuuacugaaaauggauucuuucucugauuacaguuucccacccuccuuucaguuccaccccacacccucacauccagaucaauuccuuuuuuaucucucaauagaaaagaacaggcuucuaaaagauaacaacaaaacauaauaaaguaaaauacaaggaauucuuuuuuuuacuuuuuuuauuuuaagacugcagaguuuuuuaaauguaugcauauugauuguacauuuuuaugcaguacaguauguuuuugguuuuuuuagagaagaccauaaguaccagguuuguugcuggaguugcuauuucuuauuugcuuuucauauuuauuuauuuauauauuuuccguuuguuuuguggguauuuuaauuuuguuuguuugucuuaauguuugaguacagugucuguauauaugccuacaugccagaagagggcaucagaucauauuaggguagggaaauuaguuuuauuuuaaguccugucccuacuuccaguucguaguacuuccugguaguacuuguuuuaccuguuaaggcuagaggggccuuuucuaauccuuucuguucccuuaguugauaaauugagauuauaacaauugagcugugguaccuaacccaaaucauauauuuaacacaaacuucacaucucaggcucagggaaagucaugcaaguggaggcagaaagguuguuaagugcuagagaacccagauuccugcugcaugauaggacuucuagacauaagaaggaagcuaaagccacgagaucucagcaauauugugccuaaacagcauauagaggggaauuucucacuaccccaccucugcagaugaagaucugaaaaacagucaguggcuucugagauagaaucaguuuucucuacguacaaaccucuugauugguuauccagucccaacucaucagcccuaaccacuacuaggacucaguagauuguauguguaaacacacacacacacacacacacacacacacacacacacacacacacacacacacacacggggagagagauacaaauaacauauagcaauaauaagucaugaauuugagagaguaggagggauaaaggaagaguuggaaugaaaagagagauaauuauuauguaaacaguacuuacgaaguucucuaaaaguauuuuuaaaaauuaaauggaguaauuguggagaggguuaagacuuagagacuauuauaugaggucuacccauaucuucacaagaagauagauaauuuuguagugaaaugaguccauaccucaaugugccuuagcuuuuccuacccauuugauagacguuuucucaguuguggagugacuaggaaguucugaacugguuucugaccuucuuucagagggaaucaauccauugauaaauaauuaggguacaucccuagguggagggaaguccggagauuccuauuccgcuguguagucucuaucucuuuuaaucauucucccauuuuauacaucaucuuuguguuuugacuuuagagaacuuuuuaaaaauauaacauucauuuuaaauguucuuguaaguuugcuucuguggguggagauguuugguguguuuguuaucucuuagaugguaucagcucucauuuguauugacuuuugguugucaguucaucuuuauaaacuguccaugggcaaucccacuuuucacugugguuauauguauguguccaagguagcuucaguuuuauuucuuugaacugaauuaauuuaugcaauugaguauuaguuugguuucaucaaaauguuucuaucuucuugucauaaaucuuucuacaggcagagggaauuuuuauuauuacccugccaucuuaaaucugaaaaauaaggcccaauaauaauuauaaaagucucaaaauguaugaccagugagauuugccaagucuagccguaaggcacuaucauucuaaguguaaacaauauaaucauuuacucaauauauauuauaggaguuuuugaagaacuauuuucuagcacauuuauaagaucuuuuugcugcuggguaucagaauguuaaaauccuuuaugcuaagcuguuauuuguuuaucuuuccauaaguucuuaaauguguaaugauuauccucuuugccuuaauagugugauguguauaauuucaucaacaacaauaugauaaaaacuaauuagguucgauucuuccauccuaccauaacuuuuauggagguagaagcuguuuucuccauucuaugcuaagugccugguucagagccagacaguggaugagcuagccauuaaacaugaaauugagccuagacucacuucauuuuuuuaucaaauaaguuuauuuuguuguuuuguuuuuguuuuuguuuuuugagucaaauaagaaccuuaaauucauacaugcaaguuuauuucuaguggcccaaaaugauguggguuuuuuucuuccuuaaaauauuccuuaucuuucacuaaauaaauauacuuagauacuugucgaauuugauuuagcuuagaaaauauauguagguauacuuuaaaggauacuguauuaauagaauauagcacuguagaacauguaacuuaaacauaauaguauaauucauaaauaaacauuuuaaaguaucauagaaauuguaucuaagaaugggaauauuauauaugaaauucaucuuagguuucaauauugucuccuuucuuaguucauuucaaacaaaucaauuuacuggaaugguuuaucaaacaguacuucuugcccaucggcauucuuugcgaacuggaaguuuggaugaaucaguaacucccaacacaucaccagcucaauggccagguauaaauaauuuacauauauaagaauuauuuuuugaaauguuaaaugauaaaaagcaaacuugccuuaguuuuaccaguugaugaucauuguuaaauauugauagcauugacaccauugcaaauucaauacauauucuucaguuguauuaaauuuuuagcuaugagauuuuacguaaguuuaucugaauugaacaaauguuucaucaauugcuccuaaaaccacaauaaucuacuaauuaugaauccagcagaaauauauuuaauauuuauugaguacaucuuuuuaaaaacucaaaaaguagaaaaauguauuuaauuuuuaacguuaaaaauuuuuaauuuuuugucuuguuuuugauaauaucagcuaauuuucuuauuuguccuaggaauaaauuuucuaauucagcuuuugaauuccucuggggaagaagcucagucaggacuuacagucuugcuuugugaaauucucacagcaguauaucuuagucuguucauucaugggcuggcaacacacucuaguaaugagcuauuucggauuguagcccacccccuaaaugaaaaaauguggucugcaguauuugguggaggagcacauguucccagcaaaggacaggcaaacucaaaagcuuuaucugguaaguuuuuauuguccuguugugcacuccccccacaacaccccguccgccucccauucuuuccuuccacucuaaccuuccucucaguucugucuuuauaagcugaagcuuuauucauuuuaugguaacuuuguuaaauguaauuacaucuuaauuuuauguaagaaaguucuuguuguacaagaccaccaacaaauacuauuguaaaaaaugaaguuuuaaaguuucuugugcaguuuucaaucuuuuagauauuccuauacugauaauuaaacuauacaauguaguuauaaugucucuuaguacuaaaaucuuuauuucuuuugaaauacacuuugguuuuauuccauaccaaauacagauuuuucucuucuuucuuuggcaggaaggcacuuugcuaugccuagcccucaccagguagugguauucuccauggaaugugugggcuuuuccaaagcucuuucagccaucaguucucauagccuucccacucuugcaggcaagaucuuagcuuuagaaauaggcucuuacaguuuagcuugcuuuauguuguuguuuuucaaggguugcauacagugggguaguuuguuuuguuuggcauuuaaggaaaauugacauuucuuuuaaucaagccauauuuuugauuuaaaacaaugauuagcauuuuagaaaacuguuucugcucuuccauuaaaguuucaaauacuugguuuuugauauuuuuuucugucccuuaaauuauaauauuucuaaguguacaaaacccaaaagaaacaaaugcuagugcugaucauagaaaaucacaguauggcuugaaaugauugggaaagcauuucccaugaggcugcuuuaugguuugcauauuaugacuggcuauuagaguuuuuaaauuucuaaguguuuagaauaccaugaaaaguaaaucuuuuaaauaaauguauccuuuuacuacauauacuauauuuaaauaaaauuaaaacagucaccuuuuugaacuagaaaauaauuuucaugauauuuucuaaaucuuuuuuuugugauuuauuaacauaugugauaguauugguuuuucaguuuugaagcuugucuauaauacuggaaauccugcuacuuuauugauauuaaauuuaaaaauuauuaaaauguguaaaauuaaaucuucgaguauaagucugaaaacaauuuuaaaugcuuuuuagaagaaacccuugucgguacauauauaagugaagcccagcaagcucaucucugaauuuuacuccucaccaccucuaagcaccguacaccugcacucguuguagguuuggauguuuaugauuuagaugaugaggacuuacagaaaaauaaaauuugacuuggauuuguuacuuuuaaaacaucauugugggagauguaaagagauggcuuaacagacagaagcacuuuuucuucagaaaacccagguuugaggaccagcacccauguggcagaugacaacugucuguaacucacauuccaggggaaccaacacucucuucugauuuucccaggcaggagucacaccaggauucacagacauauugcaagcaaaaagaugcaagugaaacauucaaauacauaaaauaaauuuguaaaaagguuuucaaaaacauuagaguucauacucugauaaagaaauauuuuuagaccugaaguauucuucuguaauagaagaaagaaaagugguuauuuucaauagucauuauaagcaguaauggcauauauuuuucacagagcuauaaucccaugauuauagaacaaaauucuuggcaacuuaguuucuacuuuauccucacauugaaacuauuugcucauuuuaucugccacucuguuacuuuuuaauccauauacggucccuuuucaacagcucaggagagguaggauacagccucaaauaaacagggauuaaauuccugauuuuuaaugcugagagucaagcaaauucaguucauaauuuugagcgaacuucaggcagcuguguugguacagagaugguuugguaucuuguaacugcucagucuucucuuguaguaccacaguagcaauagcaaacauuaaguaaguauggcuguauuucaguaaaauucagauauaaaaggucuuaacccaggcaugaugaugcaugucuuucaaucccagcacuuuggaagcagagacagggagaucucuguguguucacagcuagccuggucuauuauauagugaguuccaggacugccagggcuacauguagugaaaccuugucuucccuccacacucccaaagucauuuugucagcccuuagguaggaaguuugcucuucuauuggaagguccagugcagauguaguugcuccacagacuucacucugucucaccugcuauugauacaccuacuacacuugucuacguaauccuuucgcucugaauuaaaauuauuuucuucuaccuuuuccccuuaaaauuauaaauuuuaagugcagaguugcuuaucaaauuuacuuguucguuaaaauauuaaacauuuuaauuuucacaauuuuuaaauuacuucccaugauauauuuaucaaauuaaaauuaacaacugugaaauuuaccuugauuguauuucucauauaucugagaucaagaaaaaaauuucaaaccuaacaggaguuaaacucauagaucauuaaguuaaugauuaaguaaauaauuguuaaauuaauuuuggcucuauuuuuaauauauuuuagaaaaauuaauuaagauuccaguuuuauuucuaugaaauacugaaagggauaaguucugcuagacaauguuaauauaugcuuuaagaugaaaaguauaguguuagccugaucguagcuccagcuuguucuuuuucuuugaaacugaaaauugagcacagaaccauguguguguuaggcaagcuucuaccacugagacacaucaguagucgcaguucuacauauuuaugcugagcacagguaaauaugaagagccuuacacaauguauagguugauucuuauuuauauacuaagauuuguugcuuuagggcaaaaguaacauuguauaguuguacauaagaaucuucauaaauguuaauacuaaccauucucaaauaaucaaaaauaaucaaguaaccaaaaauuaucuuauguuuauccuuuuggaguggggauaugacaaccaaauauucaaaacacaguuaccuaguaguggaguuagauguaaacauauccaaccuagguuauacucacccaucuuagagaacugagaaacuggauguagucacagaagucacaccaagugcaccuacaugauugaucaguugauuaagacagguauuugguuccaaaacuaauccaguuuggaagggaacagggaggaaaagagaggaauaaaaggagaggauggagagacugagggggaagggaagcagauuguagaguaauggcagacagaaauagccuggucugugaagcagauacucugaaaagcuguugaccaauagcaucuaggagaaaauagcagaaugauggcugcucgugugaaauaaaacucugaaaucuuaguuuuaagcucauucuuuuucuuuucuuuuuuuuuucuuuuuuuuuuuuuuuuuuguuuuuuucaagacaggguuucucuguguagcccuggcuguccuggaacucacucuguagaccaggcuggccucgaacucagaaauccgccugccucugcuucccaagugcugggaacacacccggcacacauuauuuuucuuaaagcacaggaaugcagcauggcaaucuagggaauuuucggugcagauaagcagugcucuguuuggauugcugcaaaaugcaaucacagugcuucaagaucuuaaguguauuaaauaagauucaguguacauugucgaguaaggaguuugucuucauuccuuuuccuguugcuaugauaaaauuuccugacagaagcaacuuaaggaacuguuuauuuuagcucacaguucaagguaaugucaucauggcguaaagucaaggcaggaggaacuugacgcaguugguuauaucauuucugcccuuggaaguuuaaagcagugagugucugcucccuuuuucuacuuacguaaucuaggacccccaccagaaauggcacuacaccugauaacaccuuagucaauacaagguaauccccguaggcacgcccagagggccaucuccuaggugacucuugauucuaucaaguugacauuaacugucacaaggauaaaaaaauauucgucagaaaguugacaugaguuuaaucaucauuaaaauacauguauauuuuaaguuuuuaaauuuagccuaaugaaaacugagaugucuacaguacuucguuuuccuaaauaaucaguauccaaauucaguguauugaaagugaaauacuuguuugaaaccccuaaaugcauguuuuauaaagguguuuucaaauuuagugcuuggaaaggucuuugaacuuugguaguuguguuuccuacucugguauaaauucuuaucugaaguguuuugaagcaaugaucucauaaacucaauuauuuucuacaugucuuuuguucuagugcuuuuacuaacuguuguucuuugcuuuuuguugugacaaaacacucugaccaaaagaaacuuggggcagaaagguuuauuugguuucuccuuagaugagucauucagagaaguucaaggcagccaacuggagcucggagccugaaggaacugugccuccugauugcucccugaagcauucucagauagcuuucuuagggagcccccauggccacuugacuaggaauggcaggcuaggauuccuaaccaaaaaguuaguuauauauauaauuuauuaacuuaaauguuaauaaauuucuauuugugaauucuauaucacauauuagugaaaaacaugauuuuuauaauuaaauugugguaauuguguaugcucauaguauuuuuaguuauuuugugauagcuagucauuagguugaaaauuagaaguuuaacuuuuuuuuccugcaaacagaaauccauacuuuuguuucuuguauuaugcaggaaaauauuuuaaauuuuaaaauuuuggauuuuggauuuaccauaaaaccuaugaauuuugucuucucuuaauaaguuuaaggaaauuuuaacuccuaauuguaaaauaaaauauaaaauuacuuuuuuuuuuucuuuuuuuucgagacaggguuucucuguguagcccuggcuguccugaaacucacucuguagaccaggcuggccucgaauucagaaaucagccugccucugccucccgagugcugggauuaaaggcaugcaccaccacgcccggcuauaaaauuauuuuuauuugugguaagcaugucaugucuccuuacuaugaaacgaaaaaagucacauauuuugaaaacauuuaaaauuaucucuguuuuuuuauuauuuaugcuaaauacagaucagaaaaucuaaguaauuuguauacauagaacuuauaugaaagcuaaguguuuuauuagucacagaauaacauuucuuauagaagaaaaauacacauuuaagauaaaugucagcgauaaaacacaguugagcacaacaaacacucagcacugguaucugacugcugagagguuuuaaaagaugaucaagucugaaacaaccacuuuagagggaaaugaauccaugguuguuaguguuagguguugaugagaugagggccaugccauauuaagcuucccuuuauguuuaaagaacacuuuuuuuugugagaaugggagauacaagaagccuuccaagaagaauugaaaggaauguaaauauauauuuuuauaauuauucuuuuauuucacuauuaaggcuguccuuuuugauauacaaagcuagaagcuauaaggaaaagaagcauaucaucugucuaguauagauagucucauucacuggauaaugauguuuuugaaacuaaguauagugucuuccuguagacauuuuuuucugauguuuuuggcuguuucuaguugugcaacaaaauggguugaauauuauuuccuaacuguggugcuguaauaauuuagaguugccaugucagcacagugaucacagaucuuuagaugacagaacucuacugagcauacuugacugacccgcauuagaucugugugcuccugugcauacagcacuaaacuuguuuucuuccuccuccaaccaguuuugcuccauucucuccucuuuuuuuuucucucuuccuacccuugucucuccccacccuguuccuuuccaccccuuugccuuacuuaccccagcuuuucccuuuuccuucucucucgcaguuuaacaaaaaaggcuaaauaacagcuuugguauuuucuugguaucucccagugaaucauuuugcucaucagcuaccuuagaaucuacuacuuucuauucaaauauauguaaauuuauuuauuuuuaagacagggucucacacuagaguccaggcuagccuggaacucacuuuguagaucaugcaguccuuaaacuccagaaucuaacuagcucugccuucaaaguuuggaaauuagcacugugugucaccauacccaucuuguuaauuuauuuuuaugaauacuuacagaacaaguacaauauauuauaugagguaaugauucuaggaggauccugagagucaaacauucuuauauguauaguaugucagguuuugaaaauuauuaauuguauucauuuaagaaaaaccuuuacuuaauuugcuggcuucuuuaauauuuuccuuuuuggacucauugaagcuuauuucuagauuucacauagguucauaucuaaaguucccuucaugauauacaugccuguaaaaagacuaagcacuuagccugaauugucuuacuaaaacaagaaauggauuuggaauuaauuuguuguuaagcuucaaugacuuuuaucuuuuacaaaucuguauuuucuucaaccuaacuuuaagucacuaguuaagcaauuugcccuuucuucucuguauuuugguguuaagguucaaagucaccauuaugaauuucauguacucuggcauucucuguaggagccccaaagauaagugaguuuucaguugaaaugaagacaugaaauacuuuugcuuauuguguuaaaauuguaaagaaauaauguuuacaucggguuauaaaauacugguuuuguuauaucugcuuuaaaaugguaagcugaggcuggagagauagcucagccaauaaagugcuugcugugugugcaugaaaacugagaucagucucuaaaaugugcauaaaacgccaguuauaguguaaccacugcacuggagaaggggaugugaagacaaauagcagauucuuguggcuuacaggcccgccugcuuaacugugauucuaggccauuggcagacacugauucaaauuacaagguaggcgacauuauugagaacugacacuugaggcuuucauaugacacauauaugauacauacccugcaugcaaagccaccacauuaaguacacacacauacacucacacacacacacacacacacacacacacacacagguaacauaaauauuaagcaaacuuuugauguacucuugauuaugucaucaucaucaucauccagguuaccuaaggccauuuccacgcauguauauaaugaacuuggaauauauucagcucugcucguacauauuauccuuccccuucucacuucuuccucuuaauuuguuuguucguuuuuaaucacaguaauagcuucauuguagcaaaucuaggaauacagacacgauaguuacccacucguaugccuaugccauaaugugaccucuuacacauuucauuucuguuugagucuuuugggaaugacuuacauuucuaaauccauaguacagaaugugcugagggucaggucaggauucucaaggaaaggaaggaaugucugugaaaucuguuugucauggaaaccaaucagugagucaagacaaauaagaauuguguuuuuaaaauucauguuaccucuugauccuaucuggcuuuuccccauccuugcaugccuuucuuuuuuauuaguuacacuuuacccucuccauuccucuuagauaaaucauaaggccuauauccuguuucuauuccauuuuaguuuuagaauguguauuaauguauacaauguguguauuggaaacuugauuguagauugucagauauaaguaaauggaaaaguucauacaaauuuaaauguguaaacauaagcauuaauaccugaacugccaggggaacuacuaauguauaauaucuuagaauauuaauaugucauucuuuccccucugccaaagucauauaaucacuacauuaaacucagguuauuguugcuugauauauugcaugugcauguuguauuuuaaaguugaauaguuaaaaauaauaaauuaaaauuguaauuauggcacaaauacuuagaucauuuugggagguaaguaaaucucauucgaaccauuagagaaaaauauuguugugucuucaugugaacuguuugccuauuaggucaugcuuaugguuacaagauccuuguuugucuaugacuuaguauugauuaagcauuucuauagccuauggauauguagcucagagaugcaguaguugcauggcaugugcaggccuuggcuuugaucacuggcaccauauaaaucuguuuuagaaacucccauauaauuuuuacuuucuagggcaaauacugaaagaaugcucucuaacguuagaggcuugaaaaaaaugagacaaagauagcauuuucucuucuguguaauucuaaugacuagagauucccucucucucacccacuuuucaaguuauaacaaguauaauuuaauuauggaagucaaaauuuuccaauaaaaauauuuuaaauguauaauaagaccaguuuguucaugagcagucugaacuguggcauuauuuuugauuuguauuucauuugucucuuuauuuuuuaaauuuuuuuuuuuuuacauaaguaugcuguagcugucuucaaguauaccagaaggggucaccaaaucucacuauagaugguugugagccaccaugugguugcugggaauugaacucaggaccucuggaagagcagucagugcucuuaaccacugagccaucucuccagccccaucuauuuuuucucucucuuucuuuuuagagcuuguugggguaguucacuaguagaauauaugcuugcaugcuuaaaucucuggguucagugcccagcaaaccccuacccccuacaaacacaaaguaaaaggauuugggaaguuuuugucacaguccuaacuaaacuguaggggauguuuuaguagguagguacuacaucucuuauccacuacagacaguagauaaauagccauucagguaauuauggacaagauagaguaaaagcacaggcugcuauacagagaugguuugccuccuuccuuucgucugcuuuucaucugcucuguacuuucauaaucauauuuuagcuuuuguauccuauucguaguuacauuuagcuuuuaucuaaagauguuaauuggagguaguacuucuaauaauaauuuuuuucauuucuuuacuaguugaaggagaaaaacaaaacagacauauuaguccaucaaaagugucugccagagaaucuccuguauccucuuccucuggaaaucaggagccaccugcagucaaggagaaguucgucccgccugaacuaaguaucugggacuacuucauagccaagguacuaaaacaucacugacagaagaauguaaucaaauggaacaguuggguuuagagauaaaugguuagcucuugguacuucuaaguauuuuccuaugcuaguuuuaaaauuuuuaacuugugucaagauauucaacaauauaaaaagcaagaaaaaaacugaacuauuuuaauuauacaucuaaucagcuuuuaaaggaguauauauauuauacauauuaggacucuccacuucaaacuaagguuaaguaagauaaaaagaguaguuaguuaacaucuuaauauaauauaccuaauacuagccaagagucaaggagucagaguguucugaucaucuguuaccccuauucaauuucugcuucuuuuucuuuucaaucuuuuuuucccuacagucuuguaaaucuaacuuagaaccuuauaugagcuuuguaccacuaacuccauagucccucauucauuuuaacauugaggccacccugaauuguuuuacagauacaaauuauuuauuuaccaguauuuaguuaaauaacauuauuaucucaacuuuaacuuucuacacuaaauuacauauuuguaauugcauaaaaugcagacuucccuacuggcucuucauuccacacaugacugugugauaacagaugcaugcuaugauaagcgaacaguuacuuuacuucuuucaaaacccuuuagugucugugauucaucucacacaaauaacauagcauguauuaucuugauuucuuaucucaucucccauaagauauuuuauaaucggaagagggaauuggcaacaaaaaugaaagauauaacaacacaauccugaaaaguaauaauacuaagaagucaucucaaauuaaauugaagugauauaagagcuaauugugaauaguaacgcuggugauauuuaaaaguuuaugcaaagagaauguaguaaagcuagucagcguaaguauugaggguaguguugaagaaagaaugaaaauauuucagaugucaaaaacuguacauuaaagauacaauauuuaaaauguaaaggagugggcuggagagagagcuaagggaauaagagcacugacugcucgucuagagguccugaguucacaaccaucuguaacagggauccaauacccuguucuggugugucugaagacagcuggaguguacucauauaaacuccuuuaaauguaaaggagugaaacuuaccaaguuugucaguuugccaguauacagaaaagguaccuuucaugccaugauuuacauaugaauaaugcaaguacuuuuugaacuacaacuaguuuaaaugaacaaaaaacuguaaugauaauguaacuaauauuuuaaucaugcuacaugaguuucgguuguacugcuuucuauauuuccccaauacauagauagccaaaaguaaaguuuuucauuucuauuuauuuuuauauguuauuuccuuuaauauaucuuuaaucauuuaaaguuaagguuucauuuuuuuaaagcuaccuucauguuaaauaaugucaaugaacuuguaaguuaaaccuuuuaguuguacauggcuugugugugcgcgugugcgcgcacgcguguauaucaaugcucugguauguaugcauguguaggggagugguacacauacacauguauacagagaauaacaucgcgugucauucuucagguguuaucaaccuuauuuuugagacaggguaucucucccuagccuggaaauggcaaaguagacuaggcuugcuggacaauaagucccaggaucuaccugucucugcuucucuagugcuaagauacauaccacaacaccugaccuuuuuuuacauugauucugaauuuguucccuguauuuacauagcaagcaacuuaauaacugaguuauugccccggccuccaacuauacauuuuuagaagcuguaauuguaaguguuacagcuugcaugggaaagauauccuggcaaucaguagcaaagcaauacaacaaaucacacugcacaacaaaccucacacaagacauuuauugggugggaaaauuccaaaaucccaggagggugacugcuucugcucaggagagaaacagcagagaacugggcugaacacaugguugauauaggguuucuuggaggggagggaagcuuucgggguggcuggagguuagagggauugugcggccugauuuuagggcaagcucaaggacugguaggauuuuuuuuuuuccuguuuacuuucccaccuuggggcuggaaaaguccuuuauagucuuuccugcugcuuagguugauguuagugguuggcaauauuucuuuuuuaacauguuaaaauauagcucuguugaauuauuuuuuuaaaauggucuccauauaauauauaacaaucaucugugccucaauuuuuagggaaacacuagcuuauauaaucaauuacaguagaguaggugagaaacauuugaacagauuugcagaggacuggagagauggcucaguaguuacuacugcuuacuuacugcuuguggugguuugaauaaaaaugguccccguaggcucuuaggaaguggcauuauuugaaaggauuagaacauguggccuuguuagaguagauauggccuuguuggaguaauugugucacuggguagacuuugagguuuaagaagcucaagccaggcccagugucgcucgcucuuccugccgccuguggauccagauguaaaacucucaucugucauccuugccuacaauagcaccacaccugccugcaaacaugcuuucugccaugauaauaauggacuaaaccucugaaccuauaaaccuuaaauguuuuucuuuauaagaguuuccauggucgugguguuucuucacagcaauagaaacucaaacuaaaaccuaaguuuaauucccagaauccgugucagagagguuaccaccuauaacuccagcuucuggcaauccagcucuuuguucuggccucuggaggcacaggcauauauguagcacauccauauacauuuauagacacauacacauugucuuaguguucuguuccugugaagagauaguaugaccacaucaacucuuaauaaaggaaaacaucuaauuggcaucuugcuuacaguuccauuaucauggcagggagcgaggcagcauggaggcagacauggugcaagagauuucuguauccagaucugcaggcaacagaagaaagagccacugguccagacuugggcauuugaaaccucaaagcccacacccagggacacauuuaccucagcaagguuacaucuccuaaucuugucuaaacauucaaauuuaugagccuaagggagccuaaccaccacacauauaacauaaaacucuucucuuuuaaaacaguuaaagaaaaauaaaacauacgauggaagaauccucuuguucuucagggcuauguaacgacaauaauguggauuccuuaaucuacccaaaagccaggcacauagcaauguacauacuaacucaguaaccguggacaguuguucccagggucuuaucagcuagccaguccagcugaaaucaugagcucuagauucagugagggaaucugucucaaaaguuaagguggaggaccaugauuaagacacccaacaguggccuugccuccacaugugcauacccacacaaauagacacacacaaaaaaauuauuuuuaagccauaagaacaguuucaugagaagccuuuaauuucacauguaaucuuucaguuauggaucucaaugaauggauaagguuacacauuuuacuuauguaaucuacuaaugcuuagaaugaauugauguaucauagugcauucucagcugucuuaaccguugcuuuugacaaauacuuuuguuaaagguuacagaacauuuuuauuuucuuccuaauuauuaacauuguuuuuagaauuucuacuuaaugaucaguuuuucaguccuacacuacucuacagaacaggggcuauuucuacugcuuuuuuauguuaauugccaaaucccucacauuuucaacauuuggauauuuuccaaacaaccuuauaguaauuaacuuugaucuaaucucugauggucucacuccacuggccuguuaaacuucaugcuucagauaauguaggaaauuugucucuuucuuccucucugucuucauuuaaucauugguuuuggagaauuguuuucucuguauaugagauuauuguuuagucagacuuuauuagcccuguuauuauuuuuaggcugguaauguuuucuuccuuuagguuucacuuaaaugccacuugucaaagaggccuucuguggucagcuuucacuuuucuccaucuuuacuuuuuucuuuguaacauuuaauauauaaauuuuacuuaauuuuuuaguuacuuucuuaucuuuaucauuaaaauauaaaauucuuuaugguaucauugggugugauucuuuuaaacauuguauuaucaagccaauuuauucuugcaaaugcuuguauuuuccugcacuugagagguuaaaacacguaggucacaagucuaagacugggcugcuuagaaagaccuugacagaggaaugugggguggagcagaucuaucucaaguagacuuguggggcacauucugaagaauguuuuuguuuacugagugaauagauaaaaucuuauaucaaagauauacugugguaaauaauagguacuuugcuuacugugaaauagucacaaaugggaugaauuauauguuugaaagcaucaaaucagauauuugggugauaauauauauaauuuuucuuucagccuuuucuaccaccuucccaaaguagagcagaguaugauucugaggaaagucuagaaagugaugaugaagaagaagaggacgacgaugaugcuuugccuucuggucuccagcuccaugagcauucaaacucaaauucauucagguacugaauauuguguuuuaagcuuauuuuagaaaaucacuuuggccuauauaaauaauauuuuuaagguaauguggaauaauuuauugauugauuauacacuauuuaguugaaauugccaaauucuuuucuaaaacaguaaguuuucaauuaacuuuuguuuauuuaucucuugguaaaucauucuaauuucuaacauguuguacaaaucuuccauauuaugcuuugauuugggcccauaagguaaaucuuaagacuuuaacugugaacuucaaaugccuguuugguagaccucuaguucuagaugucuuuaaaaagcaucugugauuauaaaaaucuuuaauuauucacuauacucgaaagcauuuugaaagguucacuggcuuuauauucaugagugaucuuauucauguuuacauuggagcagcaauacauuuuauuaagacauggcauauuaaugaugaguuaacaguaguuuaaaaggaaauaagcagauuucuauccuucugauuacagaaauaaguaccucuguaugucugcugcuuucuuacauagaggacaacacaaucauauaugaugcucugaagcuugcuguucaauuacuguugcacacuguaguuuuauaaauauuuauuguaaaucuuuauugaaaaauuaagagauuuugcuuucuaguguauuuuuuccuguugaauuagguuuacuuuuugacuguauaaacauauguaugacucagaauccaaauuguauaacccaacaauuuaagaaggaaaucuacuuaaaaacuggccugaacuggagauguagcucaguuguagaacauuuucuuagaugugugaagcccuguguuuaaucuucaguauuggauaaauggaagggcgaggggaagauggccaaaagaugugaauagauagguauuucucuaaagaagacaugcagaugacugauaaacacuggaaaaauauauucugguuauuagggaaagguuaaugaaaaccagagugggaaggauguuaucuuacacccauuaagguagcuacuacaaaaauaacuaaauggcaguauuagccaaacuggagagaaauuagagccuuuguguucuuuuggucagacuauaaaaugguacagucacuuuggaaaaugauaauguaguuuauuuaaaaacuuacucuauuguauaaaauguuaauucugcuuuggauauauaccaaaagacuugaaaguaagcacaaacaugugguuguacaucuaguugacagcagguuaaaggccaguggauugaagcaauucaagugucugacagggugacugaauauacaaaauauguuauauauguaauuagaaaauuauuuuacaaaggaagagaauucugauuuaugcugcaucauggaugaauuuugagggcauuauacaaagagaaauaaaauaguguauuuuaauuccacuuuauaaaaugcaugaaauggucaaauucacagaaauugagagaagcauauaggucccaugagaaguuguggagaaugaugguggugaugguuccaaaacagugugcauguacugcuguugagaagguuauacugcuaaacuuuauagugugugcguuuugcacgguugauaauuuaaaacuaguaccauaagucauaaacaugauguacucaaaauuaaagauggagaaauaauuuuaaauuggacuauauaaaaauauaaagucaagcgccucauuucuuguuucuacucaguuuucucuggcacuuguaaagauagccauuuuuacuaguuucuauguccuucugauuacagaaauaaguaccucuguaugucugcugcuuucuuacauagaggacaacacaaucauauacgaugcucugaagcuugcuguucaauuacuguugcacacuguaguuuuauaaauauuauacuucauuuuuauaguuaccuuaaaauugcauccuugaaaacuaucguuauugucuccugacagccauuuacauuauuuucacuguuuugguuaaugcugacaugaauuauuaguuacauguguaugugauuuagguuuugcagauguguaucuugaaacuaauuccuguuaggaaauugcugccuuaaaggauggcaucauuuauagaucucauguaaaucuuuaauggggacauuuuuuauuuuuaguuggucuuugaugagauuggcuaugguccaguuggugcucaacaauuugaagacuuucuaucccuuugcaggucaugaucuugcagguaauaaacaucuuaguguggcuugaugccgauuguuauucuuuauguguauucuaaauaaauuaaaaguuuaaaugaguuucuguaguaaaggaugcauuucugucagguauaaacuauuuuuaaauguucuuaucauaccuacugaggagggaaauguuugagaaaucaaaggcucuguacaugauauuauuauauugagacuguaucucuaccuggaacuuaauacuaaaccuauaaaccuucaaaaauagugaugaguuccacaguaggagaugguuguacagaaaguaaggaaaugugguccuaugcaagauguuucagcuuugaacuguguuuuaaucauacgcuaaaaaguaaacacuaaaauaucaguuuaaugauaaaaauuuugugacuauguugggauaauagaggaaggaaaguuuauacucauucuauuguuauaaaucaguauguaauuuucagaauuauaaaucaagaccauuauuaaauaugaauagauaaacaaaaauaguuaaauuaguauuucauuucaugguaaggauuauauaagcuugcuuauuauuuucuuuuuuaaacaaaaaugcuaaaugauagucuggcuuguuucaaagauuaaaguacuuaauuuuucuuucauaaacauuuuuguaaucuucaaaaacauuuucaugugaaauuaaauucauaaguaguaaugcugaaauagucauauagacuuuacgacauuuuaucuuuaaaauauaagauucugugcccacauauucuacuauauuuuaucaauaucccuugcuuucucagaaacauuuuauguagaauauaaucauuuaucaauuauguuuuuguuuuuuagaacuaccaguuaguucaccucuuugucaugcaguucuaaaaacucuucaaugcugggaacaaguucuucuccggcgacuugaaauccaugguggaccaccucaaaacuauaucucaagucacacuucugaggagaaugugucugcaggcccugcaauacuccgucacaaagcuuuacuagaaccuacaaacacuccuuucaaguagguuuuaccauggauguuguuuuguuguugcuuuauuguuauugucuuaauaauaauaauaauaauaauaauaaagaguuuuggagaaucaggcuguccuuggguaguguuuagagaaaaacauacuuauaguccaugcuuaacauuuuuguuguuguuguuguuguuugguuuuucgagacaggguuucucuguguagcccuggcuguccuggaacucacucuauagaccagccuggccuggaacucagauauccaccugccucugccucucaagugcuaggauuaaaggcgugcgccaccacugcccagcaaugcuuaacauuuuguucuaggaacauaucugugucuuugguguaaugcuugugauucucgaagguuaucuaacauuuguugaaaguccugauaguaauuauuguaggcuuuucaggauuccuuguugugacuaguuaacuuuggcauugcagagugaaagcaaccacacagaagauguaaugaaggaggcuuggcuaugagccgguaaacuugaguuuuucaaaaugugggacagacuagcuagauguagcuugaggaguguacuuuuauugaacuacucugcaauagaauaaacuauucagcagauguuuuaauauccagaagaagaaaaugauugaccuauaaguaaguuuauacgauacuuguuuuaucuagaaaauguuuuccugaauaaauguauacuuaauaguguauuuaguucuucagugucauuacuucuguuuuugcagaagcacuuuuggccaggaacaugaagguuauagacuuacugcauucauagaaaacacacuaaaacaaaacaaacaacaaaaacaaaaaacaaaaacacucugcuucuacuugucuucuaugagacacuacuuuuuaaaaauuccuuguccuuaguuuaagguucaggaaauuguggccaaccccuguugccaaauucagcccuauuccugguuuuugucaguaaaauuuuauuagccuauagcuacaaauaccauuuuuauauuaggauaagacauaaauuaaugcuuuauaaugucaguaaaugcuuguauaaguaucucuagugcagaauccguuaugcucuaaaaccuaaaacauuuuggaugucauaucaucucuuaaaaagaauuaaauuuuagccaagcauggaggugcaugugcuaaagaggcagagacaagaaguaggugggucuuucugaguuugaaccuggucuacaauagagaguuccaguccuaccauaguuuugaguuacugucuaaaaaaaacacaaaccaaacccaaaaccaaaaaaaguucagauuagugauggucaacuugucugcuuucccacuacagugacaaacuaacaggaaucacauuguccacuagucccaaacuauccguuauaugauccucuauaaggaagcucuuuggcugcuuucuuaggucaugaggugugauccuagccaacuuauucuaauaaacacugguauaguuguaaggacuugggaaguuaaucagaaaucuuugagguaaauaacuaauguacuguaccuauagauccaaaaaucaucucgcacuaucugugaagaggcuuuggcaguacuuggugaaacaggaagaaauucaagaaacuuuuaucagaaauauauucacaaagaaacgaugucuaaaugagguuuguauaucuuaaaacucuuuacuauuuuauuacuaaaguuucauaguauuauauaaccaauaaaauaaaugaaguuugcccaucuuugugcagauccauuuuauaucauaaacuuuaauguuuagagaacuauguuaaaagugaaggaacaauauuuuugcaucauguucuuggagcuuucuccucuuaaguagauauugagaugagagucugauucuugcauaucauguuuuacauuauaugaccaguuacuuaagagacauuuccuaugauuuuccuaugauaguuaaaaagaagucuaucuuagaguuaguugaaacugauuuaccuacaggaaacauuuugaauauguguauuuucucuuuuugugaauuauauaucaauaaaagaaauuuugcaaaucuaaaguagucuauaauuaaacuauaauagugugauuauaccuugaaaauaucauuacaaugaguugggauuucuuuuuuucuuucuuuuuuuuuuggagaggauuauuuaguucagagcuacuaaaaaauacauuugauaacaugaagaucuuaccaccuauaaauaaaugaacaucauuuuucuuuucuucaugcaaaauguuuuguaauuaauaguuauuaggugaaccuaaacaguagacacaguuguaguuagccaguuauuccucugggguacuugaguuuuuuauuugaauuuuuuuugaaauuauaauguacuuauaucauguuccucucccauaguaacaaaucauaauaaacaacuggauggagauauuguuacuauuugcuaugaccauacgacaaaaaaagaauauacaguacuuuugcuaacuuggaauuuaaaagugaauacuuugauugcauauuaaaaucuaggcaggcauaaaugcuguuuacuuauuaauauaacugugaaaauauuguuauuuaguauaugcauucaagaaaauggaaaaauacaguuaacagugaauaugcuagacaaaacuauauaacugauuaaacugauagguagagagguauacuuuuuuaagauaugauuuucuaaaaugaauuacaacuuacagcuuucuuauguagucucuaaggauaugcuacauuguccuagguguuaaaugcucacuaagcuugcugcuucucugguagugugccuuugacaugcauaugcacacagcguuguccuggugacucagcauagagaaacaguuguauaacuaacucugccauauugcauaagaauagcaguuaacuuguacauuuuuaucuaguuuauauuauggguguggaguuaacauuugguuuaaugauuuucuaauacaauauugacuuuuuaaaauugguaacaaauguuuuguauuuucauguuguauugagcccauaacuaaguagucauugcuguauucuguaucagggggaggauaauggaacagaguuuuaaucauagcuuuguuuugagcuucaugauaccuucugaaaaacaaaacugcuuuuguugaaguuuuuuuaaucaaaagcaugaacauaaguauuaaauaauagcuucuguaacaucaguaagcuaaguauuuuucugaauuuuuuaaucuacaaagcaacuguuuaaguucuuugcaauauuuuuaaaauaaauaacuuaaacguuagcacaaucguugaaaguuuuugagaaauuuguuguguuuguuuuguaaaggaaaaugaauuuauauauagcuggcuaaauggaggcaggggugacuccuguucuucccaugccaucuucagcugccuuauaauuuauagggagccaugguacagaaacuagcccaaguguaaauguagcugugaaacaggcuagccagaccuuuccgaggauggagagggauggaaggagauagacaggucaaggacccuggcccagguaggcuccacuggcucccauuuucucuuucucugcuacacacacagauuuuuauucaagccugggcuaaggagaaaaugaggucuugaaaaguccccuuuuaugaaagaaaaagaccuuggguuuuauaggauguagugccauccuggacuuagcuguaagaauuuguuauucccucguaguuuuacuacugaucgugauacuccuaaagagauuuuaauaaaggaauguggaaaaaaaaacaauaaaaucauagcuugaauagaguuaaauaaagucuuaaauuuauagaguugauagaaaauaaucuuugcuaccauuuagguugccuguuuuggguauucauaaaauugccuguuauguauuauuuauauuaaaaugaucauuaaagccauugugaauuuaguuacucagaagacugauaaauggcauguucuguauuuugaugcaauuuuuuuuuauuccuuuuugugauugaaaaugaaaauuuaccauuucuuuaucugacuucauuucuuuaucauaucuuaaaauucuuauguaucucagagcuuuucuuuuccaguauaauguaguuuauuggacauucuuuuaguuuuuaacuaaaauuucucccaaagugguuguauuuauuuggaaguuaauuacacaugguuugagcuaggcuguuaaagcuauauccaacaaaaguuggauucaacaguuagcaucuuuguucuuuaucaguuguauuuuauuuuuugagaacuuagaaguccugacuaagcuuuuucuugaaccagucauaaugucacccuugugugaagcuaugccuccaagcaagcuaccaacuauuccugccaacaugcauagggggauuggaaagauagugauugggauuuucuacuaaggauaauuucuagaggaauuauaugucauggaaauaagacagaaguguuaagacaauagauugacuuugauuuuuaguugacaucacaagcucugaauuuacacauaaaagguaccuuagauaaaauguuuuaaucucaucguuauaaaacaaaugaguuaaaaaaauaugcagugaaauaaaauuuauagugguagauaaggaauuuugagccuuuaagauuucuuacucucuaaccauauauucuccagcauauuuuuuuaauauaugaaauuuaagaagauauuauucccauauucuuuuuuaguaauuugguuacaaauauaaguuuaaaaaauaccucagcguugugcauguuacaacucaucuuuacucuuugacaugugauuauucuuucuuaacgaagucauuagaggacagcagugaaaccaucaaaaauucuaugauggaggagccaaacaucaauaagguacauuaaugucauucaacugaaauuaaaaauugcauucuuagccagaacaagaagagauuugcauuuugguuuucaacuggacuugauuucuaguggaaugagauucauccccucaacuuacuguuuaaucuuaucaauuuaaauguugcaaucauaaaaauuggcucucuuuuguuaauuuaaagaaugcaguuuuuaagggaguugaauguucccuguguuggcuacagauuuuucugaauaaauaccucugaaguuuuuaggaaauguaaucacaucaagagguauaaaguucaguaccauuguucuguguuugcaaguaucaccuuugaaagucaaacuucucucuuacuugaaaaauauagcaauuacuauuguauagucuuuauuuuacucugaagaauagcauauaacacaaaugccuuaugcauuuuaaguaccuacauucuugaaauuaaagcagagcagauaagaacuuguacaaucauaaauaacuccuagauuauuuucuguggccacaacauucagguaugacucuuacauugauuuuacucaaagugugggcagagaggagcccuacacauggcugaugggacuauaaaccggcacauccacuauggaaauaauauggagguucuaaacuaaaaaauaggguucaccuacccagacauuucacuucugggugcuccccaaggacucuuaagucaacauaccacagagauauuaacacauccuuguuuauuuccgcacuauucacaauagguaggaaauagagccagccuagguuugucuauaguuaaugcuguacauguacacaaugaaauaguauucauccuuaagggaaaaugaaauuaugacacuugcaagaaaguggguggaaguagaaaucauuauuuuaagcaaaauaagcgugacucaggcaaauauuucuuuauaugaaccucuguguguguguguguguguguguguguguguguguguguguguguaggucaugaaagaauggggacuaugagaggagaggcaaacaucuuaaaugggaaaagagaacacagaugguguuuauguaacugaauaaaccuguuuucgccucagaaaggauaccaugacagaccagaaaaauagguccacucaagucugcauuggcauaacugaguuuauugagguuauuugcaugcgcauaugugacuccaaagcaacuacaucacugaaaaguggaccucaaaugagugauacucacaaaacauguaucucugaagcuccugcccaauuugcuauccucacagacagccuucuuuggccuaggaauucuuuacugcuccuaaaacucugaagagguccuugugaacuuucuuguaacuucaaguuucuugggccuugacuauaucaugagcuuuccuaagucaucuaaguuuuguuaguuuuuugaaaaucuuuuauuuauuuauuuauuuauuuauuuauuacauguaaguacacuguagcugucuucagauacuccagaagagggcgcuagaucucguuauggaugguugugaaucaccaugugguugcugggauuugaacucaggaccuucagaagaacagucagugcuuuuaaccgcugagccaucucuccagccccaguuucuugaaaaucuuaagagucucaguuugucuaggaugaaaugcuucaauuuaaagaaauagcuagauaacaaaggcuagugggaguugucuguggcauguagaggaaagacaccaacaagaggagcaggagggcaaaggguagucggggaggaagaugaauuagaaggaagcauaguagcacaugcgagaaaauguuauaagggaacuccauaugcugucuuuaaaaaguaaaaaaaaaaucauuuuguaaacuuaaauaacugcacauauuuaaguauguagcuugcucaguuuaaucaucaccacuaucaagauaauggguauauacaucaacccucaucaaccuuuuuuaauccuucuuuuuuuuccucccuucucaucugucauuuucuuccccaaguagccacaaauguauaaguuaauuuucauuuucaggaagucauaugucauuuuauuuuauuuuugcuauucuauuuaauagagaauuugugcuggccaggagcucacuauguagccccugguggccucauacucagggcagucugucugccucaaccucucaggugcuaaggauugcaggcauaagccaccaugcuuaacuuuauuuuuauuuuuauuuuuuuugucugugucuuuuauuuagcauaaucauuuugagauuccuccaugucauguguuucaauaguuuauuacuuacuguuguugauacguauucuauuggaugacuggaucauaaucuguccaucuuuuuaccuaaugauuugauuguauuuuggagcaauuucaaauagggcugccuuaaaauucaugcauuagggucuuuauguauagacuuuauuucucuuguauaaaugccuaggaguagauagccgauguacaugguagauacagauuuuuugcaguacuagauauuguugcaauggucucucauguacuagccaaguagucuuaucacugaacuguaccugcauccuuaguauauguuuuaacucuuucggagauugucccaaguccuuccgugauuauaccauuuuacauuuuuacuagcaguguuuaagaucucauuuaccuuucauucuaacguaugacauagucaguuguuaaauuuuacuaaucguuauaguuuauuguagauuuaauuucuauuaagcacuugcucuugcaugaacuugccauuuccucauuuucauauugcaaacaucaugagaaaacugucuguuuuaacaaacuaaauaucaguuccuuuuaaugccccucuuauucccucuccucacuaaaugucaacaccuaauguggguagguauuaucgcuagcccauuugacugagguuguccuugucauaauuuggcuuugaaaaacuguaaauucauugccaguuccucucauuucagcucuucaauauccuuuauuacuacugaucccugacaguuuccuaacaugauugccucacuuaauuucuauaacaucagaguugcuuguguuagccggguuacugacagcuucuaaccuggccucaccuguaucuuuccuugacaauacuuaguucuguuuuuauuuuucuuugugauugaucuuauauuugauugaucuuacaguaaguauuaucuuugugcugguaccauuuaaaucacacuagcuccaaaucauuccuaauggcuacauuccucccacccuagcugcucuuucacuuguccuucagugugaaugguuccuucguguacucauuuuuaggcuugaaaacuagaaucagccuuucuuuaaucaugcuaaaagaauacaacccauuugcacaguuuaucuccuucuaaccauuuaccacuuggucuccugauccagucuucccccguucucucuucagccauaacagcuucucacccuguuuucugacagccauucucacauccuuuguuucagguccuaacagauuauccaaaauaauuugauggccucuaaacauucuugugacaacuggauuuguauuguaguguuuaaagccuuuccauaaacugaaccugccuguuuucuagaucuuaaauccuacuuguauagucauucuuaaauaaaauuuaccugaagcucuugagaagcuaggcuccauucuuuugcucacccucaugggauuuaaucguguauuugacaugguguucagaaccuccauauuuaaaauaccaccccaauugaaucucaggcaggccaucuuaacagcaugcugugagaaacauuguuucagguaagaagauaagaauauauucccauauugagaaagcuguuuugaaauucauuugugccugcuuucuuuucgugguaaaguuggagagagcucucccuugaaccagcuuguuccuacucucuguuaccagcagacccacuauucucuaaaaaugucaugucucuucuaauaccuucaauucuuuagacccagcaguagucucuugguguacuuuguugauaacccaaaaccacuguaguggccuuguguguacuuuagauaccaaacagauaaauggauaauuccaguuuuuauuuuaaaaaauauagaaaugagucagaacuaguaccugccuuauuauagaaguagacccucaacccagaauguuuaucaaacacugaaauuauguuuguaagcuaguuauauuuuagauagacuauauuugacauuuauauauucaggaacuauaaauaacaauauauaggcuuaguuguugcauaagucucugcaccuuucaauuaaacagucauuuuggaggccguuuuuaaaauaauuuuuuaaaaucaaugaauagauguuuaaacuuucuuuguuguaugcuaauuucuuuuuuuuuuccauuuuuuauuagguauuuagcucauuuacauuuccaaugcuauaccaaaagucccccauacccacccacucccacuccccuacccacccacucccccuuuuuggcccuggcguuccccuguacuggggcauauaaaguuugcguguccaaugggccucuuuccagugauggccgacuaggccaucuuuugauacauaugcagcuagagucaagagcuccgggguacugguuaguucauaauguuguuccgccuauaggguugcagaucccuuuagcuccuuggguucuuucucuagcuccuccauugggagcccugugauccauccauuagcugacugugagcauccacuucuguguuugcuaggccccggcauagucucacaagagacagcuacaucugucugggucuuucgauaaaaucuugcuaguguaugcaauggugucagcguuuggaugcugauuaugggguggaucccuggauauggcagucucuacaugguccauccuuucaucucagcuccaaacuuugucucuguaacuccuuccauggguguuuuguucccaauucuaaggaggggcauaguguccacacuucagucuucauucuucuugaaauaaugauuucugcauuucauaaugagauuuaaaacauuucuuauuaaccuauuuaagaagauuaaagguaaggguguuaaaauaaaaaguaauauaucaagcaauguuucuuuuaauugucggaacuuuccaacugccuauuuugguaaugcugauguuacaauauucacuucuuaacucaaaaauguuauauacauggauaugcagaaugccaaauauuuauccucauauagacucacuuggguuuacucagcuacucaaaugagucacugacuugaaugagcuaccauucuuccugaacuccaguuucucuggagguucuuuuagaucagaagucaguacccuacaacuaacugguaagaucacaacacuuguuagucuaagaacuaugaauggccuuuggacuuuguaguaaguaguuuaaagggagaaacaaaauaaauaccuacagugaaccucuguggucuguaaagcugcacugacuaccacccgaccucccuugcaaugcuuauauguauuacgcauuauuaaauaauuacacuacuuaaaacuuagaaaaucuuuacuucaauuauuaaaaugucuuuauccuuguuaguuuaguguucuuaaaagaaacagcucaagaagcuauauguuuuaucagcugucuuuuuauauaugaaaacaagcuuaaagaaauuccccucaccaaauucuuuucugggauaauuaaccuguacaguaguaccuuugguauugauguauuugaaaaguuuguuaaaauaauuuaugaaagaacuaaauaauuugcauauauacauuuguuuuaugaauaaaauagcaauuguaauauuauacuuucuucuauuuagauagaggcagaucugggauauccuggagguaaagcaagaauuauucauaaggaaucugauaucauuacugccuuugcuguuaauaggguaaguaaauagauaguugucuuuucuaugacuuguaacuauuucuuuuguuguuguuguuguuuuucgagacagguuucucuguguagccuuggcuguccuggaacucacucuguagaccaggcuggccucgaacucagaaauucgccugccucugccucccgagugcugggauuaaaggcaugcaccaccacacccugcauaacuauuucuuauuggagaacaucuuaccaguucacuuaaugauaguguucuacuuccaaaucuacuucccauuccucaaauuauuaucucaguaagauuugucuuuaguaaaacuacuauauaauuuacuaauguaguuuuguuauugggaaauauaauaaacuuuuauugccacacagagaguaguauuagguauuugaauaucaaccaauaacuuuaaaaauauaugcaagauaauauauuaguuaauccaaaaaggcuuucuagggucuuauaugagcuuauuguauauaauucuagagcuuaaacucaugcauuagaagaccuccuucuuugguguauuucuguaaaaauuguuugucuucucaguaguuguuauuugucugcuuaagauccuccuuagagagauuuguaagcuccuggagaagagcucagucuuacuuauaacaguccaaggugaaguuugucuaaaucaggucccacuugaauuucccuaaauugccauacagcauaguuucuagugucucacuguuguuguuuuuuuuuccuuuucauuuaaaaggauaggauuauaauuuuuucauguguacguaaaggaugcuuaagauaauguguaugcacauauuuauuuuuaauuuuacaauauuauccagccaggccauucuuggaaauccuugcuuuauguaagacuccugcuucagccucugaguaucuggacuacaagcaugcuaucaaaaaauguuauaugauauaugucuuguaaaaguuacccagaaauccuuuuaccaauagauuguucaucuuuauagucugcacuugucuucauaacuuucucuaaccaguuuuuuuagccauucuguucuuauauucccuguauccuucaucucaccucuuucauaaacauccuucaccauggacuuuuaaaucaggcagaagugcaguuaaucccuuagguauuucucaaguuguaauaucucugugucuguuacuguccucacccuaugaugucuucuuuccccuuaaaaagucagucugaguuuaaggacagccaaggcuacuaagaaaccuuguccaaaaaaaaaguaugaguaaccaggaaugaauagucauccacagauauaaaaucuguugcucacguguauacacauaauuacaucauuucucuacaugugauauuauaguuuuacauucuuccaaauuuggagauuuuauuaucuauaaauucugccugcaucagaagagagcaccggaucucauuauaggugguugagagccaccauguguuugcuggcaauugaacuuaggauaucuggaagagcaccuagugcucuuaaccucugagccuucucuccagcccccacauaccauguuuuuaaaauggcauuaagauugaaauuucuucauuucuuuuuuuuuuuuuuuccauuuuuuauuagguauuuaacucauuuacauuuccaaugcuauaccaaaagucccccauacccauccccccacuccccuacccacccgcuccccccuuuuggcccuggcguuccccuguacuggggcauauaaagucuguguguccaaugggccucucuuuccagugauggccgacuaggccaucuuuugauacauaugcagcuagagucaagagcuccgggguacugguuaguucauaauguuguuccgccuauaggguugcagaucccuuuagcuccucuucauuucuuucauucgauauuguuuguauugaaaacugugaaugguaugagauuuuaucauauucaagcuaacaaguucauuuuuaguuuauuggaugcuguuugauaacauaagaauccagucucucugacuagggacagauaguuuacaccuagcagcauaagcagccacuacaagaugaaucuuuucacacugauuccuugggcuaccagugacuuguuuccugccagcuccugcagagugacagaagcaggacagauaguagcuggacuuccagugagcuguauuacuggagauggucagugcguucagagacccagcuguuuucucaugcagcugccacaggugugagcuacugcaguggacuugugugcauuuuuaguuguagagauguuaagaacaaagucaucuagaagguaaaaggagagaaauugaagugguacacccauuuccauuucuacuuagcuuucuguuagauuuacuagaauuucuaaaacacagucauauauaucuauucgguucacacuuaugauuauuuuacuaaaaauucaauuauuaaaguuaauuuaaaauauuaauugguaagaauccuuuucuucaugauuuuagagacuuucuucagacauagcccuuauaccuuuuuaauguaaaaagcuaacgugauuuauuuuucaggcaaauagaaauugcauagcaauugccuccagccaugauguacaagaacuggauguuucugcaauucuggccacacagaucuauacuuggguggaugaugauacagagacagaaaccaaaggguauucuuaugcuuuguuuuaauucagucauauaguauaggugacuguauuguuuaauucagucauaugauauaggugacuguauucuuuaauucagucauauaauauaggugacuguauucuuuaauucagucauguaauauaggugacuguauucuuuaauucagucauauaauauaggugacuguauucuuuggacuauaacuuugaaaagauuccuuaagaggcaggaauaagugcccucuugaugcagcacauaaggucucaaaguagcacucuuaguuguaggcucaguaggcccugcuuugcuaaggaguggguaaggggucacaguagguucuuaaagggaaaauuaaaguugagaaagaguaauaaaaauggaaaacuaacucugaaaggaaauacaaagucuuuaaauuuucaucuauuuaaaaaaagaagaagaacugacggucuuuuuucauucuaguugauauuccuuuguagaucagaagacuucuugguuauacaugcgcgugaugauuuaucagcuguccaggguucaacuccauacacacacagcaacccuggcacuccaaucaacaugccguggcuuggaaguacacagacgggcagaggagcaucagugguaagcuucaagauccuuagguuugccuuuagccuuucccucuagguucaugcauaaagggggacuuuuaaaguuuuauuuaagucuuauaugcuagaauuguacauuuuuauaauuaagaauaaugcuuucauuugaaggauuacagaaaaauuguaaauauauuuuggcccagcaugauagcauacaccuucuaauuucagcacuuuggagauagaggcagacaaaucucugggaagcuaaccuacaauacauagcaaguucuugaacagccaggguuagagagaaagacccuaacucaaaaauaaauauacuuaaaaaugaaaguuauaguuuuuaaaauauacuuuaaaaaugaaagagcuacauuuuaguuaaugauuauuugaagcuuacugguccagaucaaguuauaggccauauguaaaccauguacuguauagaagcuacuauaauaagagugcgguuuaaguuguuuuguuuuauauuguuuuucuuuuuccaguguuaaaguuaaacccaaguccucaugugugucagccaagguuucuauucuugaguuccagccccagcccuaaguuuuucccuaugugggaaaaaaaaaaccaaaaaacaaaaaaacucaauguuuuguaucgcaugaaaauuaagugaaguuuuuauaucuguugauaacguuuuauaguaacucagcuguggucaauuuuuuuuuuuauauuuguggguccugcuuucauacuguaguaauagaacuuacugucucaacagacaugcugugcucacaaaguccaagguauuuauccagcuuuuuucaaaagcuguacuuaacccuguuccagauaauaaccuuuaguagauaucaguuaaacacuaucuauuuuagguauggcauuuuguaaugcugagacauauuguuccuucuagggaaaaaauuccauuuuucaaauuuaaacuaaauauauugguaguaguauagcauguauuugagcacugauugccuaagaaguuaucuauauuuauuucuccuuaagauuuucuuuuauuaauugauuaggcuauaaaaauuaauaccugggcuggcaagauggcucaacagguaagagcacugacugcucuuccaaaggucccaaguucaaaucccagcaacuacaugguggcucacaaccacccauaaugagaucugacacccucuucuggugcaucugaagacagcuacaguguacuuacauacaauaaauaaauaaaucuuuaaaaagaaauaccuacaagcaaauauucccugucauucuuuuaguaauuucuagguguuaaggacuauugguuuuguuuuuuuuuuuuuugcuuuguuuuauuuguuuuuguuuuuaaaacccuaaguccuauagaacauucuguuuucuuuaccagucagcugauguuuuuuaacuaauugauaacgauaauuguucaagugaagacucagucaucauuacuaacccuucuuaauguuuuguaauuuugugauuauaaaauuguagucuuuuguaaucuuuccccugauaacuaauacagccggagcugucauagauuccuguugacucauuaaucagcuaaagcuuaguucaaaggucaaguucaauguuuucaagugucuguuuuuuaagaauuaaauugaauuuguaauuagaaauuagugauuuguuuuuuguauuagugauuuuuuuuuuaauauuucauugaauguacauuugugaaggucucagauccucuggaacuggaguuacuggcaucugugagcuaccaugugggugcugaggauugaacccaggacuucuggaagagcaaccagugcucuuaaccauugagccuucucuuuagcccuagaaaucaguaauuuuaaaauauaauaauuugguuaguauauaauuuaaaaaucuuaaaauuugugaguuuuagucaugucuuauuucauagagaaacugauuuuuuuuuucaacaugagccuuggauaaaacaguaugguuucucuuguaacuacuugcuugcugcaaccucuugcucccacuauuuuauaaagcagcagauguuucuaaaauauucuuugagauugucacgccuugagaauucuauauuucccaguauaacuuaaccuguccuccaaaaccuuugccugccucuaguccuagcucuagccuacacuuuacccucuuugcuuuguucauccuggcuuacuguucccucagacucauccauuguugcaaagacuuugccuugcauucuuuuaaaaauacuccuaccucuguauuaacacucacauuccaacuucagaucucaagagauuuccauggaguucauagagaagacaucugcccuauccacuguaccucuaaucuuaauuauucacuguauuaucuuuauagcauguaguaguuguugaaauuaucaauucacgguuuaguuuuccauuuucuaagccuucugaaagagaaacuuugggaggguuugccuacauugucaauggaugugcuucacauagagcacugcaggucaugcugucaguagucaaaaauaguuguuuauacaccaaagcauucuuccugccuauguuaggacugcuuuuuuuuuuuuauugcauucaguauauuuugaucauauuccuugugcucuucccucuucaccccccacccccaccccuacccccggcuuccucauauaucucaaaaaaaagaaagaaaaucaaaauauacaagacagaaaauaccaauguuuuauaagaguuggucuuggucauggugucucuucacagcaguggaaacccuaagauaccauuaggaaucauuuucuugcuguuccuuuguaaggaauuugguuuccucuaggucuauggucuaucuagucucgcaauguuaggcguggguucugucucauggagugggccuuaauuccaaccagauaguaguugguuacugucaaaacuuuugugccacuauugcaucaacacaucaugcagguaggucacuauuguagauagcaagguuuguagaagcguugcuguuuaucuuuuuccucugauagcauacagaauaccuucaaguaccacaaacacuagucaguagggguauaagcucuauguagguccuugcucuauacgugucuguguucagugaguuguguagguguugucuucagcaguagagcauuaccaucuugauggcuuuuuaauuggaagccauucugauuaaaaauuacccccauuccucucucaaaaagauaccaauagaauaaggugguucuuuuucuaugaaucuuaaaguagcuaaugguuucuuuauuuucuauuacaugcuuucagaaaaacuuuuaaucuguguuuuguuacuuuucuaugauaauuuggucacuuuugugaccaaauuuuagaaaaaauuuuaacuaagaacauaggauuuugguagucauggugaacauaccuguaauuaugccaguaccucaggagucugaggcaggagaguugcagguuacagguaaacuugggcaauauaacaaaauucagucucaguccccacccgcaaacaaaguaaagagacuuugaugugaaguuuaaagaaauaaugauauauucaucaaguuuuuguuuucuggaaaauuaauaaaacauuucuuaauccuauuuuguuacuaaauguucaguacuaguacuuguuaaaagcagcuucuguuuuggaauaaagcuuucccaucacuuaccaguucugacggccuacuugcuugcuacccagccuacuccgcaacuuugggcuaaacaauuuaaaauccaaaaaagcaacuaaaaaguuuaccucaagauugauguacagauguaaacuaauaugcaaaugucaacuuacaugcaguuccgcucaauuuuacauaguuauuuuacucuuuuuugacaggcuaguuaaauaauucaaaaaauuauuuuaaaugaaucaguuggcaagaaagaagacuaaauucuugaaguuuuuuucuuugauugauuguuuuagacaaaaagagggguggaguggguuuuggagguauugauuaacuagaagguugaaacuguguguaugucuuguugucuguguguccuguuucuguguauaacuccuaauuaggaagugcucuaccacugagcuauaccuagcuauacaacuuacauuucuaguccuuuauuuuacuguuacuauaaaguauuucuucuuuuaccagaugcuuaagaaagccauuaauaacguuagaagaaugacaucacauccaacucuuccuuacuguaaguugacaacaaugauuguugauucucucgucuuuauuuuauauuuuuuauuguacagcaaauucauggguagcuuuuaguuucaauugaaagauagccuuuauccuaccuuauguuucauagauaaguuuguguuauacuaauuuugucagcuuaucuuucaucugguacauuaauagaaguuauaaaagggauuauuacuaaauucuuacaguuuuauguaggaaauauuuuuucauuuuuuuuccuagaaaucacaaguuucucuuguuuuagcaaaaaauaauaaauuuauuggaaguguugauuaauugguguuugaaauauacucauacuauaugauuauuguuuuuaaaaagauuuguauguuauucucuucacaguuaaaggaguauauugagagauauucaugucuuuccaaauuaauaauguauaaaauuuucaucagcuuuucucaaagacaauuguacaauaaaauaaaauuagcaaaguucuguguucuuuucggcuguauuacgagaugugcuauaagcauguguuaucuaaauugaauacuuuaucaaauaaaauggaucauacuaaaaguauaaauugguauaaaauauucaauuggcucccuuauauugaguuuauauagcuuuagagguaaucuggguuugagaaauggcuaaaaaguuaagaauuccugguauucuuagugcuugcuuagucaagauugguuucuagcaccuauuuuagggguucacaaccucuugugacucccauuuaaaaggaucugacaucccuuucuagccucuguguacccaaauacauauagcauggacuggauacauagacacacacauauaaaauaauuugaagaaagaacuaaagacagucaucaaagccuguauaauaagauguccguguauauuuuaacagagcauguggguagcguauaucugagaucacacugcuugggaggcugaggaagggugcuaucaaguucacauuuagugaguuuaagacuauccaaggcuacaaaaugagguccuuucucaaaaacacgaaaauguauuuuauauacaagguuuaaauaacauuauugguaagcaaaauauuuggaauuguuuaaaaauguucuugccuucuauuaguaagauuuguaacuguccugaaauauugaagggacuugaugugcuaucagcucuauugcauauauucugccagcuuaauauucuaccaugaauguuugcagugaaugcuauuagguccaaacuauuaaauauaaauaaagauauuaccagcuauuauuagggggcuauuaguggacuuauuuuauaaauauuagguaagaaaaaaaucaccacuguuuuaugaggcauuuucucuauagagagaauuuccauaacugacauaugagagacuugggagaggaaagcuaauuuaauuauuaaguuguuccccaacaugucuucuuugucacaaccauacuguccaugaggugauuuaguuaaagaauaugggcuuauuauuuaagcaaaugaaacaaaaauaaauuccuaaaugggaaaauacauuguuucuauacuuucucaguaacacuuuuuauggcaauugugugacuauuuuuuuccuuaucccagacagcuacccuacucugaagauaaacuuaauauguuaguaauucaguucaacucauuacacucucugccugcagugagacuuggaagccacaagucaagaacucaguucacaagcuugucuucugccucacaugcuaaucacacuuguuguccacuuccauuauagaucuggcacuaaaggggauuuucccaaccccuuccuuugguuugacuaaucugcuagaauaguuggcaaaccucaaugaaacacuuuaauuacauuugacacuuuauuguaaagguuuuuauaaaguaacacagaugaagauauauauauacagggugaggacugaagagcccugagaaccggagcuugugucucccuagaauuggauuguacuucuuagcauacauacauuuacugaugaagaagaaacucacuaaucuucuuguuugugaguuuuuauagaauguagucuucauacaaaguuuacagcuuauuauugaccccaauuuuuaccaaagauaauuagacucuuuaaaauaggucuaguuucuuugaccuuggcuugaauguuuauauagguacaagaauaauaguaauuauacaggguuuuaaaaagaacuuugcuggacaguuaugaagaaucuuguaauagacuuugaagaaccaacccauggacuugccaucaguuccuuucuucccaagaucuccaaauagcuugaguuccagaagugauacacgacccuuacucagcuguaacacaagcaccuaagaguuacauaaacuauguacaugguagugggccaguuuuauuucaaguugcuuuauuggccacauaaaaccaccuuaauacuauauaguuauauuugauuguauugaauucucaaguaugacauuccagucaaagacuugguaauauaaccaagcuuucuaauuauguccuauuaaaggagacaagauucuuucuuuucagugcugaugaucaaacccagcaagugucuucuugcugagcccaauccccaaaucugaauucuuacugaacuugugcagaugaccauauugccauaaagauacuuaacuuccaaauuccaaauagauagaaaguaaaaguaauuuuuucaccuuacuucaccaaauugcuauacaauauagauagcuuauucaguccugaaaauaaaucacuaaaggcuuaguaucauauuaaacaaaauaaaaacauuuaauaaggaaauuuugucauucaguccuauguuugauucuugcagaucugaaugauuuuacuuuacaaauuuguaauuuuuaugcuugccuuauuuauuuauaguucuguguguauguaggaagggauugccugcguuugagugcaggugcccuaggaggccagagguacuggaucucccugaagcuggaguuauggguuguuaggagucaucugucuuggguacuggucacuguaucagacucccugggauuggauuugcagaugcuucuaagcugcccugugaaugaaugguaggagucaaugcuagagcccucuggaagagcaacaaauguuccuaaccagagucaacucuuccaccccaccguagaauuuuuuaguuuauuuuucucugaaaaacauuaaaauauucauucugugaagaacggugcuaagauuuuaguuaggauuccacugaaccugaauagcuuuugcugggauugccauuuaacaagauuaauucuuccaauauaugaauauggaagguguuuucuucuagugucuucuucagugucugucuaaaguguccuuuaaaguuuucaucguaggaucuuucauuuccuuagucagauuuaugagagaguggggggagggggacugagaugcgcgugcaggugugugugugugugugugugugugugugugugugugugcgugcgcgcgcguguuuagaagccuuccuuugaguuuugaaauaauuucaguaguauuagaguuaauucuuuguucuguagaauuuuuauaguaacuccaacuggucugagaggauauuuuaguguggaagauuuuuuguugccucuucacucucauugcugcuuacggaucuguuuaugugauuuauuucuuguugguucaauuuggacauauguaucuagaaacucauagaucucauuuagauuuuuuuuccaacuuaguagaauaaaaugcccuuaugauucuccugaauuucauugauauuuguuauaaagucucucuuuucaguucuaauuucauuaauuugagucuucuuuuagauuaguuaaaccaaaggucuguuuuuaaauuuaguuuaucuuuucaaagacccaaccuuuuguuucacuauuuccuuguacugauauuuuuuguuugcuucauugauuucuacuuugauuuugauuauuucuucuuaucuacuuguuuggguuuaguucucuuuuuccacauucuucagcugcaugcaccauuaagccauuuaagaucucagggagccgggcgugguggcgcacgccuuuaaucccagcacuugggaggcagaggcaggcggauuucugaguucgaggccagccuggucuacaaagugaguuccaggacagccagggcucuacagagaaacccugucucgaaaaaccaaaaaaaaaaaaaaaaaaaaucuuagggcuuuguuuguuuguuuguuuaacguaagcauauuccuccuaggauugccuucauuuugucucauagauuuuguuauguugcgucuucauuuucauucuauucugggauuucuuuuuuaucucauucuugauuucuucagugaccuaaugauugaauugugugguauuuaggcuccagcaguuuggauauucuuuaugguuucuguuaacauuaauaacuaguuuugugccaccauagucaggcagaaugcaggaaguuaguccagcuuuucacuguuuguugagaguuguuuugugccauaauguaugaucaauuuugaagacaguuccaugaacugcaaagaaguaaguguauucuuuuuauguuugggugguauguucuguagauguuuguuagguccauuuauuuuaugaugucauuuauuuccaauguacacauuggcuacauaaucaauuccaccuauuucuucccuauucaaaauuaugaccauucucaaguuaucccuuaaagugacaauuuuucuauaauuuguaaaauaaccauuaccagacccccaaacccagaguuuuaggcugacaacucuccauaacuucuuccagcugaacaagggugacgaaaaaaauuugaaaggguuggggaggguuagcaaaauuagaaaacuugguuacacuuugggaaagcuagccuuagcauuuguuauccagucucuuaugcuuagaaggcucagggcuugacugaaguucuaacucgguccaucugaaagguggaugaggcaagauauucuggaauucaugacaauucccagaagcagggguccaagcagaucaguucagcaucucugagggugaaucuugcugaaguuguacauucuguaauauauaaaucucaccaccaaaauuuuaguaccauuaagauaucuguauggauugugcagggugcacagauuagguauggaugaaauucugcuccuuguucgagcaugugaaagacagaugucuuuuuuaugaguuaauuuuauuaauaagcaauuauaguaagucuucaugcuaugugaaggauggcacaaagaaucuuuaccuguuugguucucuugaauuuuucuaguucugaauucagggagucuccuccugucauaacugauccauaucacucugaaugggguccagagccuauucuccuuuuuugucaacacaaaugcagaggcauucucccaaaauagcauguccuugguccaguagccagaaauaauuaccaaacucaaaaucacacucaugagguggcagcagggcagggacagguggugcaggcuuggaaugaagaguuccucacguacaggacuuucuagcagugccagccaccccaucuccugcagcggaagcaguacaagggacuggcuagaauggagccaaacagaucacacugaaccaguguggaccuuccucccauggcaugugcaaguaggucugaaugaucccauguuuguggugccagccuuaccucgucuucauccguggugagcagccuuugucagucuaguuguguugaagccaagugcaguuguggaugcuguuugggcacauugcagagccucucuggugguggccaaguccacauucccuuaacugggaagugccugcugccuacuuccagucagaggcugcaugguuugaaguuccucuguucuggucagaggaacuuugguauuugguuccuuacucagcugcacguggacugggcugugcuccacuaauacacuagugccggcuuuauuuuccuuuaaacagugguugcauguguaggaaaugacaagcgaauauucagaucauacgaggaaguauuccucaacugcaugucagucagcuggcaguuuaucagcaucauauuuauuuguguuuucucagcagauauuaagguacaacuguguuuucucaauugucucuaaggaccagaguucuuaaguggcccaauuguggaaccaagucuuaguuguguggaaucagugcugacaucacuggcucaugccaucgcguguguuugcugcugcugcuugaccucacgggauuuacagacagaccuuccaagcaccauucuuugaguagcaguuaccuauuuaagaccucacacaaaaucugccucaggaauguuaauauauuuuaaauuauuuuaaaagaaacucagcaucuuauucuuuggccuuucuuaauuaaggcuuaauggaggcaguguuaacauuguacagggugugcauagaggagucuccucuauuauuugaagaacauugcaaaaugaggcuuucauugcagggaaaaaagagaagaagaaaaaagaaaaaaaaucacacucauuuugauaauuaagacaguucaaaacaaauaaagcaaucuaagcaaauguuaucuguugagacagugcuucuacuguccccugccccaacuuucaugagcucaaggccuaaauuuuuuauuuaauauuuuuugucuacuugcuguaugagccuauuuccaggcucucuuucuauauaagucucaaggccuaaauuucuacugucuaagauaggcuaggcacccuaucuccugccuuccaucuaauuuuuuaagauugaaugucucacuauuuuaauaucaacaaauucccuuuugcuuacuguauaggccuauucugaggcuucuaaucugucauaccaggaauaucgaucccagaauuccuguggagcucauauucaaagaauuugaguauuaucuuggcauagaccuuuuuagauuugcuugauaacauuauuucauucaaccuccccgacucuucucuguauucuuaagaacauuuaaacaauuaaaguauacucccuucuauccuuaaaauaacuaagucucauuuaucucuauccuuuaucugcuuguuggaggccuuuacugucugccucucucugucuuccuccaagcagccugucucugcacagccgggcucccagugccucugagcccaaacucaguauuaguuccaaacugugugugggagaggagggggauccccauguggcuugggcaaaaucuguauucccuucugucuuuacaaacaaaugaacuuuagaauucuauccuuugauuaccugcuugcaggaagcaggcugcuuuuacuaucuggguucucugccucagagcagccacccugucucucuucacagcagggaaucccagggacugugagcugagccuguguuccuuugaucagguuugcugagauggagccacaugacucuggucugcucccugagaaaccaauauucccucuuccuagauuuacgucacuauguguaugugaucaguccgagaaugacuaauuaauaguggauucucgccuucccugguaugugccaucuguuguguguagcuuucacucuccccucaaagcuccaggaacaggcugcgcuaccagccuccacccaguuucccuucaauccacagauaaaagacacacacacagguugcucauuuucaauuugccuucuuggcacaauugcugggcauuauuaaaaacucgcuacuagcaugcccuuauuaauacucuuagcuccacaccucccgccugcccuaaacuuuagugcccauuacaucuagucccugcuaaacaucccugaccuauuggagcagucacagacugccgcuccucccgagaccucacauggcuccuugaucauucuccaaagcaugguaaacucuccucuccucccuucaucugucucuuuuuuccuccagggacacagaagucccgcuuauuccuuccacccagcagcaauugggccauggcuuucuuuacagaucaagaaccaauuggagaacagguuuuaccaucagaacugcccuuacaagaaaggacaggcuuuuugagaguuuucuauugucugaguuaagagucaccauuuaaggguuaacauauguugcuaguccuucuauguaugccacuuagucaucucuggucaagcagagguuaggcaugugagauuucagagauacagcauugagagaucuaugugauacagaugaguagggccuaacuaccuauacagggaagugaagucagaucuugguggaucugggggcacuguaggaugagaagucagccaagacagagacuguggggacacugcaagauccaggaggagcuggguccccugacauugcagaagugagauuccagaugaucuagacauaaagucagguaaucuggcaacacagacaaacucuuagagacuccagaaugccagucaggugaggagggaucagguccuacuugguaacacagaguuaaaaagccuggaucaaaguagcauguauuuaccaaagguucucugaguccaugagaaaugaaaguauacuugggccagcuuccuucugagaguuuagggaacauuuaauuuacuuaugaaucuauuguuguuuaagccaaguuaucuagaacucuuaauuuagagacagaaaaaugucacacaaauaaugcaucuuuggguuugauuuuagccgugugccagauagaaaaaucacuaaaaucuugauuuaaaaugaucuuauaaaaagacuguagggcccagauguacacuauaaaaagaguccauggggaggugcagguuuuuuguuugccuuuuguaaacagucauuuaacaagguauauauggggcugaggagauggucucaucaguaaaguacuuguuagccagcaugaugacaugaauucagaucccugacacucacagaaaaaucuggguaugguggcacagaccuguaaucucagcacugggcaggagagucuccggggcuugcuggccugauaggcuugcuguaggcucggcaaugagcuccagguuccuugggagacccugucucaaaauaugguggaaagcccuugaagaagauaccacaguugacuucugguguguauguauacacaaucacacacacagagugggguggggcacaacggacagacacacacacacacacacacacacaaagaggacagaggcagggaggggaaggaacaacguagggagaaaaacaaauucaaaagauguuagcacugguccaucucguuuuuuguaacuucugcuugucugucagaagaugcauucuacucuugcugagguguuggggaucccuuuuuauccauugaguccuagagaggaauaauuaauuugccuaauuuaagcuuccccauuguaacuaccauaauuuuaaauuaucuuugauaaaguuuagucauuucucaaaaacuaaaaaauaaaauauaaaagguuaugaguccauauuguuuaugccugaaguuagguagaguuugagauauaggaguucuagacuugaauuuaggaagacacacaauucuguuacccgaggcacuuugcuggacaccgucugguacaucacacauaauacagaguuagucugggaacguguucaaaucagcugucagcugaaaucugagggugagguuuuugugguagucuauaaauagcagcaagaagcaguguacauaaggcucuccuguaccugguaaguugcugcuuuuaggaguuuuauaaguagucuccucuguguuugucuucugacacagaacuaucagaaggcuauuugaacauucgccauuucauaaacuuacgaaguuagacugcaggugguuuauggcuuuaccacgaguuagguucucagugcugucaccaaauaguugacagaaccagcugauaggggaggaauaauuuguuuuggcuuaagguuucaggggguugagucuuuugauuacuugagaagaaaugaguauggugagagcuagccaagaaccauagaaaaagaugugcuaucucuuugagcuuguuuucuccuuugcccucuucuguuucauaugcuucucuagcccaugagauguaaccugcuauauuuguagcucaucuguuuucuaucucaguuaauccuaucuagaaacaucuucacaaacacagccagagguaugucucaucaaucuaggugaaucuagacccaggcaguaaaauauuagccaucacaccaagguagcagaacuaaaauaaaaagguguucgaggaggcaagaugaaaagaaauuugauucauugaagugauagguucuuaauuagaguuaaagguucaguuuuugucuuacuguuuagagugaguuguguuuuagguuguuaauacaccacaauucaagaacaccagagccauguagccuagaguucuuagcacuauagauaauauuuggaaaacuuaaauaauuuuaaaugguuauccucauugguuauaauuaaguaagucugugaggucagagagauggcucaaagguuaagaguacugguugcucuuccagaggacccagguuacauucccagcacccacauaaaacucacagccauaucuaacuccagauccaggggauccuauacccucuucugaucucugcaugcacauguugcacaaauauauaugcaggucaaacacccauaaauauaaaagaaaauaauuaagaccaugggaagaagagagcaucucuucuagcuagugucaaggcauuaugcugcugcccucucagcccugcccagugcacagcaaacauucuaaaauagucugaauucauuuaaacuaaguauuugaugaagaauuaauaaaacucaacuaauaguauauuagcagcaugcuggguauuuuauauguauugauuuucauuauuccuauaccacacuaauucugaguuaugauuaauacaauuugggugacauuuguauaguucugagugcucauuaucaaaacuaccuacugauauuauuaaucuuuauaauaauuaguauuaucagagucauuagcauauauuugagauaacagccagucagaauaacuuaaaaaugaaauuuucuuuaauaugucauucaagaccaccuuuaacaugucuuuuccugagaaaaacauaaauuuaaacauuaauaguauaacugauaaagguuuauuuuuuaauaauuacaauaauuauaaauauaaaaauuauuuuaggguauuaagacauuaagauaauuuugagaacaaucuuaauuuauagacauguuucuaauauacauguuucuacuguuuuguuuaaagacaugcucgcauucaaauggaaguacauauuauuuuuguuguaugaaaugaaaaauaaaagggaaauuuacauaaauggauugauuuauuuccuagguauaacucugcuaaauaauucuagauugcguuaaauaaauuuucucaaaacuuuuuaaaauaaauauguaauuuuugucaucuuauaaugcagaucugaccggagcucaagauggaagugucagaauguuugaauggggccauucucagcaaauaaccuguuuucggucugguggcaauucaagaauuacaagaaugagauuuaacuaucagggaaauaagguacuauugagaauuaaaugauuuuuuuuaaaaaaaaguuugggguauaaauucacuaguuugagauuuuuaacaaaguguuuaaaguacuaacucauaagaauucuucuaauucuucugaaagaacauuuaguauauguauauaguuuaugguacauauauauuacuacuaagcuuaauuuaaauguacccuaagaaccagugcucuaucuuacauuucuuugaccaguaaguguccaacuuuuuaguuccuggaauaugauucagcgccaagcagcaaguacaguuugggguguguuagaucuaagucaucugcauuugugauuuugugugcauucuaaaacugagaaacacugcuguagaaugacaugucagcaaacugucaacuagccacacagcuuuaauaggacauuuugauauuacaguuccauuguuuauuaugauuucuuuuagcauuuucuacuagcagaguuaagaagaauaaagaccuuauggagggcaaaccuuuaguuacagagccauugaagagagggugugacuaggugugcugugagauuuuucuccuagaaaugacaggaaaaguacacccaugacaagcucagcgauacgguaccuaagcaguaaugacacaaauagaugaaguagugggaaauuucauagggcccuagaccaaaaagagcauaggcaacuaaugacuaccaagaggagaagaauugaucucuuccagagacaagccucguaauuauccaauacaaaauggucagcccuaaaagcauauauauaaacaacacuaagcagacugggcaaguuauuuauauauuuauucauagauauguaacaauaauaaaaaaaagaaugccauaaauuuuaaguggggcaaggaggaauggaagggaaagaaagaggaaaugauaauauuuuauuuaguuuuuuuuuuuuuuaagaaguuugcugaaacaccucuagagcaucccuuuacuaacuucucacaucgcuacuuauuuccaaucaagggcuuaaaguauaaauuagccugguauugucuucaggaucacgcaucacuaaaaguuuacauagauccuagaaaauagccuuuuuuuuccuaaauuucuaugauggugcucagcaaguucacauuucagacuguuuugaauuucagauuuuuucagauuaugagugcuuaauaaguguagucugaaauacuauguuuuuaugcuuuccauuuuaguuaacugugcuguugcuucuagucgguguauguuaauccauaguuccuuugauguaaugucuucccauuaaggugauaauuugaacaacauaauuaaaauaaguaauuuuuuuuuggagaaaccuuucaagauaucuuuuacaaaauucaucaguaugauacucaaaccuuucuauaauuugauucuguggucuggcuuauuuuuuuuagcauuagcacuuacuaguccuucauauagucuauuuuaaaguaaaacaggcuuuaguucauugccuaccagauaucuugcuaagcaguuaacuuuucauuuacuuuaaccaugugauggaaccaaauagcacaacaccuguacaugcucuagccuucauuaaggaaucauccuuaguaaaugguagagaagacucaauccaucccaguuauguaaaucaguuuggaugugaauuacagauagaauugggcacucaaaagacugaaauuucaacaaaacuaagauaauaagacuaauaaaugacaugaaaaauuaauuaagagauucagaaaugcuaucaauaaaacaggcuagaaugaaacagcauagaacagggaaccguuuuuacaaauuaaaaacacaguucucaaaaaugggggucagugaacauaaauguaagaaacaaguauguauguauguauauugaggaagcaccaaauaagaaauuaucuccugagaaauaguucagggaauauuuuagaaaaaucaaaguaguaggggaaagcaguacuuguuauuuguugaaagcaaagaauauaauuucacaacaaaagggucuaccuaguacuaagauguauugacagauaugugugcacauauccuagguuuuguuuugauucaaguauaaagaaauaguccucuaaaugugaaagaaauggaguuguaaauguuacuuacucaccuuccuuuucaaacaaucggaaucaagcuguucaaaauucccuauuaaaaggagaaaauuacaauuaguagaguuauaguuauagaauccuguaacauaagaagugagaaauaaguugacguucagccaaacuauauuucaaauuaacacuauuugaauauauauucuacguuuauaccugcugaagaacaaaucuagcucuacuccagaaaacagaauaaacuagaaaaaagggcuagguagugagaaaguaaaacaaauauaaaaggaauaggcuaucagaguuuucaaaaaacaguagaguaguaaauaaacaauaugaaguuugccaaaaauuggauauguucacuaaucaucacucaaaauuaaaacuugguaaauauuuuaaauuuugacaguuccuugugcuacuaauauguaagaauaaauaaguagcgaauuucaaauauuuugcuuaaaauugauuuuaccuucaauuuucauauuuuuacauuuuuugaacuuugugggggggggugcaagagcauacuguggagucuaaggcaacuuagagggcuuuccuuccuuccuuccuuccuuccuuccuuccuuccuuccuucacuauaugggucccagggaacaagaugagaucaucaaucuugccagcuucaucuuucaauuuuaauugaugcaaagcauucccaauucuaaauuuuuagucuauauaauuauaaagagguguacauuuauaugaauguucaaagcagcaccuuuuauaauacaauaaguugaaaacugucuauaaaaagaaaguuuacaauuguaagacaacuauacacugcagugccaccccaguacaagaauagcuagauuucuaugucuugaugaggucaguuaaaauaaacuuaaaauguaaacuuuuaucuguauauuauccaauuuacuauaaaaaucuauaugaguguuugaauauucauaaaaagaaaucuuacaggaaauaaucaccuuguuauaauaggugguugauuuagaauuagaagaagacuggguccaaaauaaacaugaguuuuauauaauuucuaagcaugcaccuuuguuuguuuguuuguuuguuuguuuuaaacaggaucucacucuguggcucauauuggccuuaaguucaugacaauccuuucuucugcuuuagccuccuaaaugauugggauuuacaggugugagucccuuacuagcauguacuguuuuuauaaugucuuaaaaaaaaaaaaaaguuagcuauuuuaaccugugaguucuguaucacauucuccuauacuuaauuuagugucuucccaauuaaauuuaccuugagauucagaaaaagaacuauuugacuaugauaauuaauucuuauuuuaacuuucuauuguuuguguauuuuuucuuugugauuaaggguuuuuguuuguuuuguguuuugcuuuguuuugugcuuuugagggguuuuuuuguuuuuuguuuuuuugacacaggauuucacacuguaguuuagugucccaaguuacucauuauguaggccuugcuguccugaaacucaaagcgauucuccuuccucagccuucuaaaggguugaaucacagguguguaguaccaugccaggucaccuuauuuauguauuuuucaaauugcauguuuuugaaagaccuuauuuuaguuuuuugguuuuuggguuuauuuguuuguuuuugugaacaccuauauuuguauuuacacaaagguuuuguauggccuaauaguuaauucaguaugcuuuuuuuuuaaguuauaagaacuauacacacuagugguacacauuacuuaaguuauaagaacuauagacacuagugaugcacauuacuuaaguuauaagaacuauauacacuaguggugcacauuacuuaaguuauaagaacuauauacacuaguggugcacauuacuuaaguuauaagaacuauagacacuaguggugcacauuacuuaaguuauaagaacuauagacacuaguggugcacauuacuuaaguuauaagaacuauauacacuaguggugcacauuacuuaaguuauaagaacuauagacacuagugguacacauuacuuaaguuauaagaacuauauacacuaguggugcacauuacuuaaguuauaagaacuauauacacuaguggcacacauuacuuaacuauguuugcuucuugcuacacuggaagucuucuuaaagugguauaaaaaauuaaaagguacagucuuuaucaaucaaaugcuaaacauugugucacauugaggauaaagauaaaugugugcuuuuauuugcauuaacaauuugauuuuuuuuuuaaaguuuggaauuguugaugcugauggauauuuaaguuuguaccaaacaaacuggaaauguugcccaguuacugggagcaugccuaagccauaucugguaagcaaaaaaaucauauauauauauauauauaaguuuauguuuaagaaucaaggcuauguuugaaacaaguaauauuaaaauuaauaaauaaaacauuucuauucuuaucuguucaguugcuauuauaggcuccuguuguaauaugugaaaauuaaugaguaaacuuuagaaaguuaauggguacagcaccacaucuucagagacucacagaaaauacuggaacuuuuucuaaccucacuaagcuguaaaucagucuucuaccuaagaugauuggcagauguaucagaucauuuuccuuacuuagcucuuacuuacgaacaaauuagaaagggcaucuugcugcugacccuguuguuuucaucucuauuuaagaguguggauucgggcuggugagauggcucagcggguaagagcacugacugcucuuccaaagguccugaguucaaaucccaguaaucacaugguggaucacaaccacccguaaugagaucugacgcccucuucuggugugucugaagacagcuacaguauacuuauguauaauaaauaaaauaaaucuuuaacaacaacaacaaaaaaagaguguggauucuucauaaaaauugaccuacagaaaugaaauaauguaauuacuuagucuguucuuuaauaaagcccuuuacagaacuaaacauaaacaguauguauuaaaaaagguuaugcauugugguucuguuaauucaccugaaguuaaagguuagaguuuaauacuguugugaguaaacacaauggaggauuguuuaggguaacuugaaaaggauuuagugaguucuuuccuccuagauuuauuacgcuacggugugaaauguguaaguuuauauuccagugaaaagaccgcuugagaccauugauuuucuuuuuuaauuaauaaaauguaucauaguaagcuugcuucaacuuuaagugugauuguaacuuuuuaugauuuuucaacaauuauguaaaaguuuaaauguuuuugaaaaauacauaaugccaauuugacaaagauacuuacagcuaaaauaaucuuaaauccugguuucugucugcauaaaacagcuuuguuuuuguuuuuucccacuuaacuagaucuaggggguauuugaaguuuaaccuguguauguuugcuucauaagauguugguggaacaaaaguggaaaaugugguucaggaacuguuuguauuuuuuacagaaagggggagaaucaacaugaaaauuucuuauauucuccaacuuuuuuaaagguucagaagauagaaauuauuuuuaagagacguaaagaacaugaucacauuuuagucauacauguacuugguuuuggaaauuccacuagcaacaguaacauuuguuguuuauaaccauuccaggcuuggcagugucauaacaaaacagccaaugauuuugucuucguuaguuccuccucucugauagcuacagcuggucuuucaagugacaauagguaagagauguagcugaaaugaaguguauauggauagcuaaauuuauuuuuuguuguguauucuuuugucuaaguaguuaggccuuaggaauuuuuaucauaaagauuuuuuuucauaaagcauuuuuaguggcauaaaacuuauaaaauucuaguaccauuuaaaacaaaaacuauccuuuuuuucuccauuaauuuauuuuuuauucucauauugagaauuuuaauguuuuuaguguucucauauugagacuuuagaagaaaggaugugguuguuggugaaaugaacauuucuuuguguguuauuuucuauauauccagaaaauuugaagcugaaaagguacuauuuauuuauuggccauauuauuuaguuaacuuguuuagucuucaccaugccauaauuacuagguaggucauuuucauaagaacauagggaacucagagcagccugccaguuugcaugaacauccgucuucuucacuccacccacucaugcagagcagcuaagcucuuccgucaggaccaugagcuugccaaccuucugauacucaucuguaagccucgguuuguacuagaaacuagcuuucgaggugguagacucuggcccauguuuaguagaaauugugugugugugugugugugugugugugugugugugugugugugcgugcgugagugcgugcacgcgcacacccuguuauauuaacuagcauuuucuaugacuuguguguuauucagcugauacauugggaaaucaguaaauacaucaaguaauuucuauagucagccuucauuaaucuuauuuuuaagugcaugauuaucaaagcauaacucaguuuuguaaguuagaaguuuuuuaugugagaauguuauguacauaauuuuuauauauuuaacgacaaaaacaucccuuuaaagaaaguucagguauuuaauacuaggcuuauuuucuuauucuauuuuucugucaguuaaaagaaauccuuuuuuuuuuuuccuccagaaacauaugucuaugggacacacuuguagcgccugccaauaguuuaguccaugguaaguuuuaaaggcaguuuauaaacugaagcuacagcugggaauguagcucauuuggagaguguuugccuggcacacacacaguccuaggugugaaccccagcaccacauagcguguuaauacauguuaauacauguuguaaucucagcgcucagaaggucaaggccauccuuugcaacauagaguuugagccuggacuauaggagacuaucucaaaagaaaaucauaaauuaaaaauaauuucaaauaauuuguguuuaauaguacauguuaucagauugcaagguuaacuuuguccauguuaucaguauuugaaaacagauacuugugauuaacuagagacagugggacaaagacaauauuaaaaccauauguuagggcuggaaagauggcuuuagagcauuuguugcucuugcagagggccuguguuuuauuccuaguauccucauguuggcucacaaccauagguaacucuaguuccagcgaaccugauauccucucugguuuaugcacaugguauauauacauaccugcaggcaaacaaauaacuuaaagaauaaauagcaucucuauaugugugcacaugcauauuugcagccguguaugugcuagccgauuggcaaaugcagagaccugaacaucagaaaccucauacuauguacccucuggccacuccuauacaacauuguauuggauagucuaguaacauaugcauaaaagaaaagcuaugcagacuagaaggggaaaaaaaaauaaagccaucuuuuagaugauauaauuguaugaaaaaucuaaaagaaaauuccuagaacugaugugggcuacacaucaaggucucaggacaguauacuaaaccaguugcuuuccucuguaccaauaguggauauauguaauuugaaauuugaaaggccuuaucauauuagugcccaaaauaauuacugaagcauuggucaaaagaaauacauacaggauguguauguagaaagguacaaaaauaauuaaagaagucaaagaagaucuaaauuaauauagaaguauggagcuuugaaaaauuuaauuuuguuuaaaaugccacuucaucccaacuuuauagauucaacaggguaaaugaaauacaagaaaacuguuuugcguauaacaauaaacagacacuaaaguuuguaugaaaauaacaaauaaccaacaaaauacugaagaaaaacaaauuuagaggacucauacugccuaauccuuuuaauguaaagcugcaauaaauuaagcauugugacaguggcuuuuucaaaaguuagagcauugaaaaaaauaaaaaaucucauaaucucccuuauguaucauggacuuuaacagaagcacagaagaauucaguagagaaagaaaaaaacaaaacaguuuucaauauagugcuaaaagaauugaauagugagguggcggggguggguauaggagacuuuugggaaagcauuugaaauuuaaaugaagaaaauaucuaacaaaaaaaauuuuaaaaaagagaauugaauagugacaugaaacaaccaaaaauaucuuuaacacagaccucacuucacaaauuuagcuacaaauggguuguauaguuacauguaaagugcaaacuaacgggggguggggggccaggaaaaacuagguggcuuugguuuggaggugauuuuuuuucuuuuuuuauuagauauuuucuucauuuacauuucaaaugcuauccccagaacccccuauacccuccccccgcccugcucuccaacccacccacuccugcuuccuggcccuggcauuccccuguacuggggcauaugaucuucacaagaccaagggccucucuccucccauugaucuucugcuacauaugcagcuagagacacgagcucuggggguacugguuaguucauauuguuguuccaccuauaggguugcagacuccuucagauccuuggguacuuucucuagcuuuaguuuggagaugaauuuuuacauuuaacacuuaacaaacaguuuuaugaacaaagugaugauauauccaaggauuuuuaaauaaucuuuuucucauuauuugaaaggaaaguaagcuuguaaaaauaugaucaagauaaaguaauccagaaaaaaguccauucagugugcuacaagauaacaaccacuuugaaaaccuuagaauuauaauaaaguuaaaccuguaccuagcgugauccaccuguauguacuguuuuauauaugaaagcuacaaaaaggcuuguuacaggaauguuauaauauuauaacacagcaguguuauaauauuuauaaauguauauuuauaaauugucacacuuauauaauagauaguauucaaccauuugaugcuauuguguccaguucugacacaaaacuguaggcaguuugcuagaacaacccuaugucuaccucaguuuucuucucuccacagugauucuucauugucucauguuugguuuauccaaucauuccuuauauugcauugguuuuuaaguuggcuuaggcaggaaagcaagucuguucauucaaucucacccaccuaauggaagccuguuucuucuauuacuaagugauuuuaaccuuuuuguuuuugaccuucagcuuuuaccugccaugauaguggagcuacaguuuuagcauaugcucccaaacaucaacuccucauaucggguggcagaaaagguuucacauguauauuugaccuucgacaacgacaacagaggcagcuuuuucagagccaugauuccccuguuaaagccauugcuauugauccaacugaagaguacuuuguuacaggaucugcagaaggcaauauaaagguaaauacaguugauacaugguaucuguaauaugaaaaaaauuagaaacuuaggccuuuauauuuaugauaccaacauauuccaaauaauaguugaaucaguucuauuuuagccaacaaugcuaauuacuguuuaauaaguccuuuagugaauggacauacuuuuaacuuuaaauuuuauauuuuuacuaguuuugaaauauacuuaauuaaugcuuaagaauuaaauuuucuauggauuuaaauauauuucagauauuauaagaagauaagucuugacucuauucuuuguuauaugguuacuaaauuucuagguuagcugaauauauccuagcagaauuauuuuucuuugauuugaagccacuuuuuaaauuucaacguguugcugcugguaaaggccaccaggguuucaauucucaucacucucagagaaauaaacaagagaaagcaaagaacugagaagaaauuuuauaacaaaguagaauuacacacucaagcaucauguggcuagaacuuuggauaauucauuuuauaagcaaaucuaaauagagggcaggauuggucagaagaugaaguccgacaggguaaucuaggaauagguuugggauuuuuuccugaauagaguuuucucccccuuuccuguauuugcaucuucagugcauuaacaauaauuccuacucucaguggauggacuuugaguaacaaaaaaaaaaaaaaagcaauugaugaauggucauagccuauagagaaucaggagacugugaucagagcucacacaggcacugauuguccuuguuuuagaaauguccuaacugcacaggaagggaguugcauuuuauuuggaauucauaaaucaaucaccagccuccacuuucauuuuguccuucauaucuuucagauuuggagucuuucguccuuuagucuucuccauacuuuuaucaaugaacacgcucggcagucuauuuuuagaaauauuggaacuggagucaugcaaauugagacaggaccagcaaaucacauuuucucuuguggagcugauggaacaaugaaaaugaggauccugccggaucaguuuagcccuuuaaacgagguguugaaaaaugaugugaaauuuaugcuauaacauuuucacaagaggguauaugauuuauuaccuguuuguagaaguagcgagcagaugcaaugcacaguaaucaccugcaccauggaugaacuaaugcuuucuuguuuucauauuuauuuuauggagcuuugcccuugaugcacugaugccuuaagagauaacaggucauucagcguuagauauuauugccuaacauagaguguaugaguaauguuguauccguacuuauucaaaguauauuuuaguaaacaugccaucguguuagagagacuuuguuuucucauuguuauaaauucugcaagcacugcugcaugaaguccacagacaguaaaacccuuaagagaggugccgaccaagagaacacucaccacugaacucuccaccuucucacuucucugucacacagacagcucuaauuguuuuccuguuaauaaugaaaacuucauauaaauacagauaagauaagacauugucacuaaaacugcuguugggacuucagugauaagagaauccaagaguuuauucguuuuucucuuucccuccuauaacccagaaguguauauguaaauguauuuauguguauguauauaugugugcauauguguauauauauauauaucuuauacaucuuacuugauauuguauauacagaaacagaagcuacaagucuuuucauguauuuugugccauaacaccuacugccgcaguauaaaacucuugguuuuuuuuuaaguuuuuaaauuauuuuaaccuuaauguuacuuuuaagaagcuuuaaauuuauuauuauuauuuuaaagauacugaaucaaauaagucucaguaggcaauaaagauguuguguggcacacaaggcauuuuauauuaaaaauuugucagcaguuuugaugaucagacauuuuaguuaaauuuuguuuuaauuuuauuucuuuuaagaugaauuuagucuaaaaauucuaaaaauguuauagcaguguuuuuagaaucaaaugugaaaacagucaauuuaaguauaguauuuacaaauguacaaugcccugcagaucuacauugauaggaaauaaauguuauauuuuauuauuuugccaaaauauuauuuuauuauaaaauuugaccaaaauauuuaaaauuuacaaugccucuaucuuaaauaugauaacccuauuucugucuguuuugugcuauaucuuuucugauucagaauuauaaaaaaaaacuugaaaaaaauacuugauuuuuagccaaugagacuggcuguagaauaaguguuuaagggacaguuacauacuauuuagcucaaauuuauuuuuaguuagaaccagaaauggccauuuuuauguaaugaaauauggaaaacuauuaggaauugaagagucaaagcaaagaaaugaagggcugguaaaugaauuuuguaauauccucaggauacuuuuauuauaaaaguguauuguuaaagguuuuguaauuguauuucauauuuuaaauauagugagcaaguuacagugaaaacacugucauuauagagaguuuauaugcacagaguaaacuguaccuguaaauugugcaauagcaauauaugacuauuugccauggaggaaucugugacaacauuacaaacaauauuuucuuugauguagcuaaguuauuuuuuaguaaucucuucacaaaucaagauucaaaaggcuuuaaacacuuuccauaagaaagaaaauuuacuaucguguuuauuaaaaucaaaaugcuucagggaugaucuauugagcauuuuaauugagaguuuauaugaauaacaacauuauguaaguccauauguauuuacauccagagucauauuuuaaauaaacaaucaugcagugauuuuuuucgcaugcuuuuguuuuaagaaauacuucugccaguuuaguugauuuuaauuaugugacuuuuaaauucagaauuucuauaugugaugauugaagagauaauuuaauuuccucaaauaccuucuuguuauuuucuacaauauuuuuuacuuaaugggugcucauuaaauaauugaaauguguauagaaaauaauacaaauacacuuaaauuuucauuauccacacaaaugaaauggucacaucacaauuaacuuacaugcucuguuuucauagagucauguuacagagauuuauaacauggcaggucucauguucuaaaauacuggauuucucuuaccaccgugaaacacugcuuacuugauuuuccuuuggucccacaguuugcuuuuagcuaagauagaacauuugcuguugugcuuaccagaacuuuaaagggauugguguaaaccaagucagcaggucacccuuacagacauucuuuaguuaaaaaugagguuugcuuguuuuuuaaaacagcaaaaauguucaaguggaucucauugacugaaacaauauaauuagacauuucagaaaaugcuuauacagccugaaaguggcaaugguaugauuaaaaggcuagaaaccuaggcaaacauacguuacaaaacaagaaauuuaaauaucuuaugagaaagaaccacagccaguuaaaaaccaagucaacuacaagaaauauuuguggagagguguguuagugacucuguaugugguauaacuuuuauguuauuagagaaagucaaacugaauaacagggcagcacauuaaaaguuaauaaaauauuaaauggccuuaauaguaguuaguguaaucucacaagaaaaaaauuaugaauagacauaacauuuuauugugcuuugaagauaauaugaauguuuuacaaauuuaagguuugucucaacugcgcaugacuaucaacaccauuuucaaauggugcaaaguugcuucauagcugucacauuauaguaauucuuacaauauuucaaacuauaauuaucacuguauugguuugaucacauuauuuugggauauccugaccuauacacauagaacacugcaaacuuacucacauaaaugcauuuugauugcuccaugacucuuuguuccccagucuuugucucuuuagaucuuccuauccauugagaugcaauauuaaaauuagaccaauuaacaaccauacaguggcucuuaaguguuaaagugaaagagucuuuuggcuuuaaauuuuaaaaaaagugugugaaaagaaguaaauacccggauggaccaucaagagacugccauauccagggauccaucccauaauuagccuccaaacgaugacaccauugcauacacuagcaagcguuuguugcaaggaccuugauauagcugucucuugugagacuaggccggggccuagcaaacacagaaguggaugcucacagucaacuauuggauggaucacagggcccccaauggaggagcuagagaaaguauacaaggagcuaaagagaucugcaacccuguaggugcaacauuaugaacuaaccaguacccuggagcucuugacucuagcugcauauguaucaaaagauggccuagucggccaucacuggaaagagaggcccacuggacaggcaaacuuuuuaugccccaguacaggggaacgccagggccaaaaaaugggaauggguggguaggggagugggggggcggggaagggugugggagacuuuugcgauagcauuggaaauguaauuaaggaaaauacguaagaaaaaaagaaaaaaagaaaaagaaaagaaaaaaaaaaaagaaguaaauacccaaaaccgauaaccuaccugaauuugauccccagaauccacaaauaaaaaugaaccagcuuccucaaguugucuacugaccugugaagacacagaugcacacuuauacaugcauacauuuugguuuugucuuuuuaaggggguagagaaaagaacuaagcuaaagggaggcaacuugccaaacagcuuuauugcugauaugggacaaauuuuaguggucuggcuagaacaucaaaacagauauaacauucccuuaauccaaaaguguuuaauccagauuaagaccaugacuauucgaucuaucaaggcucagagaggagugaaagcuacagaaggguuugaagcuagcagagauugauucaugagacuuaaggagagcaaucaucucuacagcgugaaaguucaagguggcaguacugucaaagaagcugcagcaagcuuucagaaagguucugugaagguguaugaagauuuuguagaugaaacaaccauaucuaggagaaaaagauacaaucugggauuauuagagccaaaaaggguaaggcagugacugccaggcugaaaagaguggaaguacuuaggcucuuccaaauuacacuaacuccugugcugcugcauaaauaaagcaagaaaaucugguaacuuuauaccuaguuacagcauaguuuauugacuauuuuguguucacuguugaaauuuacugaccauaauaagauuccuuugcaaacauuguuccuuggcaauauccuuuguuaccuuggaguucugauaggguugaaaacugggguaguaacuauaaugagaaacucaaggaguaauuuugacuuuaagucuuuuuugguuuuucaaaacaggguuuuucuguauagcccuggcuguccuggaacucacucuguagaccaggcuggucuugaacucagaaaucugccugccucugccucugccucugccucugccucugccucugccucugccucugccucugccucugccucugccucccuagugcugggauuaaaggcgugugccaccaugcccggcuacuugauuuaucuuaacaaaaaaaaaaaaaaaaaaaagagugguggcuaggcauggaauaccugagcugauaaaauaugaaguuaaaaaaauucaagggggagggaagauuaauguaauuauauuuuaaucuauaaaaauuuaauaaaacaugauugaaaaagaucuuggcaagcagcugacaaaauuguuguaauuuuucuccaagaaacuaaagaaaucagaaucaaaauuuuaaagaagccacauauuuuccuccguagagucauuuuuauuauuuuuauugcuaugcuugcuugcugucuaauaguuuacaugagcuuaagaucuccugguggcauugauugguaugaauaugaauguucaaaauaaaucuacauaccaaaauacugccuccccugguagcuauagguucuguugcuaaaauagaaauauuuccaaauuacagaaaauagguuauauuggcaacgauuuuaugcuuauugaagguggucaggguucuagauacaaagcaaagaacugcaaguccagcaaguagaaccugacugaacaagauaguguuuugaaauagcguugggugauaucugguaugcaugcauucguacacauaauuacgaugugcuggguaggagauaaaugcaaaaaaaucagauuaagagaaaauugaauagaaacagauuuggaagugaaaaauauucugaaaauuaaggguaagaguuuuuaaacagguggguuuuuuuuuuccuuuuauugaaaguagaguugguuuucgcauaauguguccugcuuaguuuccccucucucugcuuuucauaguuccucccaccuccuaucugauccauccuuucugucuccuguagaaaacacaggauucuaagcaauuaugggauaauauaaaauuuuaaaaugaacacauuggaauuggacaaaacagagagaaggcaaagagcucaagaaaaggcacaagaacaggcucacauuugggaauucaauaaaaacaaacugguagcuauaauauaugugcaaaggaucaauaggguaaaaagaaaaauauguauuauauauaaaaauaaccuuuaaaauggaaaucucucccagcacucgggaggcagaggcaggcggauuucugaguucgaggccagccuggucuacaaagugaguuccaggacagucagggcuacacagagaaacccugucuuaaaaaaaaaaaaaaaaauggaaaucucugacaucauggacaaugaaccuccaaagaugcccuuggguucauccuaucuuguccaucuacuggagcuuccucagugaggcuccuguggagaaaaugaaauuuucauuugcaagugguuaucaaguaaaagcuucuggacuguggggggugggggggauaugcugcuucuccuuucagcucuaggaccccauuugcuauagaccugugcaagcccuuugcaugcugcuucugucucuauacguguauauguugauuuagagcgccuuggugguguccucuagccccuccacuccacacacuuucugccuaaggaaccuuucucuacauuuccaagccuaggcuuauuauccaucaugccauuccacccagaauguggacuuuaggagauugaaucaagcaacucacucuagaccagucuucuuuauacuguggauaauuaguaauccacaguauugaaagauugcuuuuaaaucguauucuuccacaagggggcacugggccaucagcugaggagacgggggagcccuaggagugaggucuuccgagagcuauauauaagagguaaauauugcacaauucuucugccacacuaagaaccauuuucaaagugguuagauacuucugugguauucuaguaguaaaugugaaggcuuauuucugaacuuccaaauaagauagugggcuacagguuacaucggugagagccugguacuggaaaaagcugcucaguaagaaaaucccaccccacucgccaaaauuccaggguacacaacacaaaccaacaaaugcaaaaaguguaacacagaaacacagaaaaauggaaagauaaagcaauacaacuccgucuuccugucucgcuccccaugacuugguuuguuuguuuguuuguguuuuggagacaggguuucucuguauagcucuggcuguccuggaacucacuuuguagaccaggcuggccucgaacucagaaaucugccugccucugccuccugagugcugggauuaaagacgugugccaccacauuaagcuucccaugacuuguuugaccuaauuuuuuuuuuaauagaacccaggcucaccauccacaaugggcugggccuucccuuaaaaguggccuauaacucuggcugcagccugauauuaugggggcauuuucuuagcugaggcucccucuucucagaagcuuguuucaggaauguagccaacaccacugaccccuugucaaccugacacacaaauaccucacuguuaugccaccaccuuuccuuuccuucuccaacgccaagaucacauguuaauauugacauuacaaaauauaacuuuuaaaaaagauuuauuuauuauuauacauaaguauacuguagcugacuucaaacacaccagaagagggcaucagaucucauuaugggugguugugagucaccauaugauugcugggauuugaacucaggaccuuccaaagagcagucagugcucuuacccacugagccaucucaccagcccaaaguaaaacauuuuacaaauucaaacauuaaaauucauuuucuaauaguccaaagucucuuaacuaaaauuucucuuaaaaacucaaucucucaacuuugggcuccuguaaagucaaaaagaaaucaaaugcuuucuucaagagggaagaaccagggcacagucacgaaucaaagcaaaaacaacucccaaaaguauaaauaaguggaauucacucuggaucuuuuguguuccuccaagugacauagcucacuucucuggcucugccuuuuucaacacacagcuugucuuauaugcuccagcuggcuccacuccacugcugaugcuguucuugguggucauuccaagguacuuacaucuuuaaaaugcuggagucaucugcuacaauuagacuacacuuucacuaauaaccuuacaaagcgccucuucauggugccaagccucaacuucucugcauaaccuguucaauccuggcacuucaauugccagugugguugaaccuccaacaauggccucucuuagccucucacaaggccaagccccagcagcucuccaugacaccuucauuguagccgccaguggccacggguuccuggguuccugaaaggaaagcuggggauggauuggaaggacugcaagagaaauaacucaccaagacaaaguucucugaucaaggcucaauguuuaauucuagggucugaauuuaaagggggggggcugcccccgcuuugccaggaucucgucaggaagacaagcucagcugcucagcagcuauuggcuucuugcaggaagcugcagauggggcaggauaauagacuucaccuaggucagaagacuccacccuacaugggcuagcugacuguggcaaacaaggucugauucagcccgcugaaggcugggaggagggcacuucaugccuuuaaaaugaguacuaucugagugacuuauacuaccaaauucagcugccaguauaacguaccucuguacguuaacugccaguauaaccuuggauaccucuggaacauagcuuauauguguucucaggagacacuuccuaggagauuucaccucaauaaugcugguaucuucuuaaucuguuaaauucucaguuccagcugacuggcaucaaguauuccagcaaaagaaagguaucuuuuuaaucacaacuaauucuucaacuccagccaaccagaacaaaagaaucuuaauucaaaagcaacaaaggccccaucagagaaguuaaacuucacaauguuccaucuucugcauugccuucaacauucuuaaauuacaagcuucuacagaacaucuuaccaagcacugaauacucaaugacuuuucuuacacaaaguuccaaaguccuuccauaaucuuccacaaaacagcacucaugguuaggucuaucacagcaauaccuaacuucugguaccaacuuguuuuagguaggcuaucauuugcugcaaugaaauauaagcaaaaaucaaggaagaaaggguucauuuggguuacacuucaauaucauuuuccaucaucaauggaagauauagcaggaauuuagaagcaggagcuaaugcagaggucauggaggggugcuacauacuggcuugcugcccaugacuugcucagucuucuuacagaaccauagaccaucggccaaggauggccccacuaauuaagaaaaugccccacagccuuggucacagccugauuuuaauggagacauuuacucaacugaagcuuccuucucucagaaaccuaugucaaguugacagaaaaguagccagcauaccuacagagggagaaguaauuggaaaaaaucuauucacuaucccucaaagccauggagagagauuuguagcaaugaaugcuuacuuuuaaaaaguuuguuuaaguucucaaucuuuuuuuaauauuuauuuauuuaaugucuuuaagaaguaaucagaaaaaucuauucacuauuccucaaagccauggagggagauuuguagcaaugaaugcuugccuuuaaaacguuuaaguccucaaucuuuuuuuuuuaauauuuauuuauuuauuugaugucuuuaaguacacuguugcugucuuuaggcacacuagaagagggcauccgaucccauuacagaugguugugagccaccauacaguugcuugggaauugaacucaggaccucuggaagagcagucagugcucuuaaccacuaagccaucucuccagcccuaaguucucacucuaauaucucuaaaaugaaaacuaauaaaaugagaaaaauuugaagacaugagaaaacagaaauagguauagcugguucugauaaaguggauuauucaaagaguuuuucauuuuguaucuuguuuguacuuuagcauuuuuauguuacaaaggaucauaggaacgggcugguugaagauaaaaucauuuauuacuagaaucuaaacccuaugaauagaagagauggcucaaacaauugggaacccaaacaguugggaacaggccugcucugauugagcgaagauacauacaggugcuguguuuagcagcuagccuagauguugagagauuuuuuuuuaucaguuucuuuauuuucuaugaacaaggagggaauaucauauauauuaauggcagaaaauuugagggaaugggaaagauaguuagaugaccuaguaugauuaaaaucccuuccucccacucacucugcagacucagauccaggcuacaugauggcuuggcugccuuuggauguuaggacucugcugcaccaaguucuauacuuuuugauuuuuaaggaguucuuaugaaaaacauggcgugcaaauguaauuguugucucagaggcuuacuacugaauaaacuaacccuuuuugcuucuuucagaaguaguuccacucggcuguucuggcucaaauuccucuccaagaugacuaauucaaacuggcuucucuugucuucuugacugaauuccuuugcuuggucucaaacuaacucuggcaaucuguucuaaucuucuuuuuuuuuuauuagauauuuucuucauuuacauuucaaaugcuauuccugaaaguccccuaugcccucccccugcccuguuccccagcccacccacuccugcuuccuggcccuggcauuccccuguauuggagcauaugaucuucucaagaccaagggccucuccucccauugaugguugacuaggccauccucaaccuagacacuauugcauaugccagcaagauuuagcugacaggacccugauauagcuaucucuugagaggcuaugccagugccuggcaaauacagaaguggaugcucacagucauguauuggauggaacacaggggcccuaaugaaggagcuagagaaaguaaccaaggagcuaaaggggucugcaacccuauaggaggaucaacaauaugaacuaaccaguaaccccccacacaccagaacacuguguucuaaucuucuagcucauucucauucucuggguccuucuguauuuaccgacaaccugucucuguaaaacucucccaguaaaacugccuccucugaucugcacagacugcaugaaccaaacucacugaacugacucaacugaauuuaacuucuuucccaucuuguuuuugugagaguugagcaucuccugucaaaucuuucucugacuuaucacuuugucuaccccucaauuagaugucacuuuccaaaauggcuacuuccuacuauaaacuauccugccuuucacuguuugagauuaaagguguauacuaaggaugugucuauauuccaaccagaucauacuguaauccagggagugucuguauucugcucagaucaucuagaccuuaaaggucuuuagacaugaucccuugccagagcagccauguugcuggauuaaaauuccucuauaaugggugcuuagaaagauuuuccaagccggacaugguggcgcacgccuugaauaccagcacuggggaggcggaggcagaggcagguggaucucugaguucgaggccagccuggucuacagagugaguugcaggacagccagggcuacacagagaaacucugucucauaaaaagaaagaaagaaagaaagaaagaaagaaagaaagaaagaaagaaagaaagaaagaaagaaagaaagaaagaaagaaagaaagaaagaaaggaaggaaggaaggaaggaaggaaggaaggaaggaaggaaggaaggaagaaaaaaggaauauuuuccagaugggccaauaguaauaauggggccaaggaauuaaaaguguaggcaaggcaaugucucaugagaaucagaugacuuucuuuggaagacauaaaaggaaugguuauucauacugaagcaagucagagaagagagacuaaagaaagacuccacagagucuaguuugggagaaugaauaaugauauugauguuaccuauaggagcaugaguaacuuguaaacaguuucagcacagaagggucccacuuuuaaaccuccuauauacuuaaauauaucugagauuaugacuggggcaggaaugaguagugauggaaauaucagguuuuauggaagugugugauacuuucucuucccuuugagagggaaugguagcaauccccuucccaugggccuugcuacuugcuauauaggucuguucauuucaucgucaugacuguguaguccaguccucccauaggucaucuacccacucugcuucaugguggcauuugauggucaaaccuggaggaaacaauucacacacugaaggucaagaacaucaacaauguauggaguugaauuuacagauaacagggcauccuggugacucacacagccacucacacuuacaacagaagccucguuaaggcuuugugcuuuauccaaaaacauccaguggauauguggcagaucugguacuagaauuuucuaauggugacgaacaccacucaguggccauagaugcuuuaaugacuguaaugugaaauuugcccccauaagcuuccauucugauggcucagucucuggcuugcugugugucugaguuuaaauaggaauuccuacaccacccuccccaacucuuguguuuacaugcuugaccauagugggggcacuauuaagaaguguggcuuuguuggaguagauguggucuuguuguuggaaguaugucaguguggaggugggcuuuuaggucauauaugcucaagcuaugcccauuguagcacacaguccacagauccacugccucugaaucaagauguagaacucucagcuucuuucccagcgccaugucugccugcauaccuccauacuuccugccaugaugauaauucucugaaaguguaagccagcccccauuaaauguuuuccuugaucauguugccuuggucauggugagucuucacagcaauaaaacccuaguuaagacacugugcuauuuucaacacugugggaaguggggccuagcuagggugggccuuagaagguuauucgugcuucuggguucugccagcaugucugcuccuggaaccacucuguaagaaaaccacugcauacucuucaugcuccuggcccauagacagagccacuaugccccacuuccccaccaccauagacuacauuauaugaacccaaauauaucuuucauccccuuaagcuauuuuacaauauuuugugugcaauaaggaaguagccaaugcagguaggcauugagguaguuucuaguuaucugggagcaagaaagcucaaauauaaaaacgcauuucauucuaauuuaccugcacaauugcagauucuggaauauuuagaaugcauuuuucugcuuuuucugucuacucauaauggcuuacugcauuuagaaaccuuguccaacaacccagcacccuauccaucuguaggccuuggaguccgucuuacccuuucauccccuccagccuucgguaucuguacugguuuccaauugcugccaugauaaauuacuccaagguuaggcauuugacacaaaguuuuauuuauaguuccauacuucaugggcgucucgccaguaucaaauuauggagucuggagggcugaguuacuuucugggggcccuaaagaaagaaacaucuccuugcuuaauuuugguuaaugacaucuuacaucucagggaugcaaggcugauaucucauacccuuucugaacuguaagcuacaacccauuucagcuucuagaggccacccuguggucuuuggcucaugacccaggcugaaugucuccugacaucuugacacucugcuccaauguacuuccaccuuagaggacccacauaauuaggcucagcuaauaauccaagguaaugcccccauuucaauguucuuauuuuuaaucaugaggaaagaacuccuuccccgcugaaguguuaacauucacagauucuugagucagaggcuggacaccucucugugagacauuguuuugucugccgcagcaucuugccugacauguuuugucaguuuacugaacaagucaccuggcucugggguccucuagguuguuuccauaugggaaagccuuuucuaucuauagaacaacguuugacauaucucccaugcuuaaaauccuucugccuuccuccauccaaggguacuggaggauggaagacuuuaguuuggguucuggucuguuguuuuagcauuaguccaaccaucaauauaaccucucuucuaauccuuuguuuauuauuauuauuauuauuauuaucauuuuaauauuaguaaucauauuuugugggggaagaggggacagagccacaccacauagccuuggcucuccuggagcucacucuguagaccaagcugcccucaaacuuacagagagccaccuguuucuaucuucugaaugcugagacuaacggcaugcaccacccugcccagucugcaaucauuuguaaugggagaacaugcuugccacuugugggacaaaacauuuccuuggaggaugaagcacacauaucuauucacccuugacagggaacccaugacaaacaaaaguauggauaccaacaaaguccaauuuggugaacaaugaguuuuagugugguuacuuguaggaauauggguaagagguuacuuaaaggagcagaaaucacucaaagucacaaaacuccacuuccaaggcugagaaccugacgcaugcuguacagccuguaaggggggcggggguggggaugcucaacaggcuggcaguguccuuuccaagggacuuuggucuaaacaucuaggcaguucaggugguuucugcuucuuccagagucauccuugcgguucagcgucccucugucugagggggacugucagcuuuuaugguuuacucuagggaggaggggccuagugaaucugguuaguuuaggggacuuccugaagcugucuugagcuguuuaccuucuggcuuaaggaauuccuuaaggaaaacagcccugcaggacuaaaaaucuuuuuacauuaauuauuuauuuacuuuacagaucuaagcacccccucccaguccaccaguccuaccccacucaggucccccuuucuccccuucucuucucuucugagaagggggagcugccucccagggguaccacuccacccugguacaucaugucccugcaggacugggcacauccuuucccacugaggccagacaaggcagcccaguuaggggaacaggauccacaggcaggcaacagauucagggucaacucccacuccaguuguugggguacucacaugaagacuaagcugcacaucuguuacauaugugcgggggugggggcgcuaacuccuacugaaauagaaacagucauuaaaagucuccagcucuccccuucccccaaagcccaggguuaggaaugguuuuguugguuuguuuguuuguuuuuucuuuuguuaagacaggguuucucuguauagcccuggcuguccuggaacucacucuguagaccaggcuggccucgagcucagaaauccgccugccucugccuuccuagugcugggauuaaaggcuggggauuccacugcccagcaggcuaggaauguuuuaaucuuguagaaaaacuacuacacaaaaccacugcuccuaccuuaaaaaggauugugaaguucccacuucguacccaaacccagcucagagcaccccuuccagaaagucauccugauaccucugaugccuaauuacagccucggacagugauccucuuuuauucaccucuguaucuaguguaugguccugugcuuugcuuuaaauccguaucguugugauucuguccauuucaccaacccagucuuuacuuucuuucgcccccuccacaaccccccaaccccacccccacccccucccccguuccccugggucaaucauacacuuccugggcauguugcuuucuuuuuuuucuuuucuuuuuuuuuuucuuugauuuuuuguuuguuuguuuuguuuuguuuuucgagacaggguuucuuugaauagcucuggcuguccuggaauucauucuguagaccaggcuggccucgagcucagaaauccgccugccucugccuccagagugcugggauuaacggcaugugccaccacgcccggcuucucugccgggcuauuaagagcuacaaucauagacuguugagaggauuagaaugguugcguguacauuuuuaauuuguuaauaguauuccugaccggcuuuacagagcuagucucaagaguggauguuuacgguaugaguggguuccucuuacucacaaguggucuuugccaguuaccauagccacccaggaauggcucuuuaacagaaagaaacugcagaaucagcuucauccccguguuuccuuuggaguuuccugguuccuagggcaaaggcagucagucaugcuagaguggugugagucugagugugugcccaagaccacaggcuucccacggggaagccaaugcgagacuaaccgagagaugaauuccacgaucucugacaaugaaagccaagaauccacaagugcuuggaaugucuuugaguaaucuuaacacgaggagggagagaggaagaaagauggaaaagaagcaggauccagagacuucugcagaucaucagucacguacauggguuaagugucagucauggugcaaaagagaguggcccuauuugaccauaacaacuacaaaggcaauuucauuuaugcaaagaaacugagagaucucacaagcagaucuuggccgccagcuaccaaaguuugugcuucgcugcccggugaccuuccauacugccugcccugaguaacaccguccugcgcggaccauuguguacuggggcccuuggaggugcagaucuacccgcucugcuuccagcucccuggccacacugccuggucucugccgccagaccccgcccuaauagguggccuuugcuuuuccucccgcccagcagcucagccccuccccacugauccuacagcugaguuccugccccggccacgcccccuucccaucaugccacgccccugaccuccucucugcuucguccagcagucuggccccuccccuaguccaccucccagcuccucccuggcacacaggcuccgccccugccuccuccuggccccgccccaggcgcgagcuccacuucucccgcgcuggggcccgccagggguuuuagggguccgagagccgcgagcaguccaacuccggggaacagcauugcgggaccgccccgcucuucacucgucccggcgccgccgcgcccuuccuccgaguaagugccucccucccaggaguggagcuuagggguugugggagucaaaaaaaaaaaaaaaaaaaaaaaaaaaaguaaugauaaaaccagacacuauuugggaacuuuuaaagugcuacuggggucgcgcuugcaauucgccaagaguuucagcccugagagugggugugagugggugcgagugggugcgaguggggaguacaagugggcgugaguguguaggagcgcgcaucucggaaagucccggaguuuuaacguauccgcgcacacuauggaucccaguuccguugcuggcaaucuaccgcuggggagagaccuccuccagccccugcguugagcccccucuccccauccuuuccuuucuucucugaacuccgcucuggcgaagaguacuguccucuccaugaccaaccucacacgcugaagcaaggguugccuguguuguucaggaugccccagauuguagacugagaugcugcucugagauuguuauccaauccugcauuguaaacgggcagcgagcagaguuuugccuuaaaaucauccugcgaagaaagucgugugcgugugugcgugugugcguuucuguuugucccgugugcuuaccgguggcgccgagcuuccagcaccugcugggagaacaccugaugaguuucccagggccuggugauccaguacugcugauaggcuguuucaagaccagucugaucaaacgacuuggccaccuaaaagauguuccuugacucagcaacaccauguuucuaaaccgauugauuucccaacauacagcacuaccaacuguaguuuacugcccaguguugaaauaauaacguccuuggguugcuuaaaucugaaaguuucauccuaauguaaguuaguucuauugaggagggggcaucaguacacucguugcaaagggcauauuucuacacacaaaaaaacgauaccuugagcaguuugcugcauccuaacagccuuacugugcuugaguuucugaguucccuucuacguauaauuucugguucuccuacuggucagauuauucucgcugugugcauucccacgaaacuucucccacaucuuuguugagaauccccuggaugcugguggggaaagauacuuugaauacaaauuauuuacugaagcccagggcuaacaaaacuuuguagcugaagaaaagaaagaauaaacaggauggcuuuuaagaagccuuugugcuuuggugguugcaaguuaagagcugauaaaucacuuuaagugcggcuuaucacagcggauauuuuuaucaugcauugaauccuguauuacacaaagguguuuucacgcuguuuuaacuaagagaacauuauacuuuguaguguaaacauaugacuccauuucuguuuaagaaaagaaauaauuaucacacuuaauuaaacaccuggaaacauuuauugccaccuucuaauuagaucugucauagggaguuaagucaacaauguauugcugauauucuagguaguaauauaauuuucuuuucuuuucuuuucuuuucuuuuuucuuuugaucuuugggaugcuaucucccuccauguagauuaauguuuuccuccucuacccaccaccacuggaguguuugccuguaaacuggauaaauaaaguuuagggaaauagauuagcucccauauuccuguaagauguguauaguguauuuagauaauauguguucuggauguagauuuaauaagcucuugaaugggucuagauuuccugguuuaauaaauccucaaauauuuuaucaaaaguguagacaguaucuucacagcccuuguucucaugaguuuguguuuacugaaaaaaggggucaugugagucagaaaucucauucuuguugucuuucuguacuaguuuucuuucuauuccugugacaccaugcccaaaagcaacuagcuggagggaagaaggggcuuauaaguaauccaccauugggggaagucgagggaggcacugaagcagaguaagcacggagagacaaugccuacugcugggauggcuuugugcugucuguauucagaugcugguuuucaugcccagacaucugggugcaguccagacauuggcauggucaaacauguuaguugguggucucaaugcauguuaugcacgaucucaauguuacgugaaaauuauuuucuaucacuucggauugauuaauaaagugugauggagcaauucgcugggcagaggagacuauggaaggauuucuaaucccagucccagggacagagucaggggagauucggugagaaggagauggaccaggagacguugccaugaggccucagugagaaagcggccauggugagggcacauguggaaccgagugagccagggcaguacucccauugcaggaccacgugguggggaaguacccaagccagcauaguaggguuagaaucugccauugagaagcugccgaucuuagugcuuguagcuuguuaaugaaaauaucaggucucugugucauuuauucagguggcuuagaaauacccugcaguuauuugggagcaaagagaggcagagacaccccucccuccccauccccccaagaauuacuuuuacagauuccuagguuggucuccaugauuugcucagcuugguuucuuaucuauguaacccagaaccaccugcucaggggugguaccgcccacaauuggcugggcccucccacagccuucguaaucaaaaaaauaccacacagacuugccuauaggcugaucuaauggaagcaaguccucagcugagguuucuucuucuuaggugacucuauuguguggcagcccgacccaaucuaaccaagcacacuuucccauugugaucguauuuuuagcuauagucucugccuagguuuugaguguauaugagggcagacugugcugagacccuaaauagaaugguagccaccaggcucagagcggguuuuuuuuguuuuguuuuguuuuggaggucaggccuuuugcaguuuugguacuguugaaaucagaggaaaggguauguggagagaagugacugcguccaagcccugcucauuaggaaauguccuguagggggaggggcaggucucuaagggacacucccagcaguauaaauccuugggguuguguggggcaucaugucaggcccagcgcaguucaugcacugugcuaggguuagcugcacuuggaagcaacacagcugcuucugggggaucucacucacauuuagaguugagcuuugccgggcacuuagcagaaugaccccuucugcaccuucucaguuuugcaugguaggaguugaaaggaccagauacaagguaacuuccaggaguuaggggagagguagggaugacaaagacaggaagaaaggucaggaggccuguggaaacuuggggauuguuagcuagcucuaagggcacugacuuugccagcgaggacgcacacagagcagacucauaguuuuagggaucuaugucuaagauagagacaaugaggggagaugcaaguggugccuagccagaguagcuuuuaucuccuuguggcucugucccuucagugcccacauccuguaucgaauacugaaagcauacaggaaaaagcuucacaacccccccaaagguugucauaacuacuuaacaacucuuaguacuuccuuuccugauaucccauaucuguuauugguggacugcaguuucuagacuuuucuucuuugccgucacuguccaacauuuggaaaggaauuuuucauggaguggggaggguagggaggcaagaaagggaacgccuugccuuaagauguaaaugaaaaauaacucccaguggaggucaguugguuuuuauucuuuauuauggcccgaagauacagcgaugaguuaaaaagaauagaggguggaugauucuagaaggucaguuaagaggcaccuuagaaagcacuucuccguggucuuagaccacaaccuuuaggggcacucagauuuggggguauccaguucgucagucuagcaaggucggacaugagcguccuucauuccgacaguagaguuaauugagcucuggguguauggccgguaguucagagccacgucugguuuaucugauggccuggaaggcugguaacucacacagaaggacccagguaagaaggcauccuugagggugaccggauugaagcaaaguggacuaacauguucuguguuucacagaggaaagguacuuaggauagucaaaacauucucaaaauaguuuuauuucucugauuaugauuaggaacugugaugguuuguauaugcuuggcccagggaaugacacuauuucgagguauggccuuguuggaggagugucacuguggguguaggcuuaagacccucauccuagcugccuggaagucagucuuccauuagcagccuucagaugaagaguuagaacucucaucucugccugcaccaugucugccuagaugcugccguguucccaccuuaauaauggacugaaccucugaaccuguaagcagaccccaauucaauguugucguuuauacgacuugccuuggucauggugucuguucacagcaguaaaacccuaacuaagacaggaacuauaucuggcacauuuugccugaugucgguuuuaaauaaacaaugacagaacggcaauccgucugauccuguaauauuuucuuuccuuaaauguuuguguaaaguggggacauuacuugaggaaaauguuugaaaguaucccugucucaguagccgucagguagcaauuggguagugccuaucccgucauuucagggggcagcuguuuuuuuucugaagcagcaaggacucaugguacaggagaaaagcugcugcaggccaccgugguuggcuucacagcaucucccuucuuauugagaacaggggcuguagagacaaacacuugugguuucucucagggugacuaaggauggguuaaucuccauccaccaaaaggaaaaaauccaagggaggaaggcauuggaauucgccaaugcaggaguaccccaaacccauguacaaacaaaucucagacacucuuugauaacaguagaguauuaaguucagauuuuccuguguuuguuucaugggugaugagaguaaggauggccuguuuagucaggaggagcuagguuaggauaacucugcuggagucagcugcucguuucucggccaccacaggcuacguuacuuugaaaaauugacaucagcucucugagccugcuuccucaaaguuggugaccgugauuguguucuaugauuacuggaucgacuaaacggaaaauauuuaagguacuccauuagugguagccuuacaucaguuagccaaauuggucuccuuucaggaggaugguggcgguccugagcuacaguccuguagaagaggaugguggggaauuguuuugaaugugcucaugguguggauaauuugucucuuacaaaaccagaggagcccagugaauacagcagaguuuccgugacucccugcugcgggauuacaugauucucugaggggcaugcaucugcggugugagccagcacagggcugcuuaguuugugucucagcaugaggagcuccggugcccauuaagccucccccuacacgggacagugcuuuuaagaccugucacaauuaagcuaugaauagugaguuggccucucgccccucccguguuccaaacagguauugagggcagaguagccaacacagacagcugccuggggcauuucaaggaacucagccuaaguguuugcuccagaagcaaagggcagggaaguccgugcucuucugggaacacagcauugggcaaggcacacaauaugugacuggaugucugaaaggagccaaagaguagaaggcagccuagacaggcacaucugguacuuauuccugcaggcugauucuuuuaguaaagcccucccaacucccaaauccguauuuauuuauuuauuuguuuaucuaucuauuuauuuaaugagauggggucucuaccugguccuggcuguccuagagcuuacuauauagaccagacuguccuugaacccccaaaucccuaucccuaucuaucuaucuaucuaucuaucaaaacagaaccucuacuuauuccugcaggcugauucauuuaauaaaguccuaccaacucccaaauauuuauuuauuuauuuauuuauuuauuuauugagacggggucucuaccugguccuggcuguccuggaacucacuguguagaccagauuguccuugaacucaugcauucuccugcuucugcauucugaguuaggauuaagggugugugucaccauguucaguugguuuaauuauuuuuuaaaaugagauuuggaguuuuugagagauugcugaaagguuaaguacacuguucaugcagagggccaguguuugguucccgguauacacucuggguagcucacagcaaccuguaacucagacuucagggggaccugacaccucugugucaccucucugccuccugcacucacaugugcacacauguacacgcaacaugugcacauacauacucucacacguguacaugcacauaauuuuaaaaacaucuuuuauuuuuguuuuucaaggcagggaaaacucauggagaucugucugccucuuccuccugagugcugggacuaaaggugugcaccgccacaaccagcuuuaaaaauucuuauaacaugaccuucaacaacaauggcagauguagagguuaugguauggagcuauggcaaccuugcuaaacugaugcuuucuagucuugggcuguccagccaacugagaucugagaucagaaucaaacacacacacacacauacacacacacacacacacacacacacaccaugaaaugccaugggcuugucuugggcuguccagccaacugagaucugagaucagaaucaaacacacacacacacacacacacaccaugaaaugccaugggcuugucuugggcuguccagccaacugagaucugagaucagagucaaacacacacacacacacacacacacacacacacacacacaccacgaaaugccaugaccuuauggggaaaagugcaggcacaauguuggcaacagauuucgaaguucaagacauauuuuggugacucagaccuucaagaaauaaguccagugccugacuccaccaugaggugaucaggaaacaaauuuauuuucucuucucucucuaaaaugugaggugguuuuucugggaaauggcugguguuugauuaaauaacccugucaucaccuucguggagacggggcccccagugacucacaggguguaccuggagucgacugagcccagacuuccucagcugcuagagaugacuuuuguuugcacaugccuagccucucugcuccuuugcuuuuaugacccgaaacaucugacaggacccaaagacgcgcugcuguuacucaccauucaggaagcucuguaucaggagagaacuccuggaagaggcaccaaggagucccugccugguguacuauguacuugcugccuucccaacaggaagcucuacccaggcgggcagauccuggauuuucuaggaagccgaaaaggugaaugugugcacugaaacguuggaggcucuaucuucuggccccacaacaggccacucacuuugcaaacuugauguuaaaggugaauguucuuggguucugcuaccaggguagaccugggacucugugcuucugccgucucucugcucuacccuaccucauucccugcgagcuaaggacagcaaaaaaauagaaccuccagucugugagaccuguuuucauguccuauuugagaaaacguauuuggacagcagauaucuauagugaugugugugugugugugugugugugugugugugugugugcguguguaugacuguauacauauguauguauguguauguauugcuguguaagcaugugcauauauauauauauauauauauauauauauauauauauauauauauauuacuguaugaccauguguguauauauauugcuguauguacacacacacacauaugggacucuauauauguguguguguguguauugcuguauaugcauguguguguguguuuuauauguuccuguacauguguauuacugcaugugaacguggguugguggcacagaccugugugcauguccguggagaggccagagauugaugucaggacucuucccccacuuucuucaguuuggagacagguugucucuuugaaccugaagcccacagauuugacuggacugccugucuguuguguccggccagcagaucacaacauggguucuagccuggaaaggcauuuuggaaaccuggaagagaagaggggcuaggcggcgagauaaagaaauguagcuaagacagucauucugaucaaagcucaauuuuacuguuccgcacgcaguuauaaagcaggggaaggggcccgauucccgccaaauaaucuugggguccaauagcaggguaaccacgugcacggcuccgaacagcaaagcggcagguuccagcagugggcguggcagaacgauugaucaggaagcuccaccccugagcaagcagguuucaggcugggggaggggagacuacaccugucuaguaagguuggggcaucugcugccaucuccacaaccaccaggacacccgccugccccccagaacugggauugcagaugcaugcugccaagccggagacccaaacucaggucucccugcuuacaaagcaagugcuucccacgagacccuuuccucggccuagcaugguuauuuucucuguguagaguggcuuuagaggugaaagaacauugaaaugaacuauguacaaugaaugaaaaaagcuaucuuaagaaaucacaaaguaguuguucaauccucaccggacuggaaaguguuaacaauaaggacuccguggcaccccacaaagagauccaaguuugucauccauggaaggucggucacacgggaggaucugcucagaguggacagcacaggagugcugucagaauugggugccggucggucguacguggugcuaauggugcggguuugcugugcggcuggcuuugaggccccugacaguguuuuguagagugcugguccggcauggcacccuucuuucaagcacagccugagacucugagcugcuaagugacccauuuuccuuagccuaggccuguugcacugcccugagguccuggaaccuccaggaauaaccugucucggucccacauuuccucugauuaugcaaugguaggcaaccagauagagaccguuuuuuuuuucuucgaagccaucuuacugugacuucugcuuuucucuccccuucccugaauuuuggguuguguuaguaccugagaacuccuguccuugugcugaauucugguuccuuuuuaauuuuucauucuaacaaggucacggagaaguaugacuaacgaaggccugcucccggugcuagcuagcacuaauuuuaguugguccacugcucuugcugucuaacuuuaaauauuugauuaggugcuaacaagugugaagacugguggauuuugaguccagccucuguccucuagguuugcuggcucagauccagccgacuaggccucccagccuugccauuugaggggugaacagauggaagaaugggcauuggcuucggagacagauggccugagcggagaauuaaccaccuucugccugaugcaugauacaagcacauucucccccaaacuaucccuauaauuaaccuuaagguucuuuucccuuuuauggcuuccacuaguauguguacagucaugguagguguggaccuguuucugaggcugucagagugcuggagaauuaggccaggaucaagauaucagaggcuuggcuucuccuggggucucguuccacgccuaacaaauggccaccugcccucuguguccugcugugaaugucucugguguuugucccucuuauuagguaccagucauguuggauuagggcuucccucuuaugacuuccaucuaccccuaauuaucucuuuauuaaaggacugaauucauauauggucacauugggaguuugggccuugauauaaaaaaccuagagggacacacuuccacucacaauaaucuagguuuauagaaauuaaaaggagagaaaguuuuuuuccuuccccauuuauugacuuacucugggagugcgugugcacacacacgugcucucaugucaugacacauguggcagucagagaacaacuuaugggaauuggucuuucauccacgauguggguugucaggcuuggugacaaaugcccucaccuagugaaccaucuuacuggccccagaaagaaauuggguuucuguuuuuguuuugauuucgaauuuaccuacucacuugauauauuuggauccugucauucuuacuguugacccaaguguacaucugguauguuucuguucuucagauuugaauauuuugcuuuuaauuucuaugcaugcguguguguguguguguguguguguguguguguguguguguguagacgccagagguuggugucagauguucuggucuugcuuucuaacuugcuuacauaacuaggguucucagugagccuggagcauggugauucagaccugucucggccugcccagugcugaggguaccucugguucuuucuuuuucuguguaaguucuggggaugugaauaaacucaagucuucaugcuugccuggcaagcucuuuaccaacugagccaucuguucgggcccaugaagaauuuucuucaauauuuccuguaguugagaucugcuagccauggaucaugucugugcggcugccuggugccucugugugucauuuccucuuuuuauaaggacaccagggauauugggaaagggucaauccuaauacagcuugcuuuagcugaccuaguucuguaacaguucuugucuuuagauauagucgugcucugagauucaacaguucagcaugugaauucuggagggagggagggagggagggagagagagagagagagagagagggagagagagagagagagagagagagagagagagagagagagaugacaaaaugcccaacacuggguaauuuauaaagaaaauaacuuuauuucucacaauucugacgacugaggagccaaauaucaaaauaugagaagaaucuccucagaagccuccuuguuuauuggucugaguucacugacuccuuuaugacauuaugaggcagaacuguuccauucaagccacugcuccaaagaccuggugucucagugcugucuccuuuggguuuauguucggugauggcaggaggacacaauucagucaguucauaucgaucagggaacuuuaaguauacagguaaggggacagcccccggcauggugauuuucacaguaagaguauuaaguuauuuuuaugaagguaaucugugguuggguagaucaggguuauuguuaguggcucaaacagugcugguugucugacuucuuucucuucccaccauagcaugugugcuaccuuucauuugcuuauuugcaaauggguaguuaggcgaaugaaagggagcaugggcaggcagugguaucuuuggcagugccucaucuggaggcagaaaguggggaagugugcacucgggcacagggcacgauagagguagcaaugaccaauguucuccuggagaguccuucucuucuuuggaagguaaguaauucccaaaguuuccaugccuuccuggcuagaaccagucacaacuucaaaggaaacugugaagauggagucacacucuacucuccaaugggucacuaggaugaagcaggagggccagauacuuaggcagacaaauagcgucuggauugguccccaaccugcccaccugcccagaaggcugcugaauuaagacuggucuugaccguaauuuuuauuggaauuaaaacucuacugaugaugguuacugggaggguauuaaaaaaaaaaacaaaaaacaaaaaacaaaacaaaacaaaaaaacccaaaaaaccaacaacaacaaaaaaaaaaacccaaacauauucaaugauuuaaaaauauuaaaaaucccacgugaguaugaacugccagcagcaaaauuuauguuuaggguuuuuuguuuuguucugguuuuuguuuuuuuaaauggcauuacuuacuauggcgaaaucauccugcauuuaagccuagaaaaauucauuacauuuccacaaauguuugcuaacucaauaaucguggcaaacauuuauccagagcuucugauggaccaggcacugugugcaaagugcuuuagacugcuauucaauuucaccuugggaauggaaccaugagaaaggagccuuuguuaauccucucagccaggugaggaagguuaauaaccuccugcggccuguccagcugacccagggccacacccucgcucagcugccuccuucccacacugcaguguucugacugcucuaggggauuugcuccucagaauagcugcuaggaacacucauuuccugugaccucuccugggcccuaggucuuuagcccggugguuccacacauagcaggacuccucaguucacucuauacauggugguguuuggguuauagaaagaugcuuggagaguuguguugagccaccugcuccaugcuuccggaguggauuucggguuuugagcaccaaacacuugacuuccuuuuguuaaggaagccugguccccugccuacucccacccaagacugaaauccuuaugcagccguggaugacuuugaacucuugauucuccugccucgacagagugcuagagcuagaaaccagucccuguaggugcuagauuaguaguuugcuaacugagcuauggcacccacccaaacaacgucauuuuaaauuacaguuguccuugagaugucuuggagcacgucauauguuauaagcuuccaaacauauuuugaaauguuaugucaaguuuuaauugagccuguaaaugagaaccguuuacuuuaaacauaaaugggucucuggagcagaauucugggagccugguccccagcuccucuguccaaaauccugcaguucucucugauguacugacagguuuacagguuuaguuuuuuguuuguuuuuuuuuuuuuaacauuuuaaacuuuuuuuuuuuuuuuuuuuuuuuuuugagacaggguuucucuguguagcccuggcuguccuggaacucacucuguagaccaggcuggccucgaacucagaaauccaccugccucugccucccaagugcugggauuaaaggcgugcgccaccacgcccaacuuuaaucuuuuuuuuuuauuguagaauaaaacaaaaauaccugaaaucuacacaaaauuagaacaggacuuagggagguuuuguaaggcaagcacacaucagcauugucaauggagccucaguguguuccaaccacacaucccucugucccuccagaacucaauguagaccuguuaguaggaagccuuuucuggugccucuuugguugcgucaucccagucaguguucuguguuccgacacacagggguuuagucuugcucauuggacagaaaacaaucuuguugugucuugguuuuuuugagacaggauuucuuugcguagcccuggcuauccuggaagucacucaagagaccaggcuggcuuugaacucugauaucuuccugccucugccucucaguucugggguuaaaggcuaggugccaucacccgguguauuuuauaagugucauuacggggcugauuucccucaccaucuuccucucaucgaggagggucgguagcucuaccacuccccucacuuugaaaucaagaugcagcuccaccuuugccuccuguuuccuacaucugccuccauccugauagacucuggcaggacccccucuggcaagacuccaacugguggaauaugcuguuauuggaagguccccgggucugguuuuuccacuuucuaaaggaugcaucaugcuguagauguaauaacucccugggaguuggagaguguggggaguuuucaauucugccuuuuuuaucacgucaauuauaggcagaaucauuuuauaaagccagacuccucuuugaucauuauuugauugcccagagguauaauucacauaggaacagucagauaaaugcuuaugucuucuguuuuacccaguuuuuucuagaauuaguuucuaucauucuuggaagaugacagggaggcuuuuauuacauuuauuuauuuauuuguuuguuuguuuccuuaauaugaguacacuguagcugucuucagacacacaacauaagaaugcaucagaccccauuacagaugguugugaggcaccaugugguugcuagcaauugaacucaggaccucuggaagagcagucagugcucucaaccgcugagccaucucuccagccccggcuuuuauuacuuuuaaaguuuaaaauaauaaagcuuaaaauuuaaaccauuagaauuaaauauacuuggugaguuuccauccugggaugcuagacggggaguauccuucccuauugucucuggaguccuucuguaaugugcuugcugcccugguaaggugauccaagcuuguuuuacaugguucugccucaacuuguaaggagccucagaaucccagguuuuuauuugugauauuuacagaccacaaaacagguaggaaaugcccuucacuggagaagccauucuuuguaggcauuucuacugguuucaacugggaggaauacucacauccauacagaaacauagacucuugugaagauacaacacuuuuugaguucauaucgaugucuccaguucacaugccuugacuguguguguguguugggggugggggaguguuucuauuuuuuucccuucuguaguaggaaucugugaaagauaaaccuauguuuuaagauuuaauuacuuuuuuuuuuaaaugagauaaacaaaaauacuucuaaccuauaagcccuggauccucuaggacagaaaacuuccuagaauguuaaggucuguucauguaagaugauuacucauagguuuuucacuucuguaaacaaaauugauugcuccagcugcauaggaugugcuugaucacacauagguggaagauccaucaauaggaaguaugucaggauguaugcuugcuccaacuggacaaaggcaggaaaaauguagccuucugggguuugccuuucuaggcaccuaacauaauuugugggcauucucugggaaucucagguauggauuagacuaacguccaucuuucuggucaguauuuaauaaagcuuguuucaaauuuggcucaaaaauugugguagugcucuuauucuugccugguguggucaacacauccuguuuuguuuguuuguuuuugucacaggagagagagaaaaauaacagucacauuugauugcuccguaugauuacauguaucagucuccaaguaacaacacaaguguuauaaucaccaugauuauggaaaaacaggauacuauuugguauaugucaugcuccuucuacccaguuuuuuuaugauuuauucucuauacugcuagaucauauagccauauaucaaacaaucugccuuguaauuuccauuugguguuauuucucuaguuauuuucaucagucuucacaccagaggcuuuagacauuccaauuaaagaaggauuauuuagcugacuugauaauaagaacucauaggaacuauauucccugauuuauugcuaacauuuugugacuuuuguaauuagagucaguuuugcuggguauaaaauccauacgucacauuuucuucucuugagacucuaaaauaugucacccuugucagaaguccaaugauggaaauacaguucuuuuuugaucuuugugaucuacucuuguaacacuuuggagggcaccgauuaugcuguguaucuauuucagucaaucuacuguauucccguucuaguguuagggagcugcuaugcuaccaaaugcuaguuuguguuuugaucaguucuuauacuaaaccaucguuucuucuuuucaauuuacaauaacucugcucucaguaacuauagcacuuuugucuuugaaaggucagcugaaacuuaacagugugcaaggcuagcacuaacuacauguugugcaaggaagcuggugguuuuccuuuccuuauuaggcugugagaaaccaucuauccuuuuuaauuauuuucuuuccgugaggugaggcuuugccucagauacagcugugccaaccaaggcagcucuucucuggacaguggugguccucuauacuugcugucaggcuguguucucaucauacugcauagggaaaccuaugcuuucagcacauaugaccgugaacaccagaaugucccuaugcuugauuccucuguucguauucccuuuuccuuuucuuuauuuuacagccagauucccacuucuuuauuauugcauuugugaccacugaugccuuauuuaauaugcauauuaaauauuuuguauauuuauauaaauacauacaucucuaugugccaccuguguaccuggugccuguggcgcuagaagagggcauuggaucccuuagaaccagaauuauagaugguugagauggcaugugggugcuaggaauagaacuuggggcuucugcaagagcagccagugcucuuaagcacugagcuuucuuucuauucccuguuaucaccaugugaaagguaaaaacauucagaacuguguuauucaaggucaaugggaaagcuggcauuugaauccaucuuuaauaaagauauuuuuaguuugcacguggaagaaagagcuugccuaugauuuucacacgacacaaggccucugauugcguuugcucacucccuuucuccugcccugucuacuacccauuuguugcagaaucugucaccaaguucaucuaggggcacaugaagaugcuugccaugggucaguaacagguagggcacaagacuggguuagaggauggagcuauauuuuuccaaguuuagaacuuuuauagacuuuccucagcgcuauuaaaaguaucugguuuagacccuggaccaugagcgggaaggggaagagguaugacaccuggagcacuguggcuuccaauccauuguccucccugcagacuugagaacugcauaucauccuggcaauaagucagugcuguuaucugcccuugcuuguuaauaccuuagcacuacgugugcaugcauauguaugaggcacgugcaugugugugcacaugcauguacauguauguaugcauauguguguguguguguuuguguguaacuaaugugucacuuugaaaaguuguuaaacauguuaauuugguaaagaaaaguuucaaagccucuaaagaaguggguuuuuuuuucccuuuuggcuugcuuuuacugugcugucuccacauauucucagaauccuuuuaaaaauacacauuuggaccacugagaugauucagcagcuaagguacuugccaucgaaacugcugaccagaguuaaggagagaauugaauccccaaagcugugcccugacaucagcacaccuucuagccuccaccaaguaauuaaauguaauuuaaaaaguuaaaacaaauacucauuuggucccgagugguggggaaaggcuuggacaggcauggagguggugguuguguuguaacuggccgugugagcaugcugaacuguguaaucaccguguaaucacugucagcccgaacagccucaucuaagaaugucaagcagaaacuagauuaccucccggcccuccuggagcuggaauccuaaguucugaugacgaucacauucacuuuuuauuaucacugcaagcacaggugccaggggagaccaaagcccuugggagaauaagaaagauagcgucccaggugcccugggaaggaaaacugcccuuccugucccaagauagaguaggaaauuuuaaccaaggagcuuggcugggaaggcagaauccuggcucagugucuucccaggagacucuggggcuguacaguguuguccugagauacucuggugaguaaauuuauuuuuagacuaucuucaugauccuuuuuccuugccaagugacuguuaacucuaguuacauaugcuaaauagagaacccaucugugacaauaucaagacgcugauaugagugacccacaaguaaauucaguuucguacaaaaaaaaaaaaguucauuacaguuuuguuuuuaagaacgaacaaggaccgagagaauagcucuggcagaguuugcucaccuagcugcugcaugaggucccacauucaauccccagaauugcaaaauaaacaaaauaacaacuaaaacccuucaauggcuucaauaugcuuggcugccugugucuguaaaacgguguuuccuggaguugaaacucuaugcagccacagaacaagguuggccucugugcucugauauggaaagaucuucaagagagauugaauuaaaacaccaaauaaugaucucauuauguuuuuuaaaaaggcauauucuauguuuaugagugcauaggcauuuuugaaaagaaugaacacugucccauugguaguagagcugcagcuugggagggaaggggguuuacauuuucauuuuguucuaucuguagugcuccaacuucauaauaaaaauauauuuggcaagggagagaauuuagauuucaguugagguuuugaguccuucuaacacucccuuugaaaaaucugaauaaaaauagccugcugggaaaagccaagggaauauaaacacuuuugccucccagcuuuagguaucucuccaguuccauuuccccagcccuguccucuucaaaauacaacucuccgcugacuguuucuuuagcucagacccauccaugcuucccccagggucuauugacguucugaagggugauguggcugaucaugggccuggucuguugacuuguuauccagugucaaaggcuguuccacguauugggcauaguacucaugcaagagacacuggugugcugugcaucuccuagacacuguguuuggcuuccaggucucucaaccuucucucuuguaacaucaagugaggaauggauagacuagcagguucaaagcuccuuguauagcccucaaggcugugccugacuccaccccccuccucucucugugcuuacuucccaucccauucccaaaucucucugcagguuaccaagccacaccacacccucucuucccugagugugcuggguuggacccaaguuuucucuguucuggacacagcccaggugcugucucacaaaucaucugaguccagaaaugacuuugcuuucaucagagguccuaugaguccucccagacuccuauuuuuacaacauuccaaccugcaguucucucugguguccuuagauaacuuccugggcacaguaaagacuuuuuuagauuuuacuuuuuuuuuuuuuuaagauuuauuuauuauuauaucuaaguacauuguaucugucuucagaugcaccagaagagggcgucagaucucauuacggaugguuaugagccaccuugugguugcugggauuugaacucaggaccuuuggaagagccgucagugcucuuaaccacugagccaucucuccagcccagauuuuaccuuuuuuugguguuauugagguauaaugaaugaauaaugauugcaaucuauucaagaaguaaacuuauaugauaugauaugauaugauaugauaugauaugauagacagcuacaucuagauaaaaguuacaaggaccaacacuggacaccuucucauuaaaguuacaaucuacauguauggucagaacgcuuaagaucuguucucuuauuagcucacgacaccauguuguacaguauugggccuuggaauucuuuuucuuaggacucaagguuuguaacauuuaacuaagccuuccccauacuuccaccccagcccaggcaaccaaugucugcuuucugcuucuaugaagaaagucuuguuauuaguguuuauuaaugagugauuucauuuuuaugcuucacucaaauauuuuuacuuucauucaaagaacuauuuuuaaaagucuaauguuagggcuggaaagauugcccagugguuaggagcauuuguuuuuuugcagcguauccagggucuagucccaguacccgcuuggcaguucacacacauccauaacucuaguuccaggggauucaaugccuucucccaacaucugugggcaccaggcagacacaugaagaacaugcaagcaaaacauacauguacacaaaauaagaauacauuuuuuaaaaagccugaggcuaaaaguaaaacuguucccugagaaucuacugugauuaauagguuagaccaucucuuuccucuuacaaaguuuaaacuugaaccuuauugaggaauauuuaggcaaccaggaucuuaggcguuucccuugucaccacccuguacuugaauauuguaaguucuuaucaaauaagcgagaucuuaucuugauaguugaagaaguaaacauaucacacccacuauuaagacaacucccagaaaaguaaauuuggaaacaaagcaccguaaggcuguagacauugcgugaaaaugcaugucguuucuugguucccuuccaucucugcccuuacguacucacguauggcuccccagggaacacacagcccagcuuggugacuucacuuggcauugcuuccucccuaguucccgugcuuccguggacauuuggcugggauucaagaugagacucuuaaaauucacuugaugcggccuuuccugagaaagagauggagacuguaaaacagaugcagccagaaggagggccaugaugcacuuuaaaaagaagagaucuucuuccgauguuaccuccaugggcuggacuaaaacuaguagaggaugcuugccauuuguagcacggagagacuaagaucuugaggcaacugcaagccuuuucuuaguuaaacacacacccucaugagaucagacaaguuuuuugccugagcaauagcuuuuuauuuacgaagguguguuggaaacagcuggcuagcagcccuuccuuauccaccccuuggcuagccccaaauuguuccauaauaaaaauccuugucucuuaacugauaggauggaauaauuuacacagacgaaucaaucucgaaggagccuuuuuagaagaaaccacaucugaccuguacacagaggcaaagagguaugguuaacauaaggagagaauuaggcuaaauaccagaaucucuuugaggucuucuccaaagagaaagagggguauuaagcacacagaauuuaacaggcacuaaauacucuuucuuggacccagacuugcuuuggccccaggcgaaguuaaaaggguuaguuagcacuguauuuccugccuuaaagccauacugacuggcuuugaccuugagaaacagcuaccucccuuacaacccuccuuuacagaggcuuuagaguauucuacuguuucuuuccucucucacagucauuaauacaaacguuauccuaacuuacguuucuguuuagggacuaguguuguuacagugaucgcucaguuauaauauuucuaccccucuuuuuuucuccuccuacuuccuccccguuccaccucuacaaccugugagaagucgagaauucaugacuucuauaaucauucuuguuuuacacacacacacacacacacacacacacacacacacacagaguccaauuaguguuuccuguauauacagggauuuaggcuuaagcaaccagucagguuguucaccccaggacaaaaccaauucucccucuuuuaguaaccauuaacugccuguagcucuucagcuaggcguugggucuugugcccgcuaccuuugucuguccuagaacguugacugggauguccuugugcagguaacuguauuguugggaguuuccuguugcaucauuucugccaugucugaaggacucugguguucaccaccccaguccucuggcuuuuacaauccuccaccccucuuccucaguuuccccugagacuuaagaguaggggccauccucuagauguccccuuuaggaaugagaacguccacagccaccugcucccugcgugugaccaauugugaaccucuguaacagcuuucugcugccaaagaagguucuuugaugagggccgggagcugcgcucaucuguggcuauaccgagaaagcuuuuagaaggcgguuggacaauguauuaauuuagcaaaaugguaguuguggcaucuccuccaguaucaaucagcucucuggccagaggcccuuagcuagguuuaugauaccaggcauucauuuucuccauugagugggcccugcguccaaucacaguuguuggcuaacuccaagcuguugcaccacuagggauaucuugcuggacugggcauuacuguggcucacaggaucuguagcuagguuagacaacugauugucucuucuguccugucucagcuuauguagcacccucuggugcuaugagagcuagcccucauggggucaguacuagauugauuccugauucccccauccccaccauggucuguggcugaaugucaucagcaauaggcucuugcacuuacguuugaguaggcaaccaagagcaauggaauagucuguauuguuuuuaauggaaggcauccuugccuggcacugggguuaggauugaucaucugugguuucugguggaaacguuauccuucuguggugguaauacaacacacacacacacacacacacacacacacacacacacacacucacacacacacacacacacacacacacacacacacacacguaagcuuauaaaauaauguuucucuauggccguuuaaaacauucuuauuccuaauuaucccuccuuucuucuacuuuacuggcuucuaagguuaccccaaguuaaacucaaaccuaaagauucagaguugagaugcacaaauaagaaagaacacauggucuuugucugucugggucuugguuacuucauucaguauaauauuuuccaauccaauccauuuaccugcuaaguucaugauuuuucaccuuacuauauuacagccuguaguuucacacauuaaauauuaucagagcacugugcaguucucaguggggaugacaaggucucuguguguuacuuaugguuugauuuaugaaagggccauaaaugaguaguucucccucacccacugguuuguuuuuuuauagauuaacagcagccucuguggguccuaccaagaccugugggaaugacaucgucagacuggaacuuagccccagguuugagaggacaccagcacuguccuggaauaugggaggaguaagagaacuagcaaaugaaaaucugugaaaugguuccagucucgggauagagggaaccauaggaaugugccagguuccaugaggcuuggauagcgauaagcucugagugcugcuaucugagacuggcuccgaccccacuuggucacugcuagcccuugauggccacagguggcccuugagugcugauuuugcuuuugaugaguuagaaaagccaaguugggagaugaggccugggcuggagguguuguagagccucucuguuuuccuagaaguauuuccuaagacccagggugagaaucagaaucuaaacugccagcgguugcuacuuccacacagccaaauguuugcucauuuacugauuuuuucuuuguuuguuuuuguuuuucgagacaggguuucucuguguagcccuggcuguccuggaacucuguagaccaggcuggccucgaacucagagauccgccugccucugccucccgagugcugggauuaaaggcgugcgccaccacugcacagcauuaguauuuccauucuuuuauucuugagucaaucagcuaaugaucaguacauaaucuugcauagagcugccaugaauuugggagcagcuuagaugccuggcacugacuugaggugucuucaggcuugaagccaggucugcauaauccagagauucuggaccagaaagauccaagcaagaaaucucauuucuuacauucagcuucugacaggcuuuuuggaguaagcccuuccaugggggaugagucucccuagagacagugacccaaccuaguauagguagaagacucaaguauuugucauaaccauguccugagagucacacaguuagcuacacaggucacaugggaagggauuacacagggacgugagaaucauuggggaugcuuuggagacaagcugacucaggaggcaaagaucugcauagcguugaagaaaacguggcaagugccccgguggaggagguggcaucugugacaucugagauugacagacugucacugaguggggaagggaaaguguguccugaaguagggaccaggaggagggccaucaaugcaguguggcuggaacggaagcuggcaggaugaggaagaucagcaccuaugagaucuuaagguggggaaugaggugucucaaggcugugagcuggccaggaaccucaucacugacacagguagcuguaguuuguaugugagccucaggguugggugcccucgucuuucucaccauuaucuacaugcccagcuaucucauuuccaaauucuguaagacucuugccccugccccccuuggccacugacugucuuguacuguuuaacuuucauguguuugucuuauuuaucauggggagauuacaagggccacagggccuagucuuaucuguuuguauuuccugugcugugcuuagcacacugguguacuguaaauacuugcuaacugguggauaauaucagccaguuacucuguguggagagccaccauuuccagcuugugggugcauaauguaguuaaaacacuuuccauaagauugcggugaguggaaaacaucccaauuugccaaacuauuuagaggaaacuaggggaaaaaugauuuaacaaaaacccuguggguuauuuuuaacuucaaaaaguuuauuuugcuuaauucaguuauaacugccgaugcaguuauagcugugugaaauaagaguggcuuucuuauuugaguaugggccgccucgcucaugcgcacacagcaaggugugcuuuuguucaggacgugagguggagcagugaaaugauugcaguccaccuccguacguaacacucguguuuuaccgaaguuaucacuucacaaaagcuagagucuggguuuuaaguaagcagggacauucaugcuuucaucuuugcaaaaucuugugaaacuaggaaugaagucuaagggguauagacgaguccucauaaaccgcagagauagcgguaaccccauaugacacaaggcagaugaaggauggccacugagguugcagagaaaggggagagacuaugaggugucugcugaggaggguggagcugaagcagggaauccgugagugucccaggaaucuccaaguccugauuccagaggcucaggugaggcccauagcuucccagugggagcggaggagggaaaaaugagcccgaggaggaauaacagggauuugucccgaguaguucuggccccaggagggcagccaggccagauucacugcgagccugggaagaaaaugucugaugggaaagcaaacuauuuaagacugguagcccucagcgcaaaucccgaccagggagcugugaauccggggcagucagcuaguguaugcgcuuggguuuuaguuccuuauuuauuaaaaugcaaaagcugggucauaugauucugaggucugcucagauucaaaaauuaugauuuuguggggcaguaacuccauccccugcuccauccucagaaauucuaguucuggguaucuaaugcagaaaaaaagauauacaaauacuuuuuaugaguaugcucauauacucuauaugggcuuccaaaggaugaaagcaugcaugugcgugcuuccaagaucaugaagugcggucugucguuuacaaacucuggauugccuuaauuucuuuaaagguuuuuauuuuaguugacaaguaagucuucaauauaugaaugguguacaacgugauauauugguaauguuuacacuagggaauacucaauuaaggugcuuaauaucaguauugcuaucucuuuuuccccccaucccuuacagugaaggaaauuaagacaacagcugagaucaccgguaugugagacccaccacagucuggguucacgugcauagggcaugguuggcagcuguugucaucaggaugcacaucucuaagaugugcaguagaucuccugacugaccugaguccuccugucuaacugaaguguuaugucugugauuaccucaaacucucacugcacccaccagucucugucaacuuugaggccuuuuuggucaauguauaaaugagucauucagucuuugucuuucuggggcugguuuguuucucuuaacgggagguccuuguucuaauuuguccucuauggcugcgguuagacacgaaaagcagcuugggaggacggaguuuauuucaucuugcaggucguacuccaucacugcgggaaaggcggacagaaacuuaaggcaagggacccggaggcaggaacugaagcagaggucauggccuggugcugcuuacuggccugcuucuugaggcccaccuguccugggaugcagccugugguaggaugggcugucuaauguuuauuaacaauaauaauaaaugcccuacaaacaugcccacuguagucugaucaaggcagucccucaguugagacucccugagauaacucucaacagugucgagugaccuacccaggagacuccuccaguguuguugucaaugagauuuucuuuuaaagaccaagcagcguaccauuauuugucauugcuucucugcucccccuccccaccuucagaccccaagacaggaggggaggcaagaacaaaccaggagugauggcgacuuuaggcagugcagcaagaaacaguagacaggccucagagagcagcuccuuuaauugcagggaacaaaggcuaauuaaacaucuggggguggggggggggugggugagugucugucauugagcagggccagggugcugggguugcuugauuagcagaaggaggaauuccaggugcugcuggacaugcccuuauaaggggaaagaaaguuuaaucuggcuaaugaguaguuaugugaccuccuugguggagcaagggugagagcacagguuuuuguguaucaggacacaggucccgggcaggaggagccaugaucucugcacaagaguuccagggguuuagacaugccuugaccccacucuugcuccauccccacccccaccccugcccuccaguuauacacgcacggcacauuuuguuaucagggcaauacucuagaauuuggauugugguguuuguggcauaacucuaaagucauuaggaguauugaaauguauauuuaaaguauugaauugaauauuuaaagugacaaauugcuucauuaaaacaggggaggagccgggcgugguggcgcacgacuuuaaucccagcacucaggaggcagaggcaaguggauuucugaguucgaggccagccuggccuacaaagugaguuccaggacagccagggcuauacagaaaacccugucuugaaaaaaaccaaaaccaaaacaaaaaacaaaacaaacaaacaaaaaaaaaccaggggaggauggcaggggugugagagguugcucaguaguuaguaccuguuguuguuucugcagggacccagguucaguuuccaguacauauaauguugacuuacaagcaugccuuaacuccgguuccuaggcaucagaugccuucuuguggccucccaagacaccaggggugcgcacacgugaacaugcaggcagaacacguguacacauagaauuaaauaaauuaaucuaaagaauugcuuagaaugggggaggauauuaagaggccaaggaguagggaguagagcgguauccgugaaccgugagcaaugcaucggucauuacugaagggggugggugggggcugacagcgcuuuauccuuccaacuuugaugucuguuggaaauuucacaugccaaaacuggugagcaauuaauauuuuuaaaaaauauacaaaacauuggguuuucacuuuuauauaaguauauuauauuuuacucauauucaccucucuacugccauuuuuugucuuacugccaguaggcugguccacuccucccucccagauaguuccccacccccuuugcuuuuaccuauaaaucuagaucuugcauaugagagaaaacauguuauauuugucuuucuuaaacugguuuauuuuacaucccaugaugguggccuguucaucccguuucuugugagcagcauaauuuuguuuguuaugacugaauaaaauccguuguguauguuuguguacaugaucaaguguguacacaugugcgugcucucucaugugcacaugcauauggagguccgaagucaacacagggcgucugucucaaauucucuucaccuuaccuuuugagauagggucuuuugcugaaucuggagcucagcuagagucgcuggccagcaggccucaggaauccccucgugccucuguguccuaaugcuggcgucacacacaggcaccaucauacuugacuuuuuauacggaugcugggaauccagacucagguguuuaugcugugcgguaggcacuuaacccacugagccaucuucacagucucccagucuaagguagacuuuagcuccucuuuugugaugguuuguauaugcucugcccaagggguggcaguauuagaagguguggcccuguuggaguagguguggacuuguuggaguaggugugucacuguggguguggguuauaaggcccucacccuagcugccuggaagcaagucuccuuauaccagccuugagcuccuccugcgccaugccugccuggacucugccaugcucccaccuugaugauuauggauugaaccucugaacuugucagccagccccaauuaaaugccauccuuauaagaguugccuuggucaugguguuucuucacagcagcaaaacccuaacuaagaugccucuuaagaugaggaaacuugaagcacagaagagcugcauagcuugucugagagcaaccaccuaauggacauuagcacuguggccagcugacuacaggcugcgcuuugauacaucccguauccuugauugccuuggagcauaauuuccaccaaaggcccauuuccuacagacuucuguccaacacaguccaaccugauguuuuugaagaaauucaaugcuuucuccauagugguucucguaauuuacauucccacugacgucauuugugaguaacuuucucuccgaucuuuaucagcauuugcuguuuuuuuauuuuagguaguagucgucauucuaguugggguuucauggaacuuucuguacaucuugauuaccugugguuuuccugguugcugaguguuucagaugcugcaggcugcaggccuuaacaucuccuucacaucugacucccaaauucaguggugggcuuucguggaaucuagugggguggacuccuuggcuuaugauuucugaaaggucuaaacauguacaacgaaaacacuuaacaagucauugucaugugaaaaaaaaaauggaacugaccuaaaagcauuaguuccugcccauaaugcacugcaacugucacccugcuuccucacccugcuuccucggguaaauacguacccacguguccccaaugccuccucucacccacuccaaggucucauugaacuuuuucuguuggggaagggcgggaaagccuaggaaguagagaaaggggagagaggugagagagaaauuccuaaggaauuucuaguuugucuucaggaaagaaggggccacuuagacuguaugacuugagcaucuccugacaagccucaaaaauauuguaguuguuucaguuuuaaucuuuuaucagaaaaaagaaaagauagggcuguugagauggcucaguggguaagagcacccgauugcucuuccgaagguccgaaguucaaaucccagcaaccacaugguggcucacaaccaucccuaacugagaucugacucccucuucuggagugucugaagacagcuacaguguacuuacauauaauuaaaaaaaaaaaaagaaaagaaaagauagauuuauuuuucacucacaauguauuuguaauaauggaaccaacuuuuuuagacuuauuaguggauucuaaccugugcguuaggcuugacugucaacaccccugucccaugaaagucauuugguucccaggugcagcgucugcagcugcucgcugguguuuuguaagcuggagagucccugugcucuuagagacaagucucuuaaaucuuauccucagaguguaugaccuagaguuaugcaugugcucuuaugguggggggaaaaaaaaagauuucccgggaccgcuggguguguuuguuguuguuuuuuuuuuuuuucccucugcuuucuuguguucucugcuagucuguggguaaaagcgcaaagcaacaguuacccacuaggagaaggguaggguggaaagaaugcaauuugcacuugagaauuagugcugcuucugccaggucacccgcuucaguguguggcauagcauuugguuuuucuuagucaaguccaacucuuugucccauagucuuuugaaaaaaaaaauguguaagugugugugugugugugugugugugugugugugugugaaagagagagguguaugugugugagagacucagugugugugugugugaggggggcauguaugugagagacugugugugugggggggaggcagggugggggggggauggggagagaacacaaaagugaaggccugccuggaggucagaggucagaggucagaggacagugcucaggcauucucuucuaccacccugaaggaucuagggacagagcucagacugucaagccagcacucagaggccuuuaucaguuuugccaucggggcugggguggugugacuuaaugggcauuuuaugagcucaucuggagccucuugcucacgugaucaucuuuuccuggggucagcgggaucagcgcguuaacuuccauucuuaaugaacacuuacagcuucugaucugaggugauucacccucgacagcaaacagaaccccaaacagcagggcaaagcagaaaggcuggaaaauaccccuggccuuucccccacuucuuucuaauuuugccucaguuuuuuuguauacugugaccaacuaaauacccaagagaaacaaccgaagaaguaaggaugucuuuuggcacaaaguuucagaaaucuaggugcauguugucuuggcucugucguuccugggcaguauacggucaggcagggagcaugugggagagcgagcugcugaccuuucgauggucgagaagcacagagacugagaugaaggaucuggggacaaguucuucucuucaaaaacacaccuucagugaccuacuccccgccugggucucagcaccuaaaagcccuuucagccacaaccccaucaaaugggcugaugaaagcagagcuagaaagccugcuagguagccaagggcgcccuuagugugagccugcaggagaccguuguagauucaguguugaaggaugcuucacaugugagauuuccuauggcuagacacauaauauuuucuucuauuuuguaacuuacuuuauuuauguauuuauguauuuauuuauuuauuuauuugugugugugugugugugugugugugucuugaacuuuguccagcgugcuguuuuuugacccccugguucuucugucuuagaaagccucccuguugugugcuuuagcuccauccaguacaaaaccaugcacuaggaaaggaagggagccuggcuucccgggcugauuccuuucgggggagcagccgaacagcccguguaaacauuccauuucaguuagagauaacuccuugguuucccauuacccacgccagugaggucauacagaaugugcccacguuaaugagcguuguguucuauuucaagugcaaguugucugauagacuguguacaguuuuugaagcuuagggaacagcuaguguuucucugcuaacaacauguggugcaggagagacucaugcacacacacacacacacacacacacacacacccgucucuaucccuagccccacaccugcaguguaagcaaugcugggcgccuggggaugggcugagucagagggacugcuaccucugugccacaggagaauucuugacucacaucucagaggccuccaagaccaggggccagacuuucuugccccaucuauggauggggguaguggagugaauccaaagagauggauaaugguauacagccaagaagugaacgcaugcuucaaaccaauagaacugagaagaaaggugaguugagcucaaugaaugaggggcaggaacuggacaaugcccuuuagauucaugggucacucuucccauuguuuauguaugcacuugcuauaugacauacacguucaacagugccccuaguuucuagccccuugcgucggaaauucauuuaaguccguuuaccagaucuggaauccaaggauuaaaaaguuaaacagcuuugaguggaaauucucuccacguuuucucucugucuucugaauguuaaugggagucuucuuccguccuccagguuuuagcuuguguggucuaagacgcaaacacuguuuuccccagcuugaccaucacuaaaggguuucccuugcuuucaguuuaagcccucucaccuagcauguuaaggcuaguucauaucuaccuguccaucccagcuuccucuuugaaaucacuccaucucugcuggcuggaacuauuucuucccuccauagacuuuuuagucuucucccuuuucugugggaagcaccucucccgcucgaacuggcugcuuccuuuagagcuaaugcuuugagauauucccaagcauguccgcuguccuguguaccguguaagcucccuucuggacauuucuagagauuuagcguacugucuaauaauuuugaucuauuggccugccucccucagccccagggaguggguugugagagcauguguugaagagcuagacacuuuucuaagggguuaauuugaucaaauuauucuguccuuacagaaaugcuuuacagcuuacaucguaugcuguuuauuucucuaauuaaaaaaaaauuauuuuaaaggcuaguagauuuaauucuggcuuacuguuacagauuuugugcuacuaguugguagaaacaggaccuguccugggcaugguagugaguagagcuguguauuaugaaccuaucaaaaagguagcuuaauggaaugagggcugcaucgcugucaguuucgauguacucucaagcaaucucucccgcauuaacaagaaaaaucaggcagucaggcaugguggcucacgccuuuaaucccagcacucgggaggcagaagcaggcggauuucugaguucaaguccagccuggucuacaaagugaguuccaggacagccagggcuauacagagaaacccugucucagagaagagaagagaagagaagagaagagaagagaagagaagagaagagaagagaagagaagagaagagaagagaagagaagagaagagaagagaaaaaucagggggaucuggagagauaguucagagguugagagcacuggcugcucuuccagagguucugaguucaauccccaggacccacaugguggcucacaaccaucuacaaugagaucugguguccucuucuggccuaugggcauacacauagaacacuauacuacauacguacauacauacauacauacauacauacauacauacauacaaauagaaaaaaaucuuuauggugagcgggaaugguauagagguuuuccagaggggaaacagagaaaguggauaccauuugaaauguaaauaaauaaaauauccaauaaaaaauuuuaaaaaaucaguuuucaccuuugacaaucuccugugaguauacagcacacuguggucacaguccucuacauuagcucucuacuccugcuggcucugucuccccagcuacagggagaagaauucuuagugucuugucccaacgccaacugaguggccuaggcaaugagcuucugcaggagcacgaggcagguggacggacguuccuuggugacccacggggaauucucaaccuuuuccuggcugauuguccuggagcagagccgucaucugagcguguggcacaguccucacagcuuguaccugcaguaaaccagagguugcacggacucauuucuauccaaacagagaaucauaaccaucuccuuuuccuuccaggugauaauuuuccugucgauaaaauugcauccucuuagacuuguuuucuguugucuucauaucguucuuguagcacacaaaagcugagugggugugcugacccaacugaaauaaauaaauaaauaaauaaauaaauaaauaagaaaaccacagcccaggagaaaagguuuagauauucugggauuaaaaccuggauucccagggcaguugaguucuggguccagugagagagucugccuuaauaaauaaagagcaacggaggaagacaucugcuaucaauuuccggccuccgcagaauuguauccugugugaacauacauguguuuccccucaaaugugaacaugcagaccacacacacacacaaaaccaugccaaacaaaaguaaauaagagaauauuuuuuuuuuuacaaaggguuggcuagaugagauuaucugaaagaugauuuaugauugaauccuuaucagugagucaacauaaucuaccugucaugauauaaaaggauuuaaaaaauaagagauaagaucaugucaucgugugagacuacguuaaaucugugaaguccaaacugaaagagcagaggaagagcccugugaagaagggaaguccccgggcugcggcgagugccccgugauuggcccucuaugagcagaaucgaaauaagcugauuuacaagggaaaaauagguuuccgaaguaaagugcauugauaguugggcauguuagcaguuuucucuaaucaaaaaaaaaaaaaaaaagcccccccacccccauuuucuuccagaauauguugcaaaaagugcauguguccuaguucuggagaaggguuuuaaauuuaggcuuuggugucuaaacacuuugaaacagaaagguuuuaaucccagaauaucuaaaccuuuucuccugggcugugguuuucuuauuuauuuauuuauuuauuuauuuauuuauuguuuuugcgagauaagguuuaucuguguagcccuggcuguccuggaacucacucuguagaccaggcuggccucgaacucagaaaucugccugccucugccucccaagugcugggauuaaaggugugcaccaccacaccuggcuucauuuucauuuuaaaggucauuucaaauagaguuugcuaaacucuauuuaaauagaguagucaaaucuaaaauagaauagacuugccucaaaucuucuuuuuuuuuuuguaguuuaaggauuucacaugugaaugagcacacuguauuggccucauuuccacccuucuccuccuguguguccacucaaacacccccuucuaaaacuuacaacuucuucuuuuauaguuauuuuauuauacuugaguaauauauauaaguaugaauucuauguauguguguguguguauucauguauguguguaugcauguauauauccuacugugucaaguuaguggugcuuugauuugcauguuugggguugacucuuaggauuauaguuuuaucuuugaaaaacaacaacaacaaaaacaaguccccuauuguugaacauucuuaauaaucucagguuuuuauauaauaacuaacacugcaguaaacacucagguuucuaucauuggguaccaguaaauuauagucgcaagguaacuuucuggauaaauucuaggucaaggguagacauacaguucucauuuguaaauaucuucuggguucuacauuuuaaguaccuucugcuggcauucuuacuagggaaaacuuccuaguaaaguagauaaauacaucuaauuauucaugcauauuauaaucaucuaguuauagagcaguauuuccauucuuguauucauauuuuuauucauuuuaaaaacuuuuuauauuugaaauguagaauggauauguacagauaacauuccuuccucaaaacacaacugcuaugaaauugugauuuuugcaccuaagguccuggguuugaucuccaacccuggaaaacgaaacaaaacaaaacaaaauaaaacaaaacaccuuucauuuccaaaagagcuguauuucaagcaaaaaaaacaaaaaacaacaacaaaaaaaaaacccaaaaaaccaaaacaaaacaagccacaaacuguaccuuuaaucagucaugccacuuagaguugcagaauauagagauggauuccaacuccuguaauuuagaggugaucugacuucguauggcccaguacucgacacuucacggaucuugcccaacuguugauuaacauuaaaguaauaauguaaacuggguguugcaggcacgaaaugauagcuuagugcaaaugaguacauugcugcugacauuuccacaguuucccaucugugaacuguccucuggguucucaggguugacaguguucucguguugacccauguuugguuucaugagucaguuuuugccuuucuguuuaaauuaaguuggaaguuuggacuuuuauguguguucuucccuuacuacgacuuaugggcuuccugacugcaugcaugaugugggguacagccugggcuucccugccucuucugaaaggcugccuuugcagaaaguggccuccuaaggucuuaaguaauccaggcaugauaaguguucuuggcuauguaauguuuuacaaucucucuuaaagacugaauauagcgcgugaaggguucagagccauugcugcuccgugcugcaggugacugucccuuuccuguaacuuauggcgccuaguaaaaaggccaaugugguucuaugugguaaagccguuacacuguuucuugcugacugcaucugguauugaagaagacagcugugcacauuuuugguuacauuuugugagacacagagaccagaaaccuuuucugcaguuuccuucuuugcucaaaccgcagcuuccuuccuuuguauuagcagcucugcugcaggcucaguauucugauuucucacccugcauggcaaguagcaagcucacccaaccaagaugaaauguggccacucauggcuucgcugagugccccugucccucugaauagacacccuugccacaccugagugggguuuucaaaacauuuuguuuucagcuuuuuuuuuuuuaaaggaaaaagacuugguggagguguuacuugugagauuacaacauuuucugggggccgaggauuaaggauaggaugaaaccaugaacaaggugaggguuaguagccagaggcagugugguuuacuucacacucucugaaagagguucccuguuagcagguuuuaaaaguuuaaguauuaguguguguaugugugugugugugugugugagugugaguuucuauauuuguguguguguguguuuguguagcacccacucucccacaguauauuuguggagguuggaacacaacuuucaguaguugguucauuuucucuauaauguaaacuccagaaauagaacucaugcuaucauacuuuuauaacaagugccuuauuugaugagccaucuggucugccuucagcacuguuuaaucugucuguccacaagauggcucugggacuaaaaugaaaaggugacacuaaaggaaacaauguaagggcuaaagugggcaguucaucuugugguugaggcuucagggccagccugugagaggacagagggguugggggcagcccuugaggaugaaagugugauggugcauaucuacacacacacacacacacacacacuuuuaaaaccugcuaacagaucaauggagggagugcucagcauagaaacauuuuguauagaauguguuuauuuuucacagaagagaggaaaagaaagcugcuucagugggaagccuugguucagauucagaucagugagauucgcagggaccagcaugccgcugccgcugccgagggagggaggguguguuuguucacugggaagaguauggacuuguaaaguuagggaaaugugaccaugaagagggcaagugaaaggagauugcagggcagggcagccuguucauucaugcagagaaggcaagugugcucauuaaaauccuguaggauguaagacuuuagagcagaaggugaaguuagcuuacaguaagcaccaccugcuaaaacagcuaucugcuaaaaaccuggaaaaaaauaccuauuuugauuauuauacuuuuaauauucuagcuuccguauuaaaaguagucacauauaccaaaagaaccucagggacgaucgagagagcaguauugaauggacagaguaaugggccaauacucagcuuucccucuggggagcuucuuaaacacaggagccucaauuaccuugucucuaaaauguaugugcucauagcaauuacucuacagugcugaugggagucugugagauaguauugcauguuuggugcuuauaugaguacugcauguaucacgaguaugcaauacaaguuagcaaucacuauuaauaggaaaggaauucccgucacacguguaucagcugguucuuaaagaaacagcagccuuucuuagccuagccuuucuccgagacugacacacauuugaugaggagcccagagccugagaauuagcucccaggggaacugugccucugggguagagccaugccauucuccaggaagacuggacccaagcccagugcuguugaaugcugaggaagcuggcagaggaugcuguguguggagggaggagggcauuuggccuguuuguggcugugaaacuuuuguauagguguuaaacauugugggucccagacaaaucacagacuguaccaucuacugggccauaaguucccccauaggugguuccuguggaggucuucccagcucacagaugguuucucauuuuucacaaacuugacauugcuuuaagguggcuuaggugugucucuuaugguggagcuaucauuuuggggucucauuccccuaaggcuauuuguaaauauuccaaagcuuagcauaucugugcuucuguuacuauuuguuugcauauuuccccauuaauuaauuaguuaauuaauuaaucaauuaguugugugucugucuguguguuuauguguuuguacagagguuagagaacaucuugcuggagucaguucuuucuuuguaccaugugguucgugugguucccagggauugaacucagguccucuggcuuagaggcaagcacuuuuacccacugguuauauugcugacccuggaguguuucacugguugguguucaucugaaggagagaagaaguuugcagaucauuuauuuucuuccagccauguugacucuaacaccaagcuuagaaggauccuaacugggggguggggagggcuggucuuauguauuuuguauuguguucagaugagguauuugauagcuuugcaggacacauucuuucacuugucugugugaugggcucucuggcuuucacagauucagaagcccagggccuacuccaaacaaguaaaaucagaaccucucaggguggaacuccagucaguauuuuuagaaaguccuguggcgcuuccaguguguagccaagcuagaacacagcucucaaguaugggugacuuucccccggggacaucuggugaugccuacagacuuuuauggaugucacagugugcuucuggcaucuagguagugggagauucugccgagaacguucuuuagugcacaggaucuaguacaucauguaauuaaacuggccccaaauaucaguagaaccaaggaugacaaacaguacuucagaaaccaagagcuuccagagccgagcuuguaccucucauggggaagucacaucagguagguuacaguuuuguccccucgguaagaauauguaaggaaguacuuuuugucaguaacuugcagucucuccuggacuugccagauuggcagccuguccuugaggcugguguaccagguucucauuucuggggccagaagucucccugucucgucuucuaaauuuaucguacuuuaaugacuuggaagaagaccaaaguuaggaaaauuaaacccauagaaauuagccaagugaaccauuuucaaguaaguuugaauuugccuggucuuuccaaaccagaggagugaccugaaagaaaucugaauuuaaguucucugggaggucuuucuuuucuucuaauuuuauuuaacugugagacuuucagaaauauuauaauaucaaguuucuuuguggguugcuggggauugaacccaagaccuugcacaugcagggcauaugcucaacccaguuacauccccaguuccacaggaaguuaauguuaaucuguauuugccuacugaaucauuaauacuagcuauccaaugauguaacugauuugucuacucuguauacaccucgguguuuuuuaauauguuggaaguauauacaaauauauggaaugagagcuacauuaucaaauacaauaauccugguuuucaagaagcuagaauuguuucacacuaucuuguuuuauaauauuauaaaaagauuuuauuuuuaguuaugcauauauaugcauauauacacauauaugcauuaaaaacuaaaauauaauauauaagagucuagguaguggguacuaguauauaugccuauguucauguguggauuuaugcuugagaguacagugccuguagaggccagaaaggguguuuaaucaccucaaaguggaguuccaguaaacuggaacccaggugcucugcaaagagcaguucaugcucugugauaguuugaagaauggccacucauagacucauauauuuguaugcuugguccccaggugaagaacuguuuuugaaagauugggaaguguccccuuguuagagaagguuugugucacugggagcgagcuuugagauuucaaaagccuaccccaggcccagugucuuacuuucucuacaugccugucuaugguucaggcuguaaaauucucaacuacuuguccagcacaccaugccuguguaccugcccccauguuuccugccaugauugguuaugauggacuaaccccauguaagcaagccucccaacuuaauucuuuuuaacaguugccuuggucacagcgucucuucaaagcaauggaauaaugaccaagacauggucuuaacgacugaacaaacucuagccuuguguucuaaucuaucuuuaguccaugguuugaacuuggucuauucagucuuuaagaaguaacuuaauuuucuuuuauucuagucugucuucgaacccuaacacaacauauucuuucucucucucuuuccuuccccucucucucucccucucccugucccucucuucccccaccucucucucucucucucucucucucacacacacacacacacacacacacacacacucacacacauauaugcacacacugcacucaugcaugcucauucacgucuucaugacaaggaacacuagacuguugccaguugccauuauuaaguaccuugguaauaguucucaugacaaguuuuagggaagggucucaacacuacaaacaaucuucagagaauauaaaaggcaaacaaacaaaaaaucagggcucagaagauggcucagucaguaaagugcuugcugaacaagaaugagaacccaaguucaguaccuccuucucccaggcaaaaugucagagguggugacaugucucuuaucccagaaccggugcagcagagacagaagggcagaccccaggggcucgcuggucaaucagucuagccaaucacugagagauccugucucaguacaaauaauuaaauaaaggagagaauugaagaagauacucaucuguggcuuacacacacauacccacacacacccauacaccauacacccauauauacccuuauacaugcacacaauacagaaaacaucccaaaauuaaauugacaaauaagauaaaaacugcaaagccagauuaaaaaucugaaugucugggcuggugagauggcucaguggguaagagcacccgacugcucuuccgaagguccagaguucaaaucccagcaacaugguggcucacaaccaucuguaaugagaucugacgcccucuucuggugacagcuacaguguacuuacauguaauaaauaauuuuaaaaaaucugaauguuugcauauuuaaagauaguauuuuaauacaacuauaaauaaauugggcacacagcuguauagguuuaggcuaaggcucaagucugccccuggauuauggagccauuauuuaugcccaguaaggaaacagaaaagggccaaaacucuccgcucagccucauucucuacaguguagcuggguuuauuuuugugccucaugccgguggguggccacagaucuuuugucaccaucccuuccugacacagugcuaaucuacuagucaaugacccaucaguacuuguggcugaauaguggucugccacucccugaggccauaguguuuugucaccuaagcccuucugcuuugucauuucuucuccugggcuaccagcagcaccuacugcuaagccuaucucaaaagcuagucucauuggcuucuugacggaagacucuagaaauacacaggugugaggaaggaagugaccaugacccuugguuuagugagggguggacaccuuucacuuucucccuuccuguccacucagggugcuuccacucucugucccugugcuauguccuuggucaaccccugccuuccuuuucacugagcucuucucugccuccccucccccuaccgcccccugcucugcuuggcucugcccuucugcaagcacugccauuucucaggcucuguugguguucuuuacccucguuccacccucucccucgaggucacgucuauuuccaggucuucagauucucuacgugccaauggcguccacauuuauauuucaggacaaagcucuuaucugcauccucaacuccugugucugccuggaauguguuucgagggcaacucaugcucucacugugaaaaacacugaccuugccuuccuuucugguuuucuccucagcaaguaagccggaagccugggcagcgucuugcuuuaguguuucuuugacuccaggugaacuaccaguguugucccuucuuucacugaguacccauagcaucucugcagugcggaugaucacuuugaccagccaagaccggacuggaccuagauggcuuucaaggcuguugacugacucucgaucucugacccagcgcugcuccaugugcuacuccuggugaaaaaaucccgauucuuucauucccaggcuggaggugccgcauuaggguuuucuacaguugcagcauuuuaacagggcucguaagaucuguaguaacucguucccaaacuggcucuauuuuguggcuuuccuuaagagugccugucccuauucacaaacaccuccugcccagacagccuccucugcccugguguuuaucauuuauccuguaauuuagcuuagggcacaccaagaccuugagaaaucuggguugaaugaaagugagaagguaguagccuucuagauagugguugucaagguccuuaaauucuaauuuaauuuucccuagccugcuaagggcuuucugagucucugcuucguucugauuucugguucuguguauguuucuuuccuuugcuuguaguuuuuagaacuaagagaagugugugggauucuaugcuagcaaauuauuugauucugucgucuuuggccacugagucuugaauccaggaagcugcccaacaaaacagcccaugggagcugcggcaccuuugcuuuccggggagagcagggcgccuuggcugaauggacuuggacucucagcagcuuuccagcucugucuguaguaagucugacucugaaugccggagacuugcugcgacuuguccagacuauuuauuaaacuuccaaaccuguuugggaaggaagagcaacaguguuugggcccuguguggccgucucucguuccuaagcaacagaccagaacuuagucauguuuuacuugcaacaguaaaaagggaagggaccacucuugguuguauggauucuaaaacaccccaggucaaguuccucuccuuagaagauuccaagcccagcaguucagguucucccugggcugggagaagccagcuuccucucagcuccuaucugucaucaaaccacaaggaucagaggaccugaauggccgugcugagucagaagggccagccaggcagaagugacacacuuccugccccaagucuuaggcaggcuuuaugguuuuuuuuuuuuuuuucuguuuugcuugaagauucccugaaaagauagcagguuguccugcugagccucuguuucuucuaaguuaucaaaacauaggcuccuggcauauuucuuugucaucuacagguuucauuaauccauugcucccucauuagaagaguaucauguuuguggaguguauuugucaaguaugcucugacaaaagaaagaaaaaaacaagacagacagacaaaaacccaucuuauucaucccacauaaagaggaacauacuggggcuggaaagauggcuuagccauuaggaagaacacuugcuauucuugccgaggagaccuggguuuggguccuagcacccagguggcagcacaaaaccagaucuggugcccucuucugguuuccucaggccgcaagcaccacucgugucguacacauacauacauucagacaaagcacuuagacauauaaaguacaauaaauaacuuguuuaaaaguccagagaauauacuuguacauaucauuagucuagguucuuuccuuuccacaaagacucuauacuguuuccuauaaucucucugcuuuaaaauggauuuucauguguguauguguguggacacaugcagaccaugaaacacgugugaagguuggaggacaguguuugguugguucucuucuuguaccauguggguccucaggaucaaacucagguguuugucacauuucgcagcaagcuccuuuagccagggaaccuucucacaagcccucugcuucaauguauuguuuuacagccuuugugaagggucuccauguccucaaaugcaaggucuauuugaaggcuguguggcaugccagucuguggaagugcccugcucugaguaugguauuuagauacuugggucuucccuucauaccuuccccaaccccagucacuugaucucguuucagugguuagcucaggcuggcccugacuucucuauccaccugcuuuggcaccccaguaacucugauaaccaguguuaccacaccaaguagcucugcccucauuguuugucauaaucuauacuuuuuuuuuuuuuacauaauagcugucuacauucuuauccgucucauugacugugcgcuuggacgugguucagagggaugguggaguuguaagauuuuugauccguauugccaccuugccuuccaggcauuugucuugugucacauuccccccagaugguauacauuuccaacagugucuuaaaugagcuguguauuccagcccuugccuagcucacaauugccuuucauacuuugcuuccaacagugcauucacagccugcccugcccugccuuccugacuccacugcccacaguaagccaugcaugcccugucucaggcuggagcccaguucuugcuccagacugcuaguccuuugcuguuggauaugcaccaucaaugucacagccacuuuccaucccgauuccuucuucaugccuguggcuccacauaggucguuuacuuacgugaguguucacuugucggccagccucuuucccucaucgagugucaguuugcagggcagcugauuccucacagaguccucgcuucugaguuagccuuauauucgguaagcgucaagcgucaguugacauuuuccagauuaaacuguugcaugggcucucacuggcaguaacaagacagacaaggaugguagaauagcacuggacaggggacuugggccuccuguguccucaucuucuggaguaggucuguauuaguggaaaggaagggggacucuaaccacuuugcaggggaugagauacagucugcuuccaucuucuacuggaaagguauuucauuggggaggaggcuguggagaacuugugcacagcaugcaagcucugcauacagauggacucgggcccagaauggcuugauacaucauccucucuggcaagcacuagcaaacaaggugcuuuuuuuuuuuuuuuuuuugaguuucuguaguuuauuuuuauuacauuuaaaaaaaaaauugugcuuucaaauaggaccauauaccauauaauguacaagauguucugaccuccagggagacuggaaauacucugcugggaucucugagguguugugucuucagggaaccaccuuuugacaccaugugggaaagguuuacagaagccaguggggggcagcaccaaugagaagacaucagaagcaauggccaaccaggcugccaaggcagggggcuuuggaaaugucugacgucaggcuggaaaauauucugugucgccucauuaaauagaauuuccagaaaugcauagggagauuuacuccaaggcuggagagagcuucuccuagccaauugagaauuuaauuaguuuaaaauuuauuacuggggaugcuguucuguucugugugaaggauuguggugugagaacgcuauaaaagcccagggcucugcuucucuucagcucaguugagaagaaaccacauccaaguaggagcagaguugcugcagcuggaaccuggcauuucuuugcuuucuaaaggcugauuuaguguuuucucugguggugcaagugcgaagaggauugaguauaaaugaaucggacaagaagacagacgucccuguucacugaguccccagaccugcucgcuucauggccauucaacaccagcacugugauuggggccuggcugucagucuccccugcugacucauuuucuuugcuugagagaccugguuagaugguagcaaagcucuuggaaauaccaaaagaacaagacccuaaggaaaaccaaaagaauaacguucugauacaauguauacuugaaacuauagcaauaaauaauaccuaauggaaaggcucaaaaccucacaugugcucuuugagcacagugguucucaaccuuccuaaugcugugauccuuuaauacaguuucuccuguuuggugaccgccccccccccccaaccuugaaauuauuuuuguugcuacuucauaacuguaaguuugcuacugucaucaaucguaauguaaguaucugauucgcaguccuccaaagugcucaugacccacaagauugagagccacuguuugagcagcugcuuggguggaaggcuuugaauggcagcugcugcagcaauggacacgggaaaccuccaccccaaccuugauaccugugccauugcuggccccagcaacagcugcccaguuuagcuuguuacucuaagagguccaagaggggagauuuccagguguucuguuuauuuucccagacuguccccauuguguuaucugaugagccaaggacgugcuuuuuuuuuuuuuuuuuuuuguagagugauaugaagagggaaagccaaggaaucuagagagaggcaaaccugauacacccauguauccccauccuuguuagagggcgcuuagauucuuuuucuggagauguugcccaccuccuagggccuggggaagcauccugcucucacgguggggcagcuguuggccauucaacaguaggcuuucucugaauaugacuagccuuggacccugggcuucaugcaaagguaggcuaucccccagguacaucuaucugcauugucuuuaaugaaauuucuggagggcaccucugagcauguagcagucucaggcacugagucucuuggaacaguuccaucaggucaccuuccuugccucuucuccaaugacuuccuccuucuugaagaagagcaaagugagaagaggagagcagucugguucaaucaugguuuucagugggucauuggcaaagcuagguaggaccgggaaagagggggcuggaagaagacugacggggucagaggaagcugaacacuaagacagaaaaugacauugauguugguagucucagcuuugugcacgaugggcugggcauugucuugggaauaccagacucuaaaggucaagguguucugugaauguuuccaguucccgcuaaggcuugaaaagucguauguaauaagugaagguaucuuuugcgugcaggcaccagcgugguggugauuguguucaaugugccgcugauaaggauguggguggcagcacaggaaguuucuucauaauacgcggccacugaaaugaagccagagugagagugugugucuggagauaguucuggaaggguaggaggaguuggccuuacgguuguucuucucagcccugcccugugcugcagagccuugcugcugcuugcccaguugcucugccauauucuauggagauugagacugccacucauuuucccuggguguagggaggauauagauguaaguguuucuuucuugcugagaguugcuagauagcauauaguacagcugauuuucuagcggccacuaucauguggcugcagagacaugcagaaaccucugauggauggcccuggaauccggggguggggggugguggcacucacucagugucagcguguuacuuggcaucuccaugacugacgauguaguuguacgcuggagaguuucaacagcccugugccuccacugaagugugcucauccuagacaagacucuggcuuugaucccugguauugccaaaaaagauaagauagaggcaaggggaggggggagacuuggagaucaagaguaacucguauuugaauacgaauuaucuuaucaagaucuagucuagacacauucuuuggcuacuaggucaccaacuaguguccagguuuggaaauucugugagcuccccucuugccauuagcacgaggaugcauuugcccuggacagcauaauaaauacugaucuauggacccauccaagucuuaaggaagcguggaagagcuguauuaauauccucaaaggcaaaggaguuaacuauuuuguacacgggcuacccugggggguugggcuguuccacagaucaugacaugagagucuuccuccgccugugcccgcccacccacccucuucuaaccaacuaacaugacuugagcaggauauaauucugaaugcuggaacaauuaaacaacaaugaauagauccaagcauggaugaccuggugcugagaucucaugugagggaagagaagaguuggcaaagaagggccacauccauccaggcaccuugcuuuccgguauugucccacugucuggacuucucugagaccagggauguccugcuggguauacuaccuucucuuucuugcuugguguugaugugagcugcaggagucuuccuccagcuuccccuucccauagccucacugcguaccuccaucaucagcaaucaaaagcagggccugguaaccacucagccaugacacuaucaccaaggccauuuuagggaugugggagaucuucccuccauuuaggcauggcucuuuauuaauuacccuagaguauaucaguaaaccaaguuuagcaagucccugggcuucagaaucuugaacuuccgggaacagauuucucuugacauuuucuugucacccaccgaugagguuuuguaucauucugggccagccagaguuuggagagagaacauuuuugugaguauuaaaagguggcuucuaaaacacaaaguuuguaacguccucccacgugauuacguagauggaaaauaauaaacaugugucuguguuuguacauugacacucaguuccuuuccuuuaggucacucccccaauuaacaggucauuucacuuaaguucaugccaucuguaguuccuguugcugcuggaagucgcuauguguaaggcagucugcuauucgcuuugcaugguuuucuuuaaacugcaauaaccauucucugagguuggcuguauuacuuuuauuuugcacaggugcaaaguuguucaggcagguuaaagaacuuggaaggcuacaaaccagagagcagcagaaauggaauuugaaccaggucuagcaaauucuauuucccuguauaucuucccccccgccccccugcugggugccugguaacucgagccagauuaucaauacuagaaaagauaagaguaagauccaaacacaacuaccugggggacuaagagagaaacacagccaagaaugguauuaacuguaaguagcuaucacaaaauaauaccaagaaauuagaaauuuguagcuguaggguugaaaggaagagccugcgcucacaguuaagguccccaggagaaggcuucacaccccuaaguagcgugcuucgaguaugggcagaaucuuaucugaggugguuugucagccaugacgauuuccuaauccacaggaaaguaaauagauaguaaagagacucuuagaucauuucuauggagacaugcguguugcauacguauguguguguauuugugugugcccaaacaagcucguacucccauucuuuauccaucccucuuuucacaagccaaaagcuaucgauuuuaagcaguaacauucugucaccauguucccuagcucuccgaagaacaagaucaucucugagcaauucuuccuauuaauagaccuucauucauguuuguacuagcuagguaggagugggguguuguuuuuuaaaauuuccucuccagacaucugugaauggagccacacccuuuugucuuuuacuuuuuuuuuuucuuuuaagucucugcuuuuccccccuagccuguuggaacaguagacuuccuguucugcuugaauuuuuuuuuuuuuuaaucuugcccaugugccuagcacaguaagcucguguuucuguguaguguagcucacagguagggagcucaggcagcccccauccauccucugugugaaugcagagaccucugugacagcacaauuaagaggugccuaacacauuccucuacaaacugcaaaaugcagcgcccugaauaccaagcaggacagcuucuaaagugaccacugaugaccuacgguaugcugguucguugguucgugugguaagcuuguggugaauuuccuggaaggcuggggugaaucgacuugaaagaugggaccguggaugacccucacgcuugugugacauacuuugacgcuguccuccuuaggaacacagggagaaaaugccgagacugggugaguuaagacaacguucucagacaacgcugggugcagcgucucguggggucuggugggaaguucagaugccuaagguccugcuguaugcaaggggcuaauguuugguuauggcuuuagaggggcuguacacuaaucaagggcucuuccugucugugggagccaguguuaagcugagagauaugaggguuaugggucaaaauggcaucugcauaguacagauaaguaauuuuacuugagaacaaacagaaucuuuaaaaaguuucagaaacacagccucuaagauuuuauagguuuuuuuuuuaagauccucaguuuauuuucuauauuucucugaauuugugaacuguagaauaccucugauucccaggggucuguggcauuguaaccuguaaacacccaguuuaucucucuuccccauuuuguaacugcuggugagaauauuauugcucuuauuuuuuuccuaauauccaaagaacaacuuuauccaaauagaaaaccuuuugccucuuaagaauaauaccuuagguuuguagcuacacuguugcuccaaauaaacaauuugauuuuuaaaauaaauuuuaaaaauugucaagauuugaaaugaaagaacuuuucaaacauccuuuaaaguuauuuuuuuuauaugcaugucucuacaggucugugcauaguacuuagauaaauguaucuaaaaguuuuauauuuaaggcuuuuggggggccaagugugaggaggaauaaucuguaaacccaacaauuagcugguugaagcaggaagagagugaauucaaggauuuucagugagaguuggucaagagagagagagagagagagagagagagagagagagagagagagagagagagagaaagaaagaaagaaagaaagagagagagagagaaagagagagagagagaaaagaagagaaaggaaaagguuggaaaaguaccugguagagcauaagugacuaguagaaagaacuagaaauugaaagacauagguaggugcugagguaacuugucucaguucauuaauugaaccuuuggcagccaauacuauuuuguagagucauaacuucggaugaaguguggucacuugcacaccaauuauauaagauaaauaugugucuucugggugugcagaacugugcaugugaccuucugccugcuuugugcuuauguaguacacacacacacaacacacacacacacacuggcaugcuucuaugacugaugucguggugucuauacaacuggggucugagccagcuuugcuugggaaggucuuggagaaguguguuuggggagacuuccaaaaggaagggaugcacuuuggcagaaugaacuacguguaaaccuuucagggcuguugauuucauggguuagcaugaagcacuagagagcagaguauguuagcaaaugaaaauaagcagaaucgugugaaaaaagagagugcgagcccagcaaagaaccaaagggccaaggggcuuggcugcgcccuccccucuaccacccacccguccuccugccccguggaucccagcacacaucucauguugcccucuaguggaaugagcugagaugcgcaugggagcgccaccacuucuguuuuccuugggucuucuaagugaagaguuacagcagauggagguacuuuccucacugggaaugcuaaaauuuagacacuggaaauuugaagccagauggcgguaucgggaacuucuuauuggccaaguguuacuauuuacagagcuauugggcaugcgccugcgcaguucugcagcggagugaaagcuugucaccacuggcccuuaaggucuucucuugcguugucuugugguuacaaaauaaauccugcuagugaagaaggagagaccuaugaucaugggcacuacagcccacaggacugaaagccaaagaaacgagagguuggcacugcuguauuucuuuccacacacacaccauguuccuuguggaucccagucauccuuucaggcccugaagauacagagguagacuaggcaagaggaaacaccagcucuuggagagccgcuguuguaguugaaagaggcugacaccaaacauuauaaauguaaaauauauaauaagccaaaacuaugugcuaagaaugggaaaauuuaaacauggggagggaaauaguuuguucucucuccccguccccguccccguguguguguguguguguguguguguguguguguguguacaugcaugcuuauaugcauauguguuaaugagucauauaagugauuguaguugugaauguucuaggcagaauucaagcagcugcaaaggccuugaggucacaacacccuguuucauuuauagauccgagguccaccuuuccaccacucuguccacacgggcagggauguguggucgcauacagccucaggcuuccaagugcacugggcuccucuagcaccaauguuucuguaggauuaccuuuugucuuuaccccagugcaccguuauccaugaagccaccgcaacaauggcucuuucucuucaagcccaaaggacaguugugccaauacugccuaucuauuuuggggaaugaagauaaauccuuuguaguuucgugauaauucucuaccagucagucgauggaugaccuauguuucacccacauuaugauuagauuacuugggccuaguuaacauaggaugaaauguccacaagcugucaggaaaaggagauugagaagcagauaguauuuaagauuaauuugaaagcggaaguucagaagggggucaacucacugccaccaaaugcagcauuuccuggacagauuuugccugcccuuguccuuuuguauaugaugagcuaguucaaaccauuuucccccuuggcauuccuuuacaucuuaugacugcuguccucuggauacaggccaaguccuccaauaucauugugugauguuggucugaccagugcuaaguacagaaaaaggugacuuugagaugucaccugcagugucuccucuuguuuagucauucuguguccuacguccaaugaagaaagugacagaggguauuuucaucuuguauugaguguguccuaggaucucuuguaugguucuuucuccuccucuuugaguucaucuuauagaugugagauuuaccucaccaccgucguuacgaucaucaugacaaucauaaucaaccaucacccaccaucucucacuuauuuaagauuuauuuauuuaauguacgagugaucaagcugcaugggcaccugcaugccagagagggcauuagauucccuuaguagaugguugugagccaccauguaguugcugggaauugaacucaggaccucuggaagagcuuuuaugcuuguuuguauaguuucuucccuuucuuccuuuuaauugccagccaaggucauuucauguuucuuuguaaugaccgaugaaaucucacugagccuaaaggaugagcauuaaauuuccuucuuuguuaacagcucuuggaguaaagugcuuugauuacuuugggagccugggagcccagagcugugcuaucuuuucuuuauaauuuucagaaggguaguagcuccaguggagucuucuuagccagauuuacggagaaucuaagaauaggggacugcugggagaaauuauaaacagcaucguaaguauuugcaacaugugggagacggggcauggaagggcccuguuaaagauacuacuaaagaggcugguuaaagcccuaaaggauuaucagcuuccagaaagucguccuguugggagucuguuucaggugugaggcugcaaagaggcagugauuggcugugugcgcagagugggagugcuggacugugauuggcuguaugcucagaguggggcgugcugaauugugauuggcugugugcuguguuucuuguugaaagccgcgccuaaugggcucuugaguacuuucugguucuguuuguuuaauuuuugcuuuugaaaacaaggucuuguuaauguaggcaggcuagcaucuaacccuagauccuccagccuuuguuuucugaaugauagcauuagagagaugagcgcuaaacccagcugauuuugagcauccucaaaggcagacucugacccacccuuccuguauuaguaauguauuguugauuagccaccuuuccucagcaacuaguuaauagcauucugucuuucaccucucacgugcuggggcgcuccugaacaugcugaacaugggaaaaacucccaagucaugcgugaccucacuccuggguccuuacauuucagaacacggggcuuuuaccaguucagaccuuuccagaaccucguccuacccuacaaaucuugcccuuucugcccucugucaggagggaggcagucagccccauaggauaggaccuggcuauaugaagucuguuaggaagccccugagaggugagugagggaugaaguccaggaauccggcccugcagucgcuucagguucccuaacuaacuugcuucucauccgaugacuggccaaggugauauagugaauggcuaaaccuauucacuacaucucaauugaccacucccagggauuaccaucagaugcaaaaccaccagucucaugaccaccguaucaugauaggucacauacaaacagucacaaaggucaauaaagcauuuucaagguaacauaaacaacacugguauuuguuguaaguagagaaaauuuauuauagacaguucuucaaguuauuguacacuauugucacuauaaacacuguaaguccuagauaguuuuguaaaaaacuauguaaccauauuccugcaaagaccagucuuauaaauauaugagcuuagucgugauguuugacuaauuauuuuauuaacuuuaauaaaaauaaguaggcccuuggaaauacaaacccuuugagacugcacaugaauaguuaggaguuuguuuuugcuguaggugaauccugccugagaguaacugguggggacagaagaagggcuggugacagggaauauaguauagagucaggaaaauaccgcuuuggggugaguugguuggcucagagaugugccacuuuauucuuuagaugaauucccuggcucgugugucagacucuggagcauuguccccagucagcugucaucccugcuauguuccauaaggaaauucaugcacagagggccagccacaacaaggaauaccuugggcuuuggcucagaccccagugaaaagcuggaguggccagggauacugggugagauuucagagaguggggccaagugucauuacugggguuccaggagguuccuugcagcgcaccacagagcuccugaggcaacaguccagacuccggaggcucacuugucuagcugcugagaaggaacuugugugaugggcuuuugguuauugucgcaugaacuucgugggcccauuuuccccaucuguuaaaaacaaguuugaagaaugaggaaacgaacugguccuugaauguuagcuuucuggguuucuuggguuuucugcaggcagugguaggcuguauuuugaggaacugaguuauagguaacugcagaagagacuuggauccucucugugaggacccauacacacggacaggccauggcaccaugucucuauugcaugcuacaaauuagcuaugaagaggcuucagcuggcggggugccaggggugaauugcuccaaguguuguuguuguuguuuguaaaccagaaaguggccgccuucguggccacaguucacagaauggaauuacugcccuugccgagccggaauaggauauuggcugccaggcuuguauucuggaacacucaaaugucagcagcagcaguccaggaacaggguacaugagaccaaaucagugggugacucccaguagucgucucuggagaagugguuucaaagccugguuguguuuucuguccagggacuggccagucucaagguggcuucccacuucuguuuuguagugugauugcagcguugcacacuguggugguuuacuguacaucaguaaucuuauugcucaacaauucaccugcaguggcuagcucuggccucgccccagccggcaagaugcuaugauaggcauuugagugcuucacagcaaaucccgaaguguaaacaacugccaagaaagaaacuggagguccagaggcuugugaugaacuguauacaucaguguuucucaacccuccuaaugcugagacuguuaauacaguuccucguguugugaugacccccaaccauaaaacuauuucauugcuacuguuaugaaucauaguaaauaucugauauguaggauaucugaaacaugacaccccccuccccaaagggguugugacccacagcuugagaacugcugguauaaaucccuuuagcagcacuggaguuggaaacaaaggaagacuugccuggccaacauggugucagguagggauggaagcccgcugaccagcggucacugcuguguuuacucagugagagacaccagauuuuauggaugugagcuuuuugucauuucuuuuuugugugugacugucuuuagcuucuaccuuagauuaggaaacugucugucucugaguuuuggaggucuugcagaccuccaaaaacuucacccauacauuggaaacuuugggaaggaaucuguccuugugaacgucaucucuggccuuuggaggcucaaacaaaucagagaggcagaaaaggaaaucacagucaaaacuguucugaaauauuuuaugucacugaaauaauuugcauugcugucgagcaggaaccccaagcuuuugaacugcacucuccagcucugugagcugucuguugacuguggcucuuugucuguugcuaguauuaggaaggcaugagauuacuggccugccagaccugggagggaagccauaauggcuguucauucuguacccaguacaccccauacucuuuuaauuucuacaucucugcuugcuacccaggugccccuagcccucaccucugcagaaaaugaaaaaaaaaaaaaaauccaauagugaauugcuaucagauguuaguaauucccaggaccuuucuccaaggaaugcuuguauuuuuucaaaagagccucacaguagaacaggaaguggggcaagaguuucauacugaguaccgccucucuaaugagaguauuuccuguuucgcccaaaggccagcuggggccuugggagccucaggcucccuugggucaggccugcuggaccagccccaacccagggaaguugaaggaguuuugaguuuguccuuuuuuaaaauacgguauuccagcugcugccagaguccauguagauucuugcaaauguguuuuuguaagagauccagggcacccacucaccuccugugucuggcauugauacagcuguggaaauacaaauauuucccuuucaaaggcacucaccccuggacuaagauugucagauuuuuuuuuuuuuuuuuaacaauggccccuuauaacguucacuuuuuagggaaacuuuguaaaugaauggucuuccguguuuucuccauuagcuuaaagcugguuuguucugcagacccuuugguuucuaaggauuugucaagggacaaaauccuuuugacuucccaguggcuuccuccccagcgcagccuucccuccccacugaucacucuugaguguguggguuuuugcauguguugcuaauaccacccagguccuucccccuccaucccaccuccuuugcuuccagcaugucuugugaccaggcuuccaugaugacucuguccccgggugugacuuaggugcuucucugaacuuccauggcaccucccaugccuuuuugcuccuguggaugucauacuguaugacagucccucuccagccccacccucccugcaaccacuaacuggcucuucaaagauaaacacuauagcuguugucaucgguaccauuuuccuguaagagacgggggcuccacagauacuugcagaauggagaaagaggucaauagaaguggucccuggaaugacacaacguucuuuagaguggacagugagcccugguuuccuuaacaacguuuagucucccuagguuccugugauauacaacugaaguuguagaggcaccugacccugauggaaaagauaguugucaggacauccuggccacuggcacucaccacccaaucaagagcaaguaggucaauguugcuaguaugaaaucaaacuauugacaauagcuggauacacucugagguucagaccagaaggaaaauggagacuacaucauuugagaggccaagaaagguacuggugauugcuccauguuuggaggaagaacaugaauaucugaguagcaauuggauugaagcauaguuaggacucucacaagaucauguagccagugaugaauuuucuggacuguuuaaggaugguuaaagguaaaauuuuuuuuauuauguauuuuccucaauuacauuuccaaugcuagcccaaaagucccccaugcccucccccacacucuccuacccacccauucccacuuuuuggcccuggcauuccccuguacuggggcauauaaaguuugcguguccaaugggccucucuuuccagugauggccgacuaggccaucuuuugauacauaugcagcuagagucaagagcuccgggguacugguuaguucauaauguuguugcaccugcaggguugcagaucucuuuagcuccuugaauacuuucucuagcuccuccauugggggcccugugauccauccaauagcugacugugagcauccacuaauguguuugcuaggcccuggccuagucucacaagagacagcuauaucaggguccuuucagcaaacacuugcuaguguaugcaauggugucaucguuuggaggcuaauuaugggauggaucccuggauauggcagucucuagaugguucaagguaaauuuuaacuguauaacucuaccuuauggaucugagagcucagugccucucaucaccccucuaaaacacaaugacccuauaccauguguugguacaugcuaucuaaaagaacauuuagaagcaaagggaaauccugaucagcccauuggauucugaucauuuugucucuugacauugggccagaaugauugccuguguguaaaaacaaugggaaaggucaccuuuacuaguuuugggggauagauguugggcuuuaucuauguuguauaaguguaugauuaacuauaguccacuucaucacaaaaguguguucugggaucuggacagauggcucaacaguuaagagcacuggcuguucuuccgaaggaaccuggaugugauucccagcaccucgagguggcucacaacuagcuguaacucuaguuccaggggaucuaacagugucuucugggccucuucagggcacugcauacacauggcgcauagucacccaugaaggcaaaacacccauucacauaaaauaaaauaauaacuuuugaaaauaugcccugcagauuuugguaaagaguggauagucuacgugauuucacaagacugagagcuacccaggagcugugcuuauaugggcagucaguuggagaagaggcugaagacccucccacauggcuuucucgcacccuuagaugugugaaguggcacccgcuuccuuuggucacaccuguuccuccagugggcuuccucuuuucuauuaaugucuggaccucuuuccccuagucagccagccucaaagccuccaugugguauccacucucaauguuucuuaccagucuguauccuucuuccaaauugcaugacagguuaaccuugcaaacagagacaccauggguauagauaaaagacuugggcuaaagucugaagacuccuauuguaguaucagccggagcugguggcugugggccagccacuuaaugccucugaggaucuguaaacucaugagaagugaguguugaaagcaacacucaagacuucuuauuuaaggauuguugugagaggggaucagugucgaaguacuccacagcguggagcgcgccaucuugcucagagacauguccuaugauguugcuugugugacacggaaccuggaauacauuacaguaggugauaugugucaauugcugaaauagggcgugauuuaacaucucuguacauaaauucaguugcugagucagaauuugggacuaugaucaagagaaauguuuuuuucuuguucugggccagauaacaaaauacuugagacaaaugguguuccguuuuaaaagaauuuucucuucuucauauuuaauuaaaauguuauuugggcauacuuacaguguggugauuucacguucauauacuuauaaaaugucuaaagauaaaaucaagguaacuguuauuuccaaccccugaaacaguuaucauuucuauaugaugggaaacuuuggacucuucucuucugguuccuuauacaauaaauaauucauuuuuguaaaugauguucauucauccauccuguaguauucuucccgugcaaaucucuuuuguacccauuacccgcucccuccccuugugccucuaguggccaauauucaucguuucugcuuccacgggaccagcuuucuuaauuugcugccuucuuaugcuaacagauuuuuuucaugcauuaaaaaagugucaaaauuaauuacauguuaugcaaagauggauguagaaccugcuccacaaagcacaauguauuguaaaugaaggcagucucugaaggucggcucacuacugggaguccagcuuaauagaauguggucgccugaaggaaauucauggcuugagugaagaggugucuggaauucccaucugggauuuauuagugugugcguguugguggcauagccggauguuaguucuuaacuuaaggaaacaaaguuuucaacgugacgauggcgacuuuuugcucugucaagugguagcagcugccgauaccuuccugguucuggaaacuccaucagcugaaguggaguguugcucaaucugucguacuaaagggucuggaugccaaugguagugggcuguguaguugaugagggagcuaguuaggugccuccuuauggggaagcacagcccguuuguugacucgaacaucuucugggaagguugcauguacccccacacucuguuuauggggaugauaaagcaaguacguccacucggcacacgcuguaaaacagaaggcuugcagcuggcagaguugcguuccucuuggcuccuuuucugaaggaauuuuuggaaacuuguuagauuuaugaauaguugcagauuaccagccuuggucuccagugcaagcgaaugcuccuuuaaacuuuguuuuuuucuuugaagauagcagauuugguuuuuuuuuugaugguuccauaauauacuuuauggguggaggaaauacaguuuauucuuacauguugucauagcucauguauaauuaaauguugaaaugauuauuuuauugguuauauagccucuucaaaggacccaacauguauuauaggucuagaaagggaaauaggcaaacagacaugagggauaaacuuguauuugcaauaacguaacuuaguuaucugucucagaggacaucugaugucaagcuuaccaauaguagaaguugcuuggagaaauucaccacuggccuccguaggcuucguugaaaaggagaggccugagucuggcuuugagagaggccaaaagaggauguagcugcaggaaaaaaaaaaaaaaagugcaccuggcaguagcugcccccacagugugacugcacaguguucuuguaaguaauuuccaguuaauggaaacaaaugucaaaaguuucugcaugauuuuuuuuaaagauuuauuuauuuuauuuaugaguacacugucgcugucuucagacacuccaggagaaggcauuggaucccauuauagaugguugugagccaucaugugguugcugggaauuggacucaggaccucuggaagagcagucagugcucuuaaccacugagccaccucuccagcccuguaugauuacuuuuuaacccagucgugucagugagccugugggcacaugcuugugaauuuguccccagagacacuuuucaugcuuucuuacauuacuauugcuuuuaucugggggagagaugaacacacuggcuggcccccugggaguggugucucaccugcagcccagcuuaucugugucacuuaagguuugugguacguagggacuguuguauuguauccuuggcagguauuuggguuuucagcccaugcuguugggagaaacccgauuuaaacauuauaagcgcuauaacuggguaggaugacuugacuggucagugcaagaauacaggagaaagggccacccaggaaacauuaugacuggcauuugaaauuggaaauaaagggggauagaguaguaacaugagugaucaccacuagauuucuagccacuguugcccaaauggugggggguggaggguggggaaugaauguuaaguaggaagaaagucaagauguucaaaaccugaucaagguguccccugacggugccugcaggaguggauguuucuagguacacugacacuaagcagccauccaagcaggccaguacuaggcaguugacaauacauggccaauuuaauaaguauuuauauacuaagaacuuugucauccuaugaagaaauaauauacuuaaguugaaagauuaaaaugugaauuacuuaaugucacuaaucuauacauuuuuuuaauguuugcaaugauaauuuuuugucacauguauaauuuuaaauaugauaauuuuuuaaaaaauccaauguguuaaaaagaaauauuaagccagucagugguggugcaugccuuuaaucccagcacucgggaggcagaggcaggcuggcagauuucuggauucaaggccagccuggccuacagagugaguucuaaggacagccagggcuacacagagaaacccugucucaaaagacagacagacagacagagagagagagagagagagagagagagagagagagauauggaugaacucugauggggacuggcugguaggaaaugcagagcuugcuagagaacaagaaagaacagcuuucuccacucuagauauuggcucacuggguggcagugaagucucuaggguguuuguugugaugguagaacuuguugggaauucgcccucuaagcugcugaggccugcuguucauaaggggucuucucacuugggacauuugcccauuacccgaucgaugccagaagagacucucugaggccagguuguaccaaucagucaagugcacacugagugccagcugacgaagugucuguacuagggagcuacaugccuaaggcacccacaaaaagcaaggaccaagaccuggaagggaacuucuuccuauaaaauuucaucagugcuguccugaauaaacacagacuucugucagcgguagaagaauggcuaaagaaagaccccugaguuuucucauggcaggcaaugaagaacaggcuuagaaugugaagugagagagucugucgugagccaccucacaacuucuccaacccugagaucagauaggguccugcaacccuaauuuccuguucuguguuuccaucagcugaaaucuuguguuuaucacauuucuuuggaaagaaaugauaucaucacgcagacacaaugugacauuaaacuguagccaacccgagcaaagagcuuaugcacugugcauugcgcaagagguuagauguuauucucguccccuccuuguccccagucuguguuaugccauggugcccuugugaguuuaugguagcauccaauguaaacaucucagaacagcaguugugaguccugaucagcaacuugaggccacaccuuuauaacuaaugagagucuaaggagcugauguaguuaggaaugaauuagagucauauacaguaaaaacuguauagccaauguuaauuuugaagaccucccagaaagucacuuaagacuagcagccugucccucaacauuucuaagaguuauggacugaguguugcuuucuagcauggggacagguugugauuucuuuggaaucaacaauggcugccucccuuuuagaaacguuugcuauggggagauggauaccucaaaauaacuagaaaagaacauucugaauguucuuuuuuauuauuauuauuuugauuguuuuuaauacagagaaaggaaaauguugacaaggaugagagacuccaaguaucuuucauagaucaacauacagugcacuaaaacaucacaggaugcuacauggggauguucaguuauccucucucaauguuuuuauagucauucuuucucuauuucacauuuauucugggcgugcgugcgugugugugugugugugugugugugugcgcgcgcgcgugcaugcgugaggguauguacacacgaaggucaggggacaguuugagggagagucaguuuucuccuuccaacaugacagcuccagggcuugguggcaaucaccuuuuacuacugagccguuggucaugcacaucuaucagguuuucaaaagcuacauagucuuccauguagcacucacaucuccuggguaagggcugccagggucaaaggccaggcggaggugcagagagccgucagaagaggggcaaagucccagcucugcaucgucauguuuuccaagauaaaauuagggugaacagcgcuccagggacuaugucauuauuuuuuguauccgaucacuuauagcugaaauugaaaagaauuuaaaugccaugcaaggugacuuugcugaauuuaguaguuaaaaaaaaaaaaucaguggaaauagaguuuaaauugagaaaguuaaugauuuuuuuaccuuuuuuuuucccuacaaaguccauggguuuaauaucacauucuguacucuguacacggcucaggugagggggguugucagaacgugcaccccauccucugagggguaacugacacauaucucuauagccccucucuagggacuggccaaauaaaccgguuuccgaaccugaccuauucaaguggaaaaccuccugagccacagcagaaaaggagccuguccucuugcccugaacccuguuuggauaaguucugcaucaguucacauuuuaccgccugcugaguuugucuguccagugucggcuuggccaucccucccggaguuucuccacgagccucuucugucucuuaaacugugaccaccuggcacacggucaaaaccucguagguucuguucuuguccaaaaucugacaugaaagaagcagacuaugacaacuggacguagcuucaacugccaaacagaucucagacuaagagucugaguucagcuuuccacauguggagcaugacuuugggauuucaaauuuuauucagaaacuugcaaaacaaaacaaaaguacaacacacacacacacacacacacacacacacacacacacacacucucucucucucucucucucucucucucucucucucucucucucucucucucucucuccucugcuggaugcagucagccuggacuccuuacucagccugucuuggcguaguucuguggccccucgaagugaacacaagguagagagaggaggugauuacugggggucccaggcagagccccuggcuucugaacgcuucacaguaaucaaucacagaugugcgccggcuaucagcgcugggaaguugcauaagcucagauugcaugcagcuacggucagccagccagugcgagggggucucucuuaggcugcuccaaaagaaaacucagucauaagucuauucucaucuccuugcaaacuuauuuuuucagagugaggaggaaggggcagugauuagaaggggagucauuuuccaguuuuuaagcuucaauuccaacucauuagaaagaggaacuuucuaauuaggaagaaauggugcugucuuccauuuguccccacuuaccugggcauaggaaggacuccaguccugguauguuugcuaucuacagcuuugccauaucaaucugggucagcauguaggguuccaaaaagacauuccucaacagcccaaaccagucuggccucguucaugaaaauacacgggaaagagauaaggggcacgcuauaguuuguguacccagccagcuuccuugccuguuuuuaucacugagacuguuaaauaaguggcauccuccccauuuuacagauguacaaacagaggcuuaacagcuugccuguuucuagaggaaauucuuuuaaagacagggaauagaggggaucccuuuuaacacaagcaaggcuuaaccagcaugggcucugcugucuguaagaaggacaaaaaacucaaauugagucuuuucaccccuuaauucugguuguuuuauauacaaggaagcuugguuggggaccaaauugcauuuuuaauuaaaaaaaaaagauccaacacauuugugaucucauguagcugaauaaauagaugcuauuaaauuuauagcuuauuuaaagcauuaaaugucaagaauggaauugcuuuaauuugaagcggugaucucagcaugugaacagggauuagagcagucugugcuggaaugacagccagcuguaaacucuuuggugaccuuccaguguagcaaucuuugagguauuccucugugaagggaggacuggcuuuuguaugagcaacuggguagaaagcaagggcccgaauacaggagacaggaaggaggcucagccuccauacacuguggucugggguccauugcuccucagucagugacuuggcaagucauauaacccccucuguuuaguuacauaucuuagccauggugaucccaaggggugacuuuaaagaaaaccugugcuagcagcgucucucuacuagugucccauugagcgaagauccuccgucucuaagaagcugagaccuucgcagauagauccagacuuuugauccccgcauagacagacucuccuuuccugguuagcaauaaagaaguuugagaaauuugagucuucagccaucaucaaccccugagacuaaacaaagaccgagaggccagagagguaaauggagacaagauagaaagucagagaaaauuuaaagggcacagaaagagaaaggguccccucaacuuugggugugguugaauucucucaccaaccaagggugaagaguuucgacauaacagaaucuaccgugaagaaugccugcaaagagaagguauuccuuuguauacccuucaggccuauaguaagauggcagagucaugugaccuggcaauuuaaucccacuccucugaggccugcccuguccacugcaccucagagaauacccauggucccaucacuuggucucucccacaccauauaggaaggaaaaacaaggagagaaaaauauauuuaaaacccuaugaagaauauaacuucugaagcuacugagucaggccacugagucacacaugucaccuauuguggaagacacuggugucauuaucucuggagaagccaggucuauuucuuggguauauacugcccuucuccuacaaaccuaaaucuaaugcccacacugagaucugauuaaaggucucccaguaaacuccagcaauuccaacgcugcuuccaaagaggaaacauaaacaaaaggaaucccggaugcauguucuagaaagaggaccagggacucacgaaaccuucagacauuuuccaaccuggugcaugcaucuaaucgucuacuggaagcuuuguagcaagggugauuucuuaggagggaaacagaaacaaacagugaaauccuaggaaacaagugugugccagaugcaucgcucucugccugccagcgcgcaccucugugucauugccuccuccuccuccucccucagaacuauccgcucacacccacccagcacaugaaugauuauguaagauuugcuggaacugucauugaaaaucugaauggaauuuacccauagcuacacacucccagaaucugguggccagugccccguuuucuucucacuuccacacuucuguggccuuucuugguucaggcccuuguguucuaacucccuaaccguacccacauacucaucagcgcaucaacauaugaggucauaugaagcacacgcguaaccucauuggaagauacauaaguagccuccacuguuacacaaauauccuuucacaccgagagccagcauccuggccagcgagugagggcugagggaagcccaauggggcuuccccauguuuuagaggauccaauggcaagguauuugauggaaugugaagguagaggcuggaaguccauagccccaagcacgugggaccgagaaaaagaucuuuuccauauuucaggucagggaaaacaaaggucacuuuuguacagagaccaugggagucuuugcagacagguaauagaaaaguugaggacagccuccgagucaaacagaaggaccauuagaauacucuguaaacagcuauuuugugaccuauaauuuuauauguucagcuccugcauccugaccccagggcagaaauaaaaacuaucgauagcuccauaagaagcucuggucaugcuaucaauaguuuugacuucuucauuuccauguuuuuauuuccuuauucuuuuauucccauagccaguagaugccggugcaggagcacucggcagacgugcauguuuuccacugcagauggccaggcccuccuugagucugcuggggugugcaugauguuuccgaguagccacaccagcucuccccacuucugcuugcuagccuucugaacugcaaauucucuaacccacuucauucugcaaaagcgccugggucucuguaagccaaagggcccagagcccaggcuuguagccaaccccucuuuucuuuuaaaaaauggcuucauuagaauguaauuuaagaggcuuguccuguugcaugagauuuagucggcuuacaaagauuuagcucaguuggguuggcauuaauacauuuuucauagaaccaggugccuuguaaggaaugaauuuaauccgugguccagaauuaucauaauuagagaaggaagguccagcuaaagaagagccacuucuaugugacuuguguaauaguagguaaggccuggaugaauggaguaaaccaucagaauccuugagguguuugaauucucccaccuugauagagacgggauacaggggucagaacccaacguaagauuuaaguaugcacuuuucuagaugggaaauguugccgauuugguugcuacuuuauauuaggugaucuauaguggaugguuaauaugaauuccgagcuuacugcccagaaaggacacuagacuguuucuuaaacaugcaagaguaaguaggggacuggagagauagcucagcugguagagggcuugcuuaccuagaaugcacgaagcauuuaaucuccagccccaccuaaacuagacgugguaguauaagccucucuaaccccagcacauugggggucaaaugaggagaaucacaaggucaagugcauccuugaccauauagaaauaccucuaugggauccaugagcccuaucuccaaaagacaaaaagugaauagucuuauaggcaguugcagaucacuguguggcauauuagaguguuagucacuggcuagcccagcccucuucgaauaaaagcccaacaaaucaacacuacgaaguauucacuuggaagaaguauaaggcuaccagagcuguagagaaccaacuaucuguugucauggucaugaaacagaauaguuugccugcccagggcacaugacuuugagguccugccaacagcuauagagugcuuauccuguacagucuauuuuuuaaugaccugggcauuguugcucuugaaggcucuacaucagaaaguucucccccaaggugacugcuggacugcauuugaauaaaaaaguuucucuggagguuucucaaggauccuggugaauguucaaagaucugcagggcuguuaacaggaugcuaaauugauuaccaggcugcugucuuggccuuuaaacuguucguucagcacacguucuccuugacuaaccugggcugggcugaagcacuuuuugugaaccaacguaaaaacaagcaggguauuaaggacuuuuacguaacaggccuugggagguuugcacauacucagauuugugagagggcauuuaauaaauaugacauacaggggcacuuuccgaaggaagaaagaaaggccuucugccaggagccaacggauguggaagcugggcugucuugauuugcauaauuaccgccucaccuucaaaaggugcugcuucuucacuccagcucuagauccgccgaaggcaucucauuuguguagcaaacagcuguggcgagguuccuccgaggcccagguggacaucuguggacaucuggccagcggaagagggaaggcaaagccggaugcugucggguagggaggggcagaaggauugcuccgaaggacaggcaaagacagacagcaagggggcguuucuuuuguuucagaagcaucggcauccuuuguguccgccaugaauacaaagaguacugagcauagauugucuaucucagcagcacuaggauguagggcacaggagagcaagguuaaccgucauuuucagaaggguauagccgguuauucuuuuccggccaugcucaguucccguaggcucuacagcacugaucuuuuccagauguuucuuucuucccucuggcuauuaugucuugguucaccuugcccuuucaauaaauuugagauaaaauucugguagggucucaagcauguuagaaucacucagcaguagcgacugauuuaauaucagaccauagagcucuaucuauggcaucccccuugccggugaauagcuucgauacugauggcaaacugauuggcaaagaaaaggcaagaguauccuuuacaaaguuuauuguaauaaggugcaauaguuagugacaaccuguguguagaacuuacaguuucaaaucacuguguuuauagugccaucuguaauaaccagacaaaucugugaaucacauacugcuuuugucuucauuuuauagauaaguagauggauauuugaguuuuuuuuuucuuaagguccuauaaauaauaaauagcagaauuaaauccaaacuacaauucaaaaaagccuggucaguuuacauaguccuuucacuaaauuuaccacaaggccuggacuccgcccuccuuuccauauaaaaaugcuauaagaaaaagaaagguagcuggaaaauacauuucuuaaagacucuaaccuuucucaguuauaggagaauguaacacucuccagccagagauuucuuuccauuggauguuuuccuuucagguauuuuacuuggagccccucacucuaggguugaugcuaaaacaaggcccuguaaaaaauacaaucucuguaagacagguaggcuggugggagcugguguagccaccccagaguuaagaugacuuccucugagccagugguggaagccagguggggaggggaagggaggggaggggagaggaggccaggauggcugcccuuugcccuuuuaucuccugccugucagcauuucccaaagccugagaagccuuuagcuccuagcagcuugguuagagagagccagccgugcauaagggcccccugccuauccugcccuacuuuccuuagaggccgguccuggcgcuggugaaguuuugcuuugugaacaggaccccuucuaaacgcggcuagcacagcauccguaucacuagccugaaaaauaacaguccgaaaaguuuucaagaauuggggcauguaaaaacccaagaccgagagugucaaaaacgucacuccccagauguagugagugcuugucccccugcacgucugcccccauucguucuguccagggcaccuuuccugcacugggccccaccugccuggucgccuccacccgcaguggccccucgggggcggacuccugcagcccagccccgcgcgauucgauucgucacuccugcggaacuuuccccugaaaaucccucccgcagccgcucgcucgcccgccccgggagguucugaucucagaggcuuccucccaccgcgucccgcccgccggcgcacaucucacucgucuaggagccucgcagccucacguccauguccguggcgguggcgccuguggcugugcaccccgacagcaugcucuccgaagcggaggagcccagggaagguacgccagccgcuggacuccgccaaguucagcgcaggaauguggaggaaggcgggagcaggagcugaugggagcucgcagaaagcgguggggaacuuugucucugccuggcuggacuuuagagaguaggcagcccugucccaccagccaggcaguuaaggagcaaaggacccagcaccagaccuagccaagccagcccaccaaggcugcuuuucagauuucucuggaaaggagaaagcgggcuuugacuguugagaauacaaaacgcgcuuggaaugggcugccugccugccuggggacaacccaaagcuggauucccaggaagagucugaguccgggucccuuugaaagggggugucaagaauuggaagggacauacguuuccggcuaaaaaggggaagcagagugaggagagaagugaaagaucuuuauuuggggaauauguuaggcucuuuuuuuucccuuuuauuuauuuaaauuuuucaugccagaccuucugcaguuuccgggggccugaaagaugugaggggggccuuuuuguccuuugaaacaggagaguuugucccuuucugucuuugcaaaagcaagaguuucauuuacuccuaacagagcuggugacagggcuggacaagcuccaaucaaaacacuauuauagcugguguuagcuugggaguuuauuugugugugaguguuugugcgcuuuguucccugcaacuugauguauacaaaaguccacuuguaagugggggugggauuagggguagcuggggaaaauuagucagguguguguggggggggggguaguguucaagguugugaagucucccucucuuuucacguagcuuuuugggagacucuuuuaaguugcaagucagucagagcuaaggcagcggcagagcaagggaaguucugcauuuugcaauguaggcuuuccagugugguuguguaccuagcuuuguggcaugagggaagcugucaauugaaaagggcuuguuuaauagaaauacgggccagucaguggaaaaaaugacagcagaaggauugugucugagcuucccgugggcuuuuuggagcugggauguuucccuguaggggccucuguaccaacagaacuuugugcugaugggugcuuucuuuuucuguuuugcaccauuugcacgaagucaaaagcagucaaagagaaauaggagcggagcugagaaaaccauccuugaacuuuauaauugcauagcacuuagauuagcauuuucuuccuggccuguuauucccagccuuuuacgaaaggggggggagugggggugggguggggaucggaugaaaaacugcuaggucaacuguauuauaccucccucuagcaacauccacaguguccccuucuuugcuggcucugcuagggaguuuguaagcuguguggaaacugguguaaucuuuagcuugauccucaccugcccaugccugcaacgguguaccuaccauacaggcuuugcccucugcauuuuaaaggaagcccaaaacguucgcgucugcuagaauuuuaaacugauaguaggguaagauuuucuuuuucuuuuuuacuaagucugaggaaaaagugaacgauuacuuuauugacuggacugauucacugaagcuucugcuagggcgaguguguguguguguguguguguguguguguaccugcuuuuaugggaccuaaucucucacacugucuaucaccagucaguuuucuuacuccuuuauccucucugauuccaaucuucccuaucucccuucacuuacaguggaguucuuuccucugguggcacacuugucaauucuguguagugagagaucagcaggagcccuucaaacucucugagcugcaaggaaauuaauugcccuuggauucuuuguaucuaauucguuguaaugguagacacuucuaauucauccuuuagaacccuaguaagagacuagugcacguucgggggaauugaaucuggaaaaaccaucgugagaugcagaaguccuuagaggccgguuuauuugugcgugugcaugagcguggaugcauaugacuggggagauuguucggcuccuauggcuuagaaugcacuugacucugugccagcgguagcucccgucuauaguaaccucuuaaagaacugcuuucauuucgccugcucgucaguaagugacugugcuuaaagugagggggaaaaaaucuagaacuugcuuuaucaaaaggcgaguuaagauauggagacauuaguggaugggaagagcccagucuauuaaggaggagaaugccuuugaaaagaggcugucaacaauuuccuguggauaugggcuuccugaggagucaauuaauauccacauaguuggcauuuagaugcuuccuguugaguacauugcuuaauuaugagagugguaaaaaugaaugaugguugagcucacuguggaugaucuagacauaagugcugaaggauccaagacuccuuugccuugggaaucaaucagaauuuuuagaguggaaaugcgaacgccauuaucgcuuugugagcacuugggagagaacggaggguuggcuggcaagagagugcagcucucuccucuguugcccacaccaaccauuucccuuuaccaccuaaccuaggccucuccugacucaccaguccugcuauuucacaacaaacauggcggccauuacacaaccuccugcuuguagacuggcagccucuccuucagccacacucaccaccauccucaagccuuggaguaggugucuuugcuaccucagaaugacacccuuccaucuuggagucccacacuauuuuucaugacuuuuccuccaugcuuagaugagagggcacucccccauucuaggguacuaguauuugccacuauucuuuuuugcccugauacucuaaucuuuaucugaacucuuuucuuagucuacucuuuggagaagccuuuucuggucgaagcaccccgcccccaagucugaaccaggacccccaguuugcuucucucagaacaccugucccuuuccuugcuggcacacgccacgcuagcuaaucuuucuuccugggcagaagagucucucuuaguccccacugcuaucucuagaacuugugccgcagaggugcucauuaaccaccauagaguaaacaagugacuuauuuauaaggcuucuucucaucgcuuuguccaacuuuaggcacuacuuacccaaccuuuaaaaugaaccuuuaaaaaaaaauacuuugauuguuuuuauuuucaagacauccucuggcuauguagccuaggccagccuggagcucacaguggugaugcugucucagccucuaugugcugggguugcagauacaaagcaacauaccuggccguuaaaugcucuuucucugcuaucuuaucuuacugaaaucugguugcuuuuguguuuuguuucaugagauuuuuuuuuuuuuuugucuuucaucuuuuugguucaucauuccacaaaugugucaaaauuaucacuacccucugcucaugucuuuuguccuuuuaaaagaacugauaguaauaauauuaguacuaguacuaguacuaguaauaauaacaauuuaaagaccagugagauggaucaugcaauaaaggugcuugccacuaugccagaugaccugaguucaaucccuggaagucuauggggaaggagaaaaccaauuccuacaaguuguccuuccuuugaccucugcaaccuuuacacaccucccauggcacacacacacaccacauaaacaaaugcaauuaaaaacaacaacaacaaaacacacaauauuuaauacuaaggaccaacaucuuccuugguuccuuggauuucaccauaccuuggacuccucuuuucuggcucuuuauccacucugcuauaccuccaucuuggacuccuaagaaccaccuguaucugggcuuccugguagacacuauguuugaacauugaacagggaccuuccauucaauaagucuaccaugaccgcaccccuucugccagcgcagaucugaucucccuucugugucuccuaugcaugcaugcuacacccuucuuuuuuuggauuccaaacuauaggccuggauguucucaccaacucuguccuuuccuuugucuucugccucuaauuggucaccaagaaaggucacccacuuuaccuuccucguuaguccugaaauauaucuucuuuauguguccuuaccguggcauuugugcucugauuguuauaguaaucaacccagucacuggccuuccaauggcaaaaaguggaauguaguuucuguuguuguaaacaaaauaauuguuggaaauuuugaauaauucauauauucucuguguuaguuuucugucacuauaacaaaauuccugaugugauuaacuucuaugaaaacacuuuaaaaaaaaaacuuacuguuugguuuugaaauaggauuuuacucuguagccuaugcuaggccucacuguccuccuguccuaucuuccuggguucuaggaguucaggaaugucccucacuggaugaagauuuauuuugacucacaguguuagaggucucagggccugauggauggagcucuugccuugggucugugcucauggcagcuugucaugaggaaggaaaaccguuaacgugguggccaagaagcuaaagagagcaaagaugcgccaaggucucaccuugguacccuuccaguuacuggaaaaccccaccaucuucuaauuguauauugagagccuuuaaacauuauaagucuuuggaggacauuugagaucaaacccacagcacccucgaacaggcugaaaccccaggauuucaggauguauuaggcacagagucagauaacccaagaauggucugguuagguugccucacugccucugacugcucagauuucuguuacugaguauuugguccuccucaaccuucaacauccuagagauuagccaucugauuggucuuggcuagcuggaguucccacccuugcugcuagggggagacacuccuucugcuuccaguagugguugugggaaaugggagcagaucacuucaauugugaaaagacagcuucucugcaucgagaaguuguuauuugcaugaccuugaccacaccaauccaccccaccacuuggccagcaggccucugcuuccucauuccucacagcagcccuguuuccuugguugugaucucucucuggaucugccucaaguggauucugucucuauguacacacauuuggcagaaaaugcuuuuccaggcugcucccugcccucccucacuuucccagugugcacuguuuugacccuguguauagucauuaguuauguuuauccgugccuuauuaggaacuuuuugacaacgcagcuauacauuuuuuucccuuccugaaccuccuacgccaaacuggggucaccucauauggaaggagccaaugaugccccauuaaagaauuaauuuuaaaucaagaugugugagcauccuggagagcauugcuuagaggcaucgccuuagccucuuuacggaaauacaaacagugccuucccaauucagaggacaagccuauuugauuuucuuaaauuuuucacucaagugccgugacuaguacaagcaaaacaagcaagugugcuucaugucuggggucagggccugcaucgugaauuuccuugaacacaaaagaagcaguuuugaagccagaauauacugaguuauucucuauacuagagucagggcugggcauucuucucauuucauacuuguaugacucucucugcuaccgcuauccaggaggcagccccccggcacccucaagugccucuguucagcccaagugcaggagaucuagaagcuagcaaagcugguagcagguaugugcauccuccaaacagagaggagcccaagugcaggagguaccuucuucacuauuugauguuauaguuaauuguagucaccgccgggcuggagaacgcuggaacuuacuccuucuguguaauguauuuuguaccugacauaugagaacaugugauauuugacuuucugugccuaguuuacuucacccaauagaauaaggucuagucacauugucacaaagaacaagaauccauuuauuuuuauggcugaaagguauugcauuuuauacucaccauuucuuuaucuauuuuucagucugaaacccauguggauuccagaucuugguuauuauaaagugauguguuaaauauggggguacggguacuucuuugauguacugauuuuauuuccuuuggauauacacacagugagacugcuggguagugugauaaagcuguuucuguuguuugcuugcuugcuugcuuuggaggaacuucuguaugguuuucuauaaugcuauauuuuuuaugcuucuaccaauaguguguaagaauuucuccucccgccccccaaaauaaaugccagcauuugauuuuguuucuccuuuugcugacggccauugucacugaggugauggcaugucacuacaguuuccaguuacgcuucccugacgacaagggcugaacaaaugcuuugggcauuuguauugauuggguauuuguauucguuugagaaacacagacaguuccuccagguuuuguugggugacuaaacccaagcauuugaccguuuaaccguugagucccuugaccccccaaacauggcagauggcaguugcuugucggaugaaugguuugcagauaucuucuguuuuguaggcuaaguguuuaugguucccuuugccccgcgaagccuugaccaugucauauaaucucauuuguuugcauuugcuuuaguuuucugucuuuuggguccucuccccuuaaaagccccauucuguuucauuauccugaagguuuuccucuaggaguuucauaguuuugcuggccaagcaauuauuauugggagaggagaggcucgguuauuucaugguggugacuuacacgaaucuucuuaugcgguaauggagaccccugggacacuauguagcuacacacaguguuauuaauucucaccgucucagucaucuauggugugacacuuuccauuucucauguauugccuugcuggguaccugccgugugucuucucucccugacucuugcuuggcaaagggaaugaugaagcaaagcuauguagugaugaaggcuggcugugcuguaaugccugguucuugguuuuccugagcuuggcaucauacauaauaucaaaggcauagcaugcuaucucagaggccagacaugauuaacuguuucuguuugugaagucacuagccugagaguacaaugugcugacaaggacuacgaaaagaaaauucauccugaccuguguaugguacacucuuucuucuauagugagccacucgcuggccuugaaguaccugggacuaccccuaccucuaaaugcugaaauacaacugaggauccccacacacgccucuaaaaauauugccagccugauuauacaucauacuguuguuguucuuggauuaugauaacaguggacugucaggagagaguagaugauuaaauucccugcuccuggcuauuaguaauccaggaaguagccaaaggguggguggguggaagagagcacagcagccagaaaaaucucaggaucuggugauuucaucugaacaugauacaagagucaaugacuugccacaaccuuuuguuuguaggcauuucuguuggaaauuauggaaacaagcacgauacaugcgcucuucguguagagaguuguuccuaaaauaauaccgagaauaaauuaggaugaaaugaaguccugugugugucuauaauguuugcagaaggucugucuagcaagugcuucguaaggaaaacaauccuuauugcccagugcauguagaaucacugugcuccagguuagcauugcaucccagaucuuuuuaaauaaauauuuugucucagagaugaggcaccaaggcuaccacugcccacuaggcuucuucuacccucuuccuggccuguuuuacaagugaggcuguaugugaacacaggcucuagcuucaggcuccgagaucuccuuaaagcaggaggguucuaaucugucuguuuaggugccauucacgaccuuuuggaguaguuuaaaaguguaaauggaauguuugaaugaaggaagugguccugcucaaccuucuccagugacaauaggagauaaggcacgauggaauacuauucagcucuacaaaucaagacuauaagacucccugguuuugaaagcaacaggccaaaggagaggccugaccagugggcucacuuguuuucauuccuuuaaggcuaucauuuaagaccaguucgauguugggaauccuggcugggcggggaacacauucuucaggagaauguguuguaugcguguggguggagaaggagucaagccagcaccuggcaugaagcaugaugccauugcagggacagaugccccucccacagccuuaccuucccuggagccugccagccgggugcauucugggagucagaacauuuguguuuaugaagugguugagggccagccgccuacugucuuccacagccccuuacaaugacaaugagagaaugagugucaggucuuguucagaugcuucggccagcauugaaagaguuagcugcaggggguuagcacccuggugaggaauggcacagaguggggagcaaacugaaaacaagucccgcucugcaaaucaccaacacuacaaagccuagguuaucuugguacccuacagcauguuaacgauguuuaagauggucacuguacuaagacucacauaugacacuuauagauggagugucuucuagcuccauaguaaugaacaaggcuuagcuuaagaauacugaggagccaaguuagauggggagaucgguugcucucugaucuccaagaggaagaguguaaaggaaggagaggcuaaaaccauaauuucaguuccugagaacaacuguucuacaggagcagagagagguggagcuagucaaggagacagcauuagccuuguacaaaugggaggaggaaaucccagagagaaugggcucuuuggaagccaggagaauaguccauggaagaaauggccagccaaggcugagccuguguuagaggcaacuuugcuuuggugugaggccuugaguggaguuggguuuaaggaagccuggaagccaaagcuugaggaggcugucauaggauuggaaugugccuuagguauucgguugguauuuagugggggaaugaagacuguccuguuguaaauacccagucuccuaagcugcccgucaucucccuuugugugugaugcccaaggcuuaguaaccagcaggcuccguucauucuguccaucccagcaccucuccucaguguugagaggagcccagggagcaggccugcaggccucugaggcaucacaucagauacacuucagcgcggaaaagaaacaggaaaagauagccaggaaaagguaaacgacaaaaggaugggaacaauucucccacaggcuacaacagaucaaaagcgcagggaaaugucugacuuagaaaaaagcaaccaaacggaagacauaccaaagaccugugugggagcccaagcaccgcugugacuccagggguaccagcucccagcacuugcaugaggggcucagaccauuagauguuagugacugaacugagucuccgguuccucccugcuccucuagacagaguucccaccuccugucacucgcuugguucuguggcaaacuguccauauugucugagaugccucauuagcauaaauagguaagauuuuuauugugaggaacaaaauguuucucgcacuuagagcguuugugacagaaacagugaaccaagaacauauaauaaaagauguuccuaucgcuuaggaaauccccaggguuuuagaaacucuggccaggagccagaaaugaagacugaauaaguauuucuuauuauaucacagcgucauacaggucuuugugcucgugagaauaaaagaaaugugcucuccucccuugugucuaacuuccuccucaugcauuuacuucaggcauacgcuguaugucgugggaagccaccgguggugggcuuugccaggguggucucuucuuccgcaucuaauucagagcucuuuggacgugaguuuaaacauguuaagugggacugagacuccgugaagcauucugagaaacuucaguuuuguccuguaauuaagguagaaaacugccaucauaugccagcagaaaaauguugcauggcuugcuccuggugagaaaccgggagauaguguuuauguauauaguuucacuuaacaacuaaguaaauaaggugguucacauugacaccccaagaccaaccacauucacgcagugaaaucuccccuguacccuucaugaaaagcaaagaaacaaccuuuuccuccugcaaaauuauucugugaguguaaaacgguucugcaucgacugcccaccccccacccccauuguaaggcacuuaugaaaugcuuuccuuuccuuucccggguuaaaaugaaaacugaguaagucaauuuugaaauagcuaguaugaagauacaucccuccucaguucgcagggccaaacacuggacacaagguuccugagaggaaaggugaucauuaaagaaggagucucccccaaaaguugucaacagagguggaauucuggggcaagcagcaccuaggaagggcaagggggaggaaggacugggacccaggacugaacagaaaaucaagggaggggcuauuuggcagauuccagaguaagggaacagaaagggagaacuggggggagggggguggguggcgggaagggaggggagggaggggaggagaaggaggagaggaaugggugggagcuguguggcaggcuuguggagggggaggaaucaaggcaugaggaauaaugggaguuggacaaaaagcaacugaaaacucccaaagugagcagcaguauucaccaggcaagaaaugguggugaccuggguaaguucgggcaauuugcuuauuuugguugaguuagcaggaagccgagugggccgugggccgggcuauguucaccaaugugcaaacuuggagcugaaggauuggugccguuaaaagaaaaggaaauuucucaggcuggauuggccacagggggcccgccaagaaggcagugacauugggaauccugcgcugacuugggggccacucaaaagccagggcuguguugagcugccugggaugucuaaugaauuucuuggucacucagccuuaguccugacuucuagaucaagcugauaacucuagaaguaugcguagguugcuucacauuccuguuccggccucguauuccagcaugcugugggaucauuucgucugcgugucuggccauggggggaggggguuguuccucacagucuccuggcugcaaagcugcagcuggcuuguuucaacacgucuaaggguuaaucagguauauucuaauugcuacugggagaggcagcugagccugacacagccccgagguugccugcaggguuggggggggggggguguucuguuuucaguucucuuucccaaagacgaguacuuagcguagcauuacgaccaguagagccguuaaugucacauaccuuccugauauguuuuagcucuuagcucuuguuucuuuaaguuuucuagacggcucugcuuuaaagcaugcuucgaccaaacuaaaaggauugcuaacaaauugaugagcuguccuuguuacugcuguuuucuucccugagcaugcuacagccuuuggcguuuugguccacagagauguggaaugucauuuggauucauugaugguagaggaaggugcuccagcuuccuuucuguggcugugaucaaauacucuaaccaaaacaaacuuuggagaggaaaggaucuaaguuuccaggucacuguccaucuagggaaguaggaaugcugccgccugcuugcucuccggaugacgaggcuaaagcucagcuagccuuuugauacagcccaggaccacugccuagggguggggccgcccacaguggguugggucuuccuacaguuaagacaauccggacagucccuuccggacuugaagauaaagacaguuguuugauuucgccacuuuccagggcauucuaggaugggacacauuuucaauaaguguucacuaggacagauugggagagagaacuguuauauuuaguccagguucgagaguuaucauagaaccaguacuuguucucucagaguagaauugucugugacuuuucuccugguuuuuauuuuuucacgggccagaucucucucccucccccuccccuccccucucucuccugugaaauagucaguccucaguuuucauuguauaucuauccauagauuuacucagccagauuuuuuuucuuucaaucuauggugcuuuuuuuucuucuaguucaugaaugagucaauugaccgaauguaggcagcuacugaacuuggcaguugguugccaucagccugccuguggacaggaaguguuuaggauagauaugacuaaccauuuuccaagccuuaaauaaagcaggggauuuuggacauaauaggucuuugucgcucguuucaacauuugcugcguguugaaguucaaagccagccccuuggcuacuuuacauuuuuccagguccucuguucccccagcuuucuguguuauagagacugaaacuguccucgggcuuugggugucaugcugauugucguaagugaauuaugaggauauuuuaauugucuugagaaucuucuaggucuguauuuucuacuuuuuuuguucuuugaguuuucccuccuuuucaguugccacccuccugagguuccuaccugacuugccuacagagcaguguaagguaagagaugaaagugacccuggacugcuacacagaccguggacuuguccuuuugaauauacggcccucaugauguagcaacauuuuccacuccuaaagcuccuuccaguuagccagugucuuuuagacuucuuuaaaucacaucuuucuuucacucagggagaaccaugccauuuugacaaauuccaaaauauuuuuagugaucuuguuggccuuuagcuaagacucuaaaagaaauuucuuuuucugcccuuugccuucucuuuaacuuuuguaauuuuuccucccuuaacuuaaaauaacaacaacaauaacaaaaacucugguaccucguuuaaguagcauccucccccuguguuaggauuuaagaaguauugacuauaaaauaaaaacugugacuauugagucucuuccuauguaauucagaauucacauaggagacauuuuaaauaauaugaaaauuacaaaagaaagccguuuugaauauaguuuguagaaauuauaaauggaugcaacaucggugagacaggauugucugcacuuucuucucugcauccccgacugugcuggucacuugaguuaccguuugucugccaaauacacagccaugcaggggaaagaggauuuaaaauacaaaaugcaugcaaauauuguuaguuggcuuagggugaagucauuaucagaucuuugaaccaucuucagugacagggcuacacuuugcuaaguuuagaaauaaauuguaaacauaaaacauaagguauuugucucggucaggguugguacucuugcucugaucaaacacuauugaccuaagcaaguuggggcggaagggauuuauuugguucaagcuuccacuucacugaaggaugucaggauagggacucaaauaggacaggaaccuggaggcaggaguugaugcggaggccaugauuggugcugugcacuggcuugcuccucaugacuuguguugucugccuuuuauggaaccuaggauggccagcccagagguuugccuacucacaauaugcugagccuccuccaucuaucacugacuaaggaaaugccccauagucuugucugcuuacagccugaucuucuggagccccuuucucuauugagguucccgcccuuuggaugacuccagcuugcgucaaguugucauaaaacuagucaacacaguauugcagucgggccagacaugacugacgcuagaaugugugcuguugagugcuuuccuuauuuauaccucuuuuuuucacacggaagcaggaaaaagcagugccagcuuugguuuagaauaaagcuuaauuuuaaaaauuugaaauccuauguaugaauuuucaucaaguaaaaacaguuucuugauggaaaauauugauucuuuuuuuagaaaccaagacucuuagaguggagaguagcagauaggaauuuuguauagaugucuuguguguguguguguguguguguguguguguguguguguguguauaggacucccuggaacuugagauaggcagggauggccuugaacugaaccuggauccucuguaagaaugccaagacauuucaauugcugacccaucucucuaacccuuuguaccuuuuuuaaugaugaauauacuacauuguaggcaaacagaaaaugcuugauagccagugaagugugaauagacccacuucuagauggcucacaauauaaaauacuuugcaaaaacaaaacgugugauuuuucaugagguccauggaucauucaaaccuggauauuuauuaugucucugggcaaaucaccugguuuguagguacuagaguaugugacgcucaguacuuacaucaauccugucucaagagucagaauuagacugaauagcucugacacaauucauaggcacaagcuuaggaaggccucguaggcugagucugcacagggagcccucagucugcugguguguguuugaaccacaguguucaggacccagcuuagagcagacaggccguggaaggacauuaagcagacuggcucugucugagcugaccgaaggcuguggcuaccuaacgccuuacuaagugggaagguggcagaaacugaagauucgucuuucaaauuugacauaauuugacauaguuaccugauguaaauauaucccaugauaccaucgcaaaaagaaguaucugagccaaacucaaugugucuagaauaccugcagucuuuuuucuuuucccugucuuccugccugccugccugccugcauauaacccaccccccaaaaaaaaaaacccugaaugccaauccccucaagacacuuccuauuagcuaaguauaauuucaaaucaaaaguguuuuaggaguggagagugguguuaugugguggagaugguauaacugagagaaacagugcauugccuccaauucaaacacuuugagcagaguaaagaaggcuuggaacccaguuugauaccugccaccguuagagcucaggcuuuucuaaguuuagacacagaagaugaaaagaaauggacuuuaugggacuuugacaagaaggccucagcccucuaaccauauauaugcaugccuugaaguucugcccaguugugaguaaugcaggcaagccacugguuaaauggccugcacuguuccuggaaaggaaaucuugccaaagcucuggacuuuccuaggcauagaaauagcuguuacuaagaccuaugcuaaugagcuaacccuagcuagagugccaagcuucuucucagcuaccccuaaugauuauagcuagaugguugauugauagauagauagagagauagauagaugguagauauagagauagauaaauagaagguagauauacacauagagcuauauaaauauaaaauauauaaacauuucauaauauuaauauagucaucaaaaugcaguaagcccuuuaucagcaaaaaaagguggaccagauugccuggccugucaguauuaucuuaccauuaaaauguuggaaaggagagauuguuaagacucugaauuuggaaaauagaauuuuaauccaaauauuguguuguuuucuuuuuuccuuguaucuaauauuguuccauauucuagugguguaaauguaaugguaguggggugcguaugugugugugugcuuguauguguguguguguguguguguguguguguguguguaugugugcuucuaaggauguaggacccugcacuagcuagacaagcacucuacuaugaagccauacccugcccccaaugcaaauauaauagaaggaaauucuuugcuuuguguauguuaaacacaugcucuccgggauuaaacucccuuuugauaugagcuaaauucucuaaacacugguuuaaauagccuauauuuuuggugggacaacacugcacagauaaauaaggacagugugugggauucguuuuguuuauuugcaguagaaagugccuggcuuuggaaugugggugugguccuggcauuuguguauuuguguguuucagggaaauaaagguacagagaaacacuugccauugccuauauaaagacuaacucucuacagcugacagguuauaaauacugcccgagaccacgucucauacaccagcaucuguuuccuucauuccaagaucaacaaaaggcaauaaagaugaauguggaaaacggaggcaagaaaggccuccccuucuggcaaauccuuaacuccccuaagcaauuuuuuuccaaagcagagaacuaggugguauaaauuaaaacauuaaaagaacaauccccuuaaauucaaaggaaaacuaguuagccaggguagguuuaauauucaguuuuagaaacugacuuugaaaucauacauucaaaagaauugaauuauaagaugauguguuuucuggaauauacauugccuuacaucuuagagaugaagucaguguuacucuucuuagcuagugcuauagugugauuguacucaaaugugcucaacacuugguugguccucaauguagcaguauugagaaauggucaaaucuugauccuauaggagguaguuggaucauggaguaccacucagaaaggaugagugcacaucuccuuggaguggacaaggucugguggggccagauuggucauaguaaagccauccugagaguucuacuucuuucugggaaucacuugauacucuguauaaacccuagugcacuugaccauuuaaccaugcucagugucaaccugagcccaugggcaguugcagauaucuuuucuagcuggcagaacuauacuuggcauuagaugcauguuaaaaacaacacaaaauagacaagaagagacuuucaaccuuuugcagcuaugagacuacuauaauacauuuuucaauaaaguaucaucuuuuccaaagaaacaauaugagacuacuauaauacauuuaucaucuuuuccaaagaaacaauaugagacuacuauaauacauuuuucaacaaaguaucaucuuuuccaaagaaacaauauuuuaauaagaagcucuguuauuuauauagacuuaauguaaaauaacuggcagauauaaucaaaacuauuuccccaggaccaaaaauguggccauaaaccuuguuaaucauuugacucuguaaaacuauauucccagccuuuaagggggaccuucucagauuuucgccugugcuucagucuuuuagaaaguuaauccagauacuuugaaaacacaaguuaugccaucaaauauuguaucucaauauuuuuuaaguuauguuaguuaaugcuguucuuuguuuauggaggcguuuguuucucucgcauuggcgcgggugaaaugaacaggucuucauggacauguaggacaccuugaaccauccccagaagaggcauccaaauccauccaaaaaccaugcugagaaagcucacucccucaucucugcuuccucaccuucuaaguuacauguauuucccuuuuaaacagaacuugcugugaauaggguagcuuuuagaagagggaauuagcuucacugauaacuaucuugaguaaugugugauacccacggugagaaccuggcagagaugcacauacauaucccugagucuuuuacucuacugaacacgugaucagcugggacaugguuuaguucauuuggaaggugguuuagaauguugacaguucuccucaaagauggcaaggcaggaugauaagggggugguucacggugcccuacuuguccauaaagaaacuguucauauuuuacauaguuaccagggccaauuacaaacgcuuccauaaacaacaguauuaacuaauguagcugaaaaaaauaucaagauacaauuuuugauggcaaaaguuguguuuucagaauaucuggaugagcuuucuaaaagauugaagcacagguaaggcaggaaucuacuggaauaaggggguaguuaauauuaguagcuucaccagagaaaacaaugaaguguggaagacccauggcugcccccugggaacuuggucucaaggaauucccagacuuacauauggauuaaguacacaagggggaugcucucugggagagagguucaugaacaaaugucuauggccacaaucucugaggcaaaacuacugauguagauagguggcuuugccaugaagcuuagaauggagugugugguuguuucccaaaacgugguccuuggacggcugguaccacagggaauggucauaggugaucccagacagaguguucagucaucuucagccucaucaugagaccaggggcuucuaaguguuuuugaaaucuucuguaucuguccagagaaugcuuguauuugggauaugugacccuugccucuuuagucaugggacucacuauuguaacccaaagcuacauagggacucauagccucuggcaaacagcaacaccugggagcagcugaugguguuggugacugacuuuuucccauugaauugauuucugauguuaaaaauagugauugauuuugaugaccuucaugugcuaaagggaauaauguuaguuuccagucacguggaauaugugguguccuuucugaguaaguuuauuuucuaaugaaaguauguugauuagcuaaaagaaaaucaaguccguaguagguagaaaacaaagcaugacagugguauuuaaaggaccaggcugaagauguggccacauggauguaggauggcguuagauggcuacuucagaaauggaagcauucugaggggaaaggugaguagagacgcugacagaagccugggaauuggggaagagagugucgccguguccuccuugccuguuuugauggacagccugagaacaaagugcuagaagcucuugagucaccaagaccuuuaucccaggcucucguaaagugacucagaucucggugugagacccuggccguuccagucagagaugagaacucauacgcucacaggggacagggaguuaguuacccauaacugcccccaacauacacacacacacacacacacacacacacacauauacacgcacacucacugcugucagaagggcuagguuuuuuuguuguuguuuugaaggagggggaggagagagaagacuccaaauuuuuaaugauuuauuuaacaaauuacaaaaacaaaaaccuaaaauauuaugggagccuauuuucguggguaugggaacaugcuggaauuaaauccuagaaaugguuguucaaaauguagauauaauaaagauauuuuuuugauggugacaguguagauuuuguuccaugaguuuuaucugagcugagaaaaagguagagucucguccaucugaccaucagcaacuaucagcuuuauaagugccaaaacuaaguuuuaaguggaagaacuugcuacccaaugcuuuuugauaguguccuggcaaaacccuuuccggaaggagagaacugucacaaguuaucagggcuuguguugugacccuaggucgccccucugagccuucccucucccucuuccaucucuagagcugggguugaugaaugaggugggaaggcagcuauugaaggaccagugugggagagagcaugaugaaagcuaugggauggggggaaucacaggcugacaaaguaucugggcaaggcauuuauuuuguugauauuuggcaguaggucauaaaaaugacccguuuucguugcguuauuugccaaaguuuauuuuacccugguauccaccauuagagaaguaauucagcuccaagacaggcagguugaucuauucaggggacgccuuccaguucuuuuaagaaaggacuguaauggucuuuuuuagcuacuuuccuuaacugaaaaggaugaguguaacauaccagcucugugucgucagcauccuagcauugugguuauuuuaacuuaacuguuugucuuucggguuugaugggggguuuauuauuuuaaauucugaauguaauuuuaagccagccaguuucaauaugggauaaaaauuaaaacauucccuaauuuguucuuucucaacauauuaagguacguuugugcuuucuuagauuucuugcuguguguaguguuugugggggagggggcauauauauauauguguguguguguguguguguguguaugagaaaaauguguguggaugucugugcguaccuguguauggaggccagggucaaucaggacccaucuacauuguauuuuugaggaaggcucucucauugucuuaaagcucucugagaaggcgaggcuggcuguccagugagcccccccccccccccgggaucuucuuguccuaugcaugaacaucaugaaguuccaacuacaacaacuuacuuuuuauuuaguguggguucuggggauagaacucaauuccucaugcuuguauggcaagcacuuuaacaggaaagauucuaugggaguaacucgggguuacaccuugugccuuccucaugacuuuucucggauguggccuuuucagaaaggcuuccccugccuacccuggauaaaagaacauacugucucauuuaugcacuucuguuuuauguggccccugccaugacuuggcacuugugcacuuguuucugcccugggucuuccuuuagaaucugaaccccuugugagcagguguucugccuggggcaugauagacacacaauuuuaagaaaaucuaaaaaauaaaaaaugagugagugaaugaaguuuuuccucacaccuauaaguucauuuacuguuuaggguuccacauugacaugguauacccaguucaacuuccuccuaggaucuuuauaaacuuggcaaauuuacucccucucuaugaccuaguuaacacauuguauagaaaugagauuuggcgcuaaagauagcugaagugugugacugucuucauuacuuuucucaugcugugaagagacaccaugaccagggcaacguauaaaagaguuuauucuguuuuacaguuccagaggguaguccgugaccgucauaguggggaauguggccacagacagacagacauggcucuggaacggcagcuaauuucucauaucucauacaugagcacagacagaaagagcgcacggggaauggugugggcuuuugaaaccacaaagcccccagugacacaccuccuccaacaaggccauuacuccuaauauuucccuaacacucacaccagcuaaggacugcauucaaaucugugagccuacggcagccauucuuauucaaaguaccacagugacuaaauaaguucugugaagaccagccauuauauuccaucgccuugcaaggccuccugagaaacucacaaauuguuccuaauuugucuucauuuucuaaguuuaccagauuagaaaacucuuguuucuaguugucuuagucacuguucuguugcugugaagaggcaccgugaccaaggcaacucugaugaaagaaagcacuaccuuggggcuggcuuacagcuucagagguuuaguccaugauccucauggcagggagcauguggcacauuggcagucacugggguaguaccugagauccacauccugaucugaaggaagaaagaaagccuacaccucaaagcccacccccaaugauacacuuucuccaacaaggccacaccuacuccaaugaggccacaccucuuaauccuucuaauuuuuucaaauaguaucauucccugguaaugaaguuucaaauauaugagccuauggggggccauucucagucaaaccaccacacuaauguauaagcacauuucuagacaggauguauuucuuucuuuuuuuuuucuuuuuuuuuuuuuuuuugcucuggccaaacuuuacucuuuuuuuuuuuuuaacccaacacuaugguuuguuuuuguuuguuuguuuguuuuuuggguuuuuuguuuuguuuuguuuuguuuuucgagacaggguuucucuguauagcccuggcuguccuggaccucacuuuguagaccaggcuggccucgaacucagaaauccgccugccucugccuccaagugcugggauuaaaggcgugccaccaccagcaccaccacccagaaacacuaugguuuuuagucacuauuaccccaggagaccuuucugcccacagagucccugucacucucagguccaauucucugggagaaucaaagacaaguagcugucccagagaagggacagggggccauggacucagcucuagcugcagucuccuguaaaggaguuugaguuuugcugugccucagccccaugucaucacgcucuuccugcaggugccccugucacccauacuuuauauucuugaucuagagagugcacgcagaugagcgagcacacugagacagggagauauuugguuuuuauucaaacuucggcggugacugugucuuuuccccacugacuuggguccaaccucacagucuaguucaacuggcuacuuugaaaagaauuagugcacaggaaacgauggaaaaaggggaacaggucacuuacugcuccagggagaaaaggguuacugcucuagggccucaaauuccuacaacagagcaguggaccuucguuuacucaaacguuuuuuacuggguggagaggauuaagacauuugcaugaaagucuucuggagaagauuagaaaagauuaauucuuuguccuaaacauaaguuuuaugguauuuugauagaaaagucucauauuuaauauuucuuacaaaucucucuuuuguuuguuuuuaaacauucuuucaagcucauuaaggugaaggcucuuuuuuucuguccugucugggaguaagaaccuacaguugggagaaguaccugguuaguaauaguuggcucaguaaaccugaguuaggaccuuaauucaaagaauuaguuauuccaucauuagcaugucuuagggggaaccucuuccuccugugaguccuuugcuaggagguucuuggugacacugagaugugaggccugucccuuggccagugauucuauucucuggaucacgacacauuuucauuuuacaggccuucauaucuacuucaaccuuccaccucccaaaaaaacauuagaaucacuugggaccagaucagagaucagagaugcugggcagaauuuuuaauuccugacuauucaguaggaguuccagaaguugcccuacaaucuagucacaucuguaugguacagguugagguuaucacucagaaggccaggggacccuccuucaaaaaaauggggucacagcuuagcucaagaggaccauugucaugccggaaugugugccucuuaugcacagaucuuaugaaaaaucagaaacaaagauuuuuauauuuauuuucauaauuuucuaacacccgcuuacucccuuauccuuagagcacacugcuuuaugcagacccaaaauggggggggggggccuguccaggcuccaaagguguguggugcuuccuaaacccuccaaauuagaggggucagccagggugcacaacacuggagagagaaggcagacagaaggaaaagaacuucuugaagaacucagaugucuccuuggaaguacccauuguggagaacaaugcuucggagagccuccagaggaagccuuguauuuaucacagagccucagggcauggcugucuugauaucugaauuaaaguagcuuacucaaaggcucuaagucuccucucaccuucugcuuacccuccacaggaucauucacaagacauuggcauggccauaagaugcuuaacugauauuuuaguguaauugcugggaaaguuugggaccaaaauuuuaggagguugugccaagaugcauauuugggagaugcuuaggguaaggccagcagguuacugcuccuaaaauacucccaacagaugggcuugagauauuuguuugggauauuccagaucauuugcuacaaaggcugaauuaacuaaauauggucacucuaccaacaaaguagcugcuauucagcacgguuuggccaaggauggagagaaaagcaauggcuuaaaaaugaaaacagaaaaugcaucaguguuguauagauuuauagcuaaaacauaaaggauugcccaccacaugugaggcccuguauuugaucaccacaaaaaaagaaugagucaauauccgguuuaucgcguuguucuuagccauggacuaaucagauagucgguuuuguauaaaugauuagaagauacuuucauuuaauuucaauccuguauguaggaguuaggcccucuuugaauuguuccuggaaaggcuuaccucauacucuccuagcugcauuaucaaaacugaguauuaacaggcuuccucuugaaaauauuuucuguggauuccaagcaugagucaacaucucuauuuucguaaaauuuuugaaaggggugcuacccacggagucuuguuuucaaugugauccuguggucaacaaguggcucuuugggauuuuaaguccaguauucuagaaacauaccccggagcaguguggaaccuuucaaucuccgagacuacaguccuggggacuucaugcagucggugcagcaauuaccaagccacuuccaugcacuucugauaccaguggcccaggacucagaauucuguccuggaaacuuguugccuccccuuucccugccaaacacugccugagaacugagaaacccaguagcaagcauuucuauguccccaacaagaacacagcuacuauuuacauucuacacuaccaucacuacccccuccacccccaccccuuaaaauccauacauuggcuucugguuuaugccaacgaacagaguuuuuagugguucacuggccaauaggaagucucugugucagcucuggaacguguuucuguaaaggcaagauguacuuuuguuuugaggcuaaguaucuuuggagaagccuucaacucuauccuccgucuguccgucaucucauccaaaaagguacuacugcucacucucuucuucacuacuguugcuuguugcacaguccucccguggaccuuccguggcacgucccacccuuguucccaucaucccgccuguguucccaucaaucccuccuggguucccaucaucccaccuguguucccaucaaucccuccuguguucucaucaucccaccuggguucccgccauaaccacccccucugugaguaugagugccuagagagaagagaaauugcuacuuaccuuuuaagccacagcaucuggcauguuacaaacaacacguuucuguugaaugguguaguacaccuguuaauauucucucugcucccuucacuugugccugagccauucuguaccagaacuucaccuuaauggugagcuagcguuauaaugaugacaauaauuacuuacacaaaccuaccugguuaccugacagcaaauguacuucauguggauuacuuuuauuuaaacuccauuugcugauaaagaaacugaggcacagaggaaguagguaaugugguccagucucaagggcccccagggaacgaugcagcuucugacccaggcugccuggguccagaagcuaugccugcaucaguguauugccuagcuuugcccacagccugcccugcccaccuggcccacuccuauuuacagugaucuucucugaauccauuccaucaguuugcuagccaauuaauuaucuuaaaugauguuaauguacagauuuguucuuugguccuguuugaaaugugguuggacaacuuaagcaaaaucgauguuauaguaauuuuuuauugcaugcauauuugagcaucuucagagggaaccuugguauacauuccuucaagagcuauuuaacaagaaagacucauccccacgccaccaauaugacuccccuuaacuucuuuuuuuaaaaaaaaccuaguauuuuuguuuugaagaaaaccuggccaauauguuuacaggauucucaagaaauguuuuauaaauauaugacuaaauccuuaguuuugcuccuuuuuuauuccuguagggauauuuuaccugaggcaguuacaguucucucgucgugguguaaugagcaguagcaccuguacaaagguguuccauuuggacgauaaguuauaugauaaucuuagucacaguaugugguccuccuuuuacucgguucaucaaaggcugaaggccuccuuccuuccucccaccacuuauaggacucuuacugcuguuggguuaguaagcagcaaaggugaauggccguguuccucggcacgucgucauuauauaucaguuaugcauagcauuuugaacaccuacauguuaugaauccuuucaucacucagacauuacauuucuuaagaaccacaagccuuagucuaggugugguggugcacacuugcaaucccagcacuuaggaggcucccaaguaucaggccagcccgaguuguuacacagugaaacccuagcucagaaucaaagaggagagguggggggccuuuaagacuucuucacauagcucaagagccauucauauauuugcuuaucuaugcaggcguagaucuaugcauagcucugaaaagaugccaaaaaucucagaacaguuguugccucuuggagaaggguugagaucagaguugugcagugagggaagccaagcuaagggacuuucacuugauuuauucagucuuguucacugucuguugguuuuuagguuaaacuccauaucuuaaagcugaccagguacauccugaaaaacacaagaugggccuucuccucuucuuugauuucccuucccguagagagccaucauuagguuuuccuuagguguuuucaauauaaaacagucuuucuuuuuuuuuaaauugguuauuuaauuuaguuauauuucaaaugucccacuuccugguuuccucacccuuacccaauccccccuccuccugcuucuacgagggugcucccccacccacccaccccuucugcucacugcacuagcaguccccuacgcugggguaucaggucuccacaggaccaagggccuccccucccauuggugccaaauaaggccauccucugcuacauaagcaguuggagccauggaucccuccuguguacuuuucgguuggugguuuaauauaaaacauuauuucuaaaacucauauaucacgugagucuuuuagagaacagauuacauggggcaugccugcauucaaauucaucucuagcagucaccgacuguguagccguuuggaggugacucaguuucagugacacuccaucagagaaaacuaaauuucccuuucccagcagggucaguugcaaauugcuucuugccuaggaucuuuguguccacuugcccuucucggggcuggcuuaaacuugugcaggucuugugcaugcuaccacggucuccgugaguucauaugcauccauccuguugugucuggaaaacacuguuuccuuggaguccuccacuagcucuggcucuuauuaucguccugcuuccucuuccacacagaucccuaagccuuaaagaaagauguuugauaaaggaaccaaccacacucuaggacaggcccuguguccaggaacaguugaccaaugcaaaaggaacuccguguuuuugaaaugggcuuuuguuuugguauaugcaugccuuguugggguuuuguuuguuuguuuugauauuuggguuuaguuuuuguuuuguuuuucuuuagaaagagagugaaaacaugaaguuggggagguagggagaugagaaagaucugauaggaguugggagagggaaaggaauauaaucaaaacagaguguaugaguaagcaacucccauuuuuuuuccugggccucagagaccugaccuggaaauauguguaguaauagccuuccuucuaggacugaugugaaacuucaauacgauaaugcaaguuccagggacaguacaguaagaauugcuaaaacgacagcuacccaguuaacauucuagcaugguaagaaaagaggcucauaagccccgacuccuacaugaagaacuauggagaggguauagccucugugggaaggaaacucaaguuucucaaaggauguggcucuugguagaucaaccugccaagauggcuccacacccagaaguauaaggacauuacgaaauguaaugagguguuauuaaaagggggguaggaaugaaaugaaacuggggaacauggaaaagacugggaggugaauaugauuaaaauauauuguauaaaauucucaaagaauuaacaaaacuauuguuuaguggcagcuacuauuauuguugucuauuuuuugcuaucuauacugugguuauuaccuaagaugauguaaugaauucuuauggcuauauauaucuugcccugacuuggggcagccauaaaauauacuuguuucucuaacuuuuguccuaacaauuaugaagcugacauucuuugagauccaaccauacugcuucaucuaaacaucgccaauuuguccuccacuucuggagccaaguagggaugucucauuggaguuuaugccagcaauaaggcaauaaagggccggaguaaucccuagaaagcaucgaucuuguccacaaacuaucaaauagaagagaggaagagaaaugaccagagagggcacacacaguguguugaauugguuccucugcucagggcaccucugccucugaaguucccagucacaccaagaagggcagcugaaguaaggcagccuagcacacuggcggcuacuucaaaguuuguaacucgguagaucucacuucgguccacaccaucuggaaaugggcaacuccucuuacacaugcgcgcgcgcacacgcgcacacacacacacacacacacacacacacacacacacacacgacgagaaaacugaauuuuuuuuuuuuuguuuuuuuucgagacaggguuucucuguauagcccugacuauccuggaacucacuuuguagaccaggcuggccuagaacucagaaauccgccugccucugccucccuagugcugggauuaaaggcgugcaccaccacgcccagcgaaaacugaauuuuuaaagacauuaaauugcacccagacuuccagcccagcgucacuccacuccgggcccuuuguuccgcugcacuggcuuccuguucccuagucucagaggccuuggaaggcugggugugcaguggugaugccacgguguggcuuccacuguggcguaaguuuugguucacuuccuuuucgagauguuccuugcuuggcuuugcaugcgucuugcaaccgcgucuguccuugcccuugcgugguaggcauucccucuguucuccgagggaggacccgucuuaucacucagaagaccuuccgcuaccucccuguuccugcagcagagucuuugccaagagagaucgaaacccuucagaaaugaaaauuuucuuuccgaaggauuuaaauaugcuccuuauauuucagugugaucauggaaaaggaaagaggaguuggugucagguacaccacaugaggucucugcuuccacacagccaucuggugcuuugcgugucucaguuucaggguacucacaggagucgauugaucuugaccaaauguaauucgucacuagaguauggagauacagaugaagguugcugugcugugcucuccauacaagucuacagaggagccuuuccguguaggcggccgcgccauguggccgcccugcuuauuacucuuuagaacgaccuugggagcuuagaucagcaaucucagcucacggguggggaaacaguccuagcaauaccccugugcaguaacugagccauagcucauucguucauuaguugcagaguguuugggcuuguuuuuccaggaguccgggaagaauugucacaauaaggacccacaauaaguccacagacuguuccuacugcagccuuuuuuacuuuaauuuuuuuuuuuuuuuuuuuuuugcuauguauuauuggaaggcgugauuuucagaucauuucaugacucucaaacacgaacuggauguuuugaagauuuuucuuauccgaguuaaugagggaacagggucagcuguuaacacuuuacgcuuaggacaguucuaaacuaugcaaacaaggcucacugacacuccacugggaaaauuuuauccaccccuccauaagccagagccauuuuucacccuuucagucuccagccagguuuugaauuguguaguagugagggagaugaaaguggucuguaagggcuuguuaccagguccuagcugcugcuaagaaugugcccagugacugacaggaggcauuucaaaaucaccauuuucucuggugcgcauccuuuauguggcccuuuaaaguggcaccuauguuucuggauuacaugcgagauaugggguguauggcuugcccuugccccugugguggugucuguugcuggguuuuagccauguggcaccaggagaauaugugcacaccacuaugcauuugaggcccaagcuaaggauccaagguuuguccauucucucaagauagcaaucucugggauagccucuuccaucugaagacaugaaugcaguuugugguaaggugccucacgcuccuccccucuccgacuaugggugucacuucugaccuuugcagggccagcuguccucacagcucacauauagauaugcagcuccuccuaacaacaaucuucccccucuauccccugucccuucccuugcccccccuccauccucucuuucccccuuauuuucauuucuucucuguccuguuuauuuccuccuucuagcuuuucaguguggaggcugccaccaggaaacauaaccagccauucucuccuggaacaccacccgaucccagaguagggagguugcaccuuagcccacugaucucccgagacagcuggauuugaugcgaacuaguuuccuuuuccuuccuuccuuccuuccuuccuuccuuccuuccuucaucucucucucucauucauucucccuucccuccuccaccuccuccuccucuuuuacuuuucuucuucuucuucuucuucuucuucuucuucuucuucuucuucuucuucuucuucuucuucuucuucuucuucuucuucuuccuccuccuccuccuccuccuccuccuccucuuccuccucuucuucuuccucuucuuccucuuccucuucuuucuuguuuuuaaaguuuuuuugagacaggguuucucuguaacaguccugccuguccuggaacuuacuuuguagaccaaaguaaguugaacuuguaaagaucugccuguccugccucugccuccgccucugccucccaagugcugggacuacaggcaugugccaccaucacccagguuucauauccaucucuuauaccccaagguuucgcacuguuuguuuauaaagaacauuugugaauucagcccaaaggcucaacaugcucucugaaugguuuucuuccacccuuccucauucugggucuacuggauggaauuuaacuugguaauaaauuggaauaacauguguguauauagucagcauucaaaagaagcaagaauaacagaccuacugagugaaaagauuauguguuuacugauaaauauguggcgugacuugagugcuucauuguguaauauuagcgauuguggggccuuuuuguucauuuuuagaaaauuugcucuucacucauugauaguagcaaaaagcuuuuccuuugguuucuucugaacacaguuuuuucacuugcacacaugggccagaauauuuuuaauuaauuaauuaauuuuauuacaucccauauuuuaucccccccccccuccaacuguuccacaucccauaccuccuccacacccccugucuccacauggaugucuucacccccuaccccaccugaccucuaaacucccuggggucuccagucucuugaggguuaggugcaucaucucucaaugaauuccagaagacccagcaagcagcugaaaagagucagaugcagauauuugcgcccaaccaauggacagaagcagcuaaccccuguuguugaauuagggaaggcugaaagaagcugaggagaagggcgauccuggaguagggucagaauauuuuuaccaucaauauuuaucuccaacuuuaugauuguuggugguaaaaccaggaaucccuaaauauuaguuuguuuugcagaaaacacugucgaggaggaccguuggauucaguccuggggaaggagggaggcgagcagacuuacuguaagaugugcucuauucugcagggcagucuuuccucucaagacuaggaaugaaaugggaccucacgcaugcuggauaugguggcaggcucgcucuucugccaacaauuuccaugucuguuuccaaggcaaacgaauccaucuuaauuguaaacagcugaucaauauucucaauacugucuccuuggagagaauuguguccaggagcgcaagccuuggugucacucucccucuccucuuccccccuccccucccccucuuucucucccuuuccccuccuucucucuuucucucucucucucucucucucucucucucucucucucucucucucucucucucucucucucucucuccuguguuuaaacaccaagccagaagcagaagugggacaccguagcuaaucuuccacugcaguucacgugagaaauauuagaccuugcuuauacucaaaauaucugcauuauuguuuucugauauauacaauaaaucuuuguauacaauaaaucuucccucuuuaaagaaaacuaauuugcugaugguaagagaaaccacuuucugaaguaggcuuacauggguggggggggggaacccacauguuuagugaguuaaaacaagugucuauuucucuagguuuuaaaauaagcaaacagaaacacccaaauguguguuuuaaauuugcguuuuccaggccaaaacauuuuccuugagaaggucuuaagcauggggaggcgaugggagaaaccagugccuggcgaggcccagggcauggcacaaacaaguaaacaggugggguuugcuuuuggagauauuaggggccaaagggagagauuguaacaauuaggcaaauaaugauuuaggagcugggaagcgugaugguuagcaaagaacuuaaauagaaccucauuuucucaugcaaugucuucaaaaugcccugaccguagcgugagaggacaucggaaaggagcugaccuagaugacaucugcagagauggaaggaacugcauacgaucuagagauggauaaaugggaaagugggggaaaaauugguaaugggcuaagaaagaagaggacgagaugguggcuaguucccaggucucagacuugagcaacagccaagagagaugccauuaacugaagugauaaauaguggagagggaguauccucuacaggaugggcuaaacaaggauucaauuaggggcccgguguguccgagaugccugcaaaguuucaaaagaaaaccgucuuaaauguuuuugcaacaugagucuggaaaaaaagucagggcugagggcugugggaguuguuggcacauggaugcuauccacagccauggagaugauaucacacaggggugagccuagacagaacgagaaaaacuagguccuggauuagcucugagaugcgccaggccuuuaagagagcugauagaucugacaacgagcccgagcaggcgaggcuagcagcaguuaguguccaagaaagaaaacagucauauuuuacgaucccagaccacauaucccuggcaagcagcugucaaccacaaccccgacuuggcucaaaacagaccugaaaaauaaacccacugaaugcaugucugcuuuguggagagggagcaggaugcacugaagugaucuaaagaguaagauggaagugucacguguacguucuggggagaaaggaaaagccucagaucaacuuccacgucuggguuaugacucgguuacaguaaaugaggggugauguugcuuagucugcaguagacugucuucucuuccccggcuugcaggaagcuaaaaugcugugcugucgcguucuugcuucucuauauguuggaaaugaaaugggauguugagaguuaaugagcaaaguagcuugaugagcuacaaagaugcagguucagccuugagaaguuagcacaaaugagucuaaaccacacacacacacacacacacacacacacacacacacacacacacacacccccguugguuucaguauuucccaacagaaagugugucuaucugggaaacaugauuguagauccuagaugggguguuuguaggugccaaucucuaaauaguuaaaaacagaaucuuuauauaaaguaaguugcugauaucuaaguaauuuguuauguuucugagaacgaccauguaucucuuccuguagaaacuagauuuguuuauucuuaaggucuguaucuggaaucauagcacaaaagagaguccuuggccauaaugagggaauauuaacugcuaggguacuguguguguuugcaugugugagugugauuucauuacugugaauuaacacucuuuugcaaaucaacgaagagacgggaaugcaaauagaugacuauuaaacacaaaugguucaaaagcuuggagacccuccugaaguugaucucuucuccugagcuuuucucucucaaaacacauuucgggucuucuucugcauuuucacuucauguuucuguaacuuaauaucaacaguugggagggcucugugucuaguuccaccaggacauccuuuccauaggugcacggcauuguauguuccugggucaguucugcaaacuaggagccauucuguaauaaccuguaugagaccacauacccgcuuugaauccagauuuuaaguguaacguggguucucuuugucuccgccuuacaucuagcaugaaacuugcucauaucuguccuagccuggguuuuguaguucugcuauuuugcuuccugcugaugcuagcuuugguccaaacaaaucuuuuuacaucaucagugcccuaagcuguucgucuucaucacuaagugguuauaugccaacuucucuaagugcauuuucuggaauguacagagagaacagaaauuucuggauacccagagcacuguaguccugagacccucagccagggggaaaggagagucccagacaagcauucauauuacagccagaacacagaagggguaauccugagagagugaagcugauguugguuucuugagcguuuucacuucugaggcucuaagcuagaagcauuuuuaugucauuaaucuguaauucaugcaacucuucuguguacauuaaacaucugccaaaguaagugacgagcauuccgaaagucgacucuggggaucagcuuuuccagagaauguuuuucguguagcauguuuuguuggcucauuuuaagcuuauuucuucgaaacguaaaagcaagaguagaccaggaacagcagcggacagugaggucucucuggaguguaaccuuccaaaagcugacaucugagagugaaauucaaagugggugggauggcugggagagcgaugaccgauggcuuaggcacuugugcuuucuguagcugguucauaaaacagugcucuccuugggguucgcuggaguaaauaugccaugucacucuguauuuugaccuuguuaucuauccugcuuucucaaaugaguuuaaguugccuagguuugcaauuggcuagaagauagguauggaguugacuuaaauuuuuauacaguuaagcuaaauagaaaggcauaaaaguuugcccccucaugaggcauaguauuuaaucuuuagauuuguuuuuauuuauaugacugcgcauacauccaugugagcauauguaggcaggugcucagaagaggaugucacauccccauagagcuggaguuacaggcaguugugagccuggcaacauaggugcuggguuccaaacacagauccccuacaagagcagcagugcucuuagccacugagccaucuccccagcccccaaaacguaauauuuucaaaucaaaaguucuuuucaaggaaguuaucaacguuaacugcucuaucagcauaauaucaauaacuggaaacaaacaguaaaugguaaaggagugccgggaaggacucccuaauucuuggagguuugcuugguuuuauuuuacuugcuauuaacugaucuuuuguucuuucuaccugucccuuucguuuuuuauucugcaguggcuacagaugucuucaauuccaaaaaccuggccguucaggcacaaaagaagauccugggcaaaaugguauccaaauccaucgccaccacgcugaucgacgacaccagcagcgaggugcuagaugagcuguacagggugaccaaggaguacacccagaacaagaaggaggcggagagggucaucaagaaccucaucaagacggucaucaagcuggccguccuccacaggaacaaucaguucaaucaagacgagcuggcgcucauggagaaguucaagaagaaggugcaccagcuugccaugacggucgucagcuuccaccagguagaguacaccuucgaccgcaaugugcuguccaggcugcugaacgagugccgagagcuccuacacgagaucauucagcgccaccuuaccgccaagucucacggacggguuaauaaugucuuugaccauuuuucagauugugauuuuuuggcugccuuguacaaucccuuuggaaaguuuaaaccucacuuacagaaacuuugcgacggcaucaacaaaauguuagaugaagagaacauaugagcuugcgaaguaagauugugaccagcagcgaguuaggugaaguccagcaccgaugacuuguaaagggaagacggagacucuuuuaucaaucacauguauuucagaaaggcuuggcccccauaugaccuguuauuguuguuggacauuaauaguaguacuucuguguggcuuguuguauuugaaaggaaaaaaaaaaguguauugccaaaaauucuggcugcaaacgucuuaaugauuggcaagaugugagaaaaacggauaguuggucauucagaugucaagggauacaaagacagaugaguguggccccaagcgcuggcacuucuuguguuuuagggaaaucauguugguggcacguuggauauuucuaauauguauaaagccguguaucuugacucaccuugauccuuugcuacgucuguguaucucucuuacaaugucgagagccucucuuugcugucauugauccuuuugaaacaacucugcuucuuugguuacagaucgucauugaccuucaggaguuaaauuugaggcagucaaaccgaaugcucaggaaagcaaaaaaaacugugcaucugaaaucaugacugugggagugaacaaucuuagacaucaugagcaguguccauugcaagaguguguuuuugaagcugacuucuaccuuuuaguacuaucagugauacuuagagucucagagcuaguggcaugauauugccuugaaauaucugcuuagggcauaacuuugaugucaucuugaacauguacugacauguucccguauuaacaucuauuucaccuguaggaagaauaaaucucuagauuggcuuugauauugagacaauaaaauguaaguagcguuucaaaaagaaaaacuucuugaauuuaaagaugaauucaucagacugauuuaugggugaaaggauagaaaggacguugcuaaguaacauaagaaagaugcauguauuucaguguguaacagggauugaugaauaaaagaugccauuuuuuauuuaacgacucgggauuuagauuguguuauuugguuuuucaacgaguagacugaugaccgugucugucuucggugcuuggugugccauuucuguauaauuuuugguguguggauaaugaaguagacccuugcuuauuguguaaaagagcuagaagccaucugggaaguaacagacccaaccacuggcccuaaacauuggaauugccaccaaaccugucauuuaccuaccucaagaacauugacugaaaaucuaccagcaaagaucccacaagugaaaauucucaaaguuaagauccgcuuugacccaucauagcuuagaaggaaguggucagguuucucugagacccagcuuucucaguaaagauaaacagcaauggcaaaaauuaccuaugcaggugugaugucauauugauuugagcuggaaaguauaauucuucccuccgggagccucuggaugauccuagaggugauaacacuaguguaauggcugcauuacugaggauuggacuuccuaagugcuaaacggcucagaaacagagcucagcagccuuccuuaaccaacaucagggaagcuaagagugugcucucaugggagccacuggucugacucacucugcucuaccaguccuugugcagcaaaagcacagauacugaagcuucucaggaauuuuuagcucaggacgugaccgacaaaacugaagaccuugggagaaauugagagacguccgcacauuugagucauacugauggaccuguagguagcaacacuaugcacaugaugcggacagugguagcaccccuuaguuuuguaugccagaguccuccuuaggguuaucguugcugugaugaaacaccaugaccaaaaaccaaguugaagagggaagggucucuucuucuuacaguucuauauaaaaguucaucaucaaaagcaguaaggguagcaacucaaacaguccaggaaccuagaggcaggagcugaugcacaggccacagaggggugaugcuuacuggcuugcuccccacgguuugcccagccugcuugcuuauggaaccuaggaccaccagcccagggaguggccccguccacaauggucugaaucacuaauugugaaaugcccuacaggcaugccuacagcccgaucuuauggagacauuuucucaauugaggcgcccuaaucucugaugacuguagcuuguguaaacugauauaaaacuagccaacauacccaggaaggcauaaaaaaagaauauguggaaaguuaguucaagaacacccuguagaugucaaacucugcuuaucgguagaugucccuuauagaaaauggcauauuguauuuguaucuagccugccuguauaucuuucuauauuuacaagucucaagaauuguaacuuauaacacauaauacaauguaauugcugauuugggggaaaaggguguuuugcuuauggaauaaccacaagaaaaa

SEQ ID NO: 8919 - RNA, 9436 nt, Mus musculus
ccuguguccaaaauagcuccauuguuccaggaugccagguguuugcguuuuuuuccagguguuugcaguuuuugccuuucuauagcccaaugccagguguuugcggguuuugugucuuuauaaaccccuuaccccuugaacucaucgucgacuccucuaccccugcauggaauacaaguuguccccagugcacuggucuuucccgaauaaaccacuugcaguuugcaucaagaccgguuuucgggagugauuuggggugucaccucuccugagucagaacguaggggaguccucacguugugggucuuucacuucuuuuucccuaccagggucuucuuaucagcuucccaaaugcuuaauauuacaggugugugcuacucguaggcccaggcuauuuucaagaaaguuuaaaaaagaauguauaauuaacaacauaaugaacuggaagauagagauaacaucuccccccaagaaucaaagguagcauuuauugaccauucagggaaauaaagauucccuuuuagaccaaaggccaguugaguucauuuuagccuuaucaaauccgugguaaaaagaaaggcaaguaguacaucaaacaaggagaacaugucauuccagacacaucauggaagaugucacgaaggacagacauugguccaaguugaauggauuuggguaggaauaugccaccaaguggaacagagaucccuggaguagaagaggcuuugucaaugucagugaguagaauaacagggcuaaaggguagaguugauaaauuugagguggcaugcagauuuuaagaugcaaacaagacuuuuugugggaaaaccagaaagaauuugggaaccuaagguuggaaaccagggagaggggugagaauuuuaaaaguaggagagacugauacuaugaaaggagaguugauacuguaauguauuacaguacugucauguacuguaaaugacugaaauuguuaaucauggagagggaaggaggaagaaggaguugaagggugagugcaagagaaaacaaggaauccccauauuuaugaucuggcuagaaaaaaggcaucccugaggcagcgugugagcgaucaggaaacucagagcauccuugcaaggaugaacagagguugggaggguagcagcaacagcugacaggagaaccacucucacaagcuuagacagagucaaccacuaguugaaaugaagaacuuuucuaaacuuuaagccauguucuagccuuggucacaguaaacagaagacauuucucagccauaccauacuuuguauuucucuguuguggauggcucugugcugcuuguguuuuuauguuaauuccguucucccaggagggauugucuggaaugaggaaugagucauguacucagguggcuucuugugaaccaauccccuaaugaauaaaggagccaaacacugggugaguggggggggggggggcuuccagguuggauggaggaagagaagaagcaggugagaguuagacccuuuuggauggggauauugugaggacaagauguaacuauaagugucucccaguuucaauggagaaucugucaggauucgccaccagaugaucuagauucaauaaggcuuacaggauuugauuuuaauugcugugcccagcgauuaccaucaucguuucugaacuacauuuguguuguguuuuucuucaugcggcggcucgucuggguucaagagagaaagauacaacagcaaaguguguaccuauaagccauagauggucaacugaaugagccacauuuacuaauggguaagaacaccaugaagggaaugcaguaauaagggccugccauuuuugcuuuacuuccuacaucucuccagaaggcuucuuccuuccugguaacauguagaccgauugacuaccaagacuguuucucagauggccagaggcucagucauucccuuuuucuaguauaacaacuagguccagauuaucacuuaagccauaaggggcagccuggauguacuuggcacugggcaggaagaugagcuuagucauucuuuuccaccuauaugacuauuuucugugguuuuuguauuuccaucuucaguugaacaacuugcuguaugaaauagagauccaugcugaacccuugaaaacauuggugucaaauauaguaacacacgaaugagaacuaccuucuuagaacaaaaauaugaagaaccaaggcaaacacugcauuucuuggcuaguugcaacauuaucacugaguagcggcuggguuugccuacagcuuuuacauguuuaucucccauuuagaccucaguagcagagguaagaaaaaaaggggggggggauucauuucgggauaauacaagcuguccaagaauuacacugcauaaaucauggucagucauggauagaaauggaaauguuuuucuuagagggucacaagaaauccccuaggggacacagcaaucaacagacagcucuaucuugccaaaguugagaucugcuuucuucucaaacucagucaguaaaaugaaaaaaacauacguuuugguugguugauugguuugguuugguuuuuuuuugcagugauguuguuuguuggugagucuugcuauguaguccuugcugaucaaacuugcuauguagaccaggcugacuuucaaacucuuagagauccacugccucugcucuuggaugcugggauaaaaggugugagacacuauacccagccaauauugugguuuugguuugggguuguuuuguguuucaguuugucuguuuguuuguuuguuuguuuguuuugagauagggccuccuguagcccuggguagcccaggcugguuucaaauuugcuauguagcugaggacaacuuggaacuccucccagauccuccuguaucuaccucccaagugcugagauuaaauguuuuucuccauuaucuuauuucauauucauaaauagguaauaugcacuuauucugcuacaggaagaaaaguuuuccaggaagcuaugugugguagcacaagcccacuaccccaauauuacugaugcugaggcaggaggauuauaaguuucagcuacauaggaguuuggagagcagcugagcuauguaauggcauuguguagguaaguaagagggggagcagcaggagaaaggaaguuauuuguaggaaagaaacuuaugcauccuuuguaguaacaaagcuuauggucuaugccagugguaacagggacugcaaugcagcuggaauaaagcuuugggcuccugcaggguaucagacggagcacaccaagcauaacuaauaugcuuauuucccaauggaguuuagguucaccaacucuggucaucuagcaccaguagacuagaaauccaacaaagccaaacagaaagcuuuucucuucucuguaucccuagauagucuuaaaucacuuugcuggaagccgcuacccaggccuggauuguacuacagucuggcgaugucauuuguacuuucaauagcagcugcugguguuuucuaaauauugccagcaggcagcugcugcugcacuguugugugaauuagguaccuuuggcaaaaguaagauccacgagagaauugcagcugagugaaucuuguuuuagaaguuugaggagaucgcaucaauucuuguuucaaagagcaagauggagugauggcacucggugcugaccaauggauaaaaguuaagcuuuuaacaaaagaucaucuaccugagccucccaagcacugagauuguagucccucaccaccacacccaugauagucauuuacagacuuauuuaauaucaaacaagaggauuuucuaauaaucugacugaugauuuggaacuuaaugcauucauauguugguuucagucuuuugagcuauaucagguuggccuucugagucaucauuuugccaguauuaauaagguuuccacauguacuugacaagaaugugugcuuuguugccugggcuugggcucuacauauggccauuagaucauauuauucccuucgucuaaguucccacugauaucuuuccuacuuguccucuaguuucugagauagauaaaauguccuccuguucauguauuucugaauauccugcucuuuccauuuucauuuuauauacuguuuccucuuaugcagcccuccucugacucucucuagaaaguaaggacuuagaagaugcccggaccauccugaaaaacacgagaagcuuagcaagauuucaaaaaucuggcaauuuuuuucugaucauuauuuuacuagaaaauaaugacuauugaaugggguuccugguaagcuuauuuggugucaagaccuauuacuuuaggauaagaccuagaauagguagccccaaaacauagugaauucuucaaaaggaauagaccaccaauuucauaaacaauacaacagggauuuuuauaguuagguaacaugagaacacuaaaaucauuguagaaauucagauuuaagggcauggcccaccuaaccuugaugguggaggaaaccuaauuaucuaacgaagggaauagagaaucauucaaaugugagaaaacauucaggaagacaaauaaaggcauuuuaccugccuaggguaggaucacaccuccuaucuuuuuuuuaccuauauagaccugggaaagucuuuaaucuccuucuaaaagaaguuccugguuaauuucucaguagaagguaauugauaaauuauaaauuuaaaauuuaaaacuauaaauuauauuuauauaauauauaaggaggggucaacagucuacuauggaacaacacaauaauuacaacuuuacauucuaugugauugguuauauuuauacuuaauuguguguagcauucauaguguaaacuauggguuuaauaccucucccuaaauugucaguuuuaaagaauaguuguucuggggaaguguuggguaguuuuaugucgacuuaugacaggcugacgucaucugagaagagggaagcucaacuaagaaagcaucuucauaagauucagcuguaggcaggucuguaagguauuuucuuaauuagugaucgaugguggaggacccagcccauucuggguggugccgccccugggcugaugguccugaacucuauaagaaaucaggcuaagcaagccaugaagagcaagucaguaagcagcgcuccucuauggucucugcaccagcuugccuccaagucccugucaugugugcgguccugcucucagugguuuugauggugaacuuuuauauggaacuguaagcagacuugaacaaugugagggaaggaucuuggggaagaugcuuacguuuucccagcaugaaggaugagacaaaugccacagucaccgugaccucauggaagcaucaggacaguuaaaggaggccauucaaacccccuggccugaaguggucucaucuuaacaaaugcucuugacgcuacccauugagaaggucccuaaagaaacauagaacauuuaaaccaugcagccaguucgucuuccuuugcaaacagaguccauuucugaugcauuuaauugagauauguuaaucccauucaggauuuaaaagagggacaucucaaguugugucauuauuucuguuccucccugugugcaacacgagaauaugcauaugaauuuagacaucacauuucaauuuucuuauguuguuucccucugcugaaacagaaguggagaaauuuggcaucuuuuuguuuuuacugaauuccuaaaccccucgucuugguagagaaaauguuuguguugguuuguuuugguuuuuugcagugcugaggauagaacccagagccuuguaaggugcuaggcaaguguucaaccaucgagccacauccucacccccaaaaaagaaguuuuuauaaggaucuauugaagggcauaguaaaacuacauguuuccauacaacuucucacagcugacuuccugagcugucugaaaaaagcguauccacauuuaacauagacuuuccucuuuuugccccaucggauuguuauagucaccccaauuagauuuugcuguugaagaacuaaggcgaugaagccaaaucugcaaguuuguguuguagagaacagugguaacacaccaccaccagagggcguaaagagccacaguaacggcucguucuguguguggguugauugauuuguggggguuguuuuauuuacucgucugcauauuuuacuuauuuguuugaaaaagaucucacucuguagcucaaggugucuuugaacucaugacaaucguccuuucucaguacugggauuccaggcgcgagccaccaugucaggucaguaaguggugcucaagcuaggcuccccuaugcuggagaguacugacaacuucuguuccagcucuagccucuuucuccuaauaauccggaagcugacagaagguagagcgauaccugcauauccugcugcaaagaagagguaagaagagccgagaggcuucugugacuguguucccagaccagcucugcaaaggaaugcagcugauuauaauuuccacagcaggcgguuccugucuccaagccuaaggcacccuucaggguuggucucuguucucugacccagaucacuaguuuaacaguucaacugccuuuugaguuugccgucaagcaauuagaugacaacacuaaggaucugcaguaaccuucaaaggccaacagcaagccguaggcagagaauggucagguuuagaacuuggggaacccccguuuuuuaaagaauuuaaggacguacaagugcccuguagcuuucuccacuggauguccuaaaaacagaagcaauaaaugguaaaccauugccucccccaccccagcaccacacaggggcuuggggauuugguuuuucauuacagugcagccugguaaaggaaugguuaauagagccaaguaggaugauucuccugugcagaauuagccaaacacugcaggcagaaaugguagucaagaguaacacugguacauuaacaguggcugugacccuuugaccacuguaaugccuuagguccuggcugaugcggccuaauacaaauaucaaacaccugggacuucauuuucuguuuuuguuuuguuuugugagacagugacuuaccuggcaggcuucaaauacacuguccuccugccucagcauccuaaaugcuuggaauuaaaggccugucacugagcucacaucuccccaccccugauuccacucccaacuagauuucaucuagaacaugucugcaagcacauuugcugaacagaaaugugaauuucauuugaacacugcuagagggaaaaaacaaaaaaacaaaaaugucaucugggccuagcagaggagggcaggagcagaagcaaacugaagucaagaggucuuagagggaggaggacuccagaaagagaaaagcugaaucauccagagggggcuggagagauggcucagugguuaagagcacugacugcucuuccaaaggcccugaguucaaaucccagcaaccacacaguggcucacaaccaucuauaauaggauccgauacccucuuuuggugugucugaagacagugacaguggacucacauacauaaaauaaauaaaucuuaagaaagaaaaggaaggaaaggagggagggaagauuauagagagggcuaaaggaacgaaggcagcacugaggcccuguacugccucgucuggaagcauaccgcucccacacccgccacacccaaaaucuccagcuccuccagaagauucagauuuggaaagucucauggugcaacgucacgaauuccucuuccuuggaccuucugcugcuaaugcugcuucucuuucacaacccucacucauggagcaacacaugacuccaguucaccaucagcuuagaucccuggcauuuuaucacuucuguuuccuagcuccagaccugcuggagccacugcugcugcuuacaagggggcuccaaggcuugggagagacacacaggcgagccuuguacuugagcuaagaagguucuaagacgagaucuauuuuagaagcuucagcaaagaggguagagucccaauuucuugucauuucccaucucugaaucaagcccgauguauggggaauuggucagacuuuguucuuaagcuacaucaggacuggagaucggcuucauuggaaugaucucuucaagaacagauuaucuggaaugucuggggcugcacaaauaaaguaaauggaugcugagcaggcaagaauggaagcaagugcccuccaucucuuuccaggccgucccucuguaucagagagccucacauaacuauaaugaaguacuucauaagcuacuuguaacgcugagacuuuuuuggcugaaaguuaaaguccaagauuagauaggccaauugguuuaagccuuugaugagggucccauuucacgguggauauauacggcugaacaagcccaaguguucccaucucaagcuagaaagggagcagggagggguaagaugccacaguaauucugggcaugcuuccaaacucuaagaacauucuaaguccuaccuccuguggauccacagcacccccaugcugccaugcuggaaaauaaaucuugaacauaaggaacuuugcgaaacacucauccaaaccauagaagucacccaauacagccuaucuagaauuuuaaauacaauguaaacaaauccuuuguacagugcggcagccuugacucucucagcauccauaggguaagaauugcaaucaugagaaucacuccuauccaauugcucgguacugcuucagucucugcccaggucuuucacugaucuccguugucaccaagucacaccuacagacacacagaauccccaggaggccgagccaagccgaugauaagaguugacaaacagcacagaaugcguauugcaaucaucagcauggcaugggcaacaugaagauccuauagcaugguagaaccuguucuguuuuuaauucauugugaagccaaacuguguuguugauaagacauucacauagaauuaauaucaaaagucaucucuaccucccauuagaacauuaucaauaaaauaaaacaauaaaaguuuuuaccuuucauuaccauccgguucauugcaguaaaacugugugcagugaguagaacugcaugggacucauuaggaaaggguggucguucucucacacaagacaucgucaauguacaaaggaacaggcagacagaauacaacaauucuucucaggaaagacagccuacuuccucaacaugauucaguucucucccauuguccauaauugccacuggaaaaucccacggugagccuugugggugacccagggaguccugaguccuggaaucuaagucuccuguugagcugagaccugguguagaacacacagguccuggaguccagaggcaaauccugccagacuggaugugcacaggag

SEQ ID NO: 8920 - RNA, 69136 nt, Mus musculus
cacgcaggcgcacuuggaaccaccggcgccaguuucccgagaccggcaggucacuuguuugugugccgccccuccucuccccgcccgcugucccggucuugccgagcaguacucgggacgcugccagugugugcguggugcaggcuagacucauggcuucgccgcugagguucgacgggcguguggucuuggucaccggcgccgggggaggugagccucgcgcugggccagcgauccggauagagggacuguggcgcgcagcugcgggauguggagcuggugcuggaucgggagggacgggcgugggccaggcacggaggggcauugggcacgccggcaggugcuccgggucccaugcccggagggagcuuauaaggcccacgucuuucccccgggagaugucagcaggcuugcagggugcacagcugaguaaaguucguccucucucucuaguguguggcuauggaugugacuuuugcugccuuugaccgcuuaggccucugucaagucacacaugagcuuaaaagaacuucuggggccuggcgucccacccgaggaauugacuugccagcuccuugacuuugaauagucagucgcugaguguuuguuugccccaugauucaaguuuuugagagggccacacaccaaaguucacuggaauuguggcaaaggucacacacucugugugugugugugugugugugugugugugugugugugugaaaggugagagaugguacagggauaagauagggagagagaacuugagagcaaagguauuucugaagugugccagccagugggaaaguugccugucuuuuauuucugcaugucuuuuguuucagagauagagaauuguaauugaagcaauacuaauuuuaaaggacagaaaaugaaaaaacaaaaacaaaaaaaccccaaaagacaaaaaacucacauucagguagaugcuuugcaaugaaaugucuucauuaguuccacagcagugaauaaccucuacccucaguuuucaggguauugaauuaauccuuugaucuuguuacuauuucgacagggucuugcccaaacuggcuuuuaacuccugaucuuccuccguccauuuguauauuuauuuguauauuuaucaguuuaucuuaaaauauaaguuuucuauuaagcuuccucaucuagcaaugaaaugugucaacuaaaacugaagaaaaaaauuaaaaagaguuuaagccagaguaaaaucuuccacccuuggcuguuaacuucacaggucaguuccccaaacauccucacuccuugccagugucauagauucagaguugaagugauuugcaguugacagcugcacauuugagguucagcgcaggcuauagaaaucacuagaccuuuuagaauaagagagauucggguuucaggcggggcuuuggaagucacaccuuugagcagucaucggaucucugccagaguccaaguacccuagaucauuaggguccugagguaaggggacugccgugcacugauuaggagaccagguuaagaaguugccucuuggggcucuguuuuaaaauauggguauuugaagagaagcagcugcgugagcagcaagcgcuagagcccggguaaggcgauacccucccacuucugccucuaacauguccugauugcgcguagugguggaccccaguucacaugcgguguucuagcagcccagggaaugguaggaaacgggugggaaaacauggcuuuaacuuguuuaacuucugcagacagaagagggucugaguggagaggauguugagaguaccaccggagguaccaucuucuccuacuguaacgaauuguugacuuauuacuuucaaauggggaccaggcuucaugggcucaaauaaucaugcugaggucuuucaacuuucuguuucccuuguuucucauuaggauugggccgagcuuacgcccuggcguuugcagaaagaggagcauuagucauugguaaguuguugugucuuacuuuuaaaccaguagcuguuagcaaaaauacaguuuucacaaguacccucuguccuucuggugcaauuaagauuucauuucauaguuuuuauuucugucagaaauauauauuuuuuuuaguucaaggcuaccuuuuuuuccuuuauaaagauuggcuuuuuauuuauuuauuuauuuauuuauuuuuaagacagaaucuuuuuuagcccuggguuguugagauuacagguguucgccaccaugccuggcuuacgucacuuucugaaguaaauuacuucuauagacuuucucauguaaaagaauugauaaagugguauaaauauucauuguauggaauucauuguugacuuuagucugguaggcgguuacucuuugaggaacaagcuuaucugcugacgugggagauuaaaugagaagcuccugguuagggccuugguaaaaaaaggaaauaguugaaguuuggagccaggaagccauaacuauuaguuacuuuuuaaaaauuuuuuaaaagaacuauuucaauggaaaguuuuuuaaaacuucaaacgaaugguggagucgauuauauguuaauuccauggugggggucaaggguuauugaaagcugcagcguugaagaauauggaaggauucagccaucugcaucguuaagauuaguaucauguguuugggagucgguguggguacaggaaccacuuuguccacgguugggaaugacugggugguagaacagggguguaugcagggcagugcucgggccucacgauauuuuauagcauauucugaggauaagacuguuggcuagcaguggcuuccuaaguuuggacacuauaauauuuagcgaggcugcguauuucuuauugucagguccucuugaggaugcuugugugcaggucugaaggcgcacaccgauacugcuuucucuucaugugcuauugaguucucaguaguuuacccuuagccuguuuguuauguaaauccuacucucuuuuugaguuuacacagaacuuguucaaucuuuccuaacuccuaaaggacugaagaguauuuccuugugcaaagaaggcauuuuauucauuggguacauugcugacaugguguuuguuguuguugcuuuuuguuuuuuugcuugguuuuuuuuuuuuuuuuuuuuuuuuuuuuuuuuuuuugaggggcuauaugagaggcucccuacccccuuaguaaaaacaaacaaacaaaaaaaaacccaaaaaacuaagacaugaaaauauauaacuucuuucaagccaggggccauggggauauuuguaauccuagcacuuaugacauggagacaggaggaucaaaaguucaaggccagccuuggcuauacacaguguguucagagcaagccuaagcuacaugagaacgccucuuaaaaaccaaaccaaaccaaaccaaaccaaaccaaaccaaaccaaaccaaacaagcaaacaguacauggaccacauccuggaaccaaacaaagccuccagaacaacaagccaaccaaacgacauugcagagacaccucccacccaccucaaauuucaaaucuuauuucauaaauaauuucagagcagggaagcuugggcucgccagucaggcucuuccucagagcacuaaaggaaaugcacugcagugauauaugagucugugcaucuuguuuuccuaucaccucugaauauguuauauucagaugauaagggcuugaguucaaagaggucagagauacaaagacaguaugucuauuuaugauugccuuggcugcucugcuauugcgacaaguccuaguugaaaguucaaggagucuaaauuaagauaauuaauugcucagccuggcaggaaagaugguuuaaguuagguguuaaagggcaggauccagucuuugugaagguacagauggauagacagguagacagacagacagacagacagacagacagacacacacacacacacacacacacacacacacacuuuuaauuuugagacuguucuuuguagccuagccuguccugggauuuguuauuaacccuggcuggcauuccccugcagucuuucugccucaaccucccaaauacuccuguuacaggugugugucaccacaccggacuugacacagcugaucuuuuugaaggccauugcccucuuuucuuuuucuuuuucccauugauuuauuuauuuaacccuuuuuuuuuucaucugugacuuuccugggaacuuuguggaccaagcaaggcauuuuuccugccuaagagcaccuugcucuuccuuagaauuaaacaaaaacaaaaacaaaaacuagagacaauuugcuuuaaggcugcaguguacagcacugaucuuuuuguguuaauacguuuuguucauccugaugauuuggguuaucuuguuucuggaagguugauccaucauauauccuguaauuggcucagaggacaguaggaaguauaagaccucaagaaauaaaguagcuugucuccaaucuaaauccuuuuaugcuagacugugaugaguuuacagucuuguauuguaauagguuguugaaauggauggauacuccuuucuuugugacuguucauguguuccugcgcugugaucaugucagauuagcuccuaccuggagcauagcuauuaggucagaggggacauaauguuguaugccagauagcguuacaccaacuuggcauaguuaaagucaucugagaggcuggaaccgcaauuaaaaaaugccucuauaaacuugggcuuucucgacaaggcuguaaggcauuuuucccaaucagcgauugacgggggaggacccaguucacuguacguguggugccuucccuaggcugauaguccugagcucucuaagaaagcuggcugagcaagccaugaggagcaagccaguaagcagcacuccucugcaucaguccugccuucaaguuccuacccuguuugagucucuguccugacuuccuuugaugauggacuauaguguagaaguguaagccaaguaaacccuuucuuuccuaccuugcuuuuggucaugguguuucaucacaccaguaggaacccuaacuaagacaugcuugggucuaccuggugguuggcugcuaagaagugucauguuauuuccacuucuguuucaguggccaaguccuuuagccagccgugaagcuaaggguguuguuaaagauauguucuaauuucaugauaauacaaaaugcuaugcuuuauauuucauauaauaaaguacuuggguauuuaaguuugggcauaagauuuacuguugucuuagcuaagguacagacuucauuucaaagcuugcuuuaagccccgugugguagcacacgccgguaaucguagugugucggacuuauagucugacaauccacauuugguuuuguauaaaugacacauugcagcagagguuugcccaugucugagguaggugcugggaacugagcaggggcugaaaugcccccaguucugugagucaugccuuagcuugaggucaugaauguaagacagauugaggucuucuagcaggaacuguagcugaaaauucagaaaguuugauccccuugaccugaggagguacugucuuagaugcacgaaguugcacucuuaugagcuaagauggauaugagcuccuuucugugcuccgcuuacacaguaauggguaaacagucuucagcuccggugggcaucggucagcuguucaaacccucccccucccccgcgucagugugacaucucagagguaagucaaugaggaaaguccauagaaugcccuagaagcuggugaaaguucaaauccugccuuuauugcuuaauuacaucaucucuuuguaaucuguuggauuucagugggugaaaaauugaugaccuuuguagagagaaguaacgaggccagcauuacauuauaccgaguacaggguacacaugugugcuagaacucacugcauuccuuaguauucauuaauuagcaugaacucuuuaaaaaauccuuuucaaaauuacuuuuuuuuuacaugcaguaugugugugugugugugugugugugugugcgugcauguguguguguguguguguguguguguguguguguguguaggucagaggacagcuuucaggaguugguucuccccuuccaccauguuggugggucuuggggcuucaacugagcuggccaggcacagcagcauaugccuuugcccgcugagcuaucucagcagcuugaacccgagaucucguucacuuaguguuacucugaggucucuucuucaagcugccgccaccacaacagcagucucgguccuugugcucaugagaaagaguucagauaguagagagaaaaaaagcuuuuaaaauauaagucauuugaaaauguaacagagaggagcuaggcauugggguacacaccuuuaauccaacagagacagggcagacagguggauuucugaguuugaggccagccuggucuacggaguuccagggcagccagaggaacccugucuauuaaaaaauaccaaagcaggaggugguggcugagccacggcaggagagugcugagaagcgucggggagcgcaggccuaacagccauggcgguggaaggaggaaugaagugugucaaguuuuugcucuacguucuccugcuggccuucugcaccugugcagugggauugaucgccauugguguagcgguucagguugucuugaagcaggcuauuaccuaugagacuacugcuggcucgcuguugccuguggucaucauugcagugggugccuuccucuuccugguggccuuugugggcugcuguggcgccugcaaggagaacuacugucucaugauuacauuugccaucuuccugucucuuaucaugcuuguggagguggcuguggccauugcuggcuauguguuuagagaccaggugaagucagaguuuaauaaaagcuuccagcagcagaugcagaauuaccuuaaagacaacaaaacagccacuauuuuggacaaauugcagaaagaaaauaacugcuguggagcuucuaacuacacagacugggaaaacauccccgucauggccaaggacagaguccccgauucuugcugcaucaacauaacugugggcugugggaaugauuucaaggaauccacuauccauacccagggcugcguggagacuauagcaauauggcuaaggaagaacauacugcugguggcugcaguggcccugggcauugcuuuuguggaggucuugggaauuaucuucuccugcugucuggugaaaaguauucgaaguggccaugaaguaauguagggcuggggggcguuuggucuucucauggaguggguucuccagguuuuucaauuaaacggauuauuuuuucagaccuaaaaaaaaaaaaaccaccaaagcaaacgaaaauaacaacaguaagacagcaacaacaaaaaccaaccaaccaccaccaccaacaacaaaaagauacuagagacacagagacacaaaccccaaauaaaguguguuguugacaagagcaggcaaaaugguaaaggacagagauggcuaaugagaguuaaguguuguuuuaguagcgccaaagaagugugcguuaaaacaaugggcuagaauuuaugcuuguucuucagauccacagacgugcugauaggccaugcugagagaagcagggauucucucagucaggaagcucugccuuuagaacgacugugacuggaaacacuggauaauuuggcauuuuaauuuauuuaccuguguaucugauuauggagugcugugugugugugacacagagagagaggcagacagacacagaggcagacagauagaugauagagaguuucaagugcagcuuagaauucuguggauccacgaguuuguaauacagguguuauuuaaugaaacgcugagaguagauuuuuaggagaacugcccccccaacccaacccaacaaagagaaccaaaccucuacagcucuuaauagcccagcuagcucacugauguauuuaaaaugacaagaaaaagggaaaaauaacuugcuuaagaaacaaacaccuuucagggugugagccaacuuuuuuuuuuuuuuuuuuuuuuuuuuuuuuuuuuuaagagaggaucugauguagcccagguuggcccaggauucuauguguauguaaggaugacuuuggaacucgcuguucccuuuucucuaucucucacgugucaggauuacaagcauguacccggacaccugccauugaaacggaguuuuaaguagagaauuacaaacguaucacaugcuagggacuuguggugggucuggguucagcuauccucagcuaucacgcccuucccacucgugucaucaccaggaggagugacugcuucauccuuuucucuggaucuuccucacacaaacaugcuugguucaaaagugcuucucaacuaaacuuugcauuugaccuagucuggguuaaugcauaaacuguguuuuuauccaggggagcacuugucaucuuaaacucuuaaaaccuguggaccuucagcacauccguguacaguugucccgaggugggaagcauacguuaauagaagcucuuugguuugcuacuuuugcagucugcaacuuugaccaugcgugggaguggcagccacgcuacauagcguggguaccaacagucccuuuuauauuugaacacagauaaacuguuaaauuacugcuuuucaggccauucagcacuugaauggguguuucuagccuggugacagaaggaguuaguuuaguucuguuuaaugcugcaucuuuucucucagcauuagugaucuucaguguuuguguuuugcugaacuuugugacgucuccacuugggggcaguguuucaucacacaguggaacaauucucuccacucaaaugcuguuugccaguuuggucuuggaaguucuugugcuguuuuacauuauuuuuuuaaagaaaaaggaaaggguagagggagugauguaauuauauuuuaguugaaauuuaaaauuaauguaaaaaacaaucaucaaaacuuuugcuuguauuuaaauuuuuauuauguuuaacuaguuuuuuugucauauaaauaauugcaugggaaugaacgguuaauagaauucagauuuugaaaauuaucuuccuuuccaugccuugaaggauaauguaaaccuguuuauuauuugugucuuuacagagcguuuuaauuuucaguaauacugguaauauuacuugauuaggaaaacauuccugcauaaauuuaggaaaacucauuuauuucaaaaagaacaaaagaaaacguuagcggaaacacauuuauccugacugcuuuuacacguggcuagguguuggccuuuucagucugucaucccaucccuuuaucucuuuagucauacacugccaucgagcccucacuucaguuuaaaggaaugcuuuucuaaagaaaaacaaaaacccaaaaccgaaacaaagcucaucaauauuaauuguaccguguaaccucuugccauuuguaauuaguaauuuauuagggugauauccucacaauccugugcuaggccuacaaaaugacccuuucacacacaagcuuugccccaaauauuuuuccugaguuuuguuuuuuuaaguuacauggcaccgaugugcuuguggccuuagugguuggaugcuguucauacaacuugcucugcacuacugugccacuugaguuugucaucugucccuaguguuuggugacuuuggcuuugcuguguacuucacguuaaugucugacgacaucauucacgucacuuucaguuagacacugaggugggcacccuugccauucgcuacagguggcacugaagagcucucugcagacggucaauguauauccagugcuagcaguuguauaauugaggauauggggaucuuauguguuuucuuguuaaaaacaaugaaaucaugguaugagcuagugacugaaaaauacuaguuucauuuauaaucucucuuuuaauagauauuuuccugaauucuagauuauaacauuguguuuugggacaauuuacaaguguucuucucugccucauaguuuaauaucaccacacacacacacacacacacacacacacaaacgcacacacuaaauaaugguuuuuuuuggaccagggaaguuacuuuauaguauauaaucuuuacaaacuuuauuguaguaagaacacaaugugagugcuaccuucaguuuuaagcuuacuauuauuauagguacuguguuauauaguaagucuauguaaguauuuauuuuguauaguugaaacuuuaggccuguuaaaacuccccaggucagcuuucucccaguuuguggcaaccauccuucucuucuguaagucugugaaucugacuauucccaaagccacacguaaggggaaccgccugguauuuguccuauucugguaguuuuacuuccccuggcauagcgugccggguuuacccuccgccgccgugggcauugggcugcuucuguaccucaacugcagugcugguggcucuccaguguuugcagagacuuucuauugcuuuuucuuuugacuuuaguucuuuuggcuaagugauuucaaauggauugcuuauuauuuccuuuuugauuuuugauuuuguuaauugcacauauucaugagguucagcuugccauuucauaugugcacacagccagcaugcauccaucgugccuacucuccaccuuucauccacaccugcucccaccgcccuucucuaucccuaggucaguaggucauuuuaaagcacacuucuucgucuauuuguuuuaaaguuuccagaagccccgggauugcuuccuuguguauuucuuuuugaagcguguuuucucacagcuucccccacucaccccucaucucuucugugaaggcuuaagucacauccuuuccauucccaaagaggaaaagcagagugaaaggaaaaacauucaugaccugaaccuuuggucuuuggcuguuuguaucuguggugaaaacuuuauuuucuuggugcuggagauaaaccugggcuugggccugugaggcagaagagggccuguuuugguaacacgugcuuuaccucguguuugguaagauuggugauaacggaggugggaagugaccgggagauugaagaacgccaucacuaauuugaauuguauaucuaacaugcuugggaggugggaaagauuaauugcuuguuuguuuuugccuugcagugaacgacuuaggaggggacuucaagggaauugguaaaggcuccucugcugcagacaagguuguggcagagauaagaaggaaaggcggaaaagcaguggccaauuacgguauuugacaaacguagauuguuuccuucccuucugcuaauaaagauugcuugcuuugguaauccuugagaaauaacucggcauuauacugaaucuaugaugaaauuagauuuuaccuaugucuaccaagccucuugacagcauacuuuauaucacaugggagaaauggcuaagcuuuugauguagccgauuucacgaaccguucugauuagcagauuucacaaacuguucugauacuuaaacuguuagagguguggcuguguucugaacucaaggucucacccaccuccauggugucuccuuuaauucuucuuaguguuuuaaaagauccucacaguaugcugugcuaagugaugaguggccuucucugcgucggcucccauguccuacugcagucacaacuguauguggccuuagcuuugcaaaaacucaagggucaaaugagacguuaaguacaugaugaaaacccugcaaauacagcuuucccgauuuggucuguuguucuaguaguguugggaagagcuugguugacuggauuuacacucaagcucgcggcucggcugcugacuuucccuggagcuaggcuuuauuuugcugguuaauaaacugucugacauaaaaguuucuuugguaauccuacacucugucgauugcuuugcuagauuccguugacugcugugugccuuuuuugaauucauucugucggguggucguaucacucaugugccacaggaaacgauugugugggaggucauggacauuuugucuuccuuguucuucucagauucaguugaagcaggcgagaagcuugugaagacggcacuggacacauuuggcagaauaggugauguuuucuuucacuuaugacuucucuaagguccauuucuguuucugugguaaaauauccccaggaacaaacaaguuaggaagaaggggauuuauuuugacuugcaaggcuaggauacagucuguuauuguggggaaguuaggacaggaauucaaaauaccaguuaugucaugaaauaguccuccacagccuugcccacggaugaacuuccuguagacaguccuuccgugagccugucuucccaggugaguguagguugggucaaguucacaaucaaagcuaucgauuacaugauuacaugauacuaaugaggcucuuguuagcuuccucauggaauauuuuugaauugacaucuguuuaacaaacaaaucucuuuuucuaauuagauuuucggguuuguuguauaauucaaauauuuuauuuaacugauuuuauuucgugauggaauugaggagaugaucuuauugccauacacauaucuagguaauuuuugaguuuuugaaucuuaagugauuaaaaaauuuugucagcauaagcucuuugcccuuuuuaaugauaauucaauuaaaucucaaaagcauuucugacauaaaucaguauuuuggcacuaauggacccaguguauuuuuuuaaaugaugauuugauguauaaauuuagaagaaauauguaugauaagugucuuaggauuucuauugcaguugugaaauacuaugaucaaaaagcuaguuggggaggaaaggguuuauuuggcuuauacuuccauaucacuguucauuacugaaggaagucaggacagagacucaaacaggccaguaaccuggaggcaggagcugaugcagaggccauggaggggcacuccuuacuggcuugcuccucauggcuugcucagccuguuuucuuauagaacccaggaccaccagcucaggaaagguaccaccuaccagugggcuggacccucccccaucaaucacuaauuaagaaaaugcccuacuggcuugacuacaacuugaauuuauagaagccucuucuuaauugggcucucuucucucagaagacuuuagcuuguaucgaguucacauaaaacuaccuggcacaauagggcuguucauuuuagagauguacucuuggcccuucuucucuaacuccuccuccugguuuagucugagacauuguuauuaaaauucaucauugcaagagggaaacaggccuguguguuuccagccuggacagcacuacuguuuguguguugagcauaucccuuccuuguuuaguucaagauauuuguucuaguuuguuaaguugaaucauaagagccauggucacaugccaucugacaggggcagaaagcagagugugaccgcagaggauggagauugccacaggauugcagggguugggucuuuaaaaacuucacuuucuuugcauagugagauuacaaagacuuaucaaauagaguauuaguuuauggccucaguggguuuguuugaaauuccuaguuuauuucauuuuauuuuauuuuggaaacagggucucauguaguacaggcuaucccacacuuucuguguaguugagguuggcucucauuucaugagccuccugcccucccuucucaagugacugaauugcaggccugaauucuuaugcuuacuuuagcgcuuccugaauuuuugaucuuuuuacuguugaggagcaaggagagaacuuuuuaacuuucugagagaauuuugaaguuaaguacaagauggcuuauaguacucaagacucaagaggguguaagagcuagcuuuuugagcuacaagacuuuugguugaagaaaggagauucagauuuuuaagucugagaggaaggugugaccugaugaucauguguuuuuuguaaguuaguuguuuuucauuuguuuauuuauuuugcuauagguacucaaauuuuguuuugauagcauucuuauuguauguaguuuuucugggggacuuuuaaaaagcuuuaaaauaaauguaaguuguaaguaagugcaaauuaaugugcauacuuuccuuuauguaacuuggaucuuuuucacauuguagacguuguggucaacaaugcugggugagucuuuuuguguucucauuuggaguagagucacacuauuguguucaccgcugugcauccccuuccacucugaccauucuguaugaucaauauuuuagaauccugagggaccguuccuucuccaggauaagugaugaagacugggguaagauguuuuucuugcuucuuuggaacauaacuaucuauuuugucuuuuaguauuuaauuaauuuauacuauuaaggaaauacuuuguauuugcuacuguuaauaugaaugaauucacucuauuaaaaaugacuuauaguuagaaguauccuauuuuaaacauuuguuaaaaaauaguuaagucauuugcggaaguucuugaaaacaauauuguuucuuaguauuaacucuuuauaguagcuuuuaccauauuuaucuaacucugucucugcuucuguguguguguuuguguguauucguguguguguguguguaugugaguguguaugugagugugugugugugugugugaguauguguguguaugugaguguguguaugugaguguguguguguauguguguguaugugagugugugugugugugugagugugugugugugugaguguguguguguguauguggguguguguaugugaguguguaugugugugaguguguguguguguaugugaguaugugugugugugugugugagugugugugugugugugugaguauguguguguaugugugugugugugugugugugugugugugugugugagugguguuuuccccaugagaagagcaggaugcagaagaucccuggauguuaaucugaaguguucaauaaauaggaaauauuucucauuuuccuuccccguguuacaaagguugaguuuauacaacaaugaaagcccauuuguaguuugguuuucuuuuguuccuguuuauggucaucagaaguaaacaaacagguggcugagagaauggcaggcauagccgcugaggugggauaauuccgucauugcuaagaugaaguuuagcuucugugccuaggacuuuuggaagaggcacgauguccuggugccugagaauuaagcaaaggaaagcuuuuagcucuucuccuggggcagcugcgauaggaagcugagaaugaagauccaagcgaugaggcuccacccugcccaguccccacuccuuaucaccugccucucucucuuuacuccuuaucgccaucucuccugccuuaguuuugcauuuacccugccuucaccuagaauuugcuuggaaacuuugguuuuuuuuuuggaauuccuuaaugaaaccaaaugaguaagaauggccaaaaaugggacagcucucaauccaggguuguuuuguaguguucuucaggugggucacucauugcuuugaaguccuuaaaaguaggcuguuuaacucauuugaaagucuugucaaaaauagagguaauagugaguauuuuauagauauuuccugauaaugagcuguguagucuaaccaugauuuguuauuuugaguauuaguuauauaugucaaauucaugaguaucuauuuagauauuugcuuuuaaugcauguaugucaguucauguaugugugggauggguaugcacauucauuuauaugccagagacagguuguuguccugaggaaugccaccuaccuccuuugagauagggccucuuauuggucuggagcucacuaguugggccagacuuguugguagcugucuuugccuuaccagcacugggauuacacacauuuacuaccaugccuaaaguuuucacauggcuucugggacucuaacucaaguucuuaugcuugugugacaagcacuuugccaggugagcuaaaucucuccagguacuuacuuaaaggaggcuggucucaaguugcuuugugucaguuuguguugccggggugcacaugcaaguggagauguaaaaagauggcacugucucccucuuggguuauauuggcauuuuuagcuugagugggcauuaauuaaauacaauagcguguuuagauuaauguaaggauuauaauaauuuuauaaauuauaggaaaagcucguagguauggguaugaguucucgauugguagcauaauuguaacaaaagcaaaagugguuaccugggugugacaguagaugauuaggaaugccucauacaaaaugaacauguuuguguaaguuuauucuaagacacaccuagcuuuugacaaacacauaaugaaaacaaauucuuuuucagauauaauucauagaguucauuugcggggcuccuuccaagugacccgggcagcaugggaccauaugaagaaacagaauuauggaagguagaguugccugcagucagcagagaggauguuuucacacagugcuguucacggguguauggugcuagggcaagcacucucacacaugugcaggcuucagaguacaguguaguacacauucaccagcuuuuauucuucuuuuaccacaugcuuuucaucaucaguacauuucccaugaaccuuuaucauguuuuuuugugugacacuguucuugaggagacaaaaugugaauccaugucuauucaucccagauggggcaccaacgacagacaacauuacagacaucaccagaguucagcuuagcaaaacaaaguaaugagcuuuauuggcauuaguuacaggaaugugggugaggggcuacuaaaaagagcagcaaugacucaaagacagcugcaucaccaaaguucccccucagcaugcaugguugacagggcacaaaaaccggacacugggagcucaccgcacagccuacaggaagcucaacucauucgagagcaucuucuuaggugccuuggugaaucugagccuuuuccagacagcucaccuugugugagacuguguuuuagcagcuguccuuacaacuuauauaaccuuugggagggaggggucuagugaauccuguugguuucagggacuuccugaagucuuggguaauuuacuuacugagcuuagugagcucccccauagcacagaauguuuuaccuucccuuagaacauccuguuguuugagcccuguaaucauccuguggcuucaugaacuuccucuaaaggcagaagaguuugacuuuguaggaaacgacuacacaacaacuuuagaaagcaguguaggcacugaagauuguuauguggagugcccagcaaccagauggacagagagaugaguggccacuucuucucaugcuagcccaccaugggcgagucuuuguaaacuguuuggaaucuggaguucucuuuauuggugcacaagugucacucauuuauacuuacauuuauacuguccuccgugugucagggucagcccugcaguuuaggcuuccgacgguuguagaagcaaguuguuaauaaugcugauuuuuuugagacuccauuuuaucucugucuucaaaguucugaaaguaaaugacgugauuuauuuuguuuguuguucuaaguggagugaaauugugucagguuauaugauggcauuuaguauuauucagaaauggaacagcaaagugaugacuucugaagaauuacaacuguuuaacguaauauuuucuugcuaaaauauuaauuuacauguuccuaguuuguguuuauaaauauuguugguuuuggcagauaguguauaaacacuguuaaauuuaauccaccuggcucgaagcagagauucuuucuaugcauuuacguucuauaguggaguuuugaaacaucacuuuuaugucaccguuauucuaacuguaugauucauggcucggggaagugaagcggguguacagagcugacaggcaccacagccucggaacagccagggucgcagugucggcaacacaggcagagaugaugcugguguuguuuuuuuuagaauccuuaugacuuccucagcuucuggaauauauggcaacuuuggccaggcgaauuauagugcugcaaagcugggcauucugggucucugcaauacucucgccauugaaggcaggaagaacaacauucauugcaacaccauugcccccaacgcugggucacggaugacggagacuguguugccggaaggugaguguguuagagccugccacacuguguguguggaaggugaguguguuagagccugccacacuguguguggaaggugaguguguuagagccugccacacuguguguauggaaggugaguguguuagagccugccacacuguguguggaaggugaguguguuagagucugucacacuguguguggaaaaagcuuugcaaaaggauuuaauuuucugaaugcuuaaaaaaauucuuucuaauuucaaaggcauuuuguguaacuuaugguugcugcugaaaaacuugaaguaggaacuauaggacgugaccauuaauuuucccuuuuggaaguaaacuuucaucccuuugcucugcauaucuagauauacacacguauuucuguagacaggguacugacauucuuacuacuuuauaauaaguacaacacauuuauaauaauagguuacuuaucuagaucauauaaagcacaauaugaaaugcauagcauaaauauggaauguaacauacuuuauuuuuggagcaauuuugcuuuauaggaagcuuuguagaacaacugguuagagcguagagaguucucauguauguuccuuuccugggcuccucuaacauccgugcucucuuguuauaacugaugaacugauauggauuuauuguuguuaaccaagguguauaguugcauuaggacucacuuuguccuauacaacugucaggcuucuuacaaaugcauacccucguguguccacucuuacagagucgugcagagcucaccagugcugcaauuacuccuuccccuuuccuucuggauggggaaacucguguauugauuggauguaguccacggugugggagcaccacuguuuguuuauuaacuuaccuacgagggcaucuugguugcuucugguuuuguuuguuuguuugauuucgcuuguuuuauuuuauuguuguaauaaagcuacugugcuugugaguuuuuauguuaauuuggcacaggcuagagucauuugggaagagagaaacucagcugagaaaaugcccuccaccacauuggcuuguagggcauuucugauuggauugaugguggugggcacgucaugugguacaucccugggcacguuguucuggauggugcacgaaaauagggugaacaaaccaugaagaauaaguacgccuccuuggccucugcaucuguuccugcuucaggguuucugccaugagucucugcccugcauucccuagaggaugaaauaagccccuuucuacccaaauuuauuuuggucauuuuuuuuuuuuauccuaggaauaggaacccucagaagauagcuaccaguaauucacaucuaaauuucauauggacauaaauuucuaauuucugagaaaauacuaagaaaugugauuauuggauaguuugcaagauuauuuuaucuguguaagaaacuacugcauggucuuucacaauuuauucaucauuugcauuuccaccagcacugacuuagaauuccuguucuauaucuugccagcauuuggcaaaucaaaauagaaccuuaguguuuuuaauaguuagcuagugagaugacgucacuauuuuaaucugagaucccuugaugacacugaugcugggcauuuucuuacaaugcugcugcacuuauuuccuucggugaaguaucuuaugauuugcuauuuauuauuauucugggugugcccauggugugccuauggguacauguuaugcaaugcauguggaggucagagguuaacugugacauugguuuucuuacuccacccuugccugguuccguggauuaaacuaagaucaccagauaggaucuugauuuguagccuaaacuggcuucacacuugacagcuugccuccaccuccugaauugcaccuuuauucuuagcuugaguugguuccuuuuuugaguuuuaaguauuuguauauuuuggaaacaucuuuagcaaauauauuucccaccauguguggcuugccucccacucuuguuuguuuuuucuucccuuagauuuuuuuccuuuuuuccuuuuacuuaaucuucucucauauauuacuuuccaaccgcaguuuucuuucccuccacuccucucagcuccuucccccagauccaguccaugcuccuccauuucccuuuagcaggccucccagagauaucagccaaacaucauauaacgaguuacaguaggacgaggcacacacccuuacaccaagucuggaugaagcaagccaguaggaggaaaaggguccgaggagcaggccaaagagucagauaccacccacuuccacuguucggugucccacaaaaaucccaagcuacacaaccaugacauauaugcagaggacaugacacagacccaugcaggcucgguauugucacuucagucucucugauccccaaugaacccuacuuaguugauucugugggccauauucuccuggaguccuccaucgcuaugccuccuacaauauuuucuucccgucuuucauacagguuucccugaguuccaccuaauguuuggcuauggguuucugcaucugauccaaucagcugaugaccacugguuuaggcauggaucuaugacauuaucagaauaucauuaggaaucauguuauugucuuuuuuuucuauucacuuguguuugggucuacccuggguuucugagccauccagcuucuaguuccugccaccugggcauugucaagcauggauucccucuuguggaaugggccacaaguuagacuagucauugguuggccacucccacaaguucugagacaccauugccccagcacauuuugcaggcaggacagguuauagauugaagguuuuguggcuggguuggugucucaguccuaccacuugccuugccugguugcagaagauagcccauucaggcgcuguauccuccaucacccucauagacuccagggaguuucaacugcacuagguucccucccccaaguccagucaucucucuccucauacucccucccuccaugccuuugccaccugaucaccaucugccccuaguucaccugcagaaccacucuauuuuccuucccagggagguccauccccucccuccagagcccucauguugcuuagccucugggucuguggacuguagugugauuauccucuucuuaauagcuaauaccugcuuauaaaugaguacauaccauguuugucuuucuggcucuggguuaccucacucaggaugauuuuuuuucaagugccauccauuugccugcaaauuucaugauguaauuuuuuuuaacggcugacuaauacuccauuguguaauaucccacauuuucuuuauccuucuauugagggacaucuagcuuguuuucgguuucuggcuauuaugaauaaaacugguaugaauguuguugagcaaguguacuugugguaugguagaguguccuuuggguauaugcucaggaaugguauaguuggguuuugagauagaucacuuuacaauuuucugaggaaccuccauauugauuuccauaguggcuguacaaguuuggaaucucaaagucauuuugauuuacacuucccugauggcuaagaauguugaacaucucuaaguguuuuucgacuauuugagauuccucuauuaagaauucucuguuuagauuuguacaccauuuuuaaaugggauuaaauuugaauuuuuuuuuaaugucuaguuucuugaguucuuuauauauuuuggauauuagcuuucuauuggauauggauuuggugaagaucuuuucccauucuguaggcugccguuuuguccuuugauaguguucuuuaccuuacacaagcuuuucaguuuuaugagguccuuuauuaguugucaaucuuagugccugugcuaugaguguuccguacaggaaguugucuccucugucagugaguucaaggcacuuucucuucuacgagguucauuguaucugguuuuaugucgacgucuuuaauccgcuuggacuugaguuuugugcaaggugguauauauggauccauuugcaugcuucugcaugcagauauccaauucuaacucuaaauuuacucuguuuauuuuuugagacaggguuucucuguggagcccuggcuguccugcaguucacucuguagaccagccuggccgugaacuuguagaucugccucucugacuuuacuuuugaagguuuauuucauugguauuuagguuagaggcuuuuuguuuuucaauacugaauauuucacuaaaugguucugugagcucucugguuuauuaguuagaguuuucuggaagaguagaacugauagaauauauauauguuuauguauauauguguauacacauauauacauauacacacacacacacacauauauauauauauacauacacacacuaauauaucacacauauacacacacacauucacauacauauauggauuuauuagaauggguuacaguuugugguccagcuaguccaacauggaaaaggaagaaucuagaaguuguucagcccacagggcugcaugucuuagcuggucuucagucuaugucauaauccuaaagaaguggguucuaucuccagcaaaugaugccucagcagcaggauagaugaacuugccggugacagugagggugagcaggcaaagagugaaagcuuucuucuucuaugccaccagaagguguggcccagauuuagggaggaucuuccugccucugaugauccagguuuagcguggguuuccacaccucaaauaaucuacucaagaaaacccaacuucuuggguuuaguugauuccagguguaguuaaguugacuacugagauggagcuauuacaagucuaccucuugucaacaucucccuaugucaggcuucauuuccagaaucuuuuuuguuuguuuguuuggagaacgagauaggguuuuuccauauaucccuggcuguccuggaucucucgaugugauguagaccaugcuggccucaaacucauagagaucugccugccucugccuccugaguacugggaacaaggcuacacuuaauuuccaucacacggcauuuccaucacccggcuacacuuaauuuccaaaugaaaauauaaccaagucauaauuuugccuaacaggauacaacuuccuuauguacaaccacaaauuaauuauaaauuuuagaauagguaguaauguccugugagaaacaguuagucuuucagugucucauaauuuaauuuaaccacggaugauauuucacuugauauuauauuacauaauaaagaaauagaggaacacaauuaucucuugauguauguguauaugcaaaaacauauucuuaacaaaauaggaaagagaacaggaagguagggccugguuggaagaaguagguaacuggggcauguguuugaagugugcacuugccucuguguacuuccugucucugccuacuuccugucucuucuaugcuuccuagcuguggugaguuguacgguucuguuccacucuaccucucuggcucgauggacagauaccuguaaaaccgugagcuaaagcagaucuuucgcugauuaagucauacacacuuccuguuaauucucgguaacucugccguaguuacuuucaacacuucuucacucccuuuucuuacucgguuccuguuguacauguuacacacuuuugaguuuuauaacccuggucuguuuuuuucuuuuucccuucauucugcuuacugagacaggucuagcuacacagcgucugcuugcaugggacuugcuguguagggcagucuggccaugaacucucgauucuacagccucagccucaugagugcuuguuuacaggugugccaccacacauggcuuccuuccuguuucucucugccuugcaguuucaggauuuuauagugccagaucgucacacauuuuuuuuuuuuugguuguuuuuuuuuuuuuuuuuuuuuuuugagacaggguuucucuguguagcccuggcuguccuggaacucacuuuguagaccaggcuggccucgaacucagaaauccuccugccucuugcuucccgagugcugggauuaaaggcaugcgccaccaacgcccggcuugucacacauacugauucuucacuucugugagagagauuuugauugcuagcauuuucuuucuuuguaacuuuuucuucacauauauuaaucauauagaauaguuggucccauuacauuuucacacuuuacguacuguacuuggaucaugucuaccccagagccucucuuguuagccgugugcucuucuuaugaacagccucuucuuguuucguggaguugcucuucacgcugacucuuccugagagagagagggcacgcgaugcuucauuucuuccucuggcuuacguucuuuugcuucugcgguuuccaccugugcgcuugguauccaucuguccuuauaauuguuucucuuuuauuagaacccguacuauguuaauugguuguuuuaaucucccaguuugauaauuccccagccucugcugugucugaaccuggcucuggcacucuuugcugccuuuuagccuggcuuucaguguuugcuggauucugaacaugaugcuuuggcaacagaaacagguaaaucgggcuuuguaugagcuuuuacuuuuauacuguuggucgcuggguucagucuuugcuguaguuggagguaccaagucuucgguuucuuuucaguuuuuguuguuguuguuguuuuuguuuguguaugugugucggugggugugcaugcaugcauuuuuugugcaugugaagacucuggguugagucaucuuucuccaucuuauacauugaggcagugucccucagucaaaucaagugugugugugugugugugugugugugugugugugugugucuagucuggcuagcuggcuuguucuggcaucuccugucacugucuccugaggcuagaacaggaagggugccacacccaucuggcauuuguguggguuuuuggggauccaaaccuuacauuugagcaacaagcacuuuagcugccgaacugucucucugucccauguucuuuauggguugucuguuaguaagauguuggccugguuucgcucuuaugacugcccuugguuugacguuuacuuuuucuguuaucaucauagcuauacugcuguaggucuggcuucugcuugcucaguaaguugacauccguuguuuuuucaguguuuugcacuaugugucuuugccaguaaaguguauuuauuucaaagagacaacaaccgaagcaucuuguuuuaaaacccaaucugcgaaucugcauauuuuaauuggaaagugaagaacauuuacauuuuggauauuauugagagaaguuuuguaauucuguuaucucacuguuuuucuguuuggacucuugcucaugucuucuccacuucuuguuguucuccuccuccuccuccuccucuguguuaucagcugggguuugcugguuuacagcccuggcccugugggcuccuucuuuguccuugguucaccucuuguuccugcuaugcaguuucuuuccuguguucucuggguagagacuuucuuccuuuucuguguuuaggauuccucuaacucucuuuuguaauaacuguauccuugaugcuugagcaacaaaguaacaguuuuuucgggagaaaaauagaguugccuaggcaaagacuggugagccaaaguccauauaacaugcaguuagauuuaugucaagguuuucaucggaguauaauuguacuuggcuauaucaauuaaacuuuucauggacacuauccuuuagguacaauuguaagguauuauaaacaaauaacauucuguagguauagucaucucuccuuugcacuuggaacaucuaaguaccauagguagggcaaguacuuuaaauuaccagcuuacugaugaagacccaggagugggggaguugggccauaugcucacauuccuaaguuuguggcacagcagagccaacgcuguaguccaggucuuugcuugccuugaguaacaguucauuucuucacuaacacgaugcucccagaguccagcgggugagcguucuuucaguuuguagucuccaguacagcagcacguucugucccagccguucccugcauuuacaucugccaaggacccuuccuaguuuccuggaugcuuauuaaacaaugggcagaguaaaauaacuuugagaaugagugcuaucuaagauugucaacuuuuauauuauucacucaccaguccuugcucaggcagcucugguaauuuuuuucagugaauauaugcuacccaucauuaaaagacacauucaaugcguguaauugcagaaacuugagaggguguuagguuucugaguugggaugaaaauguucuaaagccuuuuaagcuuagauuaauuauauguaaaguuguucacauuuauuuuaaaagucuuugguuauuuaugugagauguuuccaagaguaaaaugauuuacgaagccuguauaugcgcucuuggucauggaugcucuugucuuucuuucagaucuuguugaagcccugaagccagaguauguggccccucuggugcuuuggcuuugccaugagagcugugaggaaaaugguggccuauuugagguauuuugaaacuuuguugcuguccuaaagcauuguuucucuaaauuuuaaacauugugccucagugugucccacaugcuuacauuuggaaagucuaccaguuguaucacuugacuuguacguuuuuguauaaguuaauauggaacaaguguuaaaccagggaaggagguauacacuguuaucccagcacucugcaggcggggaacaggaugggaguuugggucuacuccugcuacacagcacagcuguguuuuaaacaaauguagagcuguaucuuuuuuuuuuuuuuuuuuuuuuuuugguagaaggugacaucauuacaaauguuuuccuguaguugugcauuuuuaauacuuuccccuaaguacaauguuggcugauuuguuguguuuaguaaaauauagaaaguccuauugauuuaauaagcugagcgauagagcagauguuuagagucagcuagaccggaaugugaauguuuggucugcacuugcuucuugaagggugacuguauugaauguuuggucugaacucgauguccugcagggugacugugaauuaacgcccagagcuuuaguuuucuugagucuuugugacaacuacaggucauuuaaaacccuugacucuggagccuaaugguuccuuuuggcaacuuuaauuauaaauauaguagauacuaugcuugacuugugacagaucaauaaauccagcuuuuuuauuuuaaauucagcagagagcguuuguucucccuauugggaaccuuuugaugucuacuguaaagcaaagguacacacaguuccaccaugugcuggagucauuuguacacuagggauugaauuuaaggccuugggccaccaccucagcuaauuuacauauuuuugcauauccauuuguguuugaucuuuuucuuuuagccuaaauuguuguauauuagacacuaccccaguuuugaaauucugucaauaaugaaccuauuguauguagacuauaacauucaaaauauuucuuagcaaaaucccuccuucagagugaaguaauauguuauuagcuaauuugauuugaauuaaaagcugauuaauaacuaaaggaaaacagguuucuauauauuugagcaaagcuaugggccuccaccuuucuaaucagaccaacugagugugaguuauagaaauuagcugcagaaagaacuuugcacccauaauuuuacagaagagaaaaaaauguaauaauauugagucacuuagaguuugaaauuuggucugaccucuuuuuacccaguuaggaaccaaauauuacuuauuucuuucuaguuauauuauuaaccucacaaacuaauguaucaucuuugugggauuuuuuuuuuuuuuuuuuuuuuuuucgaggcaggguuucucuguauaguccuggcuguccuggaacucacucuguagaccaggcuggccucgaacucaaaaauccgccugccucugccucccgagugcugggauuaaaggugugcaccaccacugccuggcuuguggaaaucuuaaauacacaggaaugugaauaggagaaaauaaaagacacacauuacuauccagagaaguacuauucauguuuuuaaaaaaaugucgucuuccaguuuauuauuagguguggauuuuacauagauucuuucuuuagauggaccuuuuauacauccucaucuccacugccacacagcuaagcucaugcauauguauaaagucuuauguuguuauuuuuuuuuauugucuuguggacuuuaaaaaaaaaauuaauguauguauauucugcugcauauacaucuacaggccagaagagggcaucagauucucuuacagaugguugugagccaccaugauugcugagaauugaacucagaaccucuggaagagcagcuagugcuuuuaaccagugaaccauaaguaugcuuugcaaaguucugauggauuucuggaguuguuagugguaguugcagauuaguccggcuggugcaguugcuuuggcccaugagaagaguuuguaguuuguuacuuugcccacgugguuaaaggugaugccguuagcagguagauagcuggaggaacaucucagucaggugaugugguccaagguuggagaggccgacaccuugaucaccuuccagagaacuaaacggaaaccagaggaaaagcuuggaaagauuuuccugagauggaagucagggaaugaaauacacuuugcaaggauagcaagucaggucaagugggagcaaacaaagagccagccgcucugagaagggccacucacaguguuugcugaggugggcagggaaacuggguucugcccagaaugagccuuggguaggaagacugccccgucucuuccagcuagcaaaggaagaaguaaccacauuguauuauggcggcucugacuuuguagucaguuuagugguucuguguggucccuaauauaggauguaugccuuagauacaggaaauagcuuaggguaaagcuuugcaucggucauaaagggggccugugcugguuuguuuuuauguaaccagugacaaguaguuugaggauugcucauuggaaggccagugcuaggaaguuuucagcuggcuucaugagaauuugcuuccuuuuucaauuccccuuugccuuuuuguguggucacagccacagcugauuaacccaccauuaauuggauauaguaaagcauagugaagcagaguaaaggcagacguugaugagacgucauauuguugaaccuagagccacuauggugucugcuauggugaguuucuucuguuguguacgugaaauuccagcaaggucuggcuaauagcguauaagaaggaugaauuucuuuaaucagauacugucuaucccuuuuaaggcuugcuugaaggauuucuacaauacugcagaaagaaaaugcauuaucuuuuccuuugaaaauuagagugugguccuuucucuugucucagccccgugaagccccacggcuuugccugcugcaggcuucugcuuugaugccaucaacaucggcaaggcggggagccaggggguuugcguggagcuuuuaaugcgucauucgcgucagcuagcguccuaguacuccucauaacuaagacguucucauaaugauuuacacuagaugauaugucuuuuuccuucccuuuacuagguuggagcaggauggauuggaaaauguaagucuguuggguuuuggauugugauggacuuuuuccuuuuguagcccgucuagccauuagagauggauaagggucuugucaaaugucuaaucacuugcauacuuaggcagacuugacuacuugguccaacaaaagguacuacagcacggguauuauucugcgggccucuuguacuuuuaaggaccuaugugaucccuauaguuugcacuugguuugucuuccucucuucagacacugugcuuucuguuuuguugacuucuaucccccaauggcucuggcuucccaagugcuucuuguucuuucaucagaccagugagugggagagagaacugccugagagaugggaggagcuuguucuagauggacaggcagcuucuccaguucucucauguaauucucuucuuuuuagacuguaagaggucaggagagagagagagagagagagagggagagagagagagagagagagagacagagagagagagagagagaauaugaacacacacacacacacacacacacacacacacacacacacaggggcugcagaugagcugugggaaucucccaccaccccaauagugaauuaauuuggcuucauuccuuggauauuuccucucuuaaaccuucugagcuucaaauaugguaguugcccuauaacaugaaaaacugugaaaacuucaggagcucagccgaguucucuguuguaucauaguuaaucauagaauuaauuggauuguuugaagacugauaucgcuggaggauagugguacacacauuguauaugauagaugcuucaaugacuccagucuaguuaaacacaaagcaacuuguauuucucaacuugagugucuuaaugaugccuauuuaaaauaucaagauacguguugcaguaacagcuacacauagacacuuuuacaauaggaaaaaucuagaaacaggcaucuuuuucauaucuuuaagaugucuuaaauugaauggucaccaauguuuugccaucauguuuaaauguuauuacuauguaguuauuccuauggauguuuacaaaagaaaacaguguuaacucucuaagagaacucaagagcagcaguacuuguugugccccugagugguucugguggggcugugggaauggaggacgagcugagaaugguggccaugguguacaggguucgugacagaggucuguagucucugcuugcugucacuuccagcucucaggucacagcggcagagcuuuguccugccagucugcaucuguaaccggagagggaagcaccucugugagugaucagugguuguaugcggagccuuuggcaggaccacaggccuuuagggucagcaagagacucugcucucaguaguucccgacagaguuagggaaguucucucuugagcuucacaugucuuguguacaguuuauuuuaaaucugauuuaguucugugccacuuaacuuggugaggguuacuuacccuggggaguggugggucucacuuccgcacuuucacccauuucugucugacguuguguuccuguucucuucccucggccuuuaccugcagacuuuucucuacaaacugacgugucugcuaacgggccuuuuagagacaaauguauuccuuucucugugauuuucccuuagcuugaagaugggcucuuaagcaucuuauguugcgucuuuaagguaugagcucagucucacgucuucuuuccaugacuagugcgcugggagaggacccugggcgccaucgucagaaagcggaaucagcccaugacucccgaggcagugagggacaacugggagaagaucugugacuucagcaaugccagcaagccgcagaccauucaagguagagcccugagccacuugguccuaaucagggagccaaggugacagacaggcugucuucuugcacaguuccaucuguuucuacuauggugagggugacacaugguguugggaacauaguuccuguuguaguaaguauuuauucuuagucacggguguuuaccccaccuuugauuauucaguucccugagaaaagacacacaacuuuuacauuuauaauaagccuuuaaugcacuggagcugggcagauaucaacccucuaagcuacuauaccuucuucucugccaguaaccccaaguuauaacuugucauauuucaucugagccgaucuuaauuccacuuggccagcacucauggccacguuuucaagacucaccuaccccauggcaucuucucccucugccuucucuccucucuccuccugguccuccucagaccccaaguccuggaauugaaaccccaccugccucucuucugccuagcuauaggcugucagcaucuuuauuaaaacaauaauuuuacauuaagaagcaagguuacauggcauuaccuuuuauaugagagaggauucucuugccccugagggcaaccagagccaguauuuaccauuacaauacauagcaacaaaccaaaccucaucagccaggacuccuccuacugaagacaguguuguugcucagccaguuuguugagugugucuuaauccuguguguuugguuggugugggugguggguggauggcugagggugugugcucauuugugcuacauguaccuucuccccaaaugcugguugguuucagagucuuacuuucuagccuuaugcucuuuuuauuuuacauuuucuuuuaauuguguguguguuuauuuaugugugcuuaugcguggguauguaccugugagugaagauuuauguggaguucagaagaggacauccuguaucguggugcuggaguuacagguugugaacucccuagggugggugcuagggacagaacucaggcccuuguaagagcagucugcacgcuuaaccucugagccaucucuccggucccuacccacauucucuuaaucugacgcaguuuuugcugcuguccuaaaagugcccucaucucucauuuaguuaaagaugugcauugauucagcacauugcuuuugcuggucucucuucugccuuccucccccuuugucaccuucccauuauuuuaggaauucuuuagaaaaauucagacucugccccccccccccccccccccccgccccaaaugaucagcaagauauugccagagacucugggcuguguuguuuaucuguuagcugaacuccuaccaugcagacacccagggauaacugcuucuuacugcucuuguuuuggauguacagcuuauuaauugaauguuaaguucuuuugaugcagaggcucuuucauguguauuuauuuuuugugaugcugaggguggaacucaggaccgugggcaugcugggaaagcucuguacacacagcacagcccgguuuauguggcauccuuuuaaaaauacaguguuuuaaauuaauucuuugaaaaugcuguagauguauguaauguauugugauaguauucacuacaccccuucaucuggcugcucccagaccaucuucuguucucuuucccuucccuagccucaacuucacauccucuugguuuuuaaaugacccacguauguuagggagccgggcagugaggcuguccacuggggugggaggcucggaagugugcuuagcucuugucuagcauauugcagcuuuccuaacucagaucuuacaguaaagcuugaucuucucuucucuuuuuaaucguagaaucaacaggugguauagucgaaguuuuacauaagguagauucagaaggaaucucaccaaaccguaccagucacgcggcaccugcagccacgucaggauucguaaguagaagugccugcagcucaccuuucuacugucccuccuucccucccuccuucucucuuucucuccaccccuguagcuuuucuuuuggagguagucauucuguaguuuaucguggagaaaaucagugguguguguucagaaucuggugguggcgcacgccuuuaaucccagcacuugggaggcagaggcaggcagauuucugaguucaaggccagccuggucuacagagugaguuccaggacagccagggcuacacagagaaacccugucucgaaacaaaccaacaagcaaagaaaacaaacaaacaaacaaagauugucuuuggaauaggcucaguugaccuaaggaauucaugaugcucacgugagcauguagcuugaagucagcccugcagcuguccagauaacucuauucaucuuagcaacuuuuccucugagauuuuucugggcaguaccauguucugugcuuugauggaggacugucuugcaaggagaggacgguuuuggguauuguuucuacagcucuccuuagugugcgagugugggagcagaagguaccagcucagcuucugcuguuggcauugguaauagauacagaagcuggaagcguucucuguuuucaggaguguaguuuuacauguaaguuuugcuagucuuucuuugggguuaugaugaaucaagguaguugcuagguugauguguuggcuagcccacacccuccuugcuauuugaaaaguaagccagggggauacugggugggagagggagaagaaagcuauuaccucugcuguugcugcugaguaggaccugaggugacgagcugucuaguguuucugugugcuguugcugucaccuucucugucucuucaugacucacuuuaaaugcuuuugaaauagauugaauuuuuagacaaauuuggauggggguuggcaccagugcccggugggcagucugcuacagguuccuggucacguuccccuuucuccugccaaccacagagcauggccucucugcugaaauggaauuuaaacaauuccaaaacauuuaaacaaauuguucuuaacuuauuaauuaaaagauaaaugggugauuuauugugaacuauauagauaggcugucgauagaaugaacaaacagaagcugaacaugaacuauaacuucguuuuguuguuuuucuuugguuugacaagugucuuucuucuuugccaccaguaaccuuccuucaguaacaucuuuucuaaguuuuugggaaaagguguuuauuuuaaugguucauuuccuuuuuuccuuuugcccaccagaccuuuugaggaaaagcauugauaacuauuagaaaaugcuggugugguuaccagucagcagccugucagugcgggaggaacaguaacaggagggcucuagcccugugacaugugucagcguacuguuagcuggcagugacguagguuaggauauguggaucuaaucuguagauaucuuuauuuuaauaaugcaugcauacauacauuuaucuuuauuuuauaauaucuagguauguauuuauauguauauuucucucuuuuuagccuauagguucuuugcauauauauuaugguuuccaguuuaguauuuuuaugggauucuugaguaugugaaugagugggucucugugucuacaucuguuucuugggccuguuccuucugucugucuguucuguccuauuuugaucuguuaguuuguguuguuuuuaucauauuacacacacacaaacacacacacacacacacacacacacacgcacucacacacgcacacacacacacacgaacgcacacacacgcacacacacgcacacacacacgcacgcgcacacacacacacacacacgcacucacacacgcacacacacacacacacgaacgcacacacacacgcacucacacacgcacacacacacacacacacucacacacgcacacacacacacacacacacacacgaacgcacacacacacgcacacacacgcacacacacacucacacacgcacacacacgcacacacacucacacacgcacacauuuacuuuauuauuccuuagaauccuguuuguuuucuaaugagagacaggaaugguguggagccaaaugggaggggagguagggaggaacugagagugaaaacuguaaucacaauauauuaucugaggaaaaaaaaaaucaaucuucaauaaaaggggaaaaaacgaaguguaguagacaagugaaaaauaauuuauuacauacccccuuggcuccccugguauuuugugaccuagggaucugucaaugucagaagucugagaauauuguuagcuuacaguuaugauuugaaguaggggccagcagaugcugcuguggaggguaauaaucuuccugguuuucucuuagguuggugcuguuggccauaaacuuccuucauuuucuucuucguauacggagcugcagaguauuauguaugcccucggagugggagcgucagucaaaaauccaaaggauuugaaguuuguuuaugaaggcagugcugacuucuccuguuugcccaccuucggagucauugucgcucagaaguccaugaugaauggagggcuggcagagguuccugggcugucauucaacuuugcaaaggugugccuaccaggagcauuguuugguccuguuuauuuaaauguuguugagaaacgucacauccccuauguacaacuacauacauaugauuuuuacauaacaugaauauacauugacuauggugguuggcuuaggaaucaugauuuaguauauauguauauuuuuugauuucuuuuuucaugaauaaaagaggggagaguuaguuuaaaauuccaagaagaguguaccaaucgauaguccuguaauccugggauaaugcuguuaguucucucucuagcauaauuguaaguaacuagguuuaggcuucugcguacaggaagacugagucagugauucacaccauuccucaguuuaaaggccucaaacugcccaugcuggacacacauucccacauccaacuguggagcuguuggcaguuguuagcuguugggagaaggagagacaguuuucucuggguauagccugauaaauuaaccaggcuucuguugaagaccacacauccacguaugugggcaaagggucuuauugggcuuaaaguaaaaggacaugaaguuggguggguagggagugagaggagagucugggaggggcuggggugcagggauggacaugaucagaacucauuguaugaaaugcucaaaaacuaaagaaaaaucuuauggggcaaaaacagagucuaagcugaaauccuuguaauugccauaaggaugccuucucacaacagccacgagcagaucgcuggaucagagcucugggcagauuucuaucuaguugaacugauaacccacugccaaugccucuccuauugcaguagaugggaacucauuuucuuagacuauugguaauauuggaagaaagggccagaaaccugggcuggaguuuucugaucucucucccauguuauaugcugaauaagauguuuacauucugugaccaggagugucuuaggguucuauuguugugaagagauaccacaaccacagugacucuuauaguagccuuauaaacgcuuauaaacuggcugacaguuucagagguuuagucccuuaucaucauggcaggaagcauggcagcgugcaggcagacauggugcuggaggagcugagaguuccacaucuugauccuaaggcagcagagagagacugugccacacugggcauggcuugagcauacaaggccuuagccuguccccacagugacaacauuuccuccaacagaacuacaccuccaaauagugccauuuccuaugggccacacaaacacaugaagcauauggggcccaugccuaucaaaccaccauaagacgugacagccgucuggaaaucuguuucucaguuucccuggcguagggugucaggcagcgugguacagugagggaggcacuccuucauuuguuccccucuucucugccuucugggguugcaggaagauggaaagcugcccugcuauguagggugggggcuuggccuggguaugcucaggagugccugcaugugcugcugcgccacccugagcucaggguagcuguuuccucggugugcuugguuucuacgcuuugagacaugcacgaagggaauguugacauucguguuuauggauugugacauuaauggauauauuacaagcauuucuaugaccuuggauauacuuauaagguuuauccuuguauuuuauuugagucaucucuucguuugugugucuugaaguuaccggcccaggcccauugguucauuuguauugagcagacacuuccugaaugcucaguauguccuaggcauuauuauaagcacuuggaacagagccuaauugagugauccaauaaggaucccugggucuucuuuccuccaaaagaccuguuugucuuugugcuggugugcuaauuauuucuauauugcaugauuaagcaaaaacuacacugggcuaggucacacaggaaguauggguagugaaauguaucagugcuuaguaguacccacagguagaaaccagugcaagaaaguuugcuaauaaaauuacauguguucuaacauaggcucuucacggggagcaguacuuggagcuguauaagccacuuccucgaucaggugagcuuaugggaauugcccaauacucugcuuuacuuuucuggucaaccugucagaccaucucauuguguuaaacugacuuagacccacccaacacuagaacacuagaacuuuccaucuguaaccuucaaguaaaugaguuaacuauuaugucuccuauuuuucuucuaucaacagaaaauuuugauuuaauacucucacauacgugccauuaugauuauaugucagauauggcuccugugauuguuuaucuugauuugcauaaagcaaacugaaagauacauuugucauuuuuuuuccuauuccauuugaagagaagaaaaccaaccuaucuaguacuuuuucuuuucucaguaguaauuuguuuauccauccuauccuaucuuucucuauccauucauccacccaugcauccauccauccauuuaugcuuucugagauaauaucucuuguagccuggaguggccuucaaccuuuucccuagcauggauaaucuugaauuucugauccuucuccucccacuuucugauuacugggauuaaggcuugacccacuacagcagauuuauguggcacugggaauggagccgaagggauguucaugguauugcaagaccgugugacugaacucuaucuccagauccacauuuuucuuuuaaaauauuaauuuaauucccccuuucaucucuccagucccaucaagcuacucucuuuugaacuucucccauguacccccacucggaaguugguagccuuuuuucuuugauuauugucacguacacacacacacacacacacacacacacacacaacucaccaagcuugguuuuguuguuuguguguauaugguuucagggcugaccacucuuacuggacaaccaguaaggggacucauucuugggagaggauaauucuccuccuucauagucaguaguugcuuauaguucuuugucuauggguggaacucuaucacuuuccuuccuucuguguuaaagcgucaauugauagugcuguugcucuggucuuacgcauucagucauagggaggagagacuauuucauaggugacuucuugaaauucuggcucuuuccaucuuucucuuuccucuuucaugauguuccccugagccacagauggaggagcugugcguagauguuuccaugcggcuggguuuucaugaucuuuugaucuugugauguacauguauuuguucaggcugggauccccaccauucauugacuuggccguugccccaguugugguuuucuguaaugauuucccuuugcuucugugaagaggggugaaagcuacacuugcccguggacaugaggagaggauugagaacauaguaagacauuaugcuggucuagcaaauggcagcaguaauuuucuaauguccacgaccucacuggcuucuggacgcugguuacauuuccaguaccaggaaggaguucccuuguguuguaugauccuuagucuuagcuguugguugcccuccaacugugagagcccucauuacaccuuaagcaugucuugccgugcuccuguuuccauggcuuauagguguugcaucuggguagaacuauguaauuacuucccuaguuugcauagucacagaagcuaggaugcaggaagcagacuuucagguuagauccauauaaaagcuuccgaauccuggguccuaaguguguggugucuuuaucaauaggguuucaccuuuaacaccugaugggcaaccaagggcuacaucuguaaucuguauuguuuugggagacucuuaaacuauccugacucaccauucuuaugccuaguauuggaguuuuugcuaguuuaugauucuugugggaagcauugucagccuaaguaacuuaacuuccuuaaaaaaaaguguguguguguguguguguguguguauguauguacacaaauaagauguacaaacaucuucacaaauaagaugguuaaaaacaaaggaggaucugguaucuugucaaauguaauguagaggucagcaaguagcuaggcuugcaccuuagguuuuucucaaaccuugauauuuuacugaaauguugagcuuuguaacuguuuuuaaaguguaauagauuuguuucgauauauugcagaauacauuucuggucuguuuagucugagauaauacccauuuuguggcgacuauaggauacuuaccauuuccauggcauuagaugcuuauuuuucuuuaaccuggcuguguguuggaauuaucugagcgauuauauuaccugcuauuuuagugaaauauaaauucuguacucaagcucuagaucuugugugucuguguguguguguguuauggugucauuucguagauguccuugcauguuucauuuguacccagccuaguguguucauuuggggaaccaucauaaaguaaguagauguguauuagauauuccccuuagggaauugauaauaugacaagagaguagguauauacuccaaaugauuacaauuauacacggauaugaacaggaagucaaggauaauacuuuucuugauuucuuuuauuucuuuagccucaaguuguauuucuugucaguucuuugucuucagucaugucuauguguuuguuaguuuuaaaauuacucuuagguaauaugcauacugaaaauugaagauccaagucaggcaaggugguaccucuuuaauccucacacucuggagguggaggcuuucagggaaacugaaagcaguuguugcguuucauuaaggaccaguuggggaguguaguaagauuugaaaguacagaaagacagagacaagaaggguugccacuggcccuugaacuucagguaaggaaguucagacuccauuccgaagguagcaggggcuuuacagaggacucaucaacagacugguuuugggaagcaucaccccgucggccuuugugacacuuuuaucauugcccaccucccaccgguagacacuuaggaagucguuugguucucugugaaucuggagucgucucuuucuguucauggaguucccacucuugcuggccuuguuucuuccucaccuaggcguccucugcccccauuccuguuccacuuggggcuuucuccucucugcagccagagugcugaaucugagaugcaaauucguuugcuguuuuccuguuaaauuccuaaauagcuuuccuuggacuuugggauucauuuaaaaaguccugucucuguaggucaaguaucaacagggaugugccauaugugaaucaaggcugacacucauguuguguggcuugggggcaggguguuaaucccaguugugucgaaaaaagagaaagacagguuuuaaaaacuuaauguuuucugacaguuuuauacuuauauauaacacuuccuggucacucucccuccccuuucuuccuacccuucccaacugccuaugugucccacaaggcuccaccaguguguuugcccuuguguuggcuuuuguuuuuuucacacacagaguuuacccaguuaaaugaggaggaauggggaaaggggacuggugcuugcccagcaucaagauagcaauuagaccuucuaagaggaggcacuauauaaguuuuucaaauuuuuguaacagaaauauucuuguuucaaaauuuagcaauuuaaguguucuauauauacaauuucuuuuuuuaguaguuaggggcaaauauuuaaaacuauaauuuuuuaagcuuugcugaaucaaguggaaaaccugauaaauucuguggugucuuaacauaauuauuuaucuuacuucaauuuuaggagaauuaaaaugugaagcaguuauugcugacauccuggauaaaggcucuggcguagugauuguuauggacgguaaauuuuuaauucuuauauaauguuagauugguagacuuuucauguaacauacuucaccacagagauccauucagaaguuuguauucauuuuauaguuuauaagaaggcaaaguaagcaguuuaaaguuucauggguucuuuaagaaaaauaagggaggaggggcaaucgauugggcuaagaggcuaggugggacaguaaguaggugaaacugcuuaggcccaugugugaggcacgugaccuugggcacgucccgggaagaguuccgcccgagcagccgggcgguguuccugaugcuccucucuguguuagcuaucuggaacuugauuauucacuuugcaguugggcuucuggacuguugacuuaucauaugguuugaacacaguagccacauuuuaccugcaguacgaaagggcuuauaguaguuuauaacaguaggaaaaaagcguguagacgcuucuaguaaguagugaguuaacagagugcuaguuguuaaacauaagcuggugacacaguacaaagcguaagcuuaaggagaaaagaagugcagguguugaguuugcuacugaggacagugcugguucuguggugaguccuggagaccaugcugguccuccuggacggaucgacggaccgugcggcuguagcccaguaaacacaguguaaguugaaauacuguugauacaaaaaugcauuaaaagucauggauugguugcacgugauaauuaucucagcacucggaggaaccuuuuuguguuaggaacucuucuuuucagcgauagaguggugaacaaagugggcaggauggcauucucugggcgccuccuaccccgguggcucuucuguccccaucccuggucacuggcucuuuccguccaugcucuuccuuggugcguugacagcacuucagagucugagugugguagcucagauuuuccagaggaauugcuugaaauguuuguggcacauaaaaaucugauauaggugguaguugggggauuuaagagguuaaaaaaacccauuguucacaguggagggauggggacccucuuguugccuucagagacuggagacaaacagugcaguagugcugugcgaauccuaucucacugcagugcccucagcucugccugcauuuaauuauugaaaccauuaaaggaauuggcaagccugucuucauuaccuaggcagagcuucguguaauaauuaauuuuucuccuuugcuucuuuuguagucuauucuuauucugggaaggaacuuauaugcuauaaucaguucucugucuuuguuguuggcucugggggcuuugguggaaaacggacaucagaaaaacucaaaguaagauguuuuaaagauauuauauuuguauaucuuuauggggcauguuauagcagcucauauaugugcucaguauauaaugcuuauauaauauaggcccuugcauauccucacacauggacuguugguauguacugggaauuucagacucuugguguggaucauuugacuuguaccugcucugcugaccuggccacgcgagcugguuugugaccauggaagaugacgacuuccaucaucucuuuccugucucagugugugugugugugugugugugugugugugugugugugugugugugugugcaggugucugaggcagacagaagcggcagacuccuccuggucauggugggugcuggaaacggaacguuaguccccugcaagaacaguacauaugcucucugcugagcugucucuccagcaccacccucuuuugauuuucuuuuuuaagauuuaauucuauagagcagguuaacuucagacuugcagccauucuccugccucagcuucccgggaaugagcggccacacccagcauucuucauucuucuauaagauggacuuacuaguugaugaaugacuuuucuuuucuuuuuuuucuuuuuuuuuuuugguuuuuuuuuuuuuuguuguuuuuuugagacaggguuucucuguguagcccuggcuguccuggaacucacucuguagaccaggcuggccucgaacucagaaauccgccugccucugccucccgagugcugggauuaaaggcgcgcgccaccacaccuggcaaugauaaaugaguuuucuauggugauguccuucccuucccuccccaccccuccacucucccgcuuacuguagaagcagcuucuccccuuguggccuuuuaagguuaggguuuugggauuugugggauaaguuugauaauaucuuagcuuggcauuucauaaugaaaaauuaucaacacuauaauuagaaaagcugaauuuauuguauaaaauuuauauaauagugacaauauuuuauuucuauagacuaaaacauugaauuauagcuaacauugaaaauauagcuauuugaauacaauauaguguaacuccauuuacaggagaaucugaugucucuggucuucacgugugccuguguuccugugugcucccccauaacuaauaauaaaaauugaacuuuaaaaacuugguaaacuggauuaguuugcuaacauggcaaauuaagauauaaaaguuguuuuauucucagaguugucaucaucccuuuauauaggaaaacuaucuuuuguccucugugaccugagaaugguucugauaauguuucuuauagagaaaagaauaauuucagggaaauuauaauuuauaaaaagcuagaaguuaugaaauuuuaaaugucauauucgucaguacauaaaacguuaaaaaaacucucuuuaucuaguuuguguaguuuauugacacaugacuguuuauuggaugucacuuuugcaagagaaucacauauaucuaaguugacccacagugccuuuugauuucaggcagcuguagcuguaccaaaucgaccuccagaugcuguacugagagaugccaccucacugaaucaggugagagggguaguccaccugccgaugauacugaugucaaaaucugcacauccuauacuuuuguguguuuucaguggaguaacucaggcaucuuauuccaagaaaugaaaaauuaaacaccaggcuuugauuuguagaguaaguucucggaggagggucauccuuuagagugaaaugcagaagggcuugcaaguaaugaucagcuuugcagaaagguggucuauggaugcucccuccucugggauaaagggcuucaguuugucugggaagagguugagagguaaugauugaguguaggugaggagagaggcgaggugcgugagaggcgaagccagauuuaugcuggcgaguaauggaagacauugugcaugaacagauccguaccaaaaguggaaaacuugggccauuagcgcaugaacuucuugcuggguuuuauauguguaucaguaacuuuuagucaauaagcaaauggcauuguuuuguauuagcccuacaaaggucacuucucagauccgcuguuuaaauguccauaggagaguuuucucauuggcagcugcuugaauguacaaguaaaacaaauguuucauggaaaauaaagauuucuaugcagugauccauggaaaagaccaaacaguaaacagcuuucaaugccaggaguuguguuugagaaugagaaacaaacuagucucaccagauacaugucuaaugcuaguuauauuguuaggauuucaguuacuauuaaguagguuguacuuuuuguuaaaauauaauuguuuauauuuuacaaaguguuuaugugcuaaauuaaaaacaguuaugaccucaaaaccaggucuucuuucggggggacccuuuuagauuuaggucauaucuuccuuggggauaaaaaguugaaacugucacagaugcuugguaggacuaucugggucacuuucauaacuaucagaagaugauaauuuucaauaaguagcccugggauggauccugguuaaauuuuuggauuuucuuuuuuuuuucuuuuuugguuuuucgagacaggguuucucuuuauauauagcucuggcugucuuggagcucacuuuguagaccaggcuggccucgaauucagaaauccgccugccucugccucccgagugcugggaauaaaggcgugcgccaccacgcccggcuaaacuuuuggauuuucaagaugaagaaaauaaucuccagguccugaaagacaauggugaaguaacuuuccacagaagauaauuagauaggcgucggauuccuccagagcaggaaagaaauggggcaccauucucaagaaauagauguuuguccuucuaaaagaacaucccacauggaggagcuucaccuaccuaagaggugacaaaggaacacugauaagaggcuggaaguagccaaguauaaaccgaugcccaggccagagacuggaggggcagaggugacacccagugucagauucugagaaaguacaagcgaugcgucccaguaggggcuaagaaaggggugcagauaggaggugaaagguagaacggaagacuaagcacaagcuagggauaagcugagaaacugaggaaggaaaagaaaagugaaaaagaaauugaagugggcuggagagauggcucagggguuaagagcacuggcugcucuccagaggucccagauuuaauucccagcaccucuauauauggcagcucacagcugccuguaacuccaguaccagggcauccaauacaccuucuucuggccuuugugggccauacauacagccaaaguacucacagacauacaauaaaaagaaauaaaucuaagaaaaaaggaaagcgaaagcaagggccagagcugaaggagagaguauuaggagaagacaggcgcuggcuggagagcucugucauccgcagcgagccaacaccgagggccugcuucuccgugcgcgccguucgugcagcugauggcuugccuuccaggagugcuaguuuggagcugggacguucuuuccccguagccaagcuccguuugcuacccccucauagaggaugucuuagcagaacuuagggaagugcuuuacuuugaaaaggagguuuagcuuucuguaucuugcaagaccucaaauuccuacuuggagccuuuaguuuuccacgcagcucuuacaggauauuuuuguuugauccuguucuccaagaggacuuuguugggcuucugucugcagucauguguguuuccaguccuguguguuuccaggccuguguguggagcaggacuggaaaucuaaucaaguacuaaucaaagacuuuauugauuuacauuguugcuaaagucuuguuaaaagcuuuagaaauugcgaauguucacugaggcaauacucaugaguuuuauaucauuuaauuucuccuguuguucuuugaaagugagcccucuuagccucuuuauuuauuuuuccucaaugagaaacugaagguucuccuuggugaggaaacuugugcgucacugauagggcuggguguggacccaggccccaucacagcccauuaugcuguguuugucugacaauuucccucuguggcccggauaugugucuuuuuuucauuguauacaugauagcucauauuuuucuaguguuuaccguuuguauacugcuuuugaaaaauagcaauuuaauuuucuaacacacauaauuuuguauuuagaagaacauacuacaggaaggaauacugagccauugagaggggaacacuuucucagaaugagacuuguuaaggagaagagcuugaggcagaccggacacugacuguaacacgcacgcucugccugcugaaguucuuccccuugcccgggagagcacucuaguuugaaaacugcacaguuuaaaugcaggaaaggaugaaggcuucccuuguuguuaccugcauuuuucugcuaauccugccugaccuauguaaaucaguagugugaaaaucugagcuuugcaccugcggagucagacuggcgggcuauuugguucacuuuccugccugggcacauuccagauuaaguguggcagagaggugaaaguuugugagaagucuuugauguuuaucugccaguauuauagacuucaaauuaaaaaaaaaaaaauaaggaaauuggcauagauuuugauuggccaaacaagacuuuaaaccuuuaccuauucacauagaguuucccuuaggcagugguguguaauucuugccuucuuuucuuauuaccuuauuccucccucuacugauuucagcaaaagaccuuauuaaagcuucagggaauugcagguaaucuuguuuuuuuaaaaugaguugucuuuuagaccacagccugggguuguguacaguguguguuuuaaucgguagcuggccaugcugccuguccugcacuugaugcuuccucggcaaacacugaggcccgugcgcuuccucugcaggccgcgcuguaccgccucagcggagacuggaauccucuacacauugacccggacuuugcgagcguugccggugaguuguaagugacgcgagucacugaaaaaccuuagcucaguuacucacucuccauuuaaagaaaggcuuccucaggacuggugauuugaauagcauuuaaaagauagcucucauauuuauucagaggcuauagaaaaguaggaaguauucagaaaacgcuauauggcucuggggaagcagggugugcgcaucaugaagaggucauuagggaggaacacaacuugaaaggcuagaaaggugaugcacucacccacaugguuuguuucaaacaaaaugaaauggaauaauucuuuguguuccuagccuucaugguuuucaaaaauaauuuuugcugguuuugcuuuaauuuuucccuaggaaguacuauuuacagaacuuuuuuuugagguacagucucaauauauagccauggcuagccuggaacuugcuauguaggccaggcuggccuugaacuuagggaguuccaccuaccucugugaccuugguguugugauaaaugguggugccauaucucuuggcauguucuguuucuuaauauauagcauaguucauaauucauucaauuacaguuuaaaagacauuaaaauauauguauguauacauauauauauauacauauauaucucacuuuucaucuauaaaaauuaucuaacuuuucuuagguuuugagaagcccauauuacauggacuauguaccuuuggauuuucugcaaggcauguuuuacagcaguuugcagauaaugauguaucaagauucaaggcgauuaagguauauaugugucuugcauauuuuugagggaugggcuuucucuauguagcacuggcugcccuggaauuuguucuguagaccagguuggccucaaacuucagagacacuccuggcucugucuccugagauuaaagguaugugucaccacccccgggccucagcauguguacauuugaagcucaacaucugccuuaacaaaaggggacaggaggcuccguuugaacucucagaacagcacugacuggacuuaguguuucuaguuuugugcugcugaguugauuucaagauuuuacugugugcucgcuuuguuaguaacaaaggaaaaugucuccaccuaauaaaaugucuccaccuaacaauauuuuugucuagaccaaaagauguauaccugaaagccaugucaaauagcuuaaaaauauuuauuaguuuauccacagugcaagagugaagaucuauuuucugaugccuggcccuuaauaacacucacuauuuucauuuaacacaauuauuuucuuuaauucaguaaucccuguauagauugacacagcgacauuaacgagccugcuuuaaaacuuugcucugcgcacucaccggggccuugagcccugauuaacuaguacuacuuugaguuuaaguuguucuggugacugccugagucacuaccucauaggauuaugguuugucucgagcaaaagcuucuugcugaugcggccuuuuccuuuucuuuuucccaaugcugaaaauugaacuuaggcuucguguaugcuaggcgagcucucugcuagggagcuauguuccuagcccugagucucuuguucugagagaaaagaacuagcuaugugugugugcacagggcucucaguguccgucccuuaugaauuuucuguauuuuugguaucuucuaugaagcuuaauauauuuaaaucucuaauauuuuccuuuuaugcugaccucagaaguuucccuuacaaguagaagagcuucuuuuaaaaacaucuuuaacgcaaaaacucuuacuauaauauuuuaauagguucguuuugccaaaccaguguauccaggacagacucuacaaacugagauguggaaggaaggaaacagaauucauuuucaaaccaagguaugaaucagaguuggauguaugugcuucgugaccgccucacacacaccaucauagagucugacguaugugcuuuggaaucuccucagcacacaccgacaguucguucucugcuagcguuuuugugguuaguaauaggacucuuugagagacgcuugggaggauuuuaaaguuaauggugacuuuucguugaaacagauuccacauguaccuuuuacauuuuauuucucucacuaauggaagaucgugcagcuucacuccagagaaucagaacagcaguuuaucuagucaacaggaaaggucuucuaaccaaaauuuugccaaguuauaggaacagcuauuugugugcuagagaacaguggaguuguagccuuuaguuuuuuuuuuuuuccuggacagaaaccaugugcucuugauaccacaaaaaucuauaaauuaacauuaauagccuaaugaauggcugacaagccaauaagcccaugugucgacuuaaguaacauugagggagaccuagugaugcuccggaaaagcacuaaagggacaucaacacuguucccuuaccagcagugugaagaacagccguguugucacagcccagcagcuaauagccuucuguugguuccucuguauuguguggugcaggcgugaguacuccaacaguggccuuaagcuuuuauuuauggagauucuguaaacacuguuguuugcaguagcaacuuucaauaacaagucuacgguugaaauguaagaaaaccuaggcgccuuagaaaguccugacauugguaaugacuugcugacggccacacagacagcuuuuuagcaggcacacaaacgcagcccuguguggcuccauagccccaaucucagggcuucuucuuaugcacuguuugguccucgaggaacugguaaguuggcagaauucugcucuaguauuaaugccuuccugcugcugcaacauuuucaugcauuagggauaccauuuguuuuauuuugcaaauuucuuccauguugaggccucaguauaaguucugucuuaucuucaggggcaaucucucggacuuuuuucuuuuuuaaauuuaaacagaaucuuagucuguagcccaggcuacccuguuagaccuugugauccuccugccucugccuucaauguggugguauugcacacacgcaccaccaaggccagcucuuguaggaccucagacucuauucauguucccacucacacacacccuggcuuccucuaaaaacgugcugcacuugaacucuuugcuucccggucaagucccagaugucugugcuggagccagggcacuagggauggggguuagggguggaacccuggguguugccgagguagcuaacgaccgcauaccccaagcuguacaguugagaauuaacaugcacagucagucaggcugggaaugcaguuuagugacagagcaucuguuguucccuaggcaccucgaaggaaggaaggcaggcaggcaggcaaacgagcaggaacuccaaaaguccuggaccacggcaccaugugcucuguuggaggguuuuauucccaugcaguccuggcaggagcagaacgugcaguuucugugaacuuaaagagcagagaaauaacgcccaaauguaaggcggucuuuccauuuuagaugacuggaaagugcucucuccucagagcacuugcuccuuccccaguaauuacagggcuauagcgacuccuaccuugacacucuccucuccacuguauuuuaggaaacauuuuaagcaaacauuucagaacucuaugcucaugugcuuacaaaaaaagcaauuugcucaaagugcauuuuguguuuucauuaaucgugccugugccuuucucuguauuuaauuuuuuuuuuuuuuaaagaaaaauuguugggaagguauuucccccuccuuucaaguaugaagagaaguaaguagucugggaaauuaguuaaaaucaaaguugcuaccuuaacuuuuagaaacuuacugucuauauuguaacuccuuuuuccuuuggagacagugucuuguuucagcacaguauguacagaaacgugccaucuuagucgaggcgggcccugaacuugcaguucgcuugcuuuggccuuucgggcacuaggauuacaagccuuggcuuccaguauucuuuuuaugugagaauaguccuuggaaugguaugaaaugcaggauuccggcugagagcuucuuuaauggcagacgugaaaggcugcuuagauauuuacuuccucuucuggaucuuaugugacuuggauccagaguuaggaccuuacaaacauucucaucuuuucuuagacaauuucagucuagauuaaugaaacaaauuuucucuauaugggacaucaugacacaccuucuacuauguacuaccuacaauagaccucuuacucuagcuccccucagaauacacucaugcuugggcaaagaaagugcucuuaaccguggaaccuucucucuagcuccuuuaauuaguguuuuggaagaugagaccugcucauaguuucuccuuuucuuuccucccuucuuuaaaggccauuaauugagucuguauccgggcuuaauaacaaucguauucacucagaaagucgcagagucuguuauuuugucauuuacaccacugcccuuuugcuucaccuggcuuucaguuuucuguuugcuugcucauuuuucauuucaaagagaagucuguuuccuuaaagugacucucauuucauaguggagcgguaaaucaggagagugaccuguuuguucucggcuccacuucuccuuagguccacgagacuggagauguugucauuucaaaugcguacguggaucucgugccugcaucuggaguuucaacccagacaccuucagagguaggcugcuuacccuggcacccagugacuucuguguagcuaaugccacuucaggauuguucgggcuacuucuuuuagcuaugaaaaggcucuugaagaaaugacacuaauuuaaaacuuacuggaaugaaaaauauuuucacaacuuaagaguuuuuaaaaucuuuucagaauauugggcuacuuuaagaggaaauaguugcuccuuucaauaagagugaguuagucauucagguuuaaugagaaaucuuuaaaaguauuuggaggaaaaaaagugaaaaguuaaaucacccauacauuuuucuuaagguuuguaugcagauaaacagcgugucucguuuauugaaauauuuauauucuaguaagguuaggcuuuugauaaaaguauuuguauucuauguccaaaauauuaauaauguuaagacuuucacacuccugaucuuuuuucauaaaccauguuauuucauaacuagaaagaaauuaauaucuuauaaaaauaaucuaagaucaaagccuaugacaucuuucagccagaaaauaauuaaaggcuucauggaguuuacucguguuucauaaacaaaggaugaaggccauagcuugauuacuugcucaauguuucugagaagugaauuagacaucaguuugugagugggguggucaggugcacucacccgguuaggcacucauguagguaugucuuccucaguugcuccucccccuuaccuuuuagacagggucccucacugagccuggggcuuaccguucagcuggacuagcuucccagagaggcccuggcacggagagcuugcugugcuggggagccagucugauucccagggcuggguuaugucauguauuaccacacuggcuuuuaacacagguguuugggaugcaaaucaggaccuugugguuacacaagaggcccuuuaccccuguaccuaaaacuauggucaacaauaacauuuucugguagaguaaacuggcucugggcaguaugauacagggaaagugugaaguaagcccgugugagcagaacagcucagcuggguauuugugagcagguuaaaaaucacuucuggggcauauuucgcuaauaaguucuuugugaaguuuucaaauacgauuuccucucucugucaggguggagagcuccagagugcucuuguguuuggggagauaggccgccgccucaagaguguuggccgugaggugguaaagaaagcgaaugcuguguuugaauggcauaucacgaaaggugggacuguugcagccaaguggaguaagugauguuugugacuuuauauuauucuauggugauuuuuaguggagauaaaguauguuuuauacccaauaauguagucccuuugaaagccagugaaucugaccuauauaguuuuguuguuguuguuuuucauaggucucaggacauucaaaagcaugcauuuuuuuccuuaaauuaaauaugucauuugucaauuucacacacacacacacacagugcauucuaauuguucauuuccaccccagccuguuaacgucuccuccuuccugccuacauuccauguaaguaaugugcuggcgcagauuucuuaaugaaaauguguauguuuggguuuuuauuugauagcuauuaagagaauauauuuagggcugaagauguacuacaugguaguguuggcguaauuguuuuauuauuuuauugcauucuuuuaucuuuacucucauuccaccuuaauccuucccaaauccgcaauacuagguuggagagaaacaagguuagaggggagagggcgcguagacuucuauaggauacuuccugcugacuaaauucaugggguuccuuggggcaagugcagugucauuguuagaauacccagcaaaccagcaauccaucaauagcaaauacaacagcaggggaggcaguguaaggggagcagccaccaccacaggcccucucgggucucucccauuuauacccucuugagacuccugagagcuggcaaaaaccaucacacaccccuagaacaugagacaguuauaguuaacaauugugaacaaaccaaagcagcccaugucccacaccugggauuuaaacaaaaacauguccauauaacuggguuuuaaaagaacccaaaacucgcacugcaugcuuuaugcuagguagaaggccuuggguuuaaucuguaucacuggaggaaaagugguagcuacguggguaccuugaaaaaucauacagguuuauuauucuuuacaaccaaacaauugccacacacaguuagagucaacaccuaaagccuguguaaaucauuuagaacuuuuggaaccaauuuucuauuucuucuucuuuaaaacguauuuaaguuugcuuuaauauaacauuugcuguuucuuuuaggcaccacauguuaauuauauaaaacaugguuuguauuaguguagagaggaaagcaacaauguaucugcuaaaaaauaaccgcagggaaucugcuggcuuuucuccuuguggggaaaauuuacacuugcaacaaguuagcugagaaaggagaagggaggcugaacugugagauguaagcaguccccagauuccagcgagccgagccucaugauuucugagcuagcucauagguuaacagagagcauagcaugguuuuugucgugucgugugucggucgucccccccccccccccccuuccauccuucucugaaggaaaucaacuuuccucucuuggagaaaguacauuagccuuugaguuauagagcacaggcuuacagaagggagugcugaggggaacgcaugcuccaggaguggcggagggcuaaguguaugcguccugaagcuggcaauggaaacucuaggggucguguggaggacaagcgguugaccuacacaagcaggccagucccacagugggauagaagugcuuaacaaccaacuaagauuucaucuugaagacagugugcuuacauuugaaaguuaccuguuguuaacacaagaaagcuaucuccauucuauuuuggaaucuuguuaauugcugccugucaucaguucuuuguccuugcccagcaaagcaaggggugacaguguucugaacccccugggucacaguaggcccaucuuugccugugcucggauaggcuuuaucugucagcuucauuugacucucagcugugcaauuguuuccaggucugguucuuguuuucacucuagucucuaugucacugagcuuccucacacuauuuggcugcaaugaaagcucuuuuggcccuaugcuuugauagaaggugucccuuuuggcagcccuguguugcauuccagugcuuauucuuauagaauggauauuuaaagacuaccuuagggaauaucuugucucuacuuuuaacccccacaagcaguuuuuaugauuuuuuugccgaaugcugaaguaccaaguauuaugugauuuauauuguuguaaguagccagcugugcucauaucaugguacaccagaaacaggauacaggggacggagauggggauacaggcugaguguggugucgcugucccugcgcacauuccaaccuaagaucccaggccaugccugucuuuuccuuucccucccugauggcuguggguagagugugugugcauacugggggaaucuuuuaaaucaaauuaaaucuaggucuagagagaaugcugauaaucaaaugagacacuguuggcauugauuauggggacagagagucauaggugugucuuaagucauagguuuaccacuucugaggccaaucccucaguuguuagguagcaacaggagcccuccuuucuuccugccagcggaaggggagaugugaagccuauggucaguacaagucagagggaguacaaggccuuuguacugcgcuuuugggaagggaggcaaucugccucaugcgucugucuucauaccucgggugcaguguugaguaauagcaguauucauaggugaggcuuccuuaugccagaggccgagcucacagcuguccucuuuuucaacagugaccguugugucauuuuauuuaguagauuggaauaaauugcuagaacugaacgucuggacacaagccgucauucccaagguucugugccguugguuaucucacacuuugaaacaauggccaucccugucccguuacuuuucuggggcucuuugacuggguugaaaaggugaacauggauaaagaagucugaguucccuugcuugucccgaugcucuugcugcacuuuggucauuucugguugcaugucucuuuuccucugaugugggcuuagcgcugagaaaggccugcacugugucugcuggcaguuagucaggucuguagcugaccuucagcaugcacaggcucaggcuguacguuccaggagucacaguuuagagggaugggaacgugucccuuagaacaaaacagaugcuuacucuccgucagucgcuuuaccguguggguggugcucugucuucuguggugaaaugugccacugagacauuucacuagaaaugauuaugcugguuuauuuauuaauuucuaaaaccauuaaaaauugucuagucaacucuuuggaccccauucugcuguuuaacaguaguguuuagaggaagugaaaguuggccgaauaagaggcuuaggaccgggaugcagcugugccugaggacuuggguucuauucucagccccacagagcagagagaggaagaggaggcggcucagguagccuacagaauugucucuggcugaucaugacggagagaagacccaucugaaacuauugcuagaaucgaaccaaccuccucaagcacuauucugucuggauaucagaagacaaagaugucugggguaaaacucagguuuugaaccugugguucuugcguauggugacgaggaaggaguguguagagagcagaugagaugugaaggcaggauuguggucagucgagguuugggcuggacugugggcugccuagaguguguggcuaagugacagcuuugagcagcgugcugggaagcacagucauugcaaguuagcuuugccgccuugauaauuccugcgggaggaaaauggaaugaaacuuagcuuguggaaaauugucugccaucccuguucauguagaauuuggcuuacaagcuucagcuguauaauuuuauugugaugcuaauaaacacauuaauauguauugccaaagauuuuguuuguugcuugaguauuuuauaauuaugggauacauuugaacuguugaaacuguuugugagugcuuauauccuaaagacaucauguugcuaaacagaauauguucuguauucauuagagugauagauuugguuuggagcagguugguuucuuuucaaucucaugccuauaauuuuuuacauuauauggauuuuacauuauaagaauuucaccuauauaucaagaucauacaaauacuauguguuuuguuugaagacucuuuaugaaaugaauuaguugaguuuuaaugguauacauuguaauuaaauguccagagcuaacuacauuuucuggacugaauccaggccucuugugcacugcaugacagcgacaggucaaggaugcuccuugaauauuauuaaugugcauacacuuuggaaacuugccaccaugugggagaaaggguagagauuuuagaacugcacuccuugagaugagaaucugcccuucuugaagccaucugaccaucagaucucuaaguuuggaacucaucugaaguuccuuaucccauuaucccuuaaagauuucucagucuaaacauaaauuauuuuaucuuuucagacaagaucuugcuuuguagcccaggcuggccucaaacuagaaacucuguugccuuagcaucacaaguaguaggaguaugggcaugugccagcacccuaggccuuauucacaaaaauuuaaauaugccaauuccagauuuuggguugagauucagaaaugucucaugaauuucaagaaaacaucucauccuucgaaagaaucuauccaguugucagucaaggaauuccccacugcuguccagugcccaagaguagcaccgcuccaaaggccaucaguccccucugugucccaugugucccaacaucauuugcaaagucuuuuaacaauaaauucuggccgagagauuaaaaauugcaaagauuguaaagagaacaguuauuuuucagcuagcacuucaaauuguuagaguuuugucccauuuugugaaaguauauguacuuaagaguaacuuggagauuggguguuguaagggugaaggcuacucuguuauuccaagaacaaagacauucucugucaaagaguaguuaucaauaccagaaaguuaacacugguacaguguuaucugcucuaacacuucaguaaugcuccacucuuugucccaauaguguuguuuaaagcaaaggaauaauaacaguagugguagcaacaguagaaauggagagagggggagaaguacucuggguguggcuuggucacacauuacacucaguuaagucucuuguugcaaccuugaugcauuugucugucucauuuguuaccuugauggauuggaaaauuuacuuugaauaauauucauuaguuuguauuuauuugauaucauucaugauuagguuguugaacuuuuggccaaaauuguagcaaaguauuguguucuugcaguaucuuuuuuucuuguaacaaaacaaaaccaaaccaaaccccuuauauuuuagugggagugguagcucccuucuguaauccuagcauuuaggaagaagagguaggaggauagcccucgaguuugaggacagccuaggcuccugggugaaucagguuuucauuuguucuguuguuuggugcauaaagcaccuucccucucacuccuuucacccacugaacuguuguuacuaaugucucucgacagagaaguagaugguaccaggggcaggcuggauuugugcccacugagcccuggccauccucggcagaggaggcaaaagcaguccagccugugauuuuaccuugccccuucccuguaggggcagucaauuaaagccaaacaauuucugaacucuuuuagagacuuagugaucauaaauuggaaguguaaucacucauaaacacaguaaacugugccacugacuggaagugcacuuucuguuucaguagugagagugaccuugccgaugucugaggcuagaugauuacagugaauaguucuuccacacaaaccaaacccucugugcguuugaacauuuugcuccuuugccccaaauuucuauauuccugcuaagaaccauuuuuucuuauauuagaguuagccauuagcuuuccaguuucaagucuccugccuguuaauggugaguagaugagucugagggagggaaagugugaagaaccgcagcgcaauggcugcagaccaggagaguugcuccuuuacucgaggauuaaugugugugaaacacaguuuuauuacugagugggauuuuuaugugcacaccccccacccccuaagugggccuugggcagagccaugcagaauuaaaacugcagaugcuaagucuauuggcucgcagagguuugcuuucuuuuagccuuucacacccucuccuuucugucccugucuauuaucuuucugacuauagagauaacauauaccaggaaaguguguuuauucauggggaucccuguaagauccgggccuuuguucuuccugucugaccccuggucuaacagucacacuggaaacuuacagagacaagugaggcagccuaagcgcaagguccuuucugcucucugccuuucugguuuuuucuuaaauucuuuucuguuguuuuuguuuuguuuacuuggcaaaauaauucucuucuguggagaccuagggugauugaauucuguuuucagcaauugcuaagcaaaaggguaauuaagugcucuggguggucuuuggaccuucaguuucccuuaugagaggugggaguucuuagcuuccucuaggaggguggauacagcugcacuagccccccacccagagagagagagagagcucaaaugcucacaaggcuaacccugaacuuucugacuggcuuuuccuguaugcguaucagucauaagggagacaacucagacauccuacauagcuucagcaagacuuuguagaugcuauacagaaaguaauggaguuaaacugguaaaaaaaaaaacuuguuuucaguuacuaagcuuguuucugggacaguuaaccuuucuauaaaaaaguuuaauggaagagaagcugguuaaacaaacguuauggcuucuucuugcacuaggugguaauuaacacagagcucacuaguggauacuacacugagaaugagugacucuggagcacucagucuuaaagggaugacuuaucaaacuccuucccuggaggcuccgggucugugcagaggaguaggugaacguggaugacuccaagggaacagcacaccugugaacuuauaagagcugcagauacaacaggacuggcacacaucaacucacagagacgguggcagcacacacgaggccugcacaggucccagcacuaaggacaggaaguggacucaaugcccacccuuaccuuuuauuguuuuauuuuauuuguuuaguuuuuggaaguaggaucuucuauguagcccuggcuguccugaaacucauuaugcaggcugcccucaaacucacagacauccacgugccucugccuuaugaaugcugggauuaaaggugugugugaacaugcacagcuugacaagcuauuugcaguugcaauagauucaugcugagaaguuuuuucuaaucgacuaugauuggguacauuaaccauacuccagugcagguccugugcccaggaguuguuggucagaacaaaaugaauucucugugcuaugugugaguucaugugcuuugugauuuguuuugucuuuuauuuguauuauuuuuuuuguuuguuuguuuuugagaaagagaaagaccaugguauggguaaggaugugggagaggaaaaacaugauauuguaugaaaaauacuuaagaauaaaauuaugauacauuaugauuuauuugugaauaacuggaguguuauucaaauuuaguuuuaaaaucuugcuagucaggugucagaaccuuugaugaaucaggcguuagaaagguuggagaacauuaugagcuccaagcagccucacaugcuacugggcuaagauucuuggcugacugcacuuucaaggccuuaguuacacacacugcagcaacuucacguccuuuaguaacuuguucuauauuuagcucauauuuauauacauauuucuaucacaugagauucuucauuaagaaagaaacuaugauugacuuggcuguucugaagaacuagcaucuagaaguagaaguagcaccuagaagaagauuuacaagcucccccugauagaacacgcugcaggaggauugcugcgaguugaagcucagucuugcuuaccgcaugacauccugccuuggccaacaaagaagacaaaacuuuucuaaaugacagaauguacguguucuagaaguaggagcauagaauauacgggcauugccuaacuuggaaccuagagcaguuuccaugguguguagcuuuuuugugcugugauauuuuugaggaaacaguggccugcauuguuuucuuguuuuccagccauugaccugaagagcggcucaggggagguguaccaaggccccgcaaagggcucugcugaugugaccaucaucauuuccgaugaggauuuuauggaaguggucuucggcaagcuugacccacagaagguaaugccaguaacauuucuauuuacaaaguuuauauugaauauucugauuagcaagucauauuuuuaaaaugacuauuucaguuaauauuuuucaaaagauuuuuuagugggucuaauuccuguuuaccauuuacuaaaacaauauaaaaccuacacuagauauuuugaaaauauaguuugugguguaaaacucggaugugauugguauaaguuuagcauuucuuaagugaaguguuucagcuuucaguuagugacauuuugagauauuugcacagauuuacugguuuaggauccauaauccaaaaauuagaaaucugaaaugcuccaaaauuaaaaaaacaaaauaaaacaaaacugauuugaauuucucaggaaguuucaguuugugaaacauuuuggaagccagaguuuuguauuagugacaugcagccaguauaaagcauuacuacucguugaaaaucuagaaguaggauauuuaacaaauaguuacuaugucacugaaguuggcgcauuccaagggauaucagggggaauaucaguaagucaggagcgucuucugugauguugucaauauuauccugaaacuguuaccuguuuucaaacaaaauugaaauagcuaauguaguaauuuacauggaggagaaaaucuuguuauuuuuaguuugugauuauauugcuugaaguuccaaucuuauuaccugguccuuacagugaaugagcucagacaaguguuugaaugcacaaguauuaagaaacgacuuccacauaguagcaaacucacaagaugaaagaauugaaggaaaccugauuaagagcuggucacuuauuuauaugcuauacagaauaccuguuuauaaaauaucucaaaaguuggaaacugucugagacaugcaucuguuacucagcccugugauacccaccacagagagaauugggaacaacagcaaagccaacccaggcugguguuuccuuccccagggugcacagcuagggggcuguggguguauguacccacaacaggagagggagaauauaacuuguggcagccacaccuuguggggcuccugccucugcucuuccacuaugguaugcugacaaaaugcaagugaauuaugaccaagugccucuccuugucaaccacuuggauuuguaccagugucaaucaggcaagugcuucaggucccucagcacuguuauagcagccagucccagacaaucuuucaaguaacaaagccgguguuaacagauaaugucuauccccgauagagucacugccccauuauuacuauguagugugcugucuagaccacaucuaucugaacugcuugagucccccagcccuugaacaguaggucuuugacuuuaggauguuauaccacccaaauacuaguagugauggucaaaagaaucuauagcgaccuauggugccaaacucaaaauugcauaaugaaccaguauuccaagagacauuuucagaagaaauuugguuucuaagaaggccauccucuuagcacuaguaaugauaucuacucuaucacacggcauaaaucuccauauaagaucacacgugaggaacaaacacauucugauaccucaugacuaugguaacucuuuaguaacaggguuagagagaugaguaguuaagaacacccuacucuuggaggggauccagguucuguuucaagcacucacaucaguuggcucauggcucuagugccaagggaacugauccccucugaucucuuugagcaccuuguacacauaaacucaugcagguauacacacauauacacaauaaaccaaccaaucaaucuuauaugaaagagcucaaaagaucaugguugaaugaaguuaggaagacaugcaggaaauaagagauauucugcaaagaggaagaaaucuuagaaaacaaagaacucaguaagauaaaaacuuuagucaaaaucccugaucagaucaaguagaaaaaagaauuuuagcuugaagauaggucuuucaaaaugccacaaucagacauaggggaaaaauaaugaagaaacucaguauguaugagacaccgugaaaauaucagcuguuaucaguguacuuagagagcaguuaagguuacagaagacauaaaaccuacucagugcauuugugguuccaaacuucccugauguugggcaagacaugggcauccagauccaggacucaagagaucccaagugagugugaccaggagagacacucacugcgacccagugagacggucagaguccauacagcacaaggaggagaaaucacagcugaguccucacuagccccauuagacugacacgaguuguggguagaaauaacccagagcaggagagcauggaaggauguauuucaagguggaaagaaauaacugccugugaagguuacgauaucaagccaaagucuccucagauguaagcagcggggaaaccuaagaguggaaaggagguaacaucaggaguuaggaaagcauaaguccuauuagagcagacgaauaagaguaacaacaguaucgauacaaucagccaccaaacuauacaaugauagaaaggaaagaaugagcagagaauucaaaacuagaagaaaaucaacaugcauuagaaaguauuugguaaaauuuaauauacuuuucaugauaugagucccaacaaauuagauauagaaggaacaaacuugagcacaauaaaggauggaucugacagacccacaggugaucugacacggaaugaggaaagcuggaaacauuuaagacagggagcaguacaagaaggaggcugcucuccccacuccuaaguguuagccagaacacuggggcaguggaaugaaauggagccaucuuccuaaacaagcugugaggaggauaccaacagacacuaacguggaagggaaaugcucaugggccucaacccuacacaaagaacuacaggcaacuaagggaugcugagagauggagaaauaaucuuacccugggaagagccccaaauugauuauccaauaccaagugucaggccugaaaacauagcagguugcauuuauauauuuaagaauagacucucuguguaugaguguguguauaacaauaauuaaagaaagagagagagaaagagcgagagcacaaaagguacgcaugggaaguguagagggugggaagggaagagaagggaaggaaugauguaauuauauuuuaauuucaaacccuuuuaaaaaaagacguacauagaggacaggaaaaaacgaaaauguuuauuuuugcagauaauguuuucaaauguagaaaaacuuagauucuaucaagagacuuagaaauguuaaaauguggaggguuuaagaauccauuuaacaugccagccuucugccuggcuuuaugcacucuugccguauaccuugcacauuauuuaacugacaugacaaggguguguuacuuuagugcugcuguccugaguuuucagagauguaggggcuggagcuucagggggucuagugguuugcccaggucacguugcucauacgugacagggcuugggcucccccaaccccccagucuucccaugcuguugccuaucaccacagcgugguccuguuguauuuugacauuaucuauggccgcuguguggggcagguguaauuagcaucuucaguuugcuuuucaaguucugaguagaauaguuguauuaagaagaaaugcaauauacucuuuuauuuauguagucucaaauccacauguaauaacagaguaaagccagaaguacagauuccaacagaaucaccaagccugucaagucagauaacucugugauuuuucuaaacgugugggcucuuuuuucuuagauagcugaaauuaugugugcagucuguagcuguuaaauucuuauagcuaggcugaagcugccuuccucguccaguuccuaacucgccuggugucagccugagcaaccaucuuucugaaagaggcaaagguaaaguuaacucuuugugcucuuuccccuccugccuugcaggccuucuucaguggcaggcugaaggccagagggaacaucaugcugagccagaaacuacagaugauucuuaaagacuaugccaagcucugaagggacccacugugugcuguuaaaggagucaauaauuaaauacugucuacccagcugagccgcagccuucugcgauccacaggagugugcagcagaaaucgcuucacauuuccagauucagauaacuugcauauuuucauuuucuacuaauuuuucacauauuuuuacaaggaacuguaaucuagguagcaaaauaaucauucuguucauagaucuguaucuuaauaaaaaaaaucaaccaagucugguuucuuuagacuuuguaaaagcauuaguaugugaaaggaaaacggaaugaauaaaagccacuuuaccgcuugucucccuuccugcuccucuuugcauugaucccuguaucucaugaauuucccaggauguccucauucucuacuguuaggauagugcugugcccaagaacaaagucuuugugcucucaaguaauucuuugauccccucugcuugaaauuuuauauuuucacuguguuuuuaaauccaccaaugauaggacacguuugcuucaucaguagccuggaaucauagagucucuagcaagcaugcucacacagcugagccccauuugccuugaugcagugugccugggaaugugcuuggguggcuuaucugcaaagggaaaggacauguggauggucaggcuccaguggagggagcugcaguuuuguugcccccggaauucccuuugcugacucuuugcaaauccaaccuuuccauggaaaguuccugggcacaacucugauguggagugcuccgaggcucugcaccugucugggcaagugggcugggugcaaggagcuuacacagccucagcuucucuuuaaaggcagugcugaagcugggauaucccucaagugguauccugaggcaacuaauaguuacucucugccuugaagagcugcgugaccuugggccaagcagcaagggaauuccuggaguagguuuauggucugcugucuucccugcagcugagaaaauggguccuucagaauuaaccuuaaaugcagagugauccacucucugccaauuuaauuuuaauaaaacaaaggcagucuuaaaauguuggucuuuauuauacuaaauuccuguucaugaugagcucggggaagccuggagcucaguaaugucccaguagaaguaacuuaucaaguuaaaugccacuguucauuaaugaacguguugguuauauacccuaggugcucaauccuugucuuaaggaaguuguguuuugguuauuuuaucuaucucucugucagucuuaaaggucagagaacuacuaauaucuagauaaggaagcauauuauuaguauuauguuucuuaacauuuuggaaguauuuaauauuguugagugcaccaucaauucuuauauucuccaaua

SEQ ID NO: 8921 - RNA, 3940 nt, Mus musculus
cugguggccgcgcaggcgcgcugugcggcuggcgcgggagccuggcggagggucgcgaugccguucgccaaccagccaacacugcggaucacggaacucaccgaagagaacgucaaguucauuaucgagaacacggaccuggcgguggccaauuccauucggagggucuucaucgcagaggugcccauaauagccaucgacuggguucagauugacgccaacuccucgguccuucaugaugaauucaucgggcacaggcuugguuuaaucccaucacuagugaugacauuguggacaagcugcaguacucccgagacugcacaugugaagaguucugcccugaguguucuguggaguucacucucgaugugaggugcaaugaagaccagacgcgccaugucaccuccugagaucucaucuccaacagcccccggauuauuccggugacaucucggaaccgggauaacgacccuaaugacuauguggagcaggaugacauccuuauugucaagcugaggaaggggcaggagcugagacuucgagccuaugccaagaagggcuuuggcaaggaacaugccaaguggaacccuacugcggggguagcuuuugaauacgauccagacaacgcacuucggcauacaguguaucccaagccugaggaauggcccaagagugaguauuccgagcuggaugaggaugagucgcaggcucccuacgaccccaacggcaagccagagagguuuuacuacaauguggagucguguggcucacugcgcucccauggaacgugaggcagaagccucucgggccggguggacaccugugcucugaccaggaaggucauguuuguccuuucuacaagaaaugcagugacgggggauggagcaaagcaugagggaauguccaaaaaauuacuggcccaaccugagacccaucucaaugggcaaacaacaguccaugacacugcuaaugauacuuuguuauacaugcagauaggaaccuagcauguuugccuuugagaggcucuauccacaacugacucaaaaagaugaaaaggcccacaaccaaacauuggauggggcuuggggacuccuauggaagaguucguggaaguauugagggcaaugaaaggaaaaggaacuccacaggaagaccaacagagucaauuaacccuugugggcucucagugacugaaccaccaaccaaagaaaauacaacacauggguucgacuuauguccacugcacauauguagcagguguccagcucagucuucaugugggucccccaacaauuggagcaggggcuaucucuaaggccgugauaugacugugggauauguuccccuaacuggauugcuuugucuggccuccgugggagaggaugugccuagcccugaagagacuugucaugauugggagauacccuggguagggcuccacucuugccagggagaagagaggggcaacagaagagggacugugugaggggggcccaggaggggagccuguguuugaauguaacgugaaucaaucaaugauuaaauaaauauuuuuuuaaaauaauuuuuuaaaaagacaaaagucaaucuugacaggaagcaggagacuaacugcagauauucaccucuccuuuugugauuccagaucaacaucccuucccuguccccaccuccaguggauaacauagaacaucccccucuuagccuccuuuccccaaugcauuggggcuccaacuccaggaggcacucucugggaacccacuggccacuccugcuagggaagcagguaaacugacuucaaauucucaucacuuuauccauuucuccaaguccaaucucccaguaucaucucuaguucucuggcuguccuccuucugugucuucuccccgcauucucacuauucccaugggacuaacuaaguagauccugacagaacacccacauccccacuuuugaguucucucaagacccagaucauacccaauucuaagucucaggucccaauauguagcuacauuuugccaaaaacucccaguaguauaccuaucaagaucaucaaagguuuuccuacaggugacacaugaccacuccauucuaagaaccagagagaaaacaggaacuaagggacaaaacacagacucaacaaagaugagaccaaauaccagcaacuagaauuaugaucuucccacuugcagauacauugaagccugacaaaacaacauaaucaauaacuaccaggaaaauaugucucccagugacccugacacagcagacccugaauauuccagcaaauuuuagacacaaauaaaagaccucaaaacagucuuugugaauaugauaguggucuuuagaaaggaaacaaaucauuuaaagaaaucuaugaaagcacaaacagugaaaggaacugaauaaaauugcuuugagagcugaaaguugaacaaguggaauagaaucaauaaagaaaaacaaacugaggaaacuuugaaagagauuguucucaucauguuuuauuuuauuauuaucccaauagaggcuuguuuguuuucuaaugagcaguagaaaggggauggauccaguuaggggaggugguaagaacugggaguaguacuggaaaaggaaaccauaauccaugaacaguuugugagaaaaaaauuaguuacauuaaagaaaaaauaaauaagaaacacuuuauaacuauuuaaaguuaauauaguaaaaugucauguagcuacacagcaguaagaaaauccuagugaacagcuaguauagaaugauacauuuauucaugguaaaaacacuuuuuugauugcaacuuuucuguuacucuugcuucccaaguuggagaacugcuguggagauucugcccacugcuuaagaaagacccuguaacuguuacucuucuuacuauugugauuaauuccuaacaaaguaacaagaucuaaagaauuuguuuugguuuaugguccaaggauagagaucacuguucuuauccuuuuagaugauacugcgguuccagacaugguacuaggagcuccaggcaacugaguucccuguguccacagacaggagacggaaggaggugaaggcaguuguucaggucucuuucucuacucucuucuuuugguuugcuuugggaucccagccagggaauggugccaccugcauuuaggguuggauuucccuccucagugaaccuccucagucuagagacaaauuauccaucuuguaauauucaaacucuguccuuucauucauuugaaagcucaaaaaucacaaacauaagacagauacuauuucaguuuugcuaacgauucauucauuaagaguacauuaauuucuuguuuuugauagauagaauuaaacauucauucacucuuccagccccccccugccccauuuuggggggggguaaauaugugcuuuggccuucuauauaguccucaguaaaguguagauacacaguauagucuuuguuaaaaucugguuuuauuuaaucugagaagcaacaagguggccaaacagugacucccuccauuccuggcuccagggaaaacaguaaagcuauuguacaguucacuaugaagguuacacacuggcaauagaggucagauaaauguggaggucagacaaaugaccaggugaguacauuccaacagaaauaugauuuuguugcaguguuccaaacaaacuggcuaucaaaagcaagcuuuacaaauuaaaaaguuaaucacaaacuguaugaauauaaaauuguagauuuggggcuggagcgaaguuuggcaguuauggccaucgucugcauuccagcacccacauggccacuccuaauuaucugugacucgcaaaccaggaggccugacacucuucugaccucugugcauaccaggcaaacacauggggcacagauuuauccaaacccagugagcaagagagaaugaa

SEQ ID NO: 8922 - RNA, 3940 nt, Mus musculus
uucauucucucuugcucacuggguuuggauaaaucugugccccauguguuugccugguaugcacagaggucagaagagugucaggccuccugguuugcgagucacagauaauuaggaguggccaugugggugcuggaaugcagacgauggccauaacugccaaacuucgcuccagccccaaaucuacaauuuuauauucauacaguuugugauuaacuuuuuaauuuguaaagcuugcuuuugauagccaguuuguuuggaacacugcaacaaaaucauauuucuguuggaauguacucaccuggucauuugucugaccuccacauuuaucugaccucuauugccaguguguaaccuucauagugaacuguacaauagcuuuacuguuuucccuggagccaggaauggagggagucacuguuuggccaccuuguugcuucucagauuaaauaaaaccagauuuuaacaaagacuauacuguguaucuacacuuuacugaggacuauauagaaggccaaagcacauauuuacccccccccaaaauggggcaggggggggcuggaagagugaaugaauguuuaauucuaucuaucaaaaacaagaaauuaauguacucuuaaugaaugaaucguuagcaaaacugaaauaguaucugucuuauguuugugauuuuugagcuuucaaaugaaugaaaggacagaguuugaauauuacaagauggauaauuugucucuagacugaggagguucacugaggagggaaauccaacccuaaaugcagguggcaccauucccuggcugggaucccaaagcaaaccaaaagaagagaguagagaaagagaccugaacaacugccuucaccuccuuccgucuccugucuguggacacagggaacucaguugccuggagcuccuaguaccaugucuggaaccgcaguaucaucuaaaaggauaagaacagugaucucuauccuuggaccauaaaccaaaacaaauucuuuagaucuuguuacuuuguuaggaauuaaucacaauaguaagaagaguaacaguuacagggucuuucuuaagcagugggcagaaucuccacagcaguucuccaacuugggaagcaagaguaacagaaaaguugcaaucaaaaaaguguuuuuaccaugaauaaauguaucauucuauacuagcuguucacuaggauuuucuuacugcuguguagcuacaugacauuuuacuauauuaacuuuaaauaguuauaaaguguuucuuauuuauuuuuucuuuaauguaacuaauuuuuuucucacaaacuguucauggauuaugguuuccuuuuccaguacuacucccaguucuuaccaccuccccuaacuggauccauccccuuucuacugcucauuagaaaacaaacaagccucuauugggauaauaauaaaauaaaacaugaugagaacaaucucuuucaaaguuuccucaguuuguuuuucuuuauugauucuauuccacuuguucaacuuucagcucucaaagcaauuuuauucaguuccuuucacuguuugugcuuucauagauuucuuuaaaugauuuguuuccuuucuaaagaccacuaucauauucacaaagacuguuuugaggucuuuuauuugugucuaaaauuugcuggaauauucagggucugcugugucagggucacugggagacauauuuuccugguaguuauugauuauguuguuuugucaggcuucaauguaucugcaagugggaagaucauaauucuaguugcugguauuuggucucaucuuuguugagucuguguuuugucccuuaguuccuguuuucucucugguucuuagaauggaguggucaugugucaccuguaggaaaaccuuugaugaucuugauagguauacuacugggaguuuuuggcaaaauguagcuacauauugggaccugagacuuagaauuggguaugaucugggucuugagagaacucaaaaguggggauguggguguucugucaggaucuacuuaguuagucccaugggaauagugagaaugcggggagaagacacagaaggaggacagccagagaacuagagaugauacugggagauuggacuuggagaaauggauaaagugaugagaauuugaagucaguuuaccugcuucccuagcaggaguggccaguggguucccagagagugccuccuggaguuggagccccaaugcauuggggaaaggaggcuaagagggggauguucuauguuauccacuggagguggggacagggaagggauguugaucuggaaucacaaaaggagaggugaauaucugcaguuagucuccugcuuccugucaagauugacuuuugucuuuuuaaaaaauuauuuuaaaaaaauauuuauuuaaucauugauugauucacguuacauucaaacacaggcuccccuccugggccccccucacacagucccucuucuguugccccucucuucucccuggcaagaguggagcccuacccaggguaucucccaaucaugacaagucucuucagggcuaggcacauccucucccacggaggccagacaaagcaauccaguuaggggaacauaucccacagucauaucacggccuuagagauagccccugcuccaauuguugggggacccacaugaagacugagcuggacaccugcuacauaugugcaguggacauaagucgaacccauguguuguauuuucuuugguuggugguucagucacugagagcccacaaggguuaauugacucuguuggucuuccuguggaguuccuuuuccuuucauugcccucaauacuuccacgaacucuuccauaggaguccccaagccccauccaauguuugguugugggccuuuucaucuuuuugagucaguuguggauagagccucucaaaggcaaacaugcuagguuccuaucugcauguauaacaaaguaucauuagcagugucauggacuguuguuugcccauugagaugggucucagguugggccaguaauuuuuuggacauucccucaugcuuugcuccaucccccgucacugcauuucuuguagaaaggacaaacaugaccuuccuggucagagcacagguguccacccggcccgagaggcuucugccucacguuccaugggagcgcagugagccacacgacuccacauuguaguaaaaccucucuggcuugccguuggggucguagggagccugcgacucauccucauccagcucggaauacucacucuugggccauuccucaggcuugggauacacuguaugccgaagugcguugucuggaucguauucaaaagcuacccccgcaguaggguuccacuuggcauguuccuugccaaagcccuucuuggcauaggcucgaagucucagcuccugccccuuccucagcuugacaauaaggaugucauccugcuccacauagucauuagggucguuaucccgguuccgagaugucaccggaauaauccgggggcuguuggagaugagaucucaggaggugacauggcgcgucuggucuucauugcaccucacaucgagagugaacuccacagaacacucagggcagaacucuucacaugugcagucucgggaguacugcagcuuguccacaaugucaucacuagugaugggauuaaaccaagccugugcccgaugaauucaucaugaaggaccgaggaguuggcgucaaucugaacccagucgauggcuauuaugggcaccucugcgaugaagacccuccgaauggaauuggccaccgccagguccguguucucgauaaugaacuugacguucucuucggugaguuccgugauccgcaguguuggcugguuggcgaacggcaucgcgacccuccgccaggcucccgcgccagccgcacagcgcgccugcgcggccaccag

SEQ ID NO: 8923 - RNA, 13810 nt, Mus musculus
augaaacugggagaaacugaacuuuauuuuagacaauuuaacaccaaaugacauguccccuacuacacagcaagcagucauauauuaaauguguguaucccaugagcuaaaccuuaauccauuuuuacauucaaguuaagacaauucagcaccguuuaaacuugaaggcuaacaaaaucuguguucaaaagcuggcuaggacguuggguagcugggaauaaaauuuaaaccguugauuuuuuuuaaaauugucuaugugaauuuaaaaaugaagcauacauaaaguggguaauuuuauuacuuaauauauuguuagcaaaauuauuucuaaaguaguucaugacuaagggcucaguauuuucauaaaaccugcugaagacuaaugaucaauggggagagaaugaacacagggaaugauguccacacgugucuaacaucaauauuuuaaagagcaccacacuacuguuacaaagagugccuagcgaauaauucaauggaacuuguaauuaaauaguuauauaaaaugugaagaaaauuuccuggaacuaggaaagcuagaccacggucccacugaagauggagucugcagucuccaugucaugauacaacucagauggcaaagaguagacuuaacuaugcugucuuccauuucuucacggccguuguuaguguaaagacaaucuuugaugaucuuugugucauucucacuuaguacuuuuuuaaaaauuuagaguuugguuagacuagcuugggauuucuuuuaaaaucauuauucuacaccaauuaaacagagaacagauacccaaaggucaaaaauacaaagugguaagucaggauuuaaagucaauuggaaguguuuuuaaaucguggaaaggaaagaaauguuuacaaauaaauagcuacuuaaaugaaaaaaaaaucaagcaaaaaggucaaauuacauuuaaaagccagacauuccauggauuugaaagguauuuuaauuauuagaaaaacauacauguauauaaucaaugacauuaaugacuuuuaacuuaauuuuuggaaaauaaaauauagccaugacaacuaauagugcuuaaauuuuaaguucuauagacuuacuuuuaguaguuaaagaugaaauaaggcuagccuaauuuucauacuuacuuagguuggggacagucguuuuauuuuccaauggguagcagguaagugcauggcuuuuacugucccuaacauaauguucaauaaagagauaagggucucauugaaauuaguauccuauaugucuaaaagccauauuauuuuuauacaguuaagaaucuuaguaggacaagauguuaaaucuauauaugccagucuggcucaguauucauacugacaguaguuuuuuguuuuguuuuuaaaagcauguauauuaaaauaccucuaucagaaugauuauaauuugaaaggaucguucuacaguaucaaaacugaaaugcuagcuagggcaaagagguacaucgaagaagcaauccuguggaucagaaaccagcucaaucagaguucugccugcauuugcuuauggguaagugugcuuucaggcagaugagaauuauguguaccgcgcuauccaccccuggcgacugcccaucucuggccccucccacuugcucugcagcaaugagucuacagcgagaugauuagagacugcugcucuuacaagucuaugacacgugagucaggaucccagcucacuuagaaagcucuaccugacacguucuaccacaggaggagaugccuuacuugagauuuuaacgcugguaaaugaaguacgacuucggcacaagcaccaggaauuuaaaagucuaacuugauuucuuucugcaccuucugaauguaagagucuccaaaucccacugcuacacacaguuucacaguuuuacguaaggucacagcggucucguuguggugcgugcuccuugguuuuugcaggaaggcucugcuucccucuuguucgccaaccucucaaguauacaaugcuaugugcuucgcuaauuuggguuguauuuuguaaauacacaaaaacguauauacccaacuccugaagagucuaagaugauggugcugcauugcacacaguaggucaucuauuacggaugguuuuauauauauauaaauucaacauucuccuuaauagcugaacauuucagaaguguaguagaguugaaaaaaaaaucuaaaagguuuuccaguauuuucuuuugacaguauuugaaagaugauugugauguuagagauuccuuguauaauugcugugucagcagugacuuaauucuggcuaacaguaaaauaugcugcagggcauguuagcucuccacugaucacagcuguuggucaucggaaugauuucccuaugccgugaaaccucacaauggggaugugcugauugucacauuagacauuucugcccacagaaaagcuaagcagcgugggaucgaauagcaacaaguaucaaacaggaucuuggaauuuuccaauucauuccaaaacaaguugacucaagucagagugaaauuaagcaauuaagagaaaggaaauugucuaguaacucuaaaauguaaacauaauuuuauauagggauguaacuaucugaauacauauaucgccaucuuucugauuauacuucaugacaacaauaguuagauguuuggcccuuccucagcaccaaguguauccauuucuguuuacacaauagggacaccuuuuuaaaaaaucaaucuaagucgaggcaaauauaggcucaucaucauuguuucacugguuucagcacuuuagaaaagaauccguucaaauuguggcucacucauuaaaauaucaauuucucauuugcacuauaauuucaaaagaacauaagaaauucagaguucuuugaaagagcccacuaugcacccacagaauugaaacacugcuaauucacaaaauaacaugaguaaggauuuaaaauuugccaaauauuguugguuuaaacacucaaaauccaguuaugucauuuguugcgaaagaguccaaacaaaaccuccuuuguuguuuacuguuugucuuuuaaaauauguaaguccuuccuacuuaagcuaaucuauaguuuccauauguccaaacaccagguacggcuuuauccacugggaacugggcuucuuucuaauaccuagguugagaaaacacaaugggacagguuaucagcaggauaauaucaugagugcgcacaacaaauaacauuuuagucagccuuuucaaaacuugauggagcaaugucucucugcccuagcaacuaucaccuuguaaaauuacuauuagaacaugaucucacagugaucagagggaaggaauaugacaauaauaugaagaacauugccugauguccacagccugaauguuuaaaaggcaaaacaaccaaauaaguaaguaaauaaauaaaaauaaaauugaaacgagaaaaagucaagcaggacucagggauccagcaaccaagccggcaagcucauucuacggaacaagagugauacaucugccaggaggcacagucauggccucugcaccaucuugcauuuucccuucucugucuccaugguuuuuugggcccagaaugacacauuaaugggcagagauaggaacagagacagaaguagguaucuuuauguugaaauauuggucaucaugcaaggaagaauccauuugggugcaaaucauuaacuagaaaggucugugaggagaaagcuuugcagagguggaaaaggccugacacaucugggaagacugagggcagagacuccaggaauggaacacaccaaauuauuggguagauuuuacaucacaccagaaugguuucaaguaucuaacuggcaugcaaaacaaucgguacuaaacuaacagugacaugucauuagagguggggagggggggccuguaaugacagcaugaggucacacacagguggccaucagacuguucacauagcuucagaugcacuacacuccugcucaaaaaaaaaaaaugucagauuuuucauggucuuuggagagaaacucaaaauucuuaguuugcuuuucaguuguucuguugaucagagcacagcugacaaacccaacuggaagcagccuuugcaaacacugccugcaacucacuccugcccugcaguugcccacgaaucugaccccuacaaugcaagcuccuugucaacucugcuuuuguacuuuuuguacuugagagcccucaaggcuaaacucacaugcuguccuaaaggcacucuccagucguguucuaaggaacacuuucuauggaacuuggaggugaaagucagaguaagaggcaaguaugauugcccuccagguaagggcuuuuccucuucugagcauuucuuauuucucacucauagauuaaguaggauauuuauuuuauuaagaauaauuaacuuugcuuaacguuauauuuccaucugaucaauacugcuuguuaaaaaucaaguacgaaccuccuuguaagaaagaaaggaggaaagaaagaaagaaagaaagaaagaaagaaagaaagaaagaaagaaagaaaggaaggaaggaaggaaggaaggaaggaaggaaggaaggaagaaagaaagaaagaaagaaagaaagaaagaaagaaagaaagaaagaaagaaaaagaaagaaggaaagaaagaaagaaacgaaggaagaaaagaauaucauuuggcuugccaaauaauacucacggugaaauugugcagccugaggcauaggcaugauguccuguguagcgaaugucacagcguacaacauuguuaguguagucugauucaggcaccagguagcugggguuuacacugaccugaacaagaaaaauagcaccgugugaaagauuuuauacuuaauggauacuguucuucccuccuauuucuauaaugcuacagugaaauuacuaacaagggacucaucuacaucaagcaagaaaaggaguuuaggugaagaagguaguuaaacauacuggagauauuacaaaaggaaguuguguagaucuccccaaguucuuuaaaaaaucauaacguagauugcuuaacaauuguucugaaaguugucuaaguacuuucaaacagaugguuauuuaauauuugaauccagaaaaagagaguggugguaaauuacacaucuucaaagccccuaccuuuagaauguaguuuccagguuguacaucuguaauaucaauccacuggcagucuaugucugccgcauaggugucauaacauccaggacucaaucccugaaaucagaaaacacuucaaaauuaaacuauaggaugugaccagacugauuauaugauauuaucuaucaaugaaaccuugaguuaguacccacaagaauuggacacaaaaaccagaacacacuuuagcccaucuuauaauaucuaguuauucaacagcugcaaguuugcaacaugaagaaaugugcccuacuucuaaagucaccaguagaaauaguccuaagcaacaaauuaggccuccagcaccauucaaaaguagcaaacauaucaggaagaaaugucucacaguaauucauuugcaguguccuauuagcgagauucccugcagugaccuuccuauguucuggaugacaacgauauuuugucuuguguagcuuuguagcaucuauucucuucugcuuuauauuaaaaucauauuauauaaaccccuuaaggauagguacagucuaauugcauucuugaauagcuaacauuuauuauuuaaccaaaaccauauauagucaguucucacaacuccagaacucagguguguuucugucuccauuuuaugguugagaaacccaaggcaugcuaagaccaaaugacugauucagggguaaaagcugagcagugacugagcuuguuucaggauuauauaaacaagguccagaauaccuuuucuuaacuaucacauucccucucucaaauaaucagugagaucuuuguggagucagaaggacggauuuuugcccaaacuggucaaagccauauccguccacuugcuaagacauuuccaccagcaagucaaugggugucucacaaggcugccaggagaaaaaugccaagaacauacauaugcuucuugcuaucaagagucugcagaaauuuccuucgguuggggcaugggcauuuucuuauuuccacaugagaacuuuuaacuguagcauuuccauucugauaauccaaaauugauuaagaagcguauugcauacccuagcaagauuuuaucgaaaggacccagauguagcuauaucuugugagacuaugccggggccuagcaaacacagaaguggaugcucacagucagcuaauggauggaucacagggcucccaauggaggagcuagagaaagaacccaaggagcuaaagggaucugcaacccuauagguggaacaacauuaugaacuaaccaguaccccggagcucuugacucuagcugcauauguaucaaaagauggccuagucggccaucacuggaaagagaggcccauuggacuugcaaacuuuauaugccccaguacaggggaacaccagggccaaaaagggggaguggguggguaggggaguggggguggguggguaugggggacuuuugguuuagcauuggaaauguaaaugagcuaaauaccuaauaaaaaauggaaaaaaaaaagaagcguaugugacaaucguucgaacuuagcagugucauuuaaaacugucucuugaguuugcuuugaugcuuaaggucaucuuggucaacaaagauaacaaaaacaaaaaucucgaugugcuuuacugauguggguuuggcugcagcuggauuugggaagaguaagagaugcugcuguccauagcacaggacaacauagacaggccaacccaacauuacuuaaccacaggagcaagagccauaaucgccuagauuuccagcuugaccagcucucauuuuauguguugaacaggaaauacaaaggaaagaacuuuaagguucuaccacauccuucucugauugugucaccuuaggcacucgguaaguaaguaguaccugcuggugucacaaucauuacugcuaucucacauaggacucuaaauugugcacuggauuagauaaccauugcagacagguauaaguaauaccacuggcaauuaaaguguuugcaaaacgcuguuguuggccuauaccuauugucccaaaugcuagaugacgagugugugugugugugugugugugugagcgcauaugcacgagccugugugugcgugggcacacauacacaaacuucuagcugacacuauuacuuuaugauucaccagcuggcagaaaaugugaauuuugagcuuugcuuauuugaacuaacaagcaaaugccugaagcugccaaggccauuaagcaaauagacuuuucauguauuugaaguccauugugaaaauaaauugaaaauagaacuucauugaagauuaucuaaauguguucuuugguuucaauaaaaaauacuugucugcaacauuuggucauugagugugauguaacuauuuuuaaauugugcauauauucuguauguaaauuuaugaucuuaaaacacgugguuagauauacaauauauucauaaguuauaccuaguuagaugcuuauauacauuuaaggaagacggcacuaguauaacaaaacuaauaaaagucaauauuaggggccuaugugaauguuuuuucuauaaaugaagucuguucaaaggacuauuaaaaaacacaaauacguaaaucacuuacaaugcaagaccuagugaagaauuuuuaaggcaugcacaggaaaggauaaacaagaaggcuaccacauuuuuuuaaaaaagugagauuacacaagugaauaggggugccucugccucuguggcugaaguauacacccuuccccucccccaaugcaaguguucuagcuuagagaugauuaacaugugucauuuuaagaauagggaaaugcaugcuccagguccucuuggggugaucacugaaugcgaaggcaaucucugcaaggguauaugcuuaauauauggguguguuagauuuuucacuuaaagcauauguccugccccucccaacguauguuaaauauaacuguuuccccgucuaaccacuuugaugagcuaagcccagaggaaagaagaauggucaccacauguaggucaccaaaaagcuucuggccacaguacuggaaucugcuucccaagaugacagccgcugaggucugugugcccuggguaauguauauucaggaacuacuugccaagagcagggcuggaguaaaauuauaauguccuuuuacaaauuaggguuguggauggaaauacugacauaguuuuuaacugacccacauuuuccaauucuaagacauacaauagcgcucaacucagcacuauuaaaaacaaaucuauccaaaggacaucugacauuaauuacaccggagguuuaaauauacauguguggaauaagaaacgugucuuucugcucugacuugcauuauuaaaagugaugcuguuuaaaguauuuuuaauaaccugccuucaaaucuuuguucuaacuuuaggcacuauuccauauuaagcaugaaaauggaaaacaaaauggauuugcaggugagaaaacagacguauauugccaacaguuauuauagcugauugaagaacacaggaugaaggcagauguuguaagucacucauguguauucagaaacuuaacuacuuuucauuguguuaugaagcaaggauccacauugcccuccugugaucuccagcagggguuacauguacagcuggaaacacuuuaaaagcaaucugcaccacccagucaucucccuucucccaaucugaaguaucccauguugauaagguaaccuuaaaaugaaacaaaauauuuuuuaaaaaagaagagaggaaagaaagaaaacagcaacugacuugcugucacuuuccuggaggucugugggcuccagaugucaggggaccugccuaccugugugugugcagugcacgcaaagcgccugugguacccauagucacaggacguguccuccagacagaagcuugcuuuguggccuucagccacucuccucuguguguuggcaucaagcaggucauaguggcugaauucguccaugcugugguaaugucuaaugucccacacaacaaagaaacagcagucaguggcacauagacaaagcaaugaggaugcuaaauaacuuccuugacucauaaauuaaauggugcugugcucacaaauuaaaacaggauaaauucaucuucuuguuuuuauuuuuuuagauugauuuauuuuauguguaugaauguuuugucuauaaguaguauguaugugcaccaguuuccugccuagugccagaggaaguuagaagagggcuucuaaucccuuggaacuggacauuugugaaccaucauguggauacagggaauugaaccuggguccucuccaagugcucuuguagagccaucauuccaacccagauauauauauauauauauauauauauauauauauauauauauauauauauauacaugugugugugucuuuccucuugaaacuuuguccacuccauauauauguguguguauauauauauauauauauauauauauauauauauauauauguauaauuauaaauuuccucuugaaacuuuguagcucuggcuguccugcaacuuacucuguagacucuugaacucagagaucugccugccucugccacccaagugauggaacuaaaggcauaugccaccaugccuggcucccaaauuuaucuucuuaaagagauauucaugccacacacuuuuaaaagaacauugugagguuuuuaacuuuacuaggugguaaagacacugugguaucgauuccuuuauauaggcuuuauguuugaacauuaaauauaaacaauugauuauauguccuuguaaccugugcaguuucuaguguauuucucuggcugccacugcugauauuggugaugugcugaugauuucaaacaaaaacuauacucuggagggguugcuaugagauacuaaaaacuggaguugcaacauucauaaaaccucuuuggaaacgugaaggacaagcaacagcaugaccaucuaucacuauuauuuaacuagcacaggcuuuuauuucaaaauaagauauuucuauuuuaauauguaaauauguggccacaguucacuuuucucuauuccuuaaauagaaggcucugagcucuuccccuucucuugugggggaggagcuacaaugagaaugggcuugaauuucuguaagugggagaccacacaucaugauuuccuggcauuggcuacuugaccacauuaccuaagcaagugauggcauaaccacauguaauuuaaaaauuaaaaccguuacauuuagaaaggguagggcgaccacucuggggcugacaggggccuugcaaaagauacaagugaauuggguccugaagucuaucuuucacugagaauggucucuaaauccuuuggguaaaagaugucgugcucuuaucaaaugccuuucaagguuaacugacugcagaucgucuugccuacagcagagacuuuaaccuaagaguaaauucuauuggcagccacccucucuccuuucacucauuuuuuaguggggaagaggcuaucuuaggguuuaacauccugugauggcaccaaacugcauaggaaaaguucuaaauauaaauaagaucaaaucucuagcauuagguaagacauaugaauagccaucugaagaaugggcaccccagaugagaggcccauucacuuacuggugacagcugugccacucccaggaguaccgagggcggcuugguaagaaguccgaugucccuugguucuucacucuuugcggaaaucguagcaguacccuguggucauagucucugacauccgcccuauaugcugaacugugaguuuagaaaagaaacguuagauccucugaacauggauggaaaacacgauaggaagaacagcucaccaucacaagguccuagcagcccccucccucgacuagccucuccgcucaagggaucaugaguuccuguccaaucccggaggaauaaacccauugcaacucucuggcgaaugagugaaugauggauaacaguaaaaucccagagagauugagauuaagauuuauacucucuuuauuauagagaagagacuaugaaucuaaaaaacuauaaaauugccauaguaaaugaucccacgccaaaaauuucauagguaucuauuaauaacgauauaucuaagauagaacguggagaaauacucuaaaacuagauaccuagauuuagauagauaacuuuauacuugacaucuaccaaacugagggcgcuucuuuaauaucuuucagcacucagugguauggaucaugccauaaagaacacaaaccagcuugaaguucuucccuuagcgcgacuguuguaaaaagucaacacggaauaaagguucauauaaacgccccuggaacgcuacuauauauauauacacauauacauacauauaugucuaucuguguuagaguauguuagugacccauuuuacuuagcauacuaccagaaccacgcaaacaucuugugcucccucuacugguggccagcugcagaaucaaagaauuccaagaccagaauagcuauuuuauuuuaggacugacggaaaacaaaacucuugcuuguggucuuauaccaaaacaacccaguuaaucacggccugaaagaaauguggaauguacucuuuaccaaugggggugggggaggacaccgugacgaauacaccccuagaccauuagaaaauaauaagugcuuccuuuauucccacacccuccccaccguguuguugguuguugaacuucuguuuuauauaaaguuauuggaagaaguuggcguuaaugccuaagagguaucuugggaaagaaccugagaccuagucaccagaauaaggguuuucuuuucccuccccggguaugcgacuuucacugaagcagcacgcauaaaaacauuccaaauuaacucucucuccaagucagcaugcccaggaggucaugucccacuucccagcccuugucccacuuccuaccccuugucugcgcugaauagcagucaaaacuaggaucaaaaccuaagaccgggcuguggaaauccauaccuggccaggcaguuuucuuccgcagcgcaucucagguuguacauagacaucuucuggacguacguggaagccuggauguaguaggggucgggcaccagguccgggagaccuaaagauaagacaagcugaugaccucugacuccuaaaccuguuugucaccuuucgcccaccaagucugcaggguggggcugaguguguggaagaacagggaaagucgggguuaggaaggaaagggaaaaggaaacugcuggugccaggagcgcgguuuccaucagauuccagagcuggcgggacaggcugggguuggggguuggggagggggggcguuguugagucugcgggaccggaucccgccgccgcgcccaggccgccacgucuagacagcacugaccggcggccaggguggccgguaccuacgguggaucuaggggugcuuaccguacuggaaguaaccggugccguauccaggucgguuccugcucccgggccggggccucucauacgugucauaguaguuauaauagggguugucgucggaguacuuguagggauuguaggggucgucgcccaccaugcgaucuauguggcuggguggccucagauuacugagcugcggaggcuguggcgaugcaguccgguucgccgcgcgccgugaggcuccaucgcgagcccccgacggcgagaaaccagcuuggaaccaguggcgggcggcgggccggggacgacccgcggcgaccccagacgggcuuggcguccucgcacggguagaggcggugcgguugucacgcagcagaagaaugggcgugcgcggcugcgaggcugcgucgccgucgggucuccgggcaguggcacuggggucgcggcgucgcugaggcugguacugcgccccgaggcucagcagacugaacaccugcccguuguucucccauuggauugucuggcgccaggcaccaggggcggcgggcggcucgcgcggggucugcggggcgcagcggagaaggggacaaagcugcaguggccccagaaggagcacagcccaggcgaaacgcauggugcucccggcucgucccuucucggggaggacguggcuaggagaaaaaggaagaccgggacucagaucccacgaaggagggagaccucuccgagcagggaggagaagggcgaggcgcggggaugggucgcagggagucgugccagggcgaacagcagacccugcccccagcccaggcugccgucggacguggcacgguccuccucuccccuuucccagcccuggaaggcgacggggagcugcgcacgaaggucugggaaagcgcacagagucuggaguagaaggaggaggagagauuuuaaacuuucugaccaguuugcaguuacacaagccguucuggccccgcugccccuccgcuauuuguucacguaaugugauuggaaacgugcaaggcggacagcuccuccacgcugccccucccuccccuccccgccccccuccccuccuccccagacacguugcacagggagaguuaaggggaaagaacaaaacggaacacacauccugagacacacucgacuuaaucugggccgaacaug

SEQ ID NO: 8924 - RNA, 72988 nt, Mus musculus
uguauugucuggcuugaccuccuacuccaagcacugcuucuguuauccuauucauuuuggcagaggacuccacaggaaauugaucugagaaaaugauaucauugagaccguuuggaacccagcagccauuaaaugggaaguccuagaaaggaauuuuuuuauuucuaagaguuuuuuguuugguuugguuugguuuuuaguuguguuuauaugcgcacacggcagcguucacggcauuuauguggcugucagaaaacagccugcagagcaggugaguucucucugucccuguuugugggucccugggcuggcaggcuugaugcaaacaccuuuaccaaugagucaucucagugggcucugugcagauuuguucugguuguuugauuuuuguuuguuugcgcugauugguuaguugacuuuugaaacuaggucuuacucugaaacucaggccggcuccaaacuuacaacccucuuucucagugccuggcauuauagggaugaacuacugcacccugaugguguggaacguuuugcucucucuuuaaaacacuagaauuuauacuuuaaucccaacacucacuugggaggcagaggcaggcagauaucugugaguuugaggcagucugaucuacauaucuacagccagggcuacauagagaaucccuguuucaaaaaaaaaaaaaaaucaaacaaauacccccaucuuaguuagggcuucauugcuaugaagagacaccauaaccaaggcaacacuuauaaauaaaggcaaacauuuagcugggguuggcuuacaguuucaguucauuaucaucauguuggggagcauggcaguaugcaggcagacaugugcuagagaagccaagaguuacacaucuugaucagaagacagcuaggagacugucuucugcaggcagccaggagaaugaaauuccacacuggguggagcuucagcauagaugccucaaagcccacccccaccgagacacacuuccuucaauaagaccacacccacuccaacaaggccacaccuacuaauuaguaccacuaccccuaggccaagcauuuaaacacaagauuauguaggggccaaaucuauucaacccccuacucccaaauuaggaucuaaucagaccuuuagguuuucuucuccauuuguaagagacuggggggaggggggugaagaauggaguguagggacagaugcaccccaccgugggcuagcaaguagcuggguccagaauggaacaaucugaugaacaagaucuaauuuccucuaccaguaaacagucugggcacagagaauauagauuaaaagagauuugacagcuguuacacacacuaaugauucacagacauccuuuucauagaaauguuucuuuuaaacaguugugaaauuuucaguuagauaaagucauuguggguagguauguguuuuaacaaacgggucuuuaucucuuacuauuauuacauucugagguauuugcagucaaaaagcgaugguguuuaaaaccauccaaugaaaauagccaaucauggaugacaugagacuggcaagaagcugagggucuuugacauugguucaugaguuauagucgccccccccugcccccgccacuucuuaauucugaauguuuggagauaccucuaguuuuaaggucccaagcacuugggauuagucacagcaacuagugucucauaagguacccaaagaggggcuucgagauacuuagcuguucuuggcacauauggcuucugaaguugugguuuuuacacuuccaagaacuguuaaguuuagcuggagggaagacagccaaaaugcagcagaaggguggggcauuggggaaguugauugagaaucgcuugcaaaagcuugccuguagacucccaguagugucuuccaggaaaagaggaagaaggaguagaaaggaaagaaaaauccugaaugggcaggagggcacauccuccaauaaucuacaucugcuuccugucaaauugccaccauauccuguguaacuuccuugccuggguacacuuuauuuucacauuugaccaaauaucuuuuuuaugauaagauuuuuuucuuauauguuuaagauuuguuuaagauuuaaauguuagagagggcaauugcgugucugaauuaaccauugugacaguggagcuauuggccucgauagcagauaggagagagucaauuuuuuuuuuaugagucuugcccuuaguggauugaccucccuccaaugaaacccacacaugcaggaauaacuauccagaauaaacuauauugaugauuuauaguuggguggguagggaagggaguaugucucccagaagaguugggagaaagggaugaauaugaucagcacacacuguacaaaagaacuaauaaaaaagugagaaaaaaauacucuaaaaagaauccugagaaggcagagcaggaucagaugauaauaguuucucuuacucuuccuuccaaucuuuauuucucaaucuguuuuaacacuauuagccaggcaguggugguacacgccuuuaaucucagcacucuggaggcagaggcagacaaucuugucuauagagggaguucugagacagcugggguuacacagagaaacccuguaucaacaaaacaaaauagaacacaaauuuguguguguguguguauacauuauguauauguauuaauuuuuuuaaggacaaggacuuauguaguccagucugccuuuaagcuccauaucuugccaaaaugaccauaacuucugaucaucaugucucuaucuccaaaugcuugacugacagaugugggccacagguguauguugugcuggguaugcaaccagggcuuccaacuucuagguaagcacuguaccuacaccauugcagcccugguuccuaacaguguuuuaaagugugugguaaaggaaugugugaaaacugcugugcaaauucaaguguuaauuaaaaggauaaaucacagaucacaaaagaaaaugagaaaagacuucaaagucccauacccauauuuuaauccucaaauauaaaagcuauuucauuaaguagaucagacuggccaccauagccaguucaaaauuucaguuuguauaacuuagauggccaacuaugaagaauauauaaaaauaguucauuguauauauuuuggugaugugugguuacaggcuuauacacuuauacagccaugauguccuuucugucucugugugugugcacauguguguguguguguauguguguguacgcuugcgugugugcauacugauucaucuguauagccacagaugaccuuauauuccucucccucucccucucccuauccccuucccucuucucccucuccaucucuguagcucagaguguucuaaaauugcuauacagacuagagauaugucugucucugccuccuaugugcugggauuaaagacauuugccacuaugcccgccucaucaauuucuuucuucaggaucuuaacauuuuuauuauauagaucuuuuaguuucuugguuagaguucucccaaaauauuuuugggaccauuucugacuucuuuucuauuuaauugaagguuuaaagcuuuaagucacauaaaacagauggauuguguucucacuauuuuaaagaauguaaaaaaaaugguaauaacaaggcuagacuuauuuuaauaaggcaagccuauuaccucagcaccugguaggugaaaagcacugagacugugaauauaggguugucuggggcuauacagaguaauccuauacagacauauaugcagacacacacacagacccacacacacacacacacacacacacacagagagagagagagagagagagagagagagagagagagaggagagggagagggagagccuauaacaaaucaacaacaauaaacuacauauucaaugcaauccccaucaaaauuccaacacaauuauucacaaaaauuuuuuuuaaaucuucaaauucauauggaaacagacacaaaaaaauuagcuaaagcaaucuugaauaagcaauaauaaaacugcugcagguauugaaagaccccgagaggagccccucacucaggccucaggacaauagcagacacccaagaauucacgagagaccaagcuugaugcaaaccacaugaggcuuuauucugggaaagccagagcucuggggacgacucauaucccaugcagggguagaggagucgaccucgagggggaaggggucccaguuuuuauaggcccucaggggggaaaggagaagggggggaguagggaauuuccagaucuaaacaaugucuauucucaagaaauggguaugggagggguacaaggaaagagucuggugcagguguagcaacucaggauuggcccggcugugguugcuggggagauuuuccaacucuuucccagcaagcaauaucacaaacaccuggcaaugggcuucaucagugggcacacacauggguucaaggaacggucaaaacauuggcagacacacggguucaaggaguggucagagcauugugcaccucuauuuuuuuaaaucagugaagcuaguucugcuaacagugaaaucuauuuugccaauuucagggcuucugugaccuuuuauauucugucaggaucuuucaguauuacuaucccagauuucaaguugaacuacagagcuacagugauaaaaacagcaugguguuggcacaaaacagucaugugaucaacggaacugacauaauuccaaaugcuuauauaugccuguuuuaaauaaagaaacuacaaauacacaguggggaaaauauagcaucuucaacaaaugaugcuggucaaauauggcugaguguagaaugaaaauugauccacaucuuucacccugcacaacacucaacuucaaauggaucaagauccucaacauaauaccagauguccugaaucugauagaugagaaaauggggaguagaggugaccugauuggcacaggaauggacuuucugaacaagacacugauagcacaggcacuaagaugaacaauuaauaaacaggaccucauggagcugagaaucuucuuacagcgaagcagcagccuacagaaugagagcagaucuuuaccaauuguauaacugauaggggguuaguaucuacauauaaaguaucuauauauauaaagaacuaaacaacugaacaucaagaaaauaaguggcccauuuuaaaaaaacaggacacagaacugagcagacaguucucaaaagucgaaacagauggcugagaaaacacuuagacguucaacaccccuagccaucagggaaaugcaaaugaaaacuacucgagaugucaucuuaccccuguuagagugaccaagauuaauaaaaaacaaacggcagcacaugcugauuagcauguugagaaaggggaaacauuuauuucuugcuggugagaauggaaacucauacggucauuguggaaaccagugugguaguuccucaggaagcaagguauuaauuuacuccaagacccagcuauaccacuucacucaguugcuuuuucauagccaugaagagacaccaugaccaaagcaacuuauaaaagaaaacuucuaacaaggggagccucaguuccagaggguuaaaggucacgacaguaugauaagauaaggagcauaucagcaggaagacaggcacggcaggaagcaguugcugagagcuugcaucuccugucuagaaacaggaaacagagagaguucccugggaaugauguggguuuuuaaauccucaaagccuaccuuaaaugauacaccuccuccuacaagaccacaccuccuaauccuucccaaacaguuccaccaacugaggaccaaauguuaugggggucauucucauucaaaccauugcaucacucuuggguauauacccaaaagagucuacaucugucuguggagauacuugcucaucccuguuuauugcugcuguauucguaauuguauuaggguucucuagagucacagaacuuauggauauucucuauauaguaaaggaauuuauugaugacuaacagucugcagcccaauucccaacaaugguucaguaguagcugugaauggaaguccagggaucuagcaguuacucagucucacacagcaagcaggcaaaggagcaagagcaagauucccuucuuccaauguccuuauauugucuccagcauaagguguagcccagauuaaagguguguuccaccacaccuuuaauagcagaugaccuugaacucagagauuuaaucuucuggaauccauagccacuaugccucaagaucuccauaccaagauccagaucagaaacuucuaucuccaagccuccagauaagggucacuggugagccuuccaauucuggauuguaguucauuccaaauauagucaaguugacaaccaggaauagccacuacauuaauacucaggaacuaaaaacaaucuagauguucaaaggacaaugugggcuuuuaagagaaauuaaauuaagaaaugugcagguaaauaaauggagcuaggaaaaaagucauccugacccccaaaagacaauguuguauguguucucuuauauguggauguuggcuuuuaagcuuucaaaacaugcgcuacagucugaauaacuacagagguugauaaucgaguaaggagaagguggaagagagagguucuccuaggaaaaggaacauagaauauaguuagcauuucggaaagauggagggaaaccauaauaggauuaaauagagaagggaugagacagaaggauaaagggaguaaugcagaagggauaaccaacacuaaaaggcauuuuaaaccuaguacuguuccuaaaauauauacacauaggaaaggaaucuaaagggaaacagcaaauaacauaggagaugaugcucuagcuaaacagcuuaucccccccccccccccccccgcaagugaaaccuccaguugccaguaaaggguuauuucuuguugagucauugaccagaggaguuccaugagacaaccccacccccaccccauccucccaaaaucacaggguauugcuaggacuaugaguugcucuccacaaccugauggucaggcccuguggcugaggauaaucaacauggagaagcggagcugggucugaacuagaagcuuuacccugcugacuggcaucuguggugcuggcagguagucucccagcugcagacugugcaacccacaauacccuuacguucugcugagugccuuuuucuuagcccuugugcuuaagcccauauucaaguaacuuuacuaaaccuaacuuggcuucauuauuauuuuuauguuuuaaagaaagcauucaaggucauccuaggcuacagaaccaguucaccuccagacucuugugucaaaaaaauauuuuaaaucugagaacacccaaacaccaagucccuauacuugaaggccuuguaacaaaacacuuaacgguguggagucucgggcaagccucugcacugaacuggucacugaccaaacagcauccuuaaacaaagagggcuuuaaccagggacucauagguucacuuuauucccuguucugcuacucucucagucuuauaaauuuaaauguaugauuugugcacucuguuuggaaccuggucaguggcagauuuaacggaagaucaauaaaggaaggaaaaaggugccugaaaacucuagaacuuaauguuuuaaauguugaccuaaggaaaucagacagggcaucuaggagcguggcauauaccuuaaagggcaauuagcauuccaugcagcuuuuaugaaguggcugcuuccuuuaacuagauauagugcuuucaugcaacaguguaauaauccucaaaguaguaaaacuaaaugccuaccuuauugauuaacuaucaaaaauaucaucauauuuuaccuuucucauaaaauauguucuaaaaauuuauuaggacauuaauauaugaguuuaccucgcuggugggaugaacuaugaauaccaaacaaaugcucccuuuggacuuuucaaagguggcauucuggagccagaggugguggcucaugccuguacucucagugcuuaagaggucgaggucuguuaggguuacauagugaguucgaggcuagccucagaaacuuugucucaaccaaaagaaaaaagaggggaaauaggagaaggaauggaaaagguguguuguguguguguauauacaguaacuuacaguaauuuccauaaauaagaauuuaucuuuguucacauaagcacuuaauucuauuucuaacacaguuguucucaaccugugagucuugaccccucugggaggccuacugagcauuucacagggguaaccuaaugccguugaaaaacacaaauauuuauauuaugauucauaacuauagcauaauuacaauuaugaaguagcgaugagcauacuuuuguggcuggcagucaccacaaccugcggaacuauauuaaagggucacagcauuaggaaggucgagaaccacuguucuagaguuuuaaaauaccaucucuucuuuaugauccuuaaacaucuugaaagaagccgggcgugguggcgcacgccuuuaaucccagcacucgggaggcagaggcuggcggauuucugaauucgaagccaaccucgucuacaaagugaguuccaggacagccagggcuauacagagaaacccugucucaaauaaaacaaaacaaaacaaaaaagucuugaaagaaacagcacaaauauaaauuaacuucuaguguuguggccuauaccuauaaucccagcauuugagagagcaaagccagccugaguuacauaggauggcccuaccucaaaaaacuaaaagcaaacaaaacuacagauauuaggugaaucuuguucuuuuucauuucuggauauauauaauuaaacauuauuaagcuguagcucagugauagaguuuuugccuggaagguaugggguccuggauuggauccccaacacugccauaaguaaauagccagaugcgcugcugacuguguagcuauuugccucuguugccuaaaucaauguucuaagacacacugauucuagaauaauuaaaauguaauugucugcuucaaaaaacauucauuuagucagaugugguggccccuaucuaucaucccagcauuuggaagguggaggcagaagacucaagaguucauagccagcaucagauacacagcaaauuccaggcuggccuggacuaucugagacccugucucaaaaaccaaccaaagaaacaaacaaaaccauucuugcuuauuuuucccaguaaauuucuauauuauuaguaaauguuuuaaaaaaucaugucauuaaucuuagcacacuaauaagcacucacaauuuuuuuuaaucuauuuccuucacuggaggcuuuuauuucuucauuuacaugauuuuaauguaaacaaaacagaccaaaguuccugcucugauggggcuuccacgcuguugcuauuagugagacaaaccucagauaguuccaugggccucaaacaaaagcauuuuaacauagguaauaguaauuugguucuuguuuauuguuuauuuucauugcauaugcguguaugugguacaugucuguaugcgcaugcaugugcucucguguagcccagacugcccugaguuugcuaugugacuacugugguucgaaugagaaauguccccaugagcucuuauauuggaacacuuugaguguggggcuguuuagagagacuauggaaccuuuaggaaggaaauagcuuacugggguggggcuucaagguuuuauagucuggcuccacucccuauuuucucucacucuaccuuucaaggaaguccuucacucuuuaaucaagcgaucaaauaagcuggauuuagagguaaagugaaucauaaauuuguuaacuauuuuaaugcccccaucaacuuaauaaguuuuaauuuaaaauaauaaauauaaggccaggcaugguggcuaauuccucuaauuccaguacuuuggaggcagagaccagcgggucagaaugucaagguuacccucagcuacauagugagugugagaucagccugugaugagaccugucucaaaugcagacacacacacacacaauuacacacacacacacacacacacacacacacacacaauuaugcacucacauaugggguaggaaagaagagagagagaaugaaugcuggggaacaucuguaauacaagggcaugagagcugaggcaggaggaucacagguccagacuagccuuaucucucuguuauuuuguuuuuuguuuuguuuuguuuuguuaaguuaauuagccuggugguagcacauacucuuaguuccaggucucaggaggaagaggcaggcagaucucuuaggcaauuaggcuagccagggaaaauguaagcucccacccaguaugguugauggugaaauagcuucagcacuguaguucccaaaugcccuguaauuuuuagagagaguucucuaauaugagggcucugaccauagugaguagaguaggggauuaagauuauuauuuggguacuaaagaaaaaaguguauagacaugguggcacagaacuacugcuacugcuacugcuacacacacauacacacacacacacacacacacacacacacacacacacacacacacauacaaggugaccccagaaagacugaagggcugggugacaaagucuugaguuaaagaaggauuuagucacauggaguauuuuaaagagagaacaguauucaggaaaagcgaugauggauuacugcccccuccccccagcuguucccacaucugcauccuugucuacaguauacaagucggcugagcugcaggauucuacaauuaaccagcagcuacucagcaccucggccaacugggagagacuucuagauccccuuuuuucugccaugaaaggccacuucagccccuuauauccugaaggaggaagugagucacccagcugcaguagcaccaaguucuccugaacccuuucgauggccccgagaauucuuauuucagggauucugaggauguaggucuacuucaucaggccuauuuguuugacuuaauaccucacugaugugacuuuauuucaagacauaaaaagaagaguuuaugugggcugugcuccggcccaccaccaaacacguggcgucugaugauagcugacaaauccagugacagagaggaaaaaggaggagggaugaacuaacugggcauccaucacaacucagaaaguagacuucauuucgcacuuuaguaaugauucauuggccccuuugucucuaaaccaggccauuuggucucagcguuuugauccuauaaguuacauaaacauauuuuugaggaaucgggucaccacacauauuuuuauuuucuccugucagcaguugcuuuacugcaaaagaagaagcccaaggugagaugccacugugcccugugccacugugcucuggcuucugggagcucuuuccuuccauccaucauggucuacuggcacuugucuccagcuacucccucgcccugaaagccucuaaggucccacagaguaaucaguguaccugggugaaaagggaccaaaaaaagcaaaacaaaacugugaguggcagugagcaacuucuccccuuaaccccagcaagcagucaaauuuaccacaacuucaaucuugcugacauuuuauagcaugcucagcgggguggggcuggggguggggguggggguggggguuacugcuguagacagagcugacaaacuacuuuugucugcuucacaacuauugggggggaauaaagugggggaggagguggauggacaacgaugugaauuuggagccaagggaagauugaacagagcuauaguaacaagugugugccaugcuuucaacuugcuggguagcaaaagauggccuugaguuccugaucuuccugccucugccucuggaaugcuggccuuauagguuuaagccaccacaacagacugagauuuuuguuguuguuuuuaacacaguggugacacacacagcuuucuauuucaaauguuuuaagauggguucucccccgcccuuguuacuauguaauuaugaaccauaugugaacucaacugacuuaaugugguaguguggguuaaauuauucauaauguugguguccugacccucaguugcucagaauguggagaaagggucuuuacaagagggaagaaaguagcugggcgugguggcgcaugccuuuaaucccagcacucgggaggcagaggcagguggauuucugaguucgaggccagccuggucuacagagugaguuccaggacagccaggcuacacaaagcaagcucagugugacagugugacaggcaacaggaaugggguccauuuuucccagcacugaagauuggaguugaaguauaugcacaaggcaagcucucugacacagagcuauauccccagaccugguauuuuuauuaaaaaaggggaagugcagugucagcaagccgguucacuccauaaagaacuugcaaucaagccugaagaccaaucuccaaaccucccaugauagaauggcagacugacccuugaaaguuguccccuaacuuuccugugugugccauggcacauaugugcguacacacacacacacacacacacacacacacacacacacacacaaaaugaauaaauauaugggaggguuauaaggaauauguccaagugaaugugaagguaaguaucuaaaugccaaggaauaagucaggauagauucauccauuggggaccucagaagaacacagcaucuguuugagacaaggaaagguucagguuggacucaaacucaugaagcucccuucagccucuggaaugcuggcacagucacuuccuaccaagugucuuggucugaccuuucuagcccgcgaaacugagagaagacaaaccucugccauugggggcacccagugcguggugcuuguuauagaaggacuagaaaaccaaccgcgaagggaaaacaagaaaguuuuuuuuccucccauuuucaguccaaguuaaaacuggcugaguuucuguucuguaauugcaagcuccaguguugcagaaacaaagcagguaaugauaggacuagaucuagccagucagacucggcaggauucccggaggggacaggacaagcuggaaaguaaacaguagccagcucuggccagcuucagugacgacauacuggccuaguauuacccaagggucugaucuuggagaaaacuccaaaauguaggguuuuguuuguuuguuaacauaaaauuuuccccccauuuaaaguauaacaacuaguuuuaauauauauacuauuguccuggccaaugccaugaguccaaauaaaaucugaggccugacccaguccacucccuaauguaacucaagguacaaaggaggcugucagagaauuccauccaugcuuuuagguggggcucugugacuaauucuggccaauggaaugugacugauggaaaggaaaucagauacugcuaugucaggacuggcacaggugggucaggcaccuucuuacugcucugccuuuucagaacagccuugcaggaauauaaugaccuucuccacuuagggagucagauggcguuugacaaaggcaagaacuugaaggguggagacaauagcaguuuaucacaucgaggauaacucucuuuuacccuagcccaacggaaagaauaagaaaggggugagggugggugguguuaucuugugcuagauaaucagaguuccugguuccacucuccgauccucuggcccaagaacuaaggguagcaucugcucgugacuuuuugcuggcucaguccccaggcagcgcgcagaaucagugaggaacaaauugguuuugacuacagacaggcucuugagauagcuuacaaacccauuaauccacuaaucauaugaauguguuaguucauuuaugaaagcagggcggggacaaaccagguuaaagucauagcacugaggucagaucuccaguucuauugaugaagggcacacaggaagccgguaagagacacgaagcaauugucccuuaccugacgacauuuuggaagacucugauaccuucuccauguuccuucccugcacaggcuuucacuggguggauagucacccgugacuaacaguccguuugccuuaggcauauuuuugcggccacuggagcguguauaaaaaaauaaccacgugccagagaggugaggaguguacaccuuugaucccagcccucaggaggcagagucaggaggaucuuuguaaguucaaggccaauccagucuacagagugaguuccaggauagccagggcuacacagagaaacccugucucaaaaaaaaaaaaaaaaaaaaaaaaaaaaaaaaaaaaaaaacaaccaaaagaacuaggaaaaaaaaaugauuacuagcaaaacuugccacuucuuucuuuucuauagaaaauuauuuccucaacauaauuauuauuaaaaugcugacugcauguuauaauacauaguuuuacuucuaacaccuaggaguaaaguucuacaacuuaaggggauaguaacuuuauuaaaaauaagccuuuucgcggggcaugguggugcuugccuuuaaucccagcacucaggaggcagaggcagguggauuucugaguuugaggccagccuggucuacaaagugaguuccaggacagccagggcuauacagagaaacccugucuggaaaaaacaaacaaacaaacaaacaacaacaacaaaaccuuuucuucuucuuuuuaaaaaaugcuugagaguaccuuuuaacuugaacuuugagaucuuucgaaacuccuguuuuugccuacauauaaacccuugggccuuguggcugagcugaauacauauuaacuuccgguagccucuuuaucuggugucuguuacagcugaaagaguuuaugcccaucuaguuugagcugcccugaagcucugagcugacuaucucccgaccugcucucuacuaucauuuuucccucagacccuccuucaacaagccuuaucucauuaaacuucccaguuuucaacguguuuauguuucuacuuagcgcuacauauuaggaaagugaauucccugaaggcaacaaucauaaguguguguguguauauauauauauauauauauauauauauauauauauauauauaugugugugugugugugugugugugugugugugugugugugugugugugugugugcaugugugcguguguauguauauauauauauguauauauguauauauauauauaugugugugugugcauguguauaugugugugugcauguuuacauauacauauaugucuguguauauaugugugaauguguguauauauauacauauauacauauauacauguauauguauauauauguguguauauauaaauacauaguuuuuuauauuuuauauauguaucuauaugcccuauaaccuuuuguguguauuuuaccuauaucuuuuaaaauuaaugauaucuaaauguaaugauuuauuguguuauccaugccucugucaaaaauaagucuuuauugaauaugguagugcauuccuguaauuucagaucuugggagacuggggcaagaaaaauguuaaguuuaaggccauccuuaacacauccuuauacaguugacaccugucuccggggugggguugggagcggggaaauagcaacaacaaaaaacaagcugaaugucuuuuuuuuuuuuaauaagauaaguuaauuacuguaagcacuggcauauauaaagauagaaacugcuucugccuugcacaucaauauuuauuggugaauuugggguuuuuauuuuuagauuuggcaaaacaaagugcuuuaaagaauuggauucuaacuugggcgcuggugagaugucuuagcagguaaaguaagagcgcuugcugccgauccugaugaccuuagcucgagucucagaacacaucugauagaaaaggagaaacaauggacugucagcaaguuguccucugguuucugcaugagugccgcgguccaucuguguccauagucccaccccucauacaagcacacaaauaaauauuggagcuggagagaggacuuagccauugaaggcuaggcucacaaccaaaacuauauauuuuuuuaaaauguuuuuuaaaauguaaaacauuggcugcuaggcaagcauucagcuaauugagcuaaccuuuaaacaauaaggcccuaagccaaguaauugcaguacccaagaaguagaggcaagaggaugcucugaguucaaagccagucuuuugcauaauagcaaguucuaggccagccagugcuacauaccuagauuuugccuuacugucaucccacugcagucccgugaccaugccaugauaaagcagguaacauagauguuacccaaaggaagaauucgugggggucggggagggguggacaauaagauguuccaggaacaugggaugaacaucuaguuuuauuucuguagacuuuucuucugcugcuggaaaccuuccuuuauucuuuaaacauguucuugaauagacugaauuuuccauaacuguaggcaaucuuuaccugcaauguaacucaagaaacuugauaguacucaucucauccaguugaauaaauccucuggucagagauuuuauguuugcuggguaacucuucuuuguucuguacguaugaugaccaugucuuggcuguuuguaaguuugaaauuuaaguuagcuauccucccaacauucuuucuuuucuuuccuuuucuagagcaaaguugagaguuuauugagaacaguuuguuuuguuuuguuuuuuuaaacucagucaucuauaguacgaguucaugaaacauuuauucugugccaagcuuuaauuacaugcaauuugcuuuuuagagaauggggagagggcaaagcuaggugguucagcggguauaggcauuggccacugagccugagcaacugagucuggucccuggggcucucaguagaaggaggggaggucccaaaauuugucgucugaucucuacacauguaccaucaccuuaccccguagguguacuuacccugccccaacaaaauaauuaaguaaauggaaaaacaaacaccaguuuguagcauauacauaccaucaagccugaagacccaaguucuaucccugguaccugugucauggaaacagagaacugacucucacagagggucucugaccucuguguguguaccugcacauguacacuaacccaucacaagcuaaaacaaauagauacaugcaauuguuaaaagaugagccuacgucgggcaugguggcacacgccuuuaaucccagcacucaggaggcagaggcagguggauuucugaguuugaggccagccuggucuauagagugaguuccaggacagccagggcuacacagagaaacccugucucaaaaaaccaaaaagaaaaaaaaaaugagucuauauaaaucacagauuucauuauaauuuccccaugcauauggcacuguccuucguccacauuucccugucuuuucuugcauuuucuucccaauggucugugaccugcacccaaaaaucaucgucugcuuucaaaucacaucagcauauaugcuaaaucuagauucugcaugacagaaaggaugcaacuuuugucucccuuuuuaucuucucuuguuucuuuccaucucccuuuaaaaucccuuccuuuucccauagagccccccccccuuuuacaaacacacuuacacacuccguccuuucaauauagacuguagaagagaagaaacauacuuaucuucagagucuuggcuuagcuugauaaaaaauucuccacuuccauucuuuuuuccuacaaaucacauaauuucauucuccuuuacagaugaauagaacauguaacacagguuuuucuuuuuuguuuguuuguuugcuugcuuguuugagacagggacucucuguguagcccugucugucugggaccucgcucugcagaccaggcuguccucaaugcacaugccuccgccucccgagugcuaagguuaaaugcagguguggccaccaccuggcucuaacacacuuucuuuauccauuugugcuggugaucagcaggcuugguuucacggcuuuggauauugugaauaguaaacauugaauuacugcaguaaacauugaaucggcaauucaagaaucucugugaugcugacuugauuccuucaaguauauuuucauaaagacaaaaaacaaaacaaaacaagcuauucgggaauaagccaaacaagugaagugacugucuucuaaaaugaaaacuuuagggcuggcaagguggcugguaacaacauuuggcacagaagcuuagccacuacuaccacagccaccacugccaccaccacccucagaacacccuaagaagcuggaugugguggcauggaacuguaaucucaacaucccuacacuucaccgagaugggagucagaaucuggaggauccgcugccauauugcaggucgguuagacuggaguauucagaaggacaggaacaaccagagagucuuugaaugagaaaugacugucguagucucauguuauuugaagccuugguccccagcuuguaucacuguuugaggauguuauggaaccauuagcaggaagagcuuuguuggaggagacauacuacuugggggaugcuuuacgguuuuacagcuugguccacuuccuguuuccuccaucccuuccucuucuuucucuguguggauggauguauguaaugugaucgcucugcuuccugaaugauagacuggauucacauguuuacuuccaugcuuuccucaugaugagagacuccaucuuucuagaacggaagccagaauaaacccuuucuuccccguguugccuuugacuauguguuuuaucucagcaaugggagaguaauuaauacagcugucucagacccuauagaauaaugaugacagagacuuuaaaaacauuuaauauaauggauacccaggugagacaugguuuuuauuguuaaaagcuuauccagagaaaggauagggguuauacugaaauucagaauacccaguguaagacacuagccaggaaaugaggauguggagaaagaggaacacuccuccauuguugguaagauugcaaacuuguaccacucuggaaaucagucuugcgguuccucagaaaauuggacauaguacuaccggaggauuccgaaauaccucuccugggcauauauccagaagauguuccaacugguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauuuaugaaauuccuaggcaaaugguuggaccuggagggcaucauccugagugagguaacacaaucacaaaagaacucaaaugauauguacucacugauaaauggauauuagcccagaaacuuaguauacccgagauauaagagacaauuuguaaaacacauaaaacugaagaagaacgaagaccaaauuguggacacuuugccccuucuuagaauuggaaacaaucacccauggaaggaguuacaaaguuuggagcugagauaaaaggauggaccaucuagagacugccauauccagggauccauaccauaauuagccuccaaacaaugacaccauugcauacacuagcaagcguuugcugcaaggacccugauauagcugucucuugugagacuaggccagggccuagcaaacacagaaguggaugcucacagucagcuauuggauggaacacaggaccccccaauggaggagcuagagaaaguaaccaaggagcuaaagagaucugcaacccuguagguacaacaacauuaugaacuaaccaguaccccggagcucuuggcucuagcugcauauguaucaaaagauggcccagucggccaucacuggaaagagaggcccauuggacuugcaaacuuuauaugccucaguaccggggaaugccagggccaagaagugggaguggguggggaggggagaggggaggggaggggggaacuuuugggguagcauuugaaauguaaaugaagaaaauaccuaguaaacaaaaaaaaauuuuuuuuaaaaacaaaaaagacacuagccaggaaagaaagacuuucuauugucuuaaaccuauguuugagcagucuucucuggugaauauuccacagcacuaaaagagaaaggaagaaaaagaaaagaaaagaaaagaaaagaaaagagaagagaagagaagagaagagaagagaagagaagagaagagaagagaagagaagagaagauuugccacgcucauggauugacaaaauuaauauugugaaaauguguaucagccaggguuauuuagagggagagaauugauagaaugaaucuauaucucuagaaaggggauuuauuagaguggguuauaggcugugguccagcuucuccaacaauagccaucuaccaacagaaaguucuauaguuauucaguucaugagguuggaugucucagcuggucuucaguauaugccagaauccugaagaaauaggcucuaaugcaaugaaggaaugggcuugcuugugagagugaggacaaacaggcagagagcaaauuuccucuuccuauguucuuuauuuacauaggcugauaagagaagauguagcccagacuaaagguugaucuucccauuucaaaugauuuaauuaauaaaaaucucucacagguguuuggguuuuaguuaauuccagauguacucaaguuaacaaccaagaauagccaucacaaaauugccaggacaguguacaaaugcaaucuaagucucaucaaaauuccaacugagaaaggauugguaaaauuaagagaacgugaaaagagagaggggacuucacccuaaucuggcugagcucuuugagcagcuaaaagucaagaauuccaggacaacuaauauuuguuaugaaauuuaccuaaagaaacagccuuucuuuuauauagagauauuucaaauaaaaaugcucauacgccagauggagagauggcucaguguuugagagcacuugcuucuccugcagaugaccuggauucaguucccaaaacuuacaugacggcucacagccauccaugacuccaguucuggggaaccaauacccuuuucugacuccagcagaaaccaguagggcaugugguacacaaacacacacucaggcaaagcauccauaaaggauucaacaaaagggagcauucaaagcauucauaaagggagugaaauuuaaagaugauaaagaaaacaaaaaccacaguugcuuuuaaaaaaaaaaaagaaggaauguuaauauaucaaugaacuacuuuuuuguuguuguuguuuuguuuuguuuuuuucgagacaggguuucucuguauagcccuggcuguacuggaacucacucuguagaccaggcuagcuucaaacucagaaaucugccugccucugccucccaagugcugagauuaaaggcgugcaccaccaugccuggcuugaacuacauuuuaaaacugcuaauguaugaccaagaauggccuuccuccucuccaguuguaaauugaauaucuucaaggacuauuguaagcaaacauauaaagcccauuguuucugccuauguuuuugugacccaugggucucacagaucagauuguaacccuaccuaaaacaccucuggaaucacacuaugaacucuucuuccagaaaacacaguccuaugauguguaacuccacaugccacugaaaucaucuagauggcuuuugggaagacauuuacagucgucucucucuugagaagucgauucuuuuccugagacucuuuguuuaccccacacucuagucaguguuaaaaucucucccuaaacuuuaacucuacuucauaaugguucaucuugagcuguuuuuggagcauccagggauuccagcuucacuuacauagagaucucugaaggaaauucucaggugucugcaguuggguagcauagggcugcuguggugacuugaauugcaacgguuccaugggcucauauauuuggauguuuggucauuagagagaggugauaacaugacagggauuaggagggcuggacuuguuggaggaugugugucacuggggucaccuuugaggauucagaagcucaagccaaggccaguggcucccucuuucuuccagcuaucugccgaugcagauguuucuagaacucucagcuacugcucuagcaccauaucuaccuucaggccaccaugcuuccugccauuaugacaacagacuaagccucuggacuggaagccagccccaguuaaauuuguuccuuuacaagaaucaccauggucacacugucucuuuaucucaauaaaacccuaagacaggugggucuccagcccuuucccccacuguuucugacacaaggauguucuuuauagaacugaacuacuucuuaaugguauuuggccugcaguuuaggcacaccuaugauuuauucugcacagugugguagaguggauuggacaucgauggagagcuaucaaguuagggaggugauaggaagccaaugggagagcaggauguaaaaagguguaaugaguucauagaagaggcauguuuugguugccuuucuguuguuagaccaaggugucuacagaagaaagaguuuauuggagcuaacagucucagaggguggccuggcagcaagcaaguagauguguuguugaagcaguagcugggagcuuauguguugagacaaugguggcaugggguaaauagagcuaacugggaaugacuugggcuuuuagccucaaaaccuguccccagugagacaucaccuccaacaaggucacagcuccuaauucuucccacacaguuuuaucuacugagggaccaaaauucaaagagaugcgcccaaggacgguauuuucaugcaaaccaccacaaggcacaaccucaucccaggacaguggcgcaugccuguaaccccagcacuugggagauggagguagcagagguagcuuagacagagucacagucccacacugccacccacaagccugaagaguucuuuuaaacuuuuuaggguccuugauucaaguaaagucaagucuuuuuuuaaaaaauaauuauuuauuaugaguacacuguugcugucuucagacacacagaaaaggacgccggaucucauuacagauggcugugagucaccauguguuugcugggaauugaacucaggaccucuggaagagcaguuagugcucuuaacugcugagccaucucuccagcccauaaagucaaaucuuguuuuugccacagaaaagaguuuuagccagcaugaaggagaacugguguuuauuaaaggauuauuacaugcauguauacagagucucaguguguagcccauagcucuuaggcacaaugguuaauagaaaggcacucagguagaaaguaaagacacauucaagaacacccaugggcugcucaaacagagagccaucagcaagugucuuuaaaguagccauauacccuguuugugguggcuucuuaaugucuggaagucauugcugauugaggucacugggguggaguuccucuguguugcauagaauucaguagauaagauaguugggucguaaggccgggggcucaguucgcagcuaagauguuuuugcuguaaauuagggguuuuaucuuguuuaugauaaagagaaaggaaugaggucaccaugggaagggagcagcaccacacuggaaggucacaugcuaucauaccuggcugauuuguuuuuuauucagcccuuggcuaucauaaaaucuaccucuccccagucuaacacuauuuuauggaauggaacggugccugacuuugaagaugaaaauaaggccgacuaggauuuuuaagcuggugaauuacguauuccaggccagcagagccugugcagugagacuguaucuccaaaaaguaacaccaaaggcgggggugggggggaguggggggguguagcuugucuaguugagugauugccuaaugugugagagguccuggauccuacccccagaacuacauaaccugaacacaaagaauguggaggcagggggaucagaaaugcaaaaucaucuucagcuacauauagucaguuugaauccuagggagaaauccaaaaagaaaacagaaaaacaaagcaccaaauuggagagggagcagccaugccuucuguccuaucuagaacuuucccuagacagcaaaauuacuagcauaaagcugccucaagauaggauggagcaauagggucagguuccuucaucuaaggaagcccuuucccucuaaacucagagaugccccuaaagucuguacagggacgggacuuuguccugcaggcuguugcaucuuuccccaccuuuuaugagacagguucucucuguguagcucuggcuguccugaaauucacuaugaaggucaggcuagcuaggaacacacaggcuugccucugccucccaaauguugagguuggcugucugucguaucuucuaucccagacauccccucgcuguaaguggccauuauaacuaaaggaaacuucaccauaaauccaucuugguacaucucuuuguugaacgugaaaaugggguuuaucguuuaaagacauauacauucuaaaauuuuuuauuauaauuuucuuucuuugugagguugggggagcaacuauggugcauguguggaggccagggaucuucugccauguggaucccaagggguucaagucaggucaccaagcuugcauuugcugacuggugugcaccuuaacuacugcaccaucucaagucccucuagguccacaccuacccaacccacagauucuuaccauguggcccagccuugccugaaccagacguccucaagucucagucucccaagugcugggauuuuaggcaugugccacugugaccaauuuaucuuuauuugauuugauuauaugguuucuguuuuuuuuuuuuuuuuuuuuuuuuuuucuucccuuaaauccucauguggucuugggacuggaaaaaaauggcucagguuaugagugcuugcugggaaccuggauuuuacucucaguuccgaaaccaggcagcauuucauucccauaaacuagaagaggucuuagucugaccagaaguugguuuuaugacagaaaagggcugagcaaaaaagaaaucagccagauacaugcauaacccagcgcucuggaggcugaagcgcgggaacugccaguuccagaucaaccucaaaauaaagagguggaugggggacaaacaaaaacaaaacagaaaagaggaaaagcauaggagaagcaaaggagacaaccagacaagagaggacaggacauagaggcgggaagaucaggagaagaguuaaagcccaaacugagcuacuagagacacagaagggacugcgggaggagugaaggagggagggcugguucaccauuuccugccuuagagcugagcucacggucuaacaaucuugaagaacacaaguaaaagaagaaguaugcaaaguguggagaagagagcucuugcagccaggcugagacugaguaccugucugggcuggggguucuuuuauaucucaagaaugggucaguuugguccagcaaggaguugggaugaacaccaagagcuauuuugaaugucuauggggaauucugauuggccaugaacccagguggaagaaagcaaacucagaaaaaaaaaaaaaaaaaaaaaaaacugccaaaaaaaauguccuacaaaaaagugugggggugggaagaagagccgggaguagcaagaacaaugucgagcagucagcugacaucucggugagucaagauggaucuggauauuagcuccugagcucacugguugugcagaguucacuguaaaacuuugcugguagaagcugacuaccggcuuugccaggauauacuuuuuguuuuccuaggagcuguaaucucaaccagcugccuauaaaguggguuuacuuuacuccuuauuccuaucagagguccccaaaagcaaaucauuucaaaguugguacugaugguuccaucagaaaacgcauggauuggcuaacgugaccuuuucucgguucaucauuuuccuuguguaugagcuuugaggccgagauccuuguuugggauccggacgauuuaucaucuuacucgccuucugaacaccccguuagaugguuugguuuuaguuuagggcaaguuggugugagugguuccuccuuugauucagugugacuuguuuguugugcuggagauaauguuacagcugcuaugaccagggcuagguugaucuagggaacggaaucuacacuggccugaguggagaccgcguguuccaagacuccuagaacacaggguuaacccaguugcucuaucaaucauuuggcuaaacagaccaucuuuccggaaacuggcuucaccuaauuccucgcuaaagaaaugggaggaauaauuauuucguugaggagauacuguacuuuucuuucacagacaacuuaguccucugugcaguuaccacagagccagcaccaggcugcguuaaguuggccugauucaaaaggcauaauuuugacuuuuuuuuuucuguguuuuauuuuauuuuucuuuugauguuggucagaguccaauauguuuucuccgguacuuugggauuuuucagcauuucucugaagcuaucuccccagcccccaccuuuguuugccaugcugcaccauucuguaccuaacucaaaaagacacaucuuuccuuccuuccuuccuuccuuccuuccuuccuuccuuccuuccuuccuuccuuccuuccuucuuuccuuccuuccuuccuuccuuccuuccuuccuuccuuccuuccuuccuuccuuccuucuuuuucuucaucucccuccuccaggcaguugcuaaaaguuauagcuuaccuaccuggcacuuuuucuuuuaaagucuaaaugaaauuguccuggagcuaucuucugagucuguucuuggauccuuuuguuaaugugacuuagaaucuuaaugaaguggucaauuaucuuggaaacaaacaucacccugacagggccccccagaauuccuaccagcaacccaguccagagccuugcauaccccaggcaagugcucuaacucuggauuguauccccugcucucuauuuugagcuuuagucuggucuuauccagucuaguauaggaucgcaaucugaggggauguuuuccuggaaauguuauuaaauacaacuuuguguuccggaaaugggcuggccagaaaguuaucacaugguaauuccugauuaugaaagaaaagaaaaaaaguguuuuuauuuauuuauuuauuuauuuauuuuugagacaggguuucuaugugcagcuguggcuauccuagaacucacuauguagaccaggcuggccccauacucagagugcugccugcuucugucuccugaaugcuaggauuaaaggcauacacuacuaugccuggcuuugaguucucucuauucuuguuuacuguuuauuaauauugccuuaauuuauauauauauauauauauauauauauauauagagagagagagagagagagagagagagacggcucaguauuuaaaugcacuuguuucuuuuacagaaguccaggguucgagucccuaugagguaaagucuucauucaaacaaccacagggcauaagccagagagagcaagcccccucgcuggagcucaaacucagaaacaaguagaugacuagcucucaaacuccagccuuacugaaauuaaaugaaacagcucaguuccucacacgagccacauuucaagagcucgggagucccguacaguaucuacuguauugaacaguacaggaagagaacacuuggauugugucagaagguucuuuuggacuccucuggcaacauuugaguguuucuugcccugacuccguguucaaucaaagcucgaagacagacguccaagcucuucuacuuccuaguccuguaguaacaaguauaagauuuuuguacuuugagucuggucagcauguaggcaaggacgccaaaacccagauguggaagcaggaggaucgugaaggggcggggccagcucggagcucuagaaaaagcgcggccccagucgggggcggggccucgcguugggcuggcagccggggacggggcggggccucgggggggcgggcccgaggggcgggccgggaggcgggucggcgcgccagcccagccuugcgugcucacgugacagguccgcgaggccccggcucuugcagacguccaggccaagaggcgaagauggcggccgagagggagccuccuccgcugggggacgugaagcccacagacuuugaggagcuggaggacggagaggaccuguucaccagcaccgucuccacccuugaggugagacggccccccggcgaggaggcccgcgccgugcgucucgccucuccccugccgcgacuugucccuuacccacccaccccuccggguuuggccaggccaggucgggugacaccugugacgccggcugcaccgcaggugccugucaaggggccugaugucggccuaggcggccaggccucgggacggcagccugcgggccugggagccgaucccccaucugcaaggggccaggacccacggacggaagccaaccuacccgugcuugcgggcgggcgggcucucgggccuucccugucacccgcgccucuuccuccaggcaggagcaaggcuugucucggguccccggggccaccuccgcucccccgggauuucagcagcuccgggcugaggugcuuguuucucugccccaccggagggugugcccugccacgggagagccaggaagucgggaagugaacucuuaaguggcuuugaggguccgcagggaggucugggugcgcucgucccuguucgugcccugcguggacaguuaguucgccugcagcuaaagagccucuugguuuugaguaggugaaugcauuggaguuaguuggcuuaggcaggcgcuccugcggugcaggcuggauucgaacucgguauguagcugaggauggcuuugaaccucugaucuucuugccucgcucccauuuccacgugcugagauuggccgacgugagccacggcuuggguuuuuagacuuuguaggggcuguaauguuugagaaguacaaacucgaaggguggaguaguccaggaaacugguuuuuaauuaccaggggagaaauagaaacagaucuccgcuccuuuuuccucuuuucucgcuuggucagcgaucuguguagcugaguguuccuguuuuugucaaaggaaacacugaauuuagcuguguuggcccgccuuuuucuaguuaccuuugaauugcuuuacauugaaugagagcacauacaccggaaaccauaaucuuaagcauguaagcacuuuucucagaagauuguuuaccucagcugauuuuuuaaaauuagguauagugugugugugugugugugugugugugugugugugugcgugcgcgcgcgcgcgcacacacacacuuauaaaaaucaaagaacaacuuuugggaguugguucucuguuuacaccauugucaggcuugguaggcaagccccuuuaccaguuuaaccaucucaccugcccuccacuuucuuauaaaguucuuuaguauuaguuuuguuggcuuguucaagucugcaccaaaucaguuggaaauagcuguaaaauacccauuaucuggauuucagugaccagaaacugaaaacuucgggauaauuuuaucuguaguggugaagccaauucccacuuuccaacagauuauacauuccucagaugauugauuuuugauauauauauauuaagauuuauuuauuuaucauauguaaguacacuguagcugucuucagacacaccagaagagggcgucagaucucauuacggaugguugugagccaccaugugguugcugggauuugaacucaggaccuuggaaaagcugucagugcucuuaccuccugagccgucucgccagcccccguugauauguucuaaacaaaaucuuggauauuugugucuuaauacagcuaauacugguuucauugucaagaccuucaucuccuaaaauaaguuaaaauuacuuuguagaauauauuuuucuaggcagggggaguuagugucuucauaaccuuugauauguuuuuuuuuguuuuguuuuguuuuuuuuuuuaagauuuauuuauuuauuauauguaaguacauuguagcugucuucagacacuccagaagagggagucagaucucauuacagaugguugugagccaccaugugguugcugggauuugaacucuggaccuucggaagagcagucgggugcucuuacccacugagccaucucaccagccccccuuugauauguuuuaugucucugaacauguguugaacaugucugcaggguccuaaaaccugaauugucuuuucuagucacaauacacagaauaagaacuauauccuguaucagagaaagucugcaaaguuuuaguaucuuggccuauauacugugaacauuguaaauaaaguuguuaauugguuguugaucuaaaccccucaucuuauggauucauuuuaggaaagugguguggcugagguuuuuagauucaguuuuuaaaguuucagguuaacauacaagguucauuuuuuuucccccuugaaaauguuugggacacucuaugcaggaugcugugcugucgcuucacucuuccuguacaugauacuucuuaugcuucagugcagaagaaagaccccaguguccaugcacacgggccugcaauucuguaugguuaacaaacacuuccccccccccccccuuuggagaccagaucucucuuuggagccuagauuggcauggaacuaauuccucuugccugagccugagugcuagcauuacaaauuuguaccacaauagccacagggugguggcacaggacuuuagucccagcacgaagaggcagaggcagaggcagaggcagaggcagaggcagaggcagaggcagaggcagaggcaggcugaucucuugaguuugagcccagccugcucuacagagugaguuccaggaccaccagggcuacccaaagaaaacaaaacaaacaaaaaggaacuccuggcuguagaaugguacugugguacuuuucuuuccacuuguucuguaacuagguuggauguggcauuacuagccccagaucagugcuucugacuauagauauaauuuauucgggggucuuauuguuguacauauuauguuucuauaggacaccauagaaucuuauguauuauuccuuuugagacaggcucuccacuguguagcucuggcugaccuggaaauaugcggggugugugugugugugugugugugugugagugagugagagagagagagagagagagaggggcacgagcgcucauagagaaccuccugccucugccuccugagugcugggaaugaaggugugcaccaccaugccuggcccgcuaaccuguuuauugcuugggauguuuguuugguuucuugagugguuuugaguucucuguacuggauaugcauccucugucugguguauaaaggccucccauucuguagccuggcucuuuacccagucaguauguuuccauugccgugcagaagcuuuugaguuucccgaaaucucuugcugaguuguugguggcguuuucugaguuagugggcuccuuuucagaaaguccuugcugugccagcauuuccccuauuucuccucuaacaguuucagcccuuccgggucuuuaaauguauuuggaguugguuuuuguacaaggugagaaauagauauccacguagagagccaaucaugugccccucauauccucaauaaauguuaauuuuuaaaacuguaaaaccagauggcugugguugcaugggauuauagcuaggcccucuguuuauugcauucugcacgugcuuguucugugcuggugcccuguugugcaguagauaacuggaaaccggguguggucgcggcauuccucuuugcuuugcuauccaguuuguuggugcuuccacauggaugucaguguuguuuauauuucugugaagaauguuacuggaguuuuguuagggauugcauugaaccuguucauaacaguaauucuguggagccaggcgugguggcgcaugccuuuaaucccagcacuugggaggcagaggcaggcggauuucugagugcaaggccagccuggucuacagagugaguuccaggacagccagggcuacaccgagaaacccugucuugaaaacaccaaaaaaaaaaaaaaacaaccaguaauucuguggcucugucugugaguguaggaagucaucucguuuccuagugccuucagguuuguuucuuuacuguuuguauuuuuuuuguagcggucuucacuuucuugguuagguuuauucuaagauauguuuauauuuacuuauuuuuagagaauagugauaggauuguuuauuguuucccugauuucuugcuuagcauguuuguuguuauuaguaaauaagaaaacuauugauuuuuguguaucaguuucuccugcauauugcuggaguguuuaacagaaccacaauuuuuugguggagucuuuagggucuauuaaauaaaauuguaucaucuucaaguaaauacaauuugacuuguuugcuacuuguauuccuuucauucauucucuugacuuacuguuccagccaagacuugaagcucuguauugaaugggaauaguaguccuuguggaaaguggauguccuuguuguuccugauauuaauagaaaugcuuuggauuucuuucucuccauuuagugugauauuggcuauagguuuguuauauguagcuuuuauuauguugugauuuuuuuuuuauaguuggucucuuuggguuuuuaucauggaguauuuuauuuaaagccuuuuuuucuucaucucuugaaaugaucaugugauuucuuuccucaaguccauucaugugauauauaacauuuacugauuuguauguugaauuaucccugugucugaaaugaagccaacuugaucaugaugaauuacuuuuuuugaaaaaaaaaauuaugugugcacacugaugcaugcaggggcccaaggaggccagaaaaggguguuggauucccuggaacuggaguuacagacaguugugagccaucaugugguugcugggaauugaaccuaguucuuuagaaagagcaguaaguacucuuaaccacugaaccaccucuccagccuggauuauuauuaucauuauuauuucuaaguuuauuuucuguguaugaguuuugggguuguuuguuuugggucugcauuucuguauguauacucugcauggcugaugucuuugguggucagaagaaggcaucuggaguaacuagaguuauggguaguugugggugucaccauguggguguuggugagaccuggaggaacaacaaaugcucguauagaaucuguguuauuuuucugguccccgaguuaccuucuuaaugugaucuggaauuuuguauuuuauugagaauuuuugugucuguguucaucagggagacuggucuguaauugucuuuuucucuugugucuuuaucuguuauggcaucaacaacauaacacacaggagucaugagagugugggagcauucuuucuuuauuuuauggaauacuuugagaaugaugaugguugauucuucuggaaaauuuaguagaauucucuagugaaugcaucuggggcuagauuucuuuuaauuagaagauuuuuauuacuguuuaagucuugcuucuuucagacaugguuacaucauuuauuucuuaguuuaacuucaguaagucauaugcauuuagaaguuaauuuccuuuugauuucaaauuuaguagaauauaaguuuuaaauuuuuuaauuuauuuuuuauuagauauuuuccuuauuuacauuucaaauguuauccccuuuucugguauccccuccaaaaaccacccuaucccauccccccacucccccugcuccccaacccacccacuccagcuuccuggcccuggcauuccccuauacuggggcauagaacuuucacaggaccaagggccucuucucccauugaugaccaacuaggacauccucugcugcauaugcaucuagagucauguaauuccuuuuuuuguuuuuuguuuuguuuuuuaacuuuuuuuuuuuagauuuauuuauuuauuguauauauguaaguacacuguagcugucuucagacacaccaguagagggcgucagaugucacuacggaugguuguaagccaccaugugguugcugggauuugaacucaggaccuucugaagaacagucagugcucuuagccgcugagccaucucuccagcccguuuauuaacuuuuuaaaaagacguauuuauuauuauaucuaaguacacuguagcugucuucaggugcaccagaagaggaugucagaagagcaguuggugcucuuaaccacugagccaucuuuccagcccaagagcuauggaauuccucuuucuuucuuucuuucuugucuuucuuucuuucuuucuuucuuucuuucuuucuuucuuucuuucuuucuuucuuucuuucuuccuuucuuccuucuuuccuuccuuccuuccuuccuuccuuccuuccuuccuuuccuccuccuccuccuccuccuccuccuccuccuccuccuccuccuccuccuucuucuucuucuucuucuucuucuucuuuuuuauuuuuuauuuuuuugguuuuugguuuuuucuuugagacaggauuucucuguauagcccuggcuguccuguuugagugaauguuguguguguuccugugaaggccaggagaaaacaugaaaucucuugaaucuggaguuacaggccuuagaagucaccagacauggguccuagaaggacaagugcucuuaucugcugagccaucuuucuaguccccaauaugcauucuuaauauauagccuuaugauuuuaugacagauuuuuuccgugguauuaggguguggggugugugcuacaaacagugcauguguggcagucgggucuacuauguagguccuaaacuuucuauuagguagguuguugggcuuggcugagagccccuuuaccugcugagucauaucaucaacccagauuuucugacuuucauugguuuuuguuguaaucuacauuuucaucucugauuuuauuaauuuuguuuuucucugguucuuuuaguuugacuaaaauguuugguaaucuuaguaucuuuucaaagaaucaacucuucauuuauugauuuacuuuuuguauuuaaaauuuuuucuaugucauuuauuugcugauauuaguucuuguagucuaccgccuggguuugcguuguucuuguguuuucagagugcugagguugugugagagcccucuggguuuuguuuuuuguuuuuuuaaauauaaaugcugguaguuacuggacuugccucuuaggacugcuuucaucuuauuccgugggguuugacauguucucuucaucuucauucaauucuacuaauucaaaaaaaaaaaucuuucuugauuucuugagagaucuauuuaucauuuaguuggguguuguuuaauucccaugagcauaugcauuuuucuguaguuucuuuugcuguuaauuucugccuuuauuauauuguggccagauuggaaacaauaaaaaguuauuucaauuuucccucuuuguccuaauagggucuauuuuagagaaaguuacaugggcaacuuagaagaacaugaguucugugauauuugaaugaaauguucguuuuucaggccccuugaucuaugaugucacugauuaauuguuuguuuguuugcuuauuuauuuauuugguuuuuugagauaguauuucucugugcgucccuggcuguucuggaauuuacucuguauacuaggcugaccuugaacucagagaucugccugccucuuccuccugaaugcuaggauuaaagguaugcacuaccacugcccagcuuuauucuuauuuuacucguguguguguguguguguguguguguguguguguguguguguguguguaucaggguguauaguuaacacaugcuacaguauguguuuagagcuaagugaacaacuuuguggaauugguucucccuuuccacauuuguuugucuuagugggaugaccugucuuauuggugagagcaguguguuaaagucaccauuauuguguugggguuaauuugaucuuauaucuaguaauauuuguuguaugaguugguugcaccuguguuuuguguuaaauuguaaagucuuuuuaguagauugcucccucaugacuauaaagugacuuuuaucuuuugcuuugaauuccauuuugccagacuuuagcagagcaacacauugacuucuuguuucuuuccuugaaaucuguuuucccugugcuuucuuucacucugaaguuucauuugucuuugauggugaggcacauaucuuggcagcaaauagguggaccuuaguuuuuuuuuuaauuauuauuauuuaauuaaaaaauuauuguaugguugcuuugcuugcauuugugucuucauaccacauucagacuuguugcccucagaggccaaaaagaucauuggaucuucuggaaguggaguuacagguaguugugagcuaccugaugacgugggugcugggaacugaguccaagugcucuuaguuaucucuagagccuugcuuuuuaaguuuaaaaagaaaaaaauuguguguguguguguacacacguggaggucagagaacaacuugggaaauccuuuuucugcuuccagaauuacauacacuugagaaucaaacaccuugucagccuuggugacagguaugcaugccugcugcagcacuguaccugcccacugacuuuauaaugcaggugcuugcaacugugaacuccuuaggauugcuuuuacuguacuauagaucguugacaugccaaauuuucauuugauuuuuaguaaauuuuuuuuuggcaguggcggguagggguugggagugguagacugagagagagucucaggcaaauugcuagguagcuaaaaugaauggccuugaauuugugaucucuugcuucucccuccagaguguuaggauuacagguuucugccacuacauccaguucaugcuguuauaggucucaaaauccaggucuccaugcauguuaggaagcacucgcccaauugagccauggccuuagccugucuuugauauuuuuugaugaccaucauaugauaguguauuguucaauuuccacagugaguuuuauggcuguugauuuuucugcuuuuauuccauguuuaucuguugaaagacaagaaauuguuuuucugauuuguugagacuugugcccuuuuguguuagagaauguuccaugggcuguugagaagaaaguacauucuacagugucugggugggauguuauuagauguuuguuaguuccauuugagcuaugcugucauuaaacacagauauuuuugucugguugaccuguuuauuggugaggauaggauguuggcaucauucaguuacuaaguuggaguuaaucuuuugaccuuacaggucuaguauuaugugaaacugggcacaccugugcucugugcauauuuguuuaaaauuguauucuugauggauuguuuucuuaaucacucugaaguggauuuuuguuuuuuggugguuuuuuuuuuaauuucuuuggacuaguuggguucaaccucugcucugucagaaagaagagugauaucugcuuacuuuucaguuucauuugcuuggaauaccuuuguccauccuuucaccccaagauuuguccugucuuugaugguaaggcacauuucuuggaggcaguaaauaauauagaucuguuuuucaauccagugugccagcucaugguucacccauuuguacguuugaguaguuuuuaguuuagugagauauguguaucuauuaccacagucaguuuuagaacauuuucauuauuuuagaaggaauucuuguaucuuuguacccuuuacauguccccuuuucccagccuuuaaccuuaacauagcaacauagcaacuaaucuaucucuauagauuucccuauucuggaguuugaaugaguagugcccccccccagcccccccuccccgccccguucugaaguuugaaugaggagaaucacauucucugucugucucucugucugucugucuguguguuuuaaaagcuuuuuuuccagggcuggagagauagcucagugguuaagagcacugacugcucuuccaaagguccugaguucagaucccagccaccacaugguggcucacaaccacccguaaugagaucugacgcccucuucuggugucugaagacagguacaggguacuuacauauaauaaauaaauaaauuuuuuuuaaaaagcuuuuuuccuacucuuuccuacucagcaucaaggagaagagggaugcuauuacagugcaucauauacaguuaugacuguaaaugaauaaaaguagagucucaugcccaaguggccuuaauuaagcuugugacccucuggcuucaguuucaccucugcgcugcgguuucaggagucuguuacuaugccuggcucccuuucauugcugauguuuugauugucaugcccaguaucugcuaagugcugauuuauaaagauuaagaccuugguuuguuuucuuuuuaacucuuccuccgcaccccaucucacuauguagucugggcugcccugaaucugguaacccuccuaucucagcuccccagaacuaggacaauaugagugccuaccacacaugacugcuuuccuuucucuuuauuuagcuguuguuuauuuguuuguuugguugguugguugguuuuucgaggcaagguuucucugugcagcccugguuauccuggaacucauguaggccaggcuggccucaacuuuggagauuugucagucucugccuauugagugcuggguuuaaaggugugaagaauuguguuuguaagugcauguacaugugggugcucacagaggccagaagaagguguuggauccccugaagcuugaguuuauaggcuggauucagggaacugaauguggauccucugcaaagacagcagaacucucagccacucagcucucucuccagcuuccuuguuucugguauaagaugggucucccauagcucaggcuugcauuguucacagauggccugaacuccuagucuuccugccucugacucuacaaaguacugugauuacaggcauggaucaccaugcccagaagaugaaugauaucaaagaugauuagggggauauggaugugguucaguaacagaguauuugcccaacuuguguacagggaccugguuucaaucucuuccaucacaaaaacaaaagaccauucaucuuacaaaaugauuacuaaccauaacauuuuuuuuuccucuguaaaacuaagagaaauucuguugugggucuacuauuaguguagaaagauaagccauggacuggcugaaaauaccuguaguuuaaaucugacucccuaacaaauccuuuuauggaaaacauaaagaaccucuaccagcuggguggugguggaucaccuuuaaucucgguccucuugggggcagagguagacagaucucugaguuugagcccagcgggccugcagaaucaaguucugucacgugcgcucucgaccagcaagaacgacacgaccaccaguccuucuaacaacaguuuauucagcaaacuucagucuuccucucucucgcuucaacuuucucucuaucuuucucucucucucuaaccugggccucacacucuuuuauacucucagcucucauccacucacagcaggccacgucaccucaccaggcacgcagcuucagcuaaucagggcagcaggggcaugucuccaccaaaauggauucgccaguauccuggugcaccugcacagcucucacgaugguuguggcuuauuuucagguguaugaggaagucaggugcaagucauaagacuuagcugcaguuccuggugccuucuugggacugcugccacacccacuccucacaaaguuccaauacaucaaggacuacacagagaaaucaugucuuagacaaaaacaagacuaaacaaacaaacaaaagccaggugguaguggcacaccacuucaaucacaucacuugggaggcagaguuggguggaacuccagguucaaggccauccuggucugcgacuacaggcuacacagugauaccuugucaaaagaaaaggaaaaaaaaaaaaaacccucuaugaauuuuguguguguguguguguguguauuuuaaagaaugcuugagaucuguaucaguuaaucuugccacucaaugggauucagaaucaccauggaaccauauuuauuucuggacauauuuuagaagguuuaucuagauuaagguuaauccaugggcgaaugcuuauuauuauaaugagugacuuacuacaaaagagauucauagggaauaacauuaaguagggaaagcagcuggauauguagaguucuacaaccccagaauuuaggagggugaggcaagagugauucaguuuuagauucuuggguugcauagccagaccuuauuggaaaagagaagaguaauuaauuuuccagauggguguagugcacaccuguacauaaugcauggggaggcuggggcaugaggcaugaggauugcguucaagucuauccugggcuaugauaccuaugugaccccuugucuaaaauaaauugguuuugagagauagaauaugagaagaguuugaaaauaauaauagaaucuuaggaauggcauaaauuccuacuauucauaauuuaucuaucauuaaaucugugcauaccacaguaaacguauagagaucagugguggcuuucaacaucauuuuucucagagauugaauuuauuagaucauuagguuucagaguaagagccuuugucacugagccaucucacgggcucuauuuuuauuuauguauuuuuauuuugguuuauuugaggcagggucucaagccagucuugaacauacaguaaguuguuggauuuuaccuugaacgcuugauccuuuugccucauaucccaaaaucugugauuacugguauaagccaccaugugugccuuugauuuucuuauuuuaaagauggucuuugaacuaaaagcucacacucuuaaaaucaaggaccuugcucugaguuugguuguauugugauacauaugguuuuguuaguaacuaaguaugccucuaaaagggaugauauacuugauuugaguuaagcaauuguugaacaaggggaggggggguguugaaauguauuugaaccuucucuaaauauuaauagcuguucuuugccucucuaacaagagcuguuguauuucuuuagcuagagacacaaugaaagucacguaagcagcccaauccauuguccaccauuguucuuuaacagucaaguccaucaucucccgaaccagccagucucccugcagaagauaucagugcaaacucuaauggcuccaaaccuguagaaguuguccuagacgaugacagagaagaucuuuucgcagguaauugucauaucuugauuuuuuuaguacuagccaauuauaauacacaugcuauuagaaaauacucucuaaggcaagugaaauucuguguuuuugaacuuggauuauucugcucagaacucuaucuguaacaccuuggagagugaaugugaacaugguugauuccuguaaucuuagcauuuggaagauggaagcauaaggauugcugaguucagggucagcccagcuuauagggugaaaccuguaucuaacccaaaagauacuuagcagcauaggagcucucuaguuaggucauucuguaagaaauacauacagaccaguagaagaagcaaaaauaaccuuaauuuuuaagcauuugagaguagggugcaugauacugaucauaccuugggagguagcagugauuguauucuuuuuguuauuguuguuacaaguugucacaaagcaaaauaaaguaugaaugaaucacuguaugggagguagagagaugccaaagcagcucuucgagaggacccagguuugauucuuauauguuaacucuaguucuaggguaucugaugccuucuucuggccucugguggcuccaggcacaugcgguucauagacauacacauagccaaagcacauugcucuauguuauaggcuugcuguuagggaaagugaugguugaguuuguuuuggauauagaauagaauuuggucuguagcccauucucacuuaaaaaugcugacucuucuaaauaccuaugucuuuaaauuaagauguaaguuaauauuuuaauauuaaaaagcaaaaauuaaaaauuuaauauugacacagaauuaaaauaguagauaacuuuguguuuagcaacauaacuuauauaauuagcuuuuauugaguuaauguucucaacuuuuguagugauccauauucaaauguacaaguaugcuugaagguacaguuaguucuucauacaaaaguccauaacauuccagcuugagagccuguggcagaauauuguuuaaaaugugagacuagccugggcuauauaaugaguaacagaucagggaugcauaacaagacccacugucagagaaaggaaggaaacaaugaaaggacaauaguauacugucauuuuuguuuaaagccuaaacaguuugggacuggugagaaggaaucagugggugaagcucuugguguauaauucugacugugcuugaguuugauccagugagcccucagggaaacgagagaacuaacuucugaaauuguccucugaccucuccaugcucucuguggcacauauuccugcacugucacacauacaucauucauacauacauauauaagcguacaacaguuuuacauuuuaaauaaaauuauuuuuaugcuuuacaguuuaacuuagcuguguuuuauaauaacuuuaggugaucuuagacauguuuguauaauacuacacuuggcucauauuuauaaugcacuuaaucauaucuuuuccuauggaagcgugggaugcuaggaaccucuaagaauagcauaugcuaucaggaugauggaacuuguugucuaguaguaauaacauaucuuugcugcauagaauacagaucuggcuuaaaguaguguagccauugugauuuuaaaaucauaaagaaaccagauuauggugcguauucguguuuaaauaaauaguuuguauaguguagguaauucagucagcaguauauggaaaaaaaauuagcugugacauguuguuagguuacuuauaaaauguucaccaaaugaguucaacggucuaacccuuguccauuuguuacaucuuaaagaaugccugaauauggacaaaaucaauguguauuucauucaagucauagcucuauaucuuccuuaaccuuuaaacuuguuuucagcugagcccuccauauuuguagcuguuuauuuaagcuaaaagaagccaugucagccauuuaaagugugaauauagugauucacaccucugauuuccagagcuuaggagguggcagcuucagggucagauacuccucaggaacaugaauugagugaaugagcucuuuccuaagaaccaaacaagggggcagugguggcgcacgcccuuagucucagcacuuggcaggcggguuucugaguucgaggccagccuggucuacagagugaguuccaggacagccagggcuacacagagaaacccugucucaaaaacacaaaaacaaaccaaacaaaacaaccaacaaaacacaacaacaaaauaaauuuaaggcagaccaucaguuugguuucuuuccuuuccauuguaguuaguuagaucaugcguagccuuacuccaaguucccagcccuuugcuguugaagcagcuacuaguacaagcaagcaaaaccuugaucaguacagucaaaugucauugaaaaacuuugguuggcuuuaaauuaguguuucucaaccuuccuaaugcuguaacccuuuaacacauaguucuuccuguugugaccccuaaccauaaaauuauuucauugcuaccugaugacuguaguuuugccucuguuacgaauuauaauguaaauaucugguguguaacccucuugggaaccucugaguuuaaagugccgacaguggaaucgugugugugacuauuuugucuccauuuauacauguguaccgacuguaugcagugcccggagaggcuagaaaaggcgccagguucccuggaauuggaguuauggaugguuaugcgcugccuuguggcuucugggaaaugaaccugggcccucuggaagagcugcucuuaaccacugagucaucauugccacccauugaaccuagcuuucauguacuaccuuuuacuuucuuauauuguugacugguuuuguuuuugagacagaggucucacuauguagaucaggccucaaauucauaggaaucugucuaccugccucugccucccaagugcugggauuaaaggcgagcagcacugugcuaugguuauuguugacuauuuuaaaugucuucuuauuacaucuaucuaucuaucuaucuaucuaucuaucuaucuaucuaucuaucaucuaucaucuaucucugugugugucuguguacacugcaugugcauggagggcagaggauagcuuguagaagguaguucucuuuccaccauguggaucccaaggaucaaacucggucagccucaguugaaagcacuuuuacccacuaagccauucucugucccuguuuucauuucuuuuuuuuuuuucuuuuuucuuuugaaaagaguauuaagugccaucaguguucaaagccuaaaguggguauccaagcuuuuaguuuguucugucagggucauauguggucuguugucucuauagaucccacccccccuaguuaccauaguuuggaagauuuuaguuauuagucauuuuucuuuuaauauaaaaauauaaagagguucauaccaguuaucuugucaacauuaaauaacgagucuaaauaguuugauaauaugucaaccuguauaauuucaaguugacugcaugaaguggcucauugaccacaauuacuacugucucaaaaucucaagaauccagaaaccuuaggaugagaaaccguuggucugauuccuuguuugccuuuuaauuccaccacccucuucuugguaucaguucuacaagccaacaggacuguuuuguguuagacucgcugauuaaauuucacuaccccaccucauccccgcuuuuacuuaugcuguuauucuauuugcaugguaauucccuccaacuucuuccuguuuaaaucaccucaaaucagagucacagacuauuucugauuuuccccacccugaaguauugacuccugugucuacucaaauuauaguguuuguucugucguucaaauaguaauugaaugucuuauaacauucuuuauuguucucuuaagucuuuuauuauuauuuaacauuccacaugucuuguuuucucaacuagauuauaaacucccugagggcagguaugauuuuuuuuuccauuucuuuguguuucuucugcauuuagcacaguauuacauaguauguagacauucaguuuauugaugugguuugaucuuaaauauauuuaauuuuagauauuucaagugaaugagcauuuaaaauuaaaaucuaaacaucccuuugcuuugugucauauuuguauauucaacuaauauccaguaaucuuuggcaauuaauugcuuuagauuacuaacuugguggguuuuccauaacagguuuuuaaucccaauuggaauagauaaagguagucugcugccauaaaaucugcuuuuauauguaugaaauaauuauauuaguuugaauaaguuauaugaaagguaaguuaccacauguacauuguauuaccaauccaaacacgaaugaauguggaauuauucacaucauugcuuuucuccuaguauagauaguuaaauggacuuaauacaguucuucauaaaaucaacacaguuccuguuugcuguaaaguuuucauaaacaacuaaauaauuagugacauaaagucacucuguagugauaacuuagaagucauaguccuuuugagacuuguagguaugucuuucguguuucucgaauugccauaugcugugauuuccuugauuuccuuguuuaauucacgucuagaagccacagaagagguguccuuggacagucccgaaagagagcucauccuguccuccgagccgucuccugcggucaccccugucacucccaccacacucauugcuccuagaaucgaaucaaagaguaucucugcuccagucaucuuugacagauccagggacgagguguggucaacauuuacauuucuagguuaauauguaaaaagugcauuuuuguuccuuaccuaguaccucucucucguuaguucgauaguuauuccuaaucaaagccuuucagauauuuuagacagacaaaccauacuaagaagaaaggcaugguggcacaagucaauaaucgcagggguagguaggucucuguuggaagcuagcguggcucuacgguucaauucuaacccauucuuuauguuguucugguuugguuugacuuuugagacagaauccuuuuaacucucuugccauguuggcuugaaacucaguguccugauuggcuuaaaacucauaacugugcuccuuuuuuagcuucucuaaauaacccaccccauggaacucuaccacuugagguucuucaaucaaagaguuugcagcugcaguguaauucggugguagagugcuugcaguguucagugucaaugaucaggucacacugugugacaucuguggucuugugauaauaguauguaccucugaagucuccuauguugaacaagugaugggugaaaguacuuaaaguggcguugugagucuuuuuuuuuuuuuuuuuuugauagagcauguaaugaauacuauugacaaugaagauugguaucuggaauuuaucuauuuauauagugcuaaggaguggcuagugguuuugguuuucuguuuguuuuaccucugagcuguauaugcagcccaaacuuuuaacuuuauuucuuuugaguuuccucaagcuuucauuuuuaaaaggaagagguacuacagaucaacuaaaguuacauucucaugacuugaugauccuuuuacuuauaaaggauaggauuauuaagaaacagcaauagguuuuaauaaggcacauuuggagaagaaaacaaucuugauacagagguuauuuuaaauauaaaacauuuaaaaauuauuuaguaauauguaaccaguauaaccacaauuaaauagugacuauauaugaacaugugaauagcauuucaaaaauaguacaaagagaaaauaguaaaugcaaaugagugcucacaaaacugaugaaguuagugaacaauaugugcacaguuaaguaucaggcagcaggcugguuggcucggugaagagguuguaacuggagacgagcucuacgaggaccuucggggauguacuaguuguuugcauuucuucucugaguucugcuuagaaagaugagcucauucugugugaaguauugaauguucacguagcaauucauauacuuuuuuuaaaucacagugcgcauguacaaaagauuagcuuaaugucucuauuuaaaaagugaccuugagcagaaagaugguaaggaaauagacuuuuguuauagcuuuauaucacuaauauugccuugauauuuuggcagauaaauacucugagauuucuugucuguuguuuguuuuuuguuuuguucagugcugugaauagaaaucagggccuugcuugugcuagacaggcauacuaccucugaguuacacucccagcuaaccuuucuacaaacucuucuguagcaaaaggauuugaaacucguggggcuuuuuuuugguuuguauuguuuuuuuuuuuuguuuugucuuguuuuguuuuguuuuguuuuguuugagacaggguuucuuuuuuauagucuugccugugcuagaagucacucuguaggccaggcuagacuggccuugaacucagagauccaccugucuuugcuucccaagggcuugggccaccaccucccagcugaaaugccuguuuuaaguugcuuucaaaggggccucucuguagucucaucaaguuauuuuucccaauugcugauuuugaaaauugaguuuuacagggccuugucuuugagaaaaauguguuuuuuaaaaguaauuagaaggacuauucuuuuaaaguugcuuuuaauuauaauuucuacaaguaaguuucuacugguacaaguaaugaguucuuucuaguuaucuaggagugaaaauucuggggcugaggcugggauaauggcauaguagauaaaguacauguagguuuagagacccugauggauauaaaugcugguggacauggacagcuagccugcagucccaauguuagagaggcaggaaccggaacccuacagcaagcuaagacuggacaaaucagugcaguagggaagcuguaaggcaauaaaccaugauuaaucuaaagaugccacuucugagcugcguguggagcacaccuguagucccagcacacaggauguagaagcaggaggaacagaagauuucauuuuaagccaaaacaacaacaaaaaucagcaauauuuacaaaacugcauguuuuuucuuguuaaaaguuuuguuguuguuggguuuuuguuuuguuuuguuucuuuuuuuuguuuguuuugguuugguuuuuuugagacaggguuucucugaauagcccuggcuguccuggaacucacuuuguagaccaggauggacucgaacucagaaauccgccugccucugccucccgagugcugggauuaaaggcaugugccaccacgccuggcuguuguuguuuuucuauacauaugagacguuaagacaaaaauuucuguucuccaaaugaucuucauuauuugaguguuuucuuuguuuacauagucagcauauaugaaagcuccuguuguuuuuaaauuauugugacaugacccuacugaaaauaguagggucuguauaucuggaaaaaaggcaguaaaaacuacucauugguauuauaauaguaauauaaguugaaauuuuuaaauuuuaaauuuuuugagaauuucauacugaguacuguguuuuaugacugacuguccacuugguauugggucaccggucaguuggcucaugcuuaggaaaaaaaauugacugccuguagcucuucacuuaaggguaggaucuuaagaaauuucucccauccacauuggcauggcaauuaguauuaucaagauagucucugucuguugcaaaaaguagcuucuucggcgauggguaagagcccuaccuguuuguggguauaggccaagcauuuagaaaacaauuagaaaugauccugguuagagagaugacaguagcaggaucuuuccuagacagcuggccagggcugcaccacuaggcagacauucccuauugagagggccaugaguccacaccgacagcugcugcuuaccuucaacauaaaggggauuuuuuuaacaccaaaaauaaacuuuucuagauugaagaagaagcaaauggagauauuuuugauauagaaauuggugugucagauccggaaaaaguuggugagucauuauuguauuuuguacuucuuuuuuuacuagcuugauuguuacauccuauaguuuuccacuuaaguauaugguuacaguauuguuucuuuuucuuuuauuuauuuauuuauuuauuuuuguauuuuacuuugaagcauuuaauuuaauuaguuaaaugccaggucuuacacacacuaggcaagcauucuauugcuuaccuaaccucugcccaagcauuuggauuucagugauauucuauggcucuuuucuuuauaggugauggcaugaaugcuuacauggcauauagaguaacaacaaagguaagcuuuuucuucuucuucaauaaaguguuggccccucauacugugcuagagaggaugugagcauaaguaugcaggaagugaguuaaucuagaccugagggucaggccuggggugagucauggugagauaggaaugggagggaggggcaggaugcuucuuucagguaaaagauuugcuuguguaaaaggccgaagucaagcauuguacuuucuagaguuucaucuguaagugacucauggcugaauuugguggccacagggucgcguguguuugaguagccgcguuaggaguuuuggugucauccuuagcaugaaggagagcuauuagagcguuggacaaaagcauggcacuauuagguuuucacugggacagcucugucuuaaccuagugugaauuguaagcauccaaguacagaucaagaucuccaguugaaaggccacugcaguuuuuaagcauuaagucuugaaacagaaagcaaguccaucauaacaucuuaauuuuacaguggggguguagcucaguugguuagagugagugccugccuagcaugcaugaacucccagguucacucuccaauauucagaaaaaacagggaaagugguacacaccugugauuucaacacuugggaggcaggggcauggggagcagcaagaaguucacagugagaucuaagccagccuggggcacacaaacaacuacaacuggggaggacucugaggaaacaguuuugaaaguaauggaaguaaauggcuguuugagugacauagguaggagaaucaauuaugugugagcagaaggaauaaggggaacacuuauucaugauaaaggaacuuuguaguuggagaaagacaagauggagagagacacaaugagguggcaaaaguuugguuaguugaugaaaaaauccuuauuaaauccuuacuauaauuucagguucuguugcaagcaccuggcucuagcaguaaagaguagaggaaagugcugucccugugggauucucacucuaacacugaaaagucacugaguuugagcugagugagauuugcaucgagcugccuuuugggaggucugggcaaugggcaaauuuaagaaucuguaguaguuuaugauugugaguucaaagguauccuaggcugcagauagauaguuggaugauagauggcuagauagauagauagauagcaaacaagcaagcaaaacaaaaccuuguuucagaaaacuaaaggggggaaccauuagcaaaaguaugguagggaucagugugauaggucaaagacaauaaaaagcgaguuuuuucuaaccucuuauauuacuuuuuuacuauaggccuuaaguuuuuguuuuauuuuuuuuucuuuuuuguuguuguuuuaaaucuauaagccacauugauacucugauucauuugcaaaacagaggaaacuccuuugcaaagcagagcagacuccacuuacagucaugugcaguagucauuuguaauugcuuacuauuaauguugugaaauaccuuuucuuuauuuguagacuucucuuuccauguucaguaagagugaauuuucagucaaaagaagauucagugacuuucuugguuugcauagcaaauuagcaagcaaauauuuacauguugguuacaucgugccacccgcuccagaaaagaguauaguagguaagcauaagucagaauaauugcucuuugcuguuccuaauucaguccuaccuguuccagugugugugucccuuguucaucccaaccagggcucccacccagagcugcagacuuauaugugcuguguuggucccacacauccuuaaagaaucccuggguuuaaacucagguuggucagguuuggcagcaagcaucuuuauacucuaagccaucucacugaccaccauuaguccacuuuuaagacuuauguuuuaaaauuuguagguuauuaccaaucuguuuaaguucuggguuuuuaaugauuccuuuuuaauuuucuuuauacucaaaauuauuacucugaaauauauuuaaaaugaauauugcugaucauuaauuuuacuaggcuugaaaagucauuuuauaauuaauaauuuugaaacuugauguguucagaugaauuuguuauauucuuuucuaaauucuugaauaaaaaucuuuuuggguuaguuuuaugguggggauugagcucagggcuuucagcaugcuaggaauacuacuacuaaauacucuuauagacccaguuuucuauuuuuuaaaaauaauacugugccaggcggugguggcgcacgccuuuaaucccagcacuugggaggcagaggcagguggauuucugaguucgaggccagccuggucuacagagugaguuccaggacagccagggcuauacagaaaaacccugucucaaaaaaacaaacaaacaaacaaacaaaaaauuacuguauuguuucagaacuguguaagaugcauuuaagauggguuaauuuuugcuggaaauguaguuuuuuuggcaguauuugccuggcaugcacaaauuccuggguuugauuuccagcauugaggacuuagagacaggagacucacguucagucauuccuggcuacacagcaaguuugaggcaagccuaggcuauauaagaauuaauaaauagguaaaguugacuagaucauuugaauaccauuucauuacaaaaauguuuuaaggcaaguagauauauauauguguguaauacauaucuguuuauaugcauguguauacaugugcauauagucggguaggauaauauaaagccaaauaaaaguuuccuccaaaaauugugaauacuuaaagguaacuagcagauuaauuuuuaaaguuucuggacucuagcuaguaaagaagcaauuauguguuucacaacaccauauauuauugacaacuuuugaauuaauauauauucucuaaaaaauaauagggucucauauagcucagauuggccugaaauccaguguguugugggggguaacccugaccuguugauccucuuaugccuccaaaaauguucaaauuauagguguggcccaccaugcccaguuucuuugcuuguucacuuuauguaugcauguaugcauucauuuauuaucaaaguucuugcugucuagcccaggcuggccucaaacucacaauccaaccaccucauucucucaaguucugggauuauagccaucugccaccacacuuguguagaugugcagauuuuuuuuuuuaauuuuuuaaaaagauuuauuuauuauauguaaguacacuguagcugucuucagacacaccagaagagggagucagaucuuguuauggaugguugugagccaccaugugguugcugggauuugaacucuggaccuuucagaagagcagucgggugcucuuacccacugagccaucucaccagcccgaugugcagauuuuuaaaguaauauaucuagugagauggcagauuacaaauaggaguuuccugggaagauguaauugcuauugaaaggagucuguauuaacuuuaguugagauaaaaacacaauucuuucugaacuauuagaaaaggaacagccuggcacaagagugcuuuuuuuuuuuaagauuuauuuuauguaugagaguacacuguagcuguacaggugauugugagccuuugugugguuguugggaauugaauuuuagguccucugcucgguucugucaacucugcuugcucaggcccaaagauuuguuauuauacauaaguacacuguagcugacuucagacacaccagaagagggcauuagaucccauuauggguggaugugagccaccgugugguugcugggauuugaacucaggaccuucagaagaguagucagugcucuuacccgcugagccaucucgccagccccgagugcauuuuuauuaugccagcacuggggggccuuaagcaagaggaucaugagauccaggucagccaaagcuacacagaugagaccuugacucuaugaaacacagacgaaaugaccaaaacagccuaccuaguugugacaaaugcaaacaugcuagcucugcacagggaaagcauuuaacgaacucauuaauuacaucuaacacauuucaucaucccauaaagaccuucauugacuauaguuuuuuaacuccauuuuauauguucaaauauaagaauggagccuaaguaauggcuuagcaguuaagaguaguugcuacauuugcuaaaagcuggaguuugcuacccaggaccaauauugggcaucuuacaacugccuguaacuccaguucuagaggaugugauguccucaucuggcuucuucaacaccuauaugcaugugcacauaacaaaaggcauauacagaaguaaauaauaaaaucuuuuaaaaaagaaauguagaagaaaauuaagcuggagaucuaggucagagauagaauacuuacuuaucuagcauucaugaggccuuggguucaagucccagaauuagggagaaaauacucuugggauauaaaaacauuuuuuguucuuaaaguauggaauaucacaaguuaugaaauuuuuauguaagcuuuuguauaaguucaaaacccacaaauauagcucaaguugugcuuuguuugcauguuccugccauacauauuuauucauuagagauauuaacauaucaugggacgugauucuucaaaaugccuuacucuuuaaguaaggucccaguaccagcacagggucauuacugucaacuugaaaaguauauuuucauuaugaagaaauuaugauggucuguuucuuacaaaucuccuccaacuucuucaaagguaugaccaaggucaaaguagguaaagaagauucaucauccacugaguuuguagaaaaacgaagagcggcacuggagagguaauccgaguuacagcaccacuuuugcuacgccuuuauuacucugcagcuuuguagucuaauagcaugacaucuguucuguaucaugcgagaagcaagaaaauaaaagaaugaaugaauugaugucaggguuaugucauaauaaccaaaaucucuaaaaggugccuguaguuguaagagggaaacaugaaaauugugcuugcagaacaccugauagagugugaggagaagccauguauggugugcacuccuacaguuccaguauucauagacuagcaggaggacuuaugucuugugcuauauagaaggacccagucucaaaauauaaacgacagagaggagacugggccuccauggagaaaugcuuauauaacauuucgggggccugagccaugcccuuagcacugcccuuccccaaauguaacagauagaaauuauuuagauucuuaggaagcuaugcuauauuaaucuacuguucuaauuaugccauacuuaaccuucuguuuuaauaauuuauaguuugucuaaauugauuuuuuuuuucgagacaggguuucucuguguagccuuggcuguccuggaacucacuuuguagaccaggcuggcgucgaacucagagauccgccugccucugccucccaagugcugggauuaaaggcgugcgccaccaccacccggccuaaauugauuuuuuuaaauuagauuuguuuauuuuaauguaugugaguguuuugccugaauaugugcuauguguacuacaugcaagcuuggugcccgugaacgucagaagaggggguuggaucuccugaaauuggaguuaacagauguuugugaaccacugugugggugcugggaaacagaccuggguccucuccaagaacaacaacuguagauuauuugauauaagcauuguuaaacugugaaaacugcucaugugugccuugucauugucguguauuuaagacugacuuuaaguaaagaguaacuuuaaauaaguaauaaggaacuuuaaaggaguaauauuacuccuugcuuagauucaguuaaagaagaguaaguacguucuggucuaccuuccuuuagaguacauaauuauacauguccuguagaucucaaggcuugcuuuucuucuuuccuuuuugagacaaggucuuacuguguaguccugguuggcacauaaagaucagccucucucugccuaccacaguacugggauuaaaggcaggcuaaaagggugggaauauuccuaccuccugcaucuuaacauauaauacuuucuuacugugcggaaaugugaaaacacaggugauccuuaaucaucagggaaaugcaaaucaaaacaacccugagauuccaccucacaccagucagaauggcuaagaucaaaaauucaggugacagcagaugcuggcguggauguggagaaagaggaacacuccuucauuguuggugggauugcaggcuuguacaaccacuauggaaaucagucuggcgguuccucagaaaacuggauauaguacuaccggaggauccagcaauaccucuccugggcauauauccagaagaugccccaacugguaagaaggacacaugcuccacuauguucauagcagccuuauuuauaauagccagaagcuggaaggaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccuaaaaccuaagauacccaagauauaagauacaauuuccuaaacacaugaaacucaagaaaaaugaagacugaagugugaacacuaugccccuccuuagaagugggaacaaaacacccuuggaaggaguuacagagacaaaguuuggagcugagauaaaaggauggaccauguagagacuagcauauccggggauccaucccauaaucagcuuccaaaugcugacaccauugcauacacuagcaagauuaugcugaaaggacccugauauagcugucucuugucagaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacuggaaagagaggcccauuggacacgcaaacuuuauaugcccccaguacaggggaacgccagggccauaaaaggggaguggguggguaggggagaggggguggguggcuaugggggacuuuugguauagcauugcaaauguaaaugagcgaaauaccuaauaaaaaauggaaaaaaaaaaaaagaaaaagaaaacacaggugagacuaucagagaaguacagcgaagcuuuuuguuuauuuguuugcuguuuguuuuugagacaggguuuuauuguguaguccuggcuggucuggaacucacuauguagaccaaguuggccucaaauucacagagaucuggcugucucuuucuucugaguagugagauuaaaaucgugaacuaugacacugguucucugaggcuuuaccacuuucuaauaccauaguuaauuuugucuggucuucauuuuaucuucugccuuaucagugacuuagguugguagccuuuaggauuguguaugucuuuguguuuguaugcauauauaucuucaugauacaauuuaauuuuuagaccuguuuuugagacaacuucuuauuuaguaguaaauuguuuacauuuuaagaaaauccccuagaaaagucaaguuaaacauauuccauuuuuaaaaaagcuaaagagcacuggagagguagcuccuuagugaagagcacuucaaaguuuaaaaacaggaggcuggcgagauggcucagcaguuaagagcacugauugcucuucugaaggucucgaguucaagucccagccaccacaugguggcucacaaccaucuguaaugagaucugacucccucuucuggugugucugaagacagcuacaguguacuuacauauaacaauaaaugaaucuuuaaagaaaaaaguuuaaaaauaaaaaauaaaagcuaauguuuaaagaaucuaguuauuuagaauuauuuaaauuguaucagacauuuaaguaaacauuggaauugauuguguuguaagauaaguauuugguguguguguguguguguggguguguguguguguguguguguguguguguguguguugagacaggguuucucuguguaacccuggcgguacuggaacucacucuguagaccagacuagccucaaacuggaagaucugccugucucugccucccaaguacuggcaucaaguuguuugugcaccacucugcccuaugaggaaguuugaaacauuuuggccagcaugcacuuacccaaagauuuguccugccaaggucuugggauuugaugcuucauuauucuucuaguuauaguguaccauauagucuauaugguuauuugauucaaauuaucuugaucuaauuucauuagucccuuaaaaguuuccuuugcuuaucugaaaauuaguucuuaggugggcauacaaaguggguauuauuaugacauucccauguugucaaaauuuguucuaauucguccccucuuccauacucuuuacugauaaacaugacuuguugaacgccaccuuaaguggaauugguagguuuauagauagaauuuuauuaagaguauuagaguaguguguaagaguuuauuaggugggcauuuugauucauaccaguaauccuacuugggagucugagugaggcaggaggauugcuacaucuuggaugcuagccugggcuaccuuaaaaaaauacaauguaaaacgcaagcacguguaucuuaauccacacauguacagacagacauggagaggugugaugcacaaugacuuuccauuugaaaucuguccugcacuacaauaccuaugugaccugugcaagaaguguaacuuaagugaacacuuaucucugaugaauuggguaggaucaguguucacuccaagcacuuaaacguucauuugcaagacccagacagauaagauagauuuauuaauccuaugcuuucacaucagugaauuuggaaguagaucacucucuagggaucucuuauuccccgggaaguucuauugcuucgaaagcuuggacucucauucuaauggcuaguaauccaaaggcuuaauuuagcgaccuguucuccuagugggcuccgugguuauuucauucuuggcaauucuccccuaccuccccauccuucucccccucuccuucucccuuccuuccuucuucccacccucccuuaaauacagcauguauagaauaaucccguuaaaacacagccugggcugcaugagacaguuucaaaaacaaacaaagccacccgagagcagcuugcacuagccccuaguccuaauuguauucaauaaaacuaaaguucuuagaauugacuacagaucccuaucugaccugcacugcucauucauucuguuguuaccguaucucucaugucucuuugguccccacuuugcucugagccacagugaccauuugguuuggaaucugaggcaugucuaacuuuuacccguuuauagcucauuauccuuuucgguguugaaauauucaaguaaagccuguucugacaacuggcuucaucguaccucucaaaauuggcacggagcgcaucuuauauacuuggucccaugugccccauucuuucuucuuuucucaugggacuuguccuauauuauagauuauguaauuuaugugauuguuguguuuauagguuaguaucugucuucuaguaccaaauuuauauuccauaaaggaagagauacuaauaaccuuugcaugcugauggauucuaggacauauaaauaacauguauucacugcucagcaaaugucugcuaaauaaacaggugauugucaucuaagacccagaguuuuugcauuccuaaucucucauuuuguugacauugaauuuaggagaauuauauuuaacucuauucaucuuaaggauuugaugcagcugucuuuguuuugcuuuaucuaagcacacaaguagaaacuagaaaacucaagugauucuucucaauuucuucugcuuaaagcagaucugagccaccacugaccaccucuuuuuuacuuccucagcccuugguaggcuuucaaaggaggauagcaaauguaagauaagaucagucugggcugccaaugagaacuuguuuaaagaaaaaaagaggaauuguugaagaaaauuuaguccuuauugaaucagaaccaaggaccaaaaccugauuguuuaaaucuaccaacaagaaauauugauaggcaguuucccauuuuagagauaguaguaauuauacuuguugagaagaaaauauacauagugguauauuaacuuaauucucuaaaauuauaacuggaaacauaauuuugucuaaagaaacauuguuacacaagcucauaauucauauauucuuuuguaacuaaauuguccuagugagauaaaguauuuacucugucucccuuucaaaagaugaaccaagaggcuagagagguagcucucaggcugagaguacuugcuguucuugcagaggaccuggguuuguucccaguaccuacauaguggcucucaacugccacugaguccagguuuggccuucauuggcaccaggcacauaugugcacauguagucacguacacauacauauaaaauaaaaauacauuucuuuaagauuuauuuauuucauguaugugaguacacugucgcugucuuuagacacaccagaagaggacaucagaucccauuacagaugguugugagccaccaugugguugaugggaauuggacucaggaucucuggaagaguagucagugcucuuaacugcuccagccccaaaauaaauacuuuuuuaaaugaccaaaacuuuguauuugauucuuuaaagucucuccucuucccacccccugaaauagggucucauauguagaccuagcugggucuagaacuugcugaguagaccaguauggacucaaacucaaaaaauucuacuugccucugccuaccaaauucugguaucaaggucuguaccaccaugcucuguucaacuguauaaaauucuagauuauuauaaugaguguagacuaauagauaaauuaaagauacuuuuacuugauuauuuuuauucuuuuguugaaacacaauuuaacaugguacuaaaauaggaucaauucaacucuugaauauagguaucuucagagaacaguaaagcauccgacauugcuucaggauccugacuuaaggcaguuuuuggaaagcucagagguauuuccacuugaaauuugcucauucauauuugcuauaacuaauacaagauuagaucgucaguaaauaauuacuucaguggacguaggaaaaccaugcuuggggacuuuuggugucgguuaacuugcaaauaccuucuuuuaguaauagaggauggacaguuccuuuuuugaagaauuuaaacugguuuuacucaaauagaugagaaauaauuuuucuguugcugcccuaauuguuauuguuugcgauuuaaaaaaaaaaaaaaccuuggcuugagucucagaguuuucuagaagcucaugagcacgccuucacagugagcaccucugcucgccagcagcuugugcuccgagacagguggcuguguuagaguccggcaguuucuuaauguguuuugacaaacaguguuuguucuaucuaaauguaaacgugcagaagaaaagcaauggaaaguccauuuuuuaaguuuuccuuugagaauguacaaguagugcauuugagaaauuagaucucacuguugaaaugugugagggugaagaaaauacagccucuuuucucuuuucuucucucucuucucuuuauuuugggagggggucccuuuugugcccaguuaaaucuccaggcuuuuaaccgguuuguuugcccuuauuugucauucaauuccagcugccgagagcaguuaauacgcaggcucugaguggagcaggaauauugaggauggugaacaaggcugccgacgcugucaacaaaaugacaaucaagaugaaugaaucggaugcaguaagagcugauuuuucgacuugaauaaugaaaugaauuaaugagcccaacaauugcguuuuaaagcuguacaagcagaaaauaggauauuaauuugcuuauugaguucaguucucagcuacaucaguugaccaccgugguuauauauggcuaauuugcuguucuaaaacaaggaagguagcuugcuauugguaaccuaauuuacaaugguuuguucguccuaaauuagcuccauuuuucacuuuuuuuucuuagugguuugaagaaaagcaacagcaauuugagaaucuugaccagcaacuucggaaacuucaugccaguguugaagccuuggucugucauagaaaagguuuguuagccguguuaaaaugcguauucugaagugacuguagaaaggaagaacaacagucucagaggaugcccugcugccugggcugcacgggggcagcugaagcagaccugccaggagucugacgcuaggcugucucaaaacagaaaaagaggauuuguucaauaucauuuaaauuuuuccacuguauuuugaucugacuucuagcuuaaaauuagaaaaaguaagagcuuguaaaacuauuuuaauucaaauuaaaauuauuacucauuugguugagugcuauguaaguauuuguacuguauuauuuugcuccucuuuuuacaguauuucggggcuggagaugucuugguagcucuugucugacaugcagaagcugggcuugagcuccagcaucacauaaagcaggcagucaggaguucagggccauccucucucucuauaggaaguuccaggccagccuagccuagaaacugaaaaauacaaaagcucaaccagcuguuggggagugaaaagcucauaggaaauuugaguugaaauuuuuuagcccacaaaguuuugguguuagacuuuuguuuguuuuucuuucuuugacuuugguauggaguauuuuuagaguucaaaacucuucacaaugguuuucuaagauacuaugugacauaaugcuuaauagauuucauuaggggcaugguaacaaaacuaauuacuugugugauaaauuuuuuucuuaaguuucuuuuuuaguuuuuauuucaugugcauuguuguuuuaucugcaugucugugcaagggugccagaugccccaaaccagaguuacagacaugugagcugccaugugggggcugagaauugaaccuggauccucuggaagagcagucagugcucuuaaccacugggccaucucuccaaccuccauaugauaguuauuucuauauaauaguuuguuuuaacuuuauuguuuauauuauguaucucuuaggaaguuggcuuuggauauuuuaaaaaagaaaucauauacaaugcagcaacagaauaguuuccagaaaauguaacuuagucauugucaguagccguuaaaucaugacuuuuucuucguuugaaaugucugaaaugguuguguuaaaaauaaucuaggaauuauuauuggagaaugaugugaguuugagggcagccuggacuaaaugaguuccagguuagcucaugucucaaaaaaacaaaaacaaaaaucucauuuaauucuuagcauuauugcacaacaaauagaaaaggacuuaaacugauaauaaguuguauguacaagcauaccuuuuuucuuucuggguaucuuauuaaaaauugagauguaaaauuuuuuaaaaaauaaauaaaaauaagacuugagauauuauccucauugacaaauauucaaaugccaaagauuauaguaugaauuauuugugauuuaaaaaaaaauauuauccuuauuuuuauguacuucuguauuccaguguguggguuugcaaacuuaggcucuccagaacaccaggauaaauuuuugaccucagagccaucucuccagcccuauucauuuuuaugcuuauucuuucuauaugagaaguacauuuacguauucaacagaaugcagaagacaauaaaugaguaauucagugugaaagggaaaggcacguuauugaauuauucagacacgguucacaaucugaagauacaaucugugaaucuauuuugguggggcuaugcugggacugaauguaaacacaggucacuccauacagcaguggugcuucugagcaucuauguccaaagcaguuuauugacugucucauauuaauuuaaaauaacucauacauuuaaauuuuaauucaugaauaaauaaaauuuagagaaaagcacauaguguuaaaauuuuacuagcaaauacuaaaugcuuuuuuuuuuuuuuuugucuuuuuuuaauuucagaacuuucagccaacacagccgccuuugcuaagagugcugccaugcuagguaauucugaggaccacacugcgcucucuagagcuuugucucagcuggcagagguugaggagaagauagaccaguuacaucaagagcaagcuuuugcugacuuuuacauguucucagaacuucuuagugacuacauucgucucauugcugcagugaaaguaagcccuauucuacaagucuucucacauucuuguuauuuaagccauuugcuuuagaaauaauuuagacuaaacaugauaggaauugccuguaacgcuaccaccuggcuagcagaugcaggagggucacauacauguucagagcuagccuggucuacauaguaaauucuaggccagucaggauuacacaucaucacacacaugcacacccacacaaucacacucauuugguuuucuauuagauauauacauuuaagugugcaaaucuuauacugcaguacuacauaaaaaugacuucaaaaugaguacuuauaacaacauaaugcugggaagaaaacccaugcuuauucaagcaauucaggcuucaggguuacaaaguauuuugacaguagcuauuuugauguaaaauuuguagaaguagaauuauugcagauaugaaauucaauuuuauuuuauacaacuauuacauauuccuuuuuaucagccuaaugauagcuuuuguguuuauagucccguugcuaucuuccucccucccuuaucuuuguuucucuuuuucauuuuuuuaaaaaaauugauuuauuuuuauuuuuuauauguaugaguguuuuacucauauguauucggguuuaccaggugcaugccuggugccugaugucuguggggucagaagagaccauuagaugccauaaaacuggaguagcagacaguugugagccacuguguggguguuaggaaccaaauucagguccucugcuagagcagcaaagucuuaaacccugugccaucucuagguccuguuuuuucacuuuuuuguuuguucauuuguauugaaacagggucucacuuuguaucccuggcuauccuggaacucauuauauaaaccaggcuggccuugaacucagagagaucugccugcuucugccaccagaaggcuuaccccaccauaccaggugguaaccgcugcuucugcuucugcugacccuccugcuccuccuguuccuccugcuccuccugcuccuccuguuccuccugcugcuccuccuccuccugcuccuccuccuccuccugcuccuccuguuccuccuccuguuccuccugcugcuccuccugcuccuccugcuccuccugcuccuccuguuccuccugcuccuccuccugcuccuccugcuccuccugauccuccugcuccuccuccuccuguuccuccugcuccuccuccugcuccuccuccugcuccuccugcuccuccuguuccuccuguuccuccugccccuccuguuccuccugcuccuccuccuccuguuccuccuccugcuccuccugcuccuccugcuccuccugcuccuccugcuccuccuccuccuccuccuccuguuccuccugcuccuccuccugcuccuccugcuccuccuguuccuccugcuccuccuguuccuccugcuccuccuguuccuccugcuccuccugcuccuccuguuccuccugcuccuccuguuccuccugcuccuccuccuccuccuccugcuccuccugcuccuccugcuccuccuguuccuccugcuccuccuccugcuccuccugcuccuccuguuccuccuccuccuccuguuccuccugcuccuccuccugcuccuccuccugcuccuccuccugcuccuccuccuccucuuccuccuguuccuccuccucuuccuccugcuccuccuccugcuccuccugcuccuccuguuccuccugcuccuccugcugcuccugcuccuccugccccuccugcuccuccuccugcuccuccugcuccuccugcuccuccuguuccuccuguuccuccugcuguuccugcuguuccuccugcuccuccugccccuccugcuccuccugcaucuuacauagcuuccggagcuauguucacacuuuccuuuauauguauauggagugcucuaaaaaacuccaguccccgagcuuccucuaccaccuagccacacccagccacacccagcccucucuuuguuggaauuguuaauuucuuuuuacccacuucccuuaaaaauaagucaugccuaucucuuauagcuacuugauaguaacuggccuucuguuuauauuccugucaagauggcaugaauaagaucauaauuugaguccaggaguacugugaagauuauuagcgcgcacuacagaggugcccuguacaaaaggggcuuccuagacacaaggucagacuuggaaugaggagucuuuagguaggcccugguaccugauguucgguuuuuguuuuguuuuucuaaggcagggucaagcucaggguagccuugagcucucuugccucugcccccauuugggauuacaagcaugaaccauaacaccuagcuauuuacugcuucuugauuaaaauauguuuuaaaauugaaauaucucuggcauaauacuuuuugauucaccuaguuuguuaauacuuggcucauuuguugaguuaguauauauuuaaaauaauguugauauacccccaacaucaagcuaggaaagaaauucauaguggauuuucccacacugucuauugguuuucuuuuuggagacacccuaguugcacuccuauaucuguauuucacuucuuuaaucucgugguuuuacucugacaggcccauugaaaauaagcuggagaugugguugacuuguucugguggagucugugugucaguuuccauuuaguucugccuuuuaguuguguuuuuuggaccccuuucaccauguacaggacucagcaucuuccucguuuuguuaggccuuuacugucuuauuauuugcguuuuauucuguuggcgucaucuaugacaguuuucacuucacuuccuguuacuuggucucacacuuaacaacaguccuccugccucugucuccugguacugggauuagaaggaugggccugguuuggcccauuuuaucuuuuuuuuuuucccucuguagccuuggcuauacugggaaucgaucuguagacuggacuggccuugcucucacaaaaaauacaccugcaucugcucaccucaccccaccccccacgcccccaguucugggauuaaagguguaagacgacacugccuaguuucuuuauauuuucaaauucuguuuuuccagcauauaaaucugucuuauauaguguucaauagaagaacuucuaauguacaccaguauauuuucauuaaauacaucuuuuuuuagacuauauaacucuuuuacaucuuaaugcaagccauauuuaaaacccuaaaagcuagagaaauugcuauuggcaugcauauuuucauugucuccacacaccaggguaacauuuaaauacuuggcuuuauaaauuucaguauuauuaugcuuauauuguaaugagaguauuuuacaauguugcguaauagccuuaugccauccacuuacaggguguguuugaccaucggaugaagugcuggcagaaaugggaagaugcucaaauuaccuugcucaaaaaacgugaaacugaggcaaaaaugaugguugcuaacaagccagauaaaauucaacaagcuaaaaacgagauaagagagguaauuaauaauacuuuauuucuuuacucagauuuuucaugucauucauauaugcauaauucucauuuuuucugaaucauucagcacuuggcuauuucuuccuauuuuuaugaauuauaugagauagugagaaguauuuaacauuuuaucaugauuaaagucugcagagcccuuuguuaucucaugugacuaugaaaugagugaagaagcaugcaaggaagaaaucacacauuaaccuucacauuuucuacauguccuccuuucaaaugguuuugauuucagaugguuauucguuuuguaucuaaaaaugguuuuaaagguagacuauccacauuucauucucugggcgauauuauccccauauauauguauuauauaugguguuuuaauaaauuuguauaaguuuauuauaauuuauacacuuuuuuugccaugcuucaauaaggaaauugaagagguaggacaaccuuuauauuacuacaacuaaguacaccugcucuuugcagaguaugaaccagugcuuugguuacggagugggaauaccauuucauugcuuaaauauuuauuuuagcuguuucauuggucacuagucauauuuuguuguuaccauucugaauuuagugauuauugaugaaucuucaguagauaauaaauaguuccacuugaagaaaaccuagucauuuuacuauugcaaaauguuuuuguuugucauauauugaggaauuuccaugagcacaugaauaaacguguuguuggaauucauauuguugacauguuuugaaauguguaacaguuuguuagugagcuuuauacucacaaucccuccaguugcaucuaguagguauuuguuagguggaucuuuauuuugcugcuuuugagacaggauccaaccauuggccagcaugggaguccuccuacacccucuuucacaaagugggaauuauagagagagcuaccauaccuggcaggacacuauaggccauuaaacauugaaauauucuagucuuaaguaaauguagugaugaguuauuaauagaauuuaagcuaacauguauaucuaccacuagaaagugaaguacacuuuuucugugcguguguggggugugcauauaugcguaugugugggcauaaguguaugugcauggacauaaugugugcaugcauauggauggcaaaguuucauguugggugucuuacuccaucacuuucugccuugugaauugagucgggaucuuucacuugaacccagaacucgcugauuucacuugucuagcuagccagcuuuccucugucugccugcaggguccacugggacuacgggcagcugucaugcccacccugcaucugagugggugcuagagaucuaauucugacccucaugcuugcacacaugcugugcccacugaacuuagcucagguucuagauacgugacuggauuaaguuaaauuggguuuucuaauaugaacuuucucgguuccuuuagccauuuugguuaaauuagaugaguaauuaugacagaaacauauuuuuuccagguaaaaauaagcauauuuuuucucuuguuuguuuuccuuagugggaggcgaaaguacaacaaggagagagagauuuugagcagaucucuaaaacaauucgaaaagaagugggaagauuugaggcauguauuauaauuuuguucuuuccuuaauuuugcuucagcucugugggaaaauuuaauguaauuuccuacuaauauccuuuuuuaauguauuguacuuuaacagaaagaacgagugaaagauuuuaaagcuguuaucaucaaguacuuggagucauuaguacaaacacagcaacagguaggcucauuuuccuuauagcuucugggguuucuugaagagucauuuuaaagaugacagguguuuaaacuggagggaaaauuaaaaguagacuaaaugcaaaaguaacuggaaaccaucuagcucugucugccucuacugaacagagacacacugcucccaauauuaggccauaaaaagucacaggggccuggagagagaucagugguuaagaacacuuccuguucuuagagaggacccagguucaguucacagcaugcacauugcaggucucguggauccaacacccucuuccagccuucuggaaugaauaccaggugcacauauagugcacaugccuucaacacccaugcacauaaaaccaaauacaucuuacuuaacaaguaccacauagauagcuuuccccuuugauauucauucuguuuuggagaugagcucucucuauauauauaccaggguagccuggaaauugccauccuggugccucugccugccuaguguugagguuguagggugcaacuacgacccuggcuuuacagcccuggauucccuuccuugucagacaaggcaggcugauagaguaggugcucccaguccaugucucccuaccacagcauagaaaccuauacuaaaaacuaaguuuuauaguuuuuucuuuguaguaguuugguaauuuuguuuuauuuggaauauuuggugcuugaauacuaccuauaacuggcauuuguuucauuagcuuucauaauacauuaaagucuauaaaaauagaauuuugcauauacaaauuaaauaacuuagugucuuuuaauagaaauaauucuucuaguuaguuuuaaaauguacagaauagaaacuuguuuguguaauacaaacucaagcuaggcacuguggugaaggccugcgaucccagcgcuuaggacgcacagggaggagaaucaugaagccuggaggccagccuguucugaguaauaauaaguuucaagccaaccaggauuucauaauacaauuuucaaaugaguaaaaaaaagcucgauuuuuaaaauuuaacugccaaguggugguggcacacaccuuuaaucccagcacuuaguuggcagaggcagauggaucucuugaguucaaggccaaccuaguuuauagauucagucugggacagccagggauacacaaagaaagccuaucuuuagaaaaacaaaaugaaaaacuaagucagaaaacaauuauuuccaaagaagcugcuuuaaauucacuuuuuaguguaccguuagucuguucuuuagaugacccagagacuggcagcugguuuuuccagucucucuuuuccuuccuuauucaguguugccucccuaccacugcccuuuaucccaguccucuuaaggagcaauaguauaaaaaguaaauauucuagaaauuaggauuugcuuuauguuagaaauggucauuguaauuaaguaaauuucgaguuuuuaacuaguaacuauauuuuauguauaauuuugcauauaucuaagaaguauaaagacuagauguuuuaacuuagcaaggaguaauguuuaaguagguuauauauuauuucugcugauaagacaucugguggggaaaugauccauuuaagaaccauauguagccaggcauggugaugaacaccuccaaucucugcacagugacacaggcaggacugccacagaaucaaggccagacaggucuaugugguaggggaacgugucugaaaaaaacacauugaaaaacaaaguagagaucaagcauaggcuaggugugguucugcaaguguaaucccagcagcagacagcugaggcaucauaaaauccugaaaguuaaggccagccugagcuaacagugguaccuucucacauauaguuauauguauaaauguauacaaagacuaaguuaguauuagcugcuuauguauauaauuuuuaaaaaaaagauauaugcauuaaaaugguaaaaaaagauuaacgaaaauaucucuuuuucuuaucacucacagcugauaaaguacugggaggcauuccuaccugaagccaaagccauugccuagccuuaccccugugaaggagacauuggauuccccagugagaucaucuagaaaccaucuaaauaaaccacucuauauuuuaugaauuacauguggguuuuuuauauauaaaaacauaugcgcugacauuuuauuacaagcugcauguccugaccuucuuugaauuaaguggacuguggcaugacauucugcaauauuuugcugaauugaacacuauugugucuuaaauacuugcacuaaaaaagugcacugcaaggccagaaaauuuuacaaucuucuuucuuuuauguucuguaguguguuuacccucauuaugaagcaaauuagcaaugcauugauuaauguucacuuauacauuccuguacagaaauuaugauuuuugugauuauaguaauaaaaugauauuacuugugaaauauuaguaauaaauuauuugaguauauaaac

SEQ ID NO: 8925 - RNA, 933 nt, Mus musculus
cuuuuuuuuuuuuuucucauacacauucaacuguauuuaaagucuggaaaaugcuaaaaguaguaauuauacaggaggcugaagagcaaacaggugugucuccugcaguaaacacuaggcagacacagcuuuacuugagguauggagcagggaaaaauuugcccuguugaccuaaguugguggcagacuugcucuuguucccaaaucugggugugcccuuggagagguuguacaaccucugacagggaacuugauaaaggagucuugacaagcuggaauucaggaguggucacaggccccaauaagcucacuuuaacgucuggugugugugguguugaguuuccauugccucucuggcugucuauguucucuugguccaccaucacgaacugauuccaguacuccaggggcagagagaacaggcgagaacaggcgcuccaccaccuugagcugacguuugauguccuggaacauugucacuggaucuggauugggcacaguaugggcaacuauuguagggccaaagacuuuagcuagauuggcaauauccaucuuagugucuggacucugagacacucucuguagguggaucauaaggaaggcuagcgugucccuguuggccuggggcagcucacugacagccugguacauggcggcugugcuguugucuuuaucuguuaucucugcuaccuccaugaaggcuuugcucagccaaaaggucaggaggggcucuuugagguugcacaggaaguccuucagggggcugcagaugacguggauaucguccacuuugcugaggagggguacaguuuucaccuuaaggaauuucucuuucaguucuuucacuguccggucacagccugagauccuguacaaaccugccucagucaggccucgcugcucgaucucauugacacagaaacgccaaauucu

SEQ ID NO: 8926 - RNA, 649 nt, Mus musculus
ggugacucugugccucauggaggaaaaaucaacuaaacaugggcaaaagagauccuaagaagcugagaggcaaaauguccucauaugcauucuuugugcaaaccugccgggaggagcaaaagaagcagcacccggaugcuucugucaacuucucagaguucuccaagaagugcucagagaggugggagaccaugucugcuaaagaaaaggggaaauuugaagauauggcaaagggugacaaggcucguuaugaaagagaaauagaaaccuacaucccccaaaaggggagaccaagaaguuguucaaggaccccaaugcacccaagaggccuccuucggccuucuucuuguucuguucugaguaccaccccaaaaccaaaggcgagcauccuggcuuguccauuggugauguugcaaagaaacuaggagagauguggaacaacacugcaguggaugacaagcagcccaaugagaagaaggcugccaagcugaaggagaaguaugagaaggauauugcugccuacggagcuaaaggaaaaccugaugcagcgaaaaggguguggucaaggcugaaaagagcaagaaaaagaaggaagaggaagaugaggaggaggaugaagaggaugaggaagaugaagaugaugauuaau

SEQ ID NO: 8927 - RNA, 1042 nt, Mus musculus
aauggugaagguucgugugaacggauuugcccauauugggugcccgguuaccaggccugacgucugcucuccacauggcaaaguggagauuguugccaucagcgaccccuucauugaccuuaacuacauggucuacauguuccagucugacuccacccauggcaaauucaauggcacagucaaggccgagaaugggaagcuugucaucaacgggaagcccaucaccaucuuccaggagugagaucccgcuaauaucaaauggggugaggccgguguugaguaugucguggagucuacuggcgucuucaccaccauggagaagucuggggcccacuugaagaguggagccaaaaggguaaucaucucugccccuucugccgaugcccccauguuuuugaugggugugaaccacgagaaauaugacaacucacucaagauugucagcaaugcauccugcaccaccaacugguuagaccccuggccaaggucauccaugacaacuuuggcauuguggaagggcucaugacuaccguucaugccaucacugccacucagaagauugugggugccccucuggaaagcuguggcgugauggccguggggcugcucagaacaucaucccugcauccacuggugcugccaagucuuugggcaaggucaucccagaguugaacaggaagcucacugacauggccuuccguguuccuacccccaauguauccguaguagaucugacaugcugccuggagaaacuugccaaguauaacgacaucaagaagguggugaagcaggcaucugagggcccacugaaaggcauccugggcuacacugagggcccgguugucuccugcaacuucaacagcaacucccacucuuccaccuucaaugccagggcugguauugcucucaauaacaacuuugucaagcucauuuccugguaugacaaugaauacggcuauagcaacagggugguggaccucauggccuacauggccuccaaggaguaagaaacccuggaccaugaccccagcaaggacacuga

SEQ ID NO: 8928 - RNA, 2198 nt, Mus musculus
guuuccauccauuugucuacagaguuugugagguuggcguuuuuaauagcuaaguaguacuccauuguguagauguaucauauuuucuguauuuauucuucugucuagggacaucuggguuguuucuagcuucuggcuauuauaaauaagauugcuaugaacauaguggagcacgugucuuuguuauguguuagagcagcuuuuggguauaugcccaggaaugguauaguugggucuucagguagaguuauucccaauuuccugaggaaccaccagauugauuuccaaaaugguuguagcaguuugcaaucccacaagcaauuggaggaguguuucucuuucucuacauccucgacaguaucugcugucgcccaaauuuucgaucuuagcuauucugauugguguaagguagaaucuuaggguuguuuugauuugcauuucccugaugacaaaggaaguuguccuggaugucagggaagcaagaggcucccaggacccaauguggaugacauuagacaaaauacccagcaacaggaagauagaaccugagagaccaccuccagaagacagacauggcucccaguggagggauggggcuauccaucccucucaaaauuuuuaacccagaauugucucugucuaaaggaaauucagggacauaaauggaccagaaacugaaaguaaggccauccagagacugccccaccaugugguucuuccaucugcagacaccagacccugacacuauugcugaugccaagacaugcuuacagacaggagccugguauggcugucugcugagaggcucugccagcaccugacuaaaacagaugcagauacuccagucaaaugcuggagugagcauggguaccccaauggagcagcuggaggaagggcggaaggagcugaagggguuuguaacuucauggaaagaacaacgauauuaauuaaccagaccucucagagggccuauagaguaaaccaccaaacaaagaguauacaugggcuggucuaugacuccaucuacauauguagcagaggauugccucaucugccaucagugggaggggaggcgguugguccugugguccuguggaggcucgaugccacagagaagagggauacuagccaggugaggagggaguaggugaguguguggguggaggagcacccucuaagcggcaaagggaagagggauucauggaggggagacgggaaagggguauaacacuugaaaugcaaacaucagaugauuaauaaauuaaaaaauaaccugauuauaaaaugaacaaacuuguggaaggauauuucagggaaacaaugaggggaagaaaaacucauguaaagaaaacacaagaaaaacacagcucggaaugcugagaaauacuuuguuucccaaauguucccuuucucuaccuguaaaaagugacaccgugcacauacaauuucauaggcugcuuugagaacauuuuuucccccagugccugcuggaguuucuggauuugccugaauucuuugaaaaccuaucuccacuuuccagagauggacaucgggccacagaaaugcugcucugccagggacagacggaccaaucaauacacauucuuuccagagauggacaucgggccacaggaaugcugcucugccagggacagacggaccaauacacauucuucgagaagcaugagcugcuucuucaaaacagucauguuuuccgcagacuggugaaaguucagaugucagaaaugaaccucuguaaaagaccaacggaucaaagaugcuacguuaaaagcuguccuggauggaaacuucuagaggguuccuuagauggcgaggauggagucccccaaaagugucugcucucuaaaaucaucagugaugucagagcuagcuggguuguaagcuuugacauccucucuuuuauggaaagcagcacugucacagccaggcaggucaccacacugggaauccacaggggaauuggcucugggugggguggggugggggcaguguaaggauucugggaaugaaggcaaacugcagauauuggggugugugugcgugugcguguaugugugugugugugugcucugggcaagaaauaaagcaacccccugucccuuuuggcuguaaccaguucaacacugcugagguccuucaugccacucuguacugcauuugaacuucugaaaaaaaua

SEQ ID NO: 8929 - RNA, 19764 nt, Mus musculus
uuucuccugcaggcgcgacaggcgcguggggcugagcggcguggcgggggcgcuggcgcggcugcccgcccgcugcugcugcacgggggucgcggucgccauggcgggcggcgggaccgaagguacaaaccacaggccggugaggaucgagcggaccugggcuggcgguggcggcggggcuaccgcacaaagagcgaagcgggagggccgcgaucgcccgccagacgcccuuugugaguguacacgcacacucgcagacgcgcgcgggaagaggccagggcagccgggagacgcagacggcugugcgcggcggacgcgagucucccgcccgcagcacuuuguuuccucucgggcugcucagagcggcgggcgggccgaggaggagggcggcgagaggcgggcaggaggcgaggcgcggggggcggagguggcacgggccgcgcuccgcaacauggcggagcccccacgugaccgccgccgaaccaauggcgagcggccggcgcgccccugcggcuuggggaggggcgggcccggccuggaaauucaaaaucugacccucgggcaaccgucggccucgagccccgagcugggcguggcggggaggggcgccccgagcgcugcucgguccuuagcccggaacccagcgccugccgccucucguggaaccccgugcggaccccuuggaagggccgggccugcgaauggcgggaaagagccgaaggcuuccggggcggguccgcgccgccuccugugcccgccguucggggaaauucaaaaguaaacgggagcggccacgggcguccgcggucgcccgagccucaccccgaagccuggccuaaaugggugccugcggucccagcucgcagcuugcugaucccaagugcgugcccgugucuuucucuaggaaggaaaacgguccgcgggggcaccuaguuguguggaagccaacagauuguuuauuaagaaaaaaaaagcaacauugauuuuauuuuauuuuauuaaucauuggcuaugaacgcggaugggcggucccugguccguuuucuuggugugcguuuuuguaaaaucagaaacagcccaccaaugacuugaccuaaugagauaaacucucgucgugguucguuaaaauaagauucauggaagucuagacuugugaugauugaaaugaccuuuguuuuguuuuaaaaagcccccccccccaccccagccuaccccacgacagaacuggucccuagauggauguuuugauccugagacaagguuuuugcuucgucaccccgguuaauuuggggcaaaaucuggccucagccuccgcagggcugggauuacaagguagaagaaagguuugauuugguuuuggguuuuuuugaaguucucagaccuacacguggagugguuccagccgcgcacugccugcucucucucgacagcgagugcuuuucuagggacagaguuucucaaacucagauuuuguaugugcaguugauacauuguauuuugugugugagcucucagggaucaaagguggccugaggacuacuuggagucccuuuccacaguggaguccuggcgucgaauggaacucaggcaugucaaagucccuuuaccugcugaugcguccccacccacccccagaaagcugugucauuucuuuuuuuuuuuuuuuuuuuaagauuuaucuauuauuuuauguaaguacacuguagcugucuucagacacaccagaaaagggagucagaucuuguuauggaugguugugagccaccaugugguugcugggauuugaacucuggaccaucucaccagcccagcugugucauuucugaggacauuauaccaugauuucuucuugggaaaauggaaugauuccuaguuuccagggaagauguauaaugauuaaguauaugaaauguauugaguaucaugaauagauaguagaucucacuaauuguaaucaacuaccccagucaaugaaaaggauuuuuaguuggauuuaaguaguugcccccucccccacuuuuggcugugugugugugugugugugugugugccggcugucacucuccucuccugggaugaaaguagcuuucaacuacacuuuccccacagcuaacuaccgggugugcacccucuguuuuccguucuucccuguccuaauaaaaauaauuucugaaauucccucaccuccagaguuuuccauaacuagagaucguuuuuuaagucuggugagaauacuuccauauugacuaguacaaccaugguuucaaauauacuuuccugcuuuuccuauaaaacucaacaugucagggcacauaucuaauuauugguuaguuuauauagaccccaccaagcuccaacaugcaugccuuuguuuuuccucuucuauagccuugcuguaaugacagccaccuuacuacauacagggaccuuacauggcgcuugcccuacuuccuguuuaucauuuggauuuaggauggaaaauauaggacacccaagagaucuagaaagaaggggcccagaauaggaugaggaugggcgggguuugggggugaggggcuguacuaacuugcagaaagccacuuuggucccaggaguggagagugacagcugacagauagcugagcaugcgggguguacaagccgaagagcuaggacagaggcagaacugagaagugcuaaaaggcugcucuuccacauagauuuacugagugagugaaggcaaaaauaauuuaagaacaugauccuccacggaggucaguuguuucauauuuacuuugcaaaauggacuuuuuuuuccaguugcaaagguauaagaauaaaucguguuucaggcgauugagcgacuauccagucucucucacaauucugauuuugacuucucuguguuaaaagagccuagagaguauaaagcacagugcagugaccaucugugacuaggguuguccucacagcccagccucugccaggucauguaacacgcagaguuguuuuccaaauccacuuguuacgaucuacacacgugauaaugggauugguggaguuauuuuccuuuaacucuguaguuucaucuuguuguuuugggguugguucuucaagccugagauucccuggguagcuggccucgaacucagaaaucugccucugccucccaagugcuagaauuaaaggagugcgccaccacuaccugauuuacaguuucauguuacuacuggcaugcugguuaagguuuuuuuuuuuaagugauuugcacucuuacccacaggagucacaugacaaaauaaugcaacaguuuaaaucacuguaaacauauuuuaaagcauuuuuaaaucaauguuuauguaucugauucuuaaaguuuuguuuaagcuuaaaaggguugccccuuccccaugcaucucugcccuugagcaugauuuggaaguggcaguaauuuuuuauugcugucaaaguguaagguuugcagauaaucuggcugcuucuaaucugauuggaacuggcccagcucaaagaguccggagcuuuccauccuccugaucaacccuagguaggucacucuuuuuuuuaaucuugagcuauggcugacuaguagccaaauuuauuagcuuaauuccucuacuacagaaaugagacucuucucccugaagcacuauggguaguuaaugguuacuggagaaaacugagucaguuucaucaaugacguaggcucugauaaggugccccucacaaguaacgcuccggacucacacauacucaugcaagcaacucugauuacacucagugggucacaggaacgaaaagaggaaaagaaaagagauaugaaaauaagagggcagucggguauggaacacucagggacagaagcaggcagaccucucugaggccagcuugaucuacauacugaguuccaagacagccagagcuacauggaaagaccccaucucaaaaauaaaaaagguggagacuuugggguggggggggggaagacguucagaaaaaaagagugaguggaaggugauuagacagggugauguggauuagaauaaccaaaauauauaugacauuguugaggaugggccaguguuaugacucagucagauaagcauuugucaccaugacugaugaugaccugaguucauuuccugacacuuaggugguggaaggagagaauggacucccacaaguugcccucugaccuccacacaagcaccuauaugcacacacacacacaaucaucaauguaaaugucaaggaauuauaaagacuuccuaauaguccuucccugcuuggccuccucauguuuccugaagacuucguguuccagaucaaaaugaaaaaagauagguggcaucuuuucccgucccugcaacuagaguucaggaaagcaaagcaaaugggugguuggggggagggggaggacgcaacaucuguauggucagcauggaaauauaaaacggugaaguuucagccagauagcaaugagucucccggucccauccucgaguugucauucuucugagauuguuagacugagcuaagguuucaagagucugacugaaccagcuccuuccacuuuaaucuuuccacaccuaauaaaauucccaacuguguaaaggacagguggaagccagguacccugugagacucaagcucuuuagucacacucgugggcugaaaugaagguagggguugaggcucaaacagugaagaugauuuguggcucacagaaaaguugccccccauccccaccacaccgcauucccucuacacuggaucagcagagcagggucccccagcaaccuuaucuagaacuguggcggucagcagcaucaaaaagacagcaaauagcagagcacuugccuagggcucaauccccagcaccgaaaccaaaaaacaguccuaagggguaagauaaaaggaucaucuggccuaaccugggugccagaugcccaguuagauagucaaacuucauucuagacguuucuguaaggcguccagguggcguuuaauuucagucaacagucugagugaaugggaggcugggauaggucaggacucuccucugaggaaggaaagggggauacuagcuaaucucuggcuugaucgucagccuuucccagaccuccagccuacaaccuacccuguauauguuaggcucaccagccuugaaccaauuccuuaaaauauaccugcccaguauaaauauacacccugucugucugaaagguuuuuaggaaaacuagacuaauacacccuccuucuucauccaaaaggucugaaagagcuaaugaaagccugcagguuggagugagccacugagacaggaaagauuccaacaucuguugaacauaggcauguuguggucuaaggcucaaauuacacuauggcacacuacauaccgaagagaaaacacuggggcaggugaucgccacucccaaggucucacauacaugaccuaggccccagcuaccgagggcugaaaagccaggagcaaaguaacaauuuaggagcaaccaagggcuaaaggugugugggaggagggagcagaacagacaaucugugagcgggcaucuaagaaugucagccuccagggauuggcaaauggauucgauaccuuguagagaccugaaaaugccaacccacagccuccagggggaaucgguggaacucucagguggcgucccuaaucuccuuauguugugcuuuuuguuguaaacugcgccacacacggggagugcuucaggaagugacgagggauggggauuucagucccagggcuggccuucacaaaucaaggaggauggaaaauugaagacacuacuuuauuauuaaaacaaauaaauugguuaagauggaucaaaaauaagaguaaucucuugucuaaagcaaaaguggaaagccaaacagaaaaauguucuugcauaccuacuguguguaaggcacugcucucuauucuugaaaagagauuucuaaagacuggggagauggcucagcaguugagagcacuugaugcucuugcugacaacccagcuucuauucccaggaacuuuaucuucaucucuguaaucucuguaaacuccaacauccucuucuggccuucaggaauacauuaugcaaacacauacaugugccuacuuacaaacaugcaggcaaaauacucauauaaacaaaucucaaauaaaucuuaaaagaaagagaacccggcaugguggagagcaaguuccuggacagccagggcuacacagagaaaccuguuugggaguuguggggaaaugagaaagagggagauuuaugauugcaggccuaacauaugugauagagguacccagggcggggggacggggggagggagggggguccuggagcucuuugagcagucagucuugccaauugguaagcaucaauuucugggagagaauccuuuaccaaaagauaaggaugauaagguaauugaaaagcaauugagcaagauaccuaacgucaacuucugcuuucagcacauauaauaacacacacacacacacacacacacacacacacacacacacacacuaaaguagaauuugacugaauauuuguuagagaaguuuuacaaaguuuaugaauugggggcuggagagauggcucagcaguuaagaacaugaacugcucuugcagagguccugaguucaauucccagcaaccacucgguaucucacagccaucuguaaugggauccagcgcccucuucuggugugucugaagacagcaacaguguacucauauaaaaaaguaauaauucuaaaaaaaaaaaauguauuaaaauuuuauggauuuuccccugggcacaugaggaaggacaggcagugcacaccucucagauucgaggggcacaugggauuucuccuguucgucaaggggucaugaggugacacaaugacggagaacacagagaugugggacuacaugcugagccuuaucucacugggacucugaguugcauccaggacugucaggguaaguaucagaucagaaacaaagcauaacuguaucagaggaggugccgacacaguugggccugcagaaaugacccagcaccuccgcauccgcugggggaaagugcccucccuggguuaaccccuucacagcgcuuccagaaguguguggucacugguaagauacggguuucauuucucuaacuuccucaagcuuucauuuacuagacuuccuuuaguggaucccacuugguugaccuuaaagugaaggauggagaaaugaaaucucaauugucauaggaaaaagggaagucaccaaauuacaggaguccaaaauuuuuauuuuuuauaauguuuuuguucuuugaaauuauauuuacauauuuacaccuucccuuuucucccuucaaccucucccgagcacugccccacugcuuuaucucaaauucacggccucuuuuuaguucauuauuaaauauguacacauaugcucucucacacaaauacacacacacacacacacacacacacacacacacaugauuaaauacauguacagccugcucaacccauguaaugucaccuguacauauaugaucucagggcugacagcucgcuauuagauaaccaauugggagggcacucucauuucucccacugucagcgucccccagacaccuguaauucuuuuucuaggguugcgguccuuucauguuaucauguguacuggugucaugcuuguucaguucuuguuuaggcagccauguugguaaagcuuugugcgaguaaauaucugacguuccuaggagaaacaaucucccagcaaaugagcccugagcccuggcagcuguguuggagguuuaucuguuuggcaccauuuuuauuucuaaaaguaaguuaagggccagugagacuccuuccucagcaggugagggugacuacugucgagacuggugaggugaacucaaccccggggacccacauggcggaaggagagaacuaacugacucccacacguuaguguccucugaguuccacacaagugccauggcgugcguacauacauaaacauaaguaagugcaguuuuuuaauugaaaaaugaaagugcagagcuggagagauggcucagugagugagagcauuuguuccucuugcagaggacccagguuugacucccagcauccacaugaaggcucauagccaucccuaacuccaguuccagaggaucugaugcccucuucugacaugguggugcacauacauacauucaggcaaaacacucacacaaaauaaaaauaaaaguaucuugaaaaacuuaaaaacaaauaauaaauaugugaauaaaagcaucuguuuugggcuggugagauggcucaguggguaagagcacccgacugcucuuccgaagguccagaguucaaaucccagcaaccacaugguggcucacaaccaucuguaauaagaucugacucccucuucuggugugucugaagacagcuacaguguacuuacauauaaaaaaaaaaaaaaaaaaaaagcaucuguuuuauuuugucguggacacuguuuaucuuaguguagcauugguguuaagaaaauacugacuaguacauacagugauugaauuguuguagcuugauucaaucuucuuuccuuguuuguuuucauuuggguuuuuuguuauucaagacuggguuguucuguguagcccuggcuauccuagaauucacucuguugacagagauccuacugccucugccuccugaauacugugacugaacaggcugaauuuaacaaacuuucaaugaauaccaccgcacgccgcuccagagaaguaacaaaggcagucuccauccccaaaaguguuaggggaaaggucauggucagucucgugacuuaugcugccucacaaugaccuggaagucaaccucucucccaacacaagcugcucaggcugcugggugauggccagucacuucccauuggugucaaggccugaauagacaccacgcuauugcaaaaggccaaaggagauaggaucuauguuucuuagauacaguauuuaaacaguccaccacuuccacaauuugaaaagaaaagugaaugugagcuuucuacaugacuaccagaccaagcacuguugccugcuggacagagaaaggagagcauuaaaagugcagccaucugcaugcccuggcuccuggggaggcuagacaagcuaauuggcacccuuacccaccucuauacccacccuuaccauuaugccuccaccaucuggcuagacagucccgucugccaacaccagcuccuuccagcuuucuuuggcugaaggaaaccauagaugcgcaucuuccuaggaagacaaaaacaagcuucaguguaacuuuucagccuugaauuuguaaaauuucaaaagaaaugacacagaucguccucuuuguccccacaagcaauaccccaucccucacuggcucuugucaucuucuccaucuaggcaaagugguaggugugggauccagugugguuuguaauugacaguugucuaaugauagccgagagacuaaucccuguagugaugcucccccgaugguuucccucagauaguuaggggcauacaugggauucaaguacaguaaauauaaggucucuuacuaugaagccacaagaaacggugacagguauguuucugggaugcuaaaaacucagauagcgucgauccuuacagacucagcggaaagagcaccaguaacgcacacuaagguuuugagggguuugagccuuccaacaaguaaacaccaaguagcuaacaacagagaagaaauaggacuccgucugucugaggacagaugugaccuggauaagcugaugcuuggaccacccauuuuguuuucauuuaacaaaauccuguuugucuguguuacacacacaucuuucccuauuaguucuuucuuauucuaaggguuuguuuguuuguuuguuuguuuguuucaagauagcaucucacuuuguagcuuuggcuguccuagaauacacuauguaaacuaggcuguccucacagagcuccaccugccucugccuguucccccaugucugaccuuuuuuuuuuuuuuuuucuauuuugaacugcaaucauuauagacuuuacauauaugucacauauaauauaauguuuaaauauauuauauauaaugugauaaggccuguucgagacaaaaagccauugaauacccacuuugaaaaucacagagcucucauugacucagagugggaauccugguuacgauguugguaaugggcugcgguuagccugugaugagaagacgugcucugucuuuccauugcaggcacagcaguguaaacuuggaaaagggaagagcagcaggguccugguagcccaguuuuugccaugcugagaugagguaaguuacucgaagaaaacguccaaguguacuuuuuacuuuacaaacaguguagaauguuuuucuaaauuaggugaaaugaaguuguggcccagaucuguacagaacucaaggcacuccuaccugcaggagauuuuuucuauauuuuucaccucuucguccacucuacugagucuaaguguccggggaauuccucaccaucugaauuuagcaaacaacagguacuaccucccuccaguccucaucuucuucucccuccuccucuuccucccucuccuuugaaaaggaaagaacaggaaggcaagcuguaagcccuggcagccucuggaagggggaggcuggagagaggaagaaagaugaccguaggguguaagaaaagagcguaaaagugaagggucagcaggacgauggaggcacacgcuuuagucauagcacagggaagccgcggcaggagaaucucucccuuugaagccagccuggucuacagagugaguucgaggacagggcuguuacacagugaaacccugucuggggguggggcauggggguggagaaaaaggagaggauguaacuggucuccagaagaacagugaggaucccagagugucaaggaaagaaugcuuaggccucuggaccccuuccaaagaagauauggaaaggcuauccuagaacuugcuuuguagaccaggcuggccuuggacucaaagagagugagugcugagaugaaaggccugugccaccacuaccaagguggaaaagcuuuccuguuuuugaguuugaacuuggaagagcagacaggcuuauugcuguuagcauugcuuuuggaggcucuguacuggggagcagcuccagggacggcugaguacacccucucauuaaggagguaauuacuccuuccaacucgaauucgcuuuccugcaggguggucuccaggcgauugacaggcuugguuggguuaauccucaagggagagaauaguaggcaguuuuaaucuuuggucaaagccgcuucucacccuugacacuaaaccuccagcugcccuuuucuuaggcaacuuuggccacucagaugaaccagcucuguauuuugacccaaaacccagugguccaaagcaagacaaaagcagggaauccguuggcaguggggacaucaggagccuguaaguacaaccuugugugauggcagcugucuagacuaugcuugucgucuaucaagagcaaucugaccagagacgacguaggacuccugcauuagccuuuuuugacccugaacucuaaccuucugaggagucugugagcuacaugguacauuuucagggcuccccucuuuugcuuauguugagacugcuuucuacuguaacgaagaagccuaggagaaagagccucuaauaguaacuuacaaagauuuacagccagggauguaggucaguggggauguaggucaguugguagaguguuugcccagcauccccgaaacccuagguuugcucuucagcaggagaaucaagagguucagggucauagucagcugcuacacagcaacuucaaggcauguccccugucucaaaaagaagagcaaaaagaaaggaaggggcggggagacagcucagaguguaaaucacuucucaggcaagcgugaggacccugaguuugaaaaggcugagcacaauaaugaaugucccagucuuccuacagagagucagggcagcugaaagagagucuccaggugcucaggggucauccagccugacacaagcaccagugagugacagagaccaugacgcaaauaaggcggaagguuaucaguccucuggcgacauaugcugacacccaaagucucugucucucucucugugucucucucucagacacacacacaugauuucuuuggaaagaaguagagaggaagaaagaaaaaaauaaacaaauuauaagaacuguugugggggugcuggagagauggcucagccguuaagagcaccgacugcuccuccgaagguccugaguucaaauuccagcaaccacaugguggcucacagccaucuguaaugagauccgaugcccucuucugguauaucugaagacagcuacaguguacucacauauaauaaauaauaaauaaauaaauaaauaaauaaauaaauaaguagggguauccaccagagaaaacuccugagacacggcagacacagguuuaagccaacagaacgucuuuauuagcugaccagcaacuacacggggugcuccaggucccagugugagguuuuuguuuuguuuuguuuuguuuuguuuuguuucacaaaaaaucauguucuggguggacaucaguuaguaagaacaguuagccagaaaccaaacuacagaagccagaaggcagggucagcacaguuagagacuuucccagaacuaugggccuugaugaguucggucuuugcuuucauuuuggcagguagugcugucuaugugcagaguuauggccugaaugguucuucuaacauggggucaguugugcuaauauccgggggccuguuacugaagcaaggcagggaguauaggaucucuuaaacguguucaacugcucauaaagccaugaguugagggagggccaggugguucaggaacacguguguauuuuacucacuagagaggauaagggaaacuuuuacugcuucuugaaagcaaggaagagaaaccucaucuuuuucuaggucugggucccaaaacaugugcaaaauauaggacuugucucuaaaggucucuuguccacaugccuaguaccauuuccgcugcccucaagucuccugaaaugaaagauccucuaauguagauaaaugcagaacagguagauccugaagguaaugucagauccuucgaagucuauagcucccugcuccgacauuaacagucagcggggguuagaacaacaccugcuggagagccaugggcagugccuggcagugucaaacucuuagucuccccuccccacaccccccuuuuaaacauucuuagccuaagcuugaucagagagcauauuaaucaggguucucuaagcagaaccaauacagugaguauuguuaaaaguaucuuuaaaaugaaaguuuuguugguuuguuuuauaaagacagaguuucuacauaguccuggcugucuucauuauguacaucaagcuugccuugaauucacagauccccuccagcucugccucccaagugcugggacuaaagucauaugccaccacaacuggaaaaaaauaaaauaaagauuucucagacuggguuacaggaugugauucaggccggguaguccaagaaugacugacugucccgagacaaaaagacagagaagaugguaguuccuguccauaugguuaaaucuucugcagucccucucuggaguuggagaccugaggauuccuggagagcugcaggucuucagucuaaguugacuucaacacuggccaaagcaacaggagucacuugccagccagagugaggcaagcaggcaaaaaacaaaguuuccuucuccccuguccuuuguaucugggcugccagcagaggcuguguccagguauaggguggcucucccuccuucaaauaaucagauuaagaaaaauccuuaugagcuggagagauggcucaguggaggcaaaggcaggcagauuucugaguucaaggccagccuggucuacaaagugaguuccaggacagccagggcuacacagagaaacccugucuccaaaacaaaacaaaacaaacaaaagaacacugacuacuuuuccagagguccugaguucaauucccagcaaccacauaguguuucacaacccucuguaaugggauccaaugcccucuucuggugugucugaagauagcaacacuguacucauauacauaaaauaaaugauagaaaaacccuuacaggaguggcuagccucuuggguuuuacugaauuccaaauacagucaaauugacaauaaagaucaaucaucacagagaguauagcaacauuucuacauuuucuuugagguggauggcucauuggguaaaggugcuugcuaccaagcaagcccugaaaccuguguuugauuuccaggacccacgugguaaaagaggagaacugacuccuacgagguuuucuccaucuuccacaugugcucugugacacacauagucacacauaguuagacacacacacaagcuaauauacauaaaaaauaaauaaagauagcaaauuuugcuuuauaaacauuuaacacauauugauuuauuuuguuguuggugguuuuuuguucuguuuuuuuuuuguugguuuguuuuguugguuuuuuuuguuguuuuuuuuuuuuuuagucggggucucucuauguagcccuagcucuccuuucuguguaaaccaggcuggcuucgaacucauagagaucuaccugccucugccucucaagugcugggaugcaauacuacacccuaccuuuacuuuauauacauuuuagaaagaacuaauguuaguagacaugguaucugcggagguuuggaugaaauauccuacauagccuuggacuuuuuuuuuuuuuaagauuuauuuauuauauauaaguacacuguagcugucuucauacacuccagaagagggcgccagaucucauuacagaugguugugagccaccaugugguugcugggaaucaacucaggaccuuuggaagagcagucagugcucuuacccgcugagccaucucuccagcccagccuugggcuuuuaacaacauagucuuuccaguuggugguacuuuuuuuuuuuuuuuuuuuuaguuuuucaagacaggguuucuuuguguagcccuggcuguccuggaacucacucuguagaccaggcuggccucgaacucagaaaucugccugccucugccucccaagugcugggauuaaaagcgugcgccaccacugcccggcuuggugguacuuugggggaauguuuagaagguguggcuuuguuaaaggaaguacgucacuagugggggagggggacucugaaguagacucuagacaucccccauaucacugucucugccuugugcuugcaguucaagaugugagcccgugccugcugccugcugucucugagccaccguuuuggacccuaacccucuggaaccauaauccccaauaaacucucccuucuaucaguugcccuccucauggcauuaucacagcaauagaaaaguaacuagugccguguuaugcacguauacuaguggcacuuagagacugagacagaaggguagcaaguuccaagacagccuugccuauguacuaggcucaaggcagaccugggcuacauacugagacccugacuccaaaaaacuuaaaaucauguuacacuucaaaagaaagugaauuagccagguguagugguccauaucuuuaaaucccagcacccaggcaggaggcagauggaucucugugaguucaaggccagccagggcuuuacagcaaggcccugucuggaaaaaaacaacuucuuauaaacuuuugguggggcugagaaaugguuccuguuguuuaauagacuuagucacuuuuuccuucccaaugaauuacuguguauaucaaguacgauagaaucaccaguggcugaaaguuuguaaugauacaucagagauuaaugcaaagggaaugcaacuccauaaaacuaagcguggcgcgaugguaugugccuuagaagacaggcaauagaaucacaaguucaaggucaucacgagcuacacagcaguuucaaggacagccucuacuguaccagcccuugccucagccaaacaaaaacaaacuagaggggacaaacaucuguuacaauuuugauauaaaguauccagguguuuaauauuaguuaucugucuaguggcaggagagacaaacaucuguuaugauuuugacauaaaguacccaaguauuuaauauuaggaaucuaucuggcauuauugaaagguaacagggucaugagagcacuaauuucauugaagagauuguagcuguggugauuugaaugagaauggccccucauagacacauagacuagaaauacuuggucaccagggaaugacauuguuugacagguuaagagguauguauggucuugcuggaagaaguguuucacugggagugggcuuuuagguuucaaaaagcccaucccaagccagaguugccauggcugccugcgugcuacauugcuucccaccaugauaauggaccaaaugucugaaacuacaguuuaaaauaaugcuaaacuacaguuuaaaauaaaugcuuuccuuugugagaguugccaugaucaugaugucucuucagaacaguagaacacugagacaguagcugaauggaauauugggagaugggggccuaguuggaggaagcagucacugggcuauucccuuuaaagggcauaucauggcucuagucccuuacccucaccucuccugucccuccuccugucugccaugacucucuugagucuuaugucucacauacaggagcccagaaacaacagagccaaguaaccacuaaggacugcaaccuuuaaccccgugagcgaaaacaaacccuucuucccuuaaguaguucaucucagacaaaacaccaagugacacaagauccuuaccuagaauguggcaguguggccagaccaaagugaaaaaucaccaagugaaaaggaaagcugggcagugguggcguaugacgccuuuaaucccagcacucaggaggcagaggcagguggauuucugaguuggaggccagccuggucuacaaaguaaguuccaggacagccagggcuacauagagaaacucugucucgaaaaaacaaaacaaaaacaaaaacaagcugggcaugguggaggagaugagagugcugcauccaaauuaggagacaacuggaagagagagugacacuggagacaacuggaagagagagugacacuggaccugacuugagcuucugaaacucaaagcucacacuccagugacaguguuuuguuuuuguuuuuguuuuuguuuuuuccaacaaggccacaccuucuaauagugccacuuccucagggccuagggggucgauuuucauucaaaccaccauauguggccugacgugguugguggcacauaccuuuaguccuagcauaagggaggcagaggcagguggaucucugaguuagaggccagccugaucuacagagugaauuccaggacagucaggauuacagagaaaccaugucucaaaaacauaaauaaauaaauuacuuaacuaauaagaaaagaaaagauaaauaaagugaagcgcauuggaaagauauugguuaagugcacuggcuacucuuccagacaacguaaguucaagucccuguacucacauagcaguucacagcaaucuauaacuccagucccugggaaucugacuuccucuucugguaccagccauguugcaguguacuuauaugcauguaagaaacacauacacauacacacaucuguguguauauguguguguguguguguguguguguguguguguguguguguguaauuguaguacucuggaggcugggacaggaagaucaccagaguucaaggucagccuagaaaaucuaacaaguccaaggccagccugggcuacauggugaggucuuaucccugucucacaauucagaaaaaaaaaauuaaaaaugaguaaauuaaaaggcuacugugcagcaaggggaagaauuggaguuaaacgcuuccagaauuggagaaaaucuuuucagcuauuugucagacagagggugaauauccagaauacagaaacaguuccaaaaauuaaauacuggaaagagauaaaaauucuuaaaaaaaaaaaaaaaaaguaggaugaaguauuccuuagccaucagaggaacguagacuucacugagagcccacccuggucagaaaggcuaucaucgagaaaacaacaaauccuggagagaaugagagggauucugacaugguuggugggauguagguuaguguagccacuuuggagucaguaugguaauuccucaauaaacgaaguacagaaauaccauaugacccagcuacaccacuccuggguagauaccugaaggaacccaagccaauaagcagcagugagugugauaccuucacaccauauuaucaaggcccuguucaccacugacaaaagaauuagcuugguucccaucaaccaauaaacuuauggcuaaagcagaaaccugggcuaugcagaaaguuccagagcauucugaacuagaguuauacccugucucaaccaaucaauggcuaaagcaaauacagacagcauuacucagcuaugaaggaaggggaaaucacuuugucugaaggagaaaagcuggaaguggagaccacacacauuaagcaagacaaaccagacucagaaugacaagauccuaaguuuucucucaugugugacucuaggacacaggguuaagaaggcaugaagaagaagaagugguccaugccuaugauccgacuaucugagaugcugaggccagagaaucagaagccuuagcugccuagcaaggucaaggccagccuggguuacacgcucaaauaagcaaacagaaaaacuggagcaacaaagaaagagaggggagaacaucggagaggggagagagauacacagacagagauugacagauagauagauguucauuaagaaagagaaaacaaacacauuguaaaaacaaaagaacacugggcuauagagugaguucuaguuuagucaggguuacaccgagaaauccugucuucaaaacaaaacaaaacaacaaacaacgaggaaaacaacuggggagaagaauuaagagaaguuaagaggugaguagaacccagccaugucacaugcauauauacauacauguacaauguacguuaaaguaacguacaaugaagccaauuauuuuguauaauuaauauauacugauaaaaaguuuauuuuuuuucagucuggaguaaagaguucuaggagucucacaagcauuaagcccuugaaaaaggagaaacugcuuucuguguugucagggagugaagaaacuuuaucaccuagacaggaagcucaucucagccuuccuggucugcaucucagagcuuuggcaaacacuaggaacccagccaacuggucuggggcagcccucuuccugcugaugccuugugagacuugugacacagcaggugugcugaccccuucugcauuccugagagagaauuuccagucuguccaguaacuccagaaaguuguucucucaccuccauauauggacaauggcaugugugcaaccgcccccucccgucccccacucacacuuagagaaaga

SEQ ID NO: 8930 - RNA, 1185 nt, Mus musculus
agugcucagacagcaccagagugccaaaaagugccagguucacagacugucaaagcugccacucagauccgaguccugacaaaaacucuuggacaagacauccugccacuuaggaaauaagcaguccuaaauuucuuucugaaauggaucggguuaaaggcagccugcggggcggcgauggccacucccggggaucccgggaggagccgcugcgucccaccggggccggcggccugggcagucugugccacgucugcaggccgggcagggccgggcgaagguccgcgggccuggccacccgugcacgcgccggagggugcggccgggagagccgggaucggggccggagcgaugcugggagggaccccguugucccgacgagugucuccgccgcccggagcccccgcacuccgccgcuggccggccggccggcccgcccaccuggggcucgcccgcgucccgucgccaccgcgcgggucaccgcccagguccacgcucaccugggucggagcgagcgccugcgcagaagcugcacacgcggaucggggucgggggccgggucgggggucccucgcggggauccggcuuacgguggacgaggaagaccagaggagcgugugccccgcgccaagauggccuccgcgccgccccgcugccacgucggcgacacgccccgacacgccccucggccggccuccaccgggcugccccacacccacccacaacuggcccgggugcaccgccgcccucgucguucuguccccaccccugucacagcaggagagugaucaaagcuuuccgcguagcugaggugaccuccagagagcuacugggcacgagaaggacggcgagguacuugacgauuuucuucucaaguacagguuaugcacauuauuuuauaauaaaaaaaaaaagcgaaagucugggugcuuaucauauaugcaccugacacaauuauuguccaauaaccacauagauuaaagaaacggaugaaugaaguguagaagaaaaaaacaacgcaauuucacaaucagaaaucuuaauuuggaucuaaagaccccuuguucugcagcauucccugguaugaaucaacuauucuccuuauuuccacguauaaaaugggaguuauauuguccaucacuaacucagguaacagagucgccaauaaaauaagacagacgagca

SEQ ID NO: 8931 - RNA, 38748 nt, Mus musculus
ucgucugucuuauuuuauuggcgacucuguuaccugaguuagugauggacaauauaacucccauuuuauacguggaaauaaggagaauaguugauucauaccagggaaugcugcagaacaaggggucuuuagauccaaauuaagauuucugauugugaaauugcguuguuuuuuucuucuacacuucauucauccguuucuuuaaucuaugugguuauuggacaauaauugugucaggugcauauaugauaagcacccagacuuucgcuuuuuuuuuuuauuauaaaauaaugugcauaaccuguacuugagaagaaaaucgucaaguaccucgccguccuucucgugcccaguagcucucuggaggucaccucagcuacgcggaaagcuuugaucacucuccugcugugacagggguggggacagaacgacgagggcggcggugcacccgggccaguuguggguggguguggggcagcccgguggaggccggccgaggggcgugucggggcgugucgccgacguggcagcggggcggcgcggaggccaucuuggcgcggggcacacgcuccucuggucuuccucguccaccguaagccggauccccgcgagggacccccgacccggcccccgaccccgauccgcgugugcagcuucugcgcaggcgcucgcuccgacccaggugagcguggaccugggcggugacccgcgcgguggcgacgggacgcgggcgagccccaggugggcgggccggccggccggccagcggcggagugcgggggcuccgggcggcggagacacucgucgggacaacggggucccucccagcaucgcuccggccccgaucccggcucucccggccgcacccuccggcgcgugcacggguggccaggcccgcggaccuucgcccggcccugcccggccugcagacguggcacagacugcccaggccgccggccccggugggacgcagcggcuccucccgggauccccgggaguggccaucgccgccccgcaggcugccuuuaacccgauccauuucagaaagaaauuuaggacugcuuauuuccuaaguggcaggaugucuuguccaagaguuuuugucaggacucggaucugaguggcagcuuugacagucugugaaccuggcacuuuuuggcacucuggugcugucugagcacuguuugaaucacugacuguuuagggaaguuuauuuuaggcucugcaccgagaauggcgaaugacugcugaccuccguccugagucugcccagggguauuugaggcagucuugggacaucaguaauaucaauaguuucagaauaguuucagaugcugacuuuauccauuuuccuauuaaguagucaccuauuuuuuuuuuaaacagacuaacguaggcacaaacaguuuugaagagcaguuugaucagaccgugaguccuuuuuguuguuguuuuuuguuuuccccgagacaggguuucuccauguagcccugacuguccuggaacucacucuguagacuaggcuggccucgaacucagagaucugccugacucugucuccggagugcugggauuaaaggugugcaccaacacugccccagacccugaguucuaaucuucuaagcuguuuccaucccuuuuucuguaguaauguugaugcauuuggacuacauuuugucccuuuaaaaaaaaaaaaaaaaaaaaaaaaaccucuaucaacuguugcaucauguucuuauccuaguagguuucuuuuuuucuucuuccuccuccuccuccuccuccuucuccuccuccuucugguggugguguugaaaguauguuuaugucugugaaguugaucucaguacuguguuuaagucauugcucagacaguaaaaggucauguuuuucugguggucuuugcuccugcugagagauugggauuaucuuuaacuaggaucuaggcuuuggaaaagauacauagcuucuucagaagagcaaaaaucagagugacugauaagagaugaaggaaagagauaaccucgguagcaagagacgcagucugcggaagggccuuucucuuucagguuaugucauuauccagguagggaauagcagauucauccucuuuaaugucuguguuuccgucuucacaacuaggcuuggggcgggggugggggguggggcgggggauacaugcuuaucuacuuuccuacuccccagucucccuucuuuggaaacaguucugagauugucuuuaauuuagcaaacacaugggaacuuucagagcgucccuucuggccucucuucaguauuuaguaccuugaaaugucgacuucucagaaccacggucucuucauuuuuuuccugccacucuguugcucguauuucugcagguuagucggcuacaugccuggaagaagguuuggccuuaaguagccgucccuugauuuugguauacccuucuuagaagagauauggcagaacgugauaccagaaaccguugguauguccacgacacuugugguuugugguuugugcacuccagacccaguugcugucccuacuuaaguguuucaaggaacuugaaccugcugaguuagaggugaaacacuuuaugauccucuaaaggacaccauuaaccuccuuggccucuuaacacugcucugucugaccuguugaaaccgucaucugucgggacugacuguaaugcugccucaucuccuccuggccuuuuugggcacucacugagccuuucccccuaaaugucucucaagucuguguccucuuucucaucuccaucaucaucaccuuaguuuaggccguagagucucagccuggcacuauggaugcgugggaucauaugaugcuuguaggauauguauuaugggaauuugugcugcuacuuaauccagaccagcaguaccuuagugacagccagaaguugugguggaaaccccccggggguacaagguuaugguuaguucuaguuuaggguauugguagauccugcugcacuucuucuacauuccuaaguggugucucugcccagugguucagugcacccuucagccaaaggaauccuuuuccauucacccucucuccccacccucacccucccccccugccccccaacagugcuggugguuguauaugcuagguaagaguuguuaccaggccuacuccaaaggagucuucagaacauaaguaggaauugucaguaacuggggucagcccgcgugcucagguggguaguggaucuacugauacaucuguggguagaaauguuguuuaucaagcauaugaauacaccaauuuggauggauuucggaggcauauggcggugugugugugugggaagccaaauauuaagggauuaccugggauuuaauuuuguuuaucuuaccuuuaugaaaugaguguuuuguugucaguguuugugucuagaguggggggacgugaccgaggagugcagugagggagucuggagcgauggugugguucugggguggugacugggcaccugugcaugcgguuuagcuucacugagcggcacacaccuccuguacacacaaacugguaaacacggcugaaguccaaguaaggucuacaagaguccuuaguggugccgugcccggcuucugcguuugggauuugucuagcgacugugacugagaucaguuugcacagagcucucuacuguguguucuucuuagagauuuaaaauaucagaagaguuagaauaaagggcagauuuuccuccacuccagugccuuucuguucuuuaaauguccugccucuuaccucugucaggaaggcugggcaucugggccccuagcugccccucagccuuguuccaccaugugggcgggcuuucuugaaugugucuacgcucuuuguuuacaccugcagggugcucacuuuguuuguuuguuuuuuaauggcagguuccccuuuuccucuuaagcucuuacuucccuuggcuuauggaaguuugcuugaucuuucagcacccaucucuguguuggagacuuuccccagguuuugcagucgcaauccuuuuucccauagcccagcaucacuguccuuagccccagcauacagaacccagccuucaagcguaucucuguuauuggguugacucgucccagcauccuuggauguuggcacugugauuugguuguguccuguacaagucucuuaaguugacuggguuuugcuuagcacugaauuucuagaggcucauuacagugcuuggcaaacaguuugccuuugcugaacauuuguaaaccaagugaaaacaugagagcugauuuggagcagauuuuuucucuccucuccucuccucuccucuccucuccucuccucuccucuccucuccucuccucuccucuccucuccucuucucuuuuuuuuaaaaaauccaaucccuguuuucuuccuugcauccaggaggaaggcaaucuuuauuuguuuauuuuaagauuuaucuauuuauuauuacauguaaguacacuguagcugucuucagacacuccagaagagggagucagaucucauuacggaugguugcgagccacccuguggguugcuggaauuugaacucagaaccuucggaagagcagucugugcucuuacccgcugagccaccucuccagcccuggagcuaguuuucuaccgucuccguuuccuucccucuugcugaauaaaacacuccaacaaaagccacuucagggagagaagggcuugucugcuuuguaguucaaggguacagcucaccuagauggagacuuguaggcgggagcuugacggucggucgcaugguguccagaaucaagagcgugcugcugcuuguuagccauggucacaccggugugaaaacucucucuguuuuggcuacguggugucaguuuucccuacccuugcagugacugggcauacagauucucaugaucaucuuucaguccagagucucucauuuaccguccuucuguuguccuuggccauggguguuugggacccacacuugcuccucugaaacuaucccuguggacauugaacugucuguuucccaaucuagagaucuuccucaguuuaagucuguucuagaaguugcuccucccugacccccacccacccacccccaccccgcaauucuaacccggacugauccuuuuagugacuucccuucagccaguggcuaucuugaccuugggagauguuguuuuagauucuacccuuuggagacuucuccuuucugacccucagccaagguggaccccucgcacaccucagagguggagagcuuucccucagaccauacuguugcucucucucaagaggaucagaagacaugccccaguccuuugggggcuuuggacccuucaaggaaaaggguguuccuccuuugaaagucugcuuucuguuugggaagaucucuugcuucaucuuuauuuaugaccaugggccagcacuuuucuaaauuacacagaacagugguucucaaccugugggucgugggaauugaacaacaggggucgcuuaagaccaucagaaauaucagauacuuacauuaagauucauaacaguagcaaaauuauagucaugaaauagcaacgaaauaauuuuaugguugggacucaccacauaccacuguauuaaagggucaaaacguuaggaaggcugagaacuacuggccuagaggggcuccuguuuccuaaaauaaugugucugcccuuggguuagaaagauggcucagugguuaagaguacugacugcuuuuccguaggaucugaguucaauucccugcaucuacaugguggcuaacaaccaacuauaucugcaguuucaggggaccuggcacccucuccuggcuuuuguggguauuagguacccacaugaugcacagacagguacgugggcagaacacuuauaaacauauaauaaaauuaacugcccugggaggaaaagcugccauauggcccaguggcagccccuggaaagaggacaacacguuugacugccgcuuucagaacgacuuagcucaguggaaucugguucaagguuuccuacauucuggccgugaucuuccuggccucugcccugcccccugcuugucccacuccaccuagaagguucuccugcaaaggcacaccuacugggcguggcucaccaaauggaaggugaggaagaagaggcaaaccagggaauaagagauuuaggauaguguagaccccuccuuacucaagagggaaaccugcagaggggucucgggaagagucggagaccaccaugagcuuacucacugaggcaguuggaaguugggguaucggguagggaguugagaagcuuuuauggcagaggaagaugagccucgaguaaaagaaggucccgugcugcucaauaaacaucuuccccggagcccacaggccggaagagucaagaauccauaaugcguuaauuaacuucuagaaaccagauuacuccaguugcuggaauuguuaccagucgaccaaaaugaaguuuagaaaauggcauggcccugguacugcugagcucccauuuuccauguuuacgggccaggaucccagucagggaguagugcugucuacaguggguggaucuugccauuucagucaacacaaucaggauuuugcccacaggcaaucccuaguggcucucccucccuagugaguccagagucugucaaguugacuaaaguuagcacuaucauauacuuuagauuuguaauuucuuuuauagaaucauaucugcccuccaccccccuacucacaccuccuccugagucugccccaccacaucuccuucucaauuucauggccucuuuguaacccauugauucuaaaugguggugcuguggguguggguguggggccaugcacuagagaauagauagccuaccgugggacauauccgugaagaaagggacucuuccuccucacagccaucgacugugucagccccuccuccaucugcacuggaaauuugacuggcuucauuuugugcaagucuuacaugcuuagaagagacuguuucauagaaguucaagcucgggcucuuccagucuucucaccccaucuuccauguuguucccugagccuugguaggagggguauaguuauuuagaugucccacuugcuguccuuuggguaguucugagccuuuuguuaacuaccauccauugccaaaagaugguccucugaugagagaggacagcugugcugauugugugugugaagcagcuaagguccuagagagaggcaguugguuaguaaggaugcugucuucuauugaccugcuuaggacuuugcucucuuguggguuguuugcuuuuguuaacuucugaaacccaagguucaucauuucccugucacaaggcugcuguggaccaggagacugggaccuaacuggcuuauaaaguugaacucaucuugauuuuuuuauuuauuuuuugauuguuaauaggcauagcccacauguacuguauugcgagaauacauuuguaaaaucaagcaaauugaacucuuaaaaagaaguguugauggaauagcccuacacagaaugcuuugugagaaaagaugaggaauuaaauuaguuuaauuaguuaaauuagauguuuguauuuuaagcauuuugacugaaauccauacauaacucuaauaggauucaaguggccaaaauuguggcacuuuacuauuuaaauuauuuaaaauauauauacauauacauguauauauauaaacacacacauauacauauauacacauguauauguggaaaugucacguuauuugcauauuaguuucauaguccuuuuuaaauuuauucaaaacuuuguuacaaagguuguuguaaauaaacccaaagacucaauguggguguauuugggugugagagagugugugugugugugcguguguauguauaaugugugugggugccuuuggaggcuaaaagagggugggugucaggugccuugaagcugcaguuacaggugguugugagcugugauguggacgcugggaucugaacucaggcccucuguaggagcugucaccugcuaaucaucucaauggcuucucaggaguuuugacaagcccuuccuccagauauuguaagugguaaaggcugacuugccuccuagugguuagucucaguuguucucugucuacaugcgcugcugccccguauaaagcuuauuacugcuuuaucucuuugcagugugccguaacugagggaaaaugauggaagaaaguggaaucgagaccacgccgccuggaaccccuccccugcauccugcaggcuuggcugccgugcccuccacugaagcucacucagguuuguguacaucuggaggguuggagacacuggucucucugaguuagaagaauuccugugcuagugcuucucuaaucccgucaggguggaaagaaauuguccuucuaaauguaaacaauaacaaagaaauaaucucacuuggccguagguaaggaaacauagaguuuugggguaagccucuuuguagccagccuucaaagcuuguguuggcuuugauguucuuugacuuugugaagauuugucuuuuugagguuucagugcugaaguuuuuacguucguaucaggaauggaaaauggccuuuuuuucauucucaggcagugucggccuugaguugugcuguuuccccgguggaaucacacggcuccugcacucagagacaguuauuaugcauuagaaauuacaccuuuaaaauuaccuauuaagauuuggcuuuccacauuagacauugcccaagaagugaguguuugaaaaugaaguagaaagcauuucuaacuuuguguguuuauccucuccacccucuucuagcugcaaccaguuccuucucgucucccaacgugucgggaauggagucucugcccccacacguguauuccacgccucagcccucccugcccccugugcagccguccgcgccaccucccuuugugucgaugucuccggcuccuuccguuccccugaguggcacuucugugccgcccuccgugucuccaucgccugccacugccuucagcggcccuccgaugucccacuucccgccugcgaccucugccucgggugcucuccugucugcaccgccuucagggccuccgauaucaggguuuucugucgguacaaccuacgacaucacgaggggacaugcugggagggcgccccagacaccucugaugccgucauuuucugcaccuccgguuacaggugagcuccccuugcuguucugugguacucaugggacuuaauauguuauuacagugcugugcucuagggugugugcacugcgguuguguagugcacaguggaguaccuuaguuuauguguagacgugggcaucugcuguucguggguuuuguuuuuucuacguuaauguucagucucacucugacuccugguuucccacucaacaucuucuugccauuuaaacuauuaaugguaaaacuaauggaacuuauuuuguaguuuuugugggcuauaaaaauugguguacaguuggcaugugaggugugagaaagaauccccaaauuccaugcuaacaccuguuacuaacugauuagcuguuacuaacugauuagcuguuacuaacugauuagcugccgguugcaauccaagaguacauuauaggucacuuaaaaaaaaaccagaaccagcuuuccuagagaauagauuuuguuuagcuagucucaugcacaagugggugauacuagcccguuucuuuuuuaggccaacugcauccccuuuuaucccccuucuuaguacggcuguuaaaaacuaaugauaacaaucuuauuugucaucuucuguccuucaucauuuuaggcuagaggaguaauuuagcuuugauuauuuaguauccaauuuggcuuaucuaccuuuacaaauaaaauguauucuggggcguaagaauuacaugguaaucuguguuuacacagauuuagugugugugugucuuugugccugaguauauguauggccaccucaugcaugaagaugccuugggaggccagaaacacuguuggauccccugcaacuggaguuagaugguugugaagccaccugaugugggugcugaccaugaguccucugcaagagcagccagugcuaucauuagcugcugaagccucucuccagccccaguggguauuuucucuuggaaguguauguauuauacauacauauauacauacacacacacacacacacacacacacacacauacauacacacacacauacauacacacacacacacauacauacacacacacacauacauacacacacacauacauacacacacauacauacacacacacauacacacauacacacacauacacacacauacacacauacauacauacauacacacauacacauauacacacauacacacacacauacacacacauacacacacauacacacauacauacacacacauacacauacacacauacauacacacacacauacacacacauacauauacacacacacauacacacacauacauauauacauacacacacauacacacauguguagugauuauuauuuuuuuuuuaacgguggacuugaguguucaguucuuuguauggauuaaggagaguagaaguacaccagucaucucaaugcugcauaggacacacaguagcacacaugcacauagauacccuaaguguguguauaugugugcuuauauuuguuguuuuuuaggacacuugguguaaacuuauguaaaagggaaaauaucuuuaaagggaucuuuucacauuuguuuuuauaaagguuucaguuaauaacuuccucuuuaggugcuuacgugguucuauuauugaauuuggguugagcuucucuugcugcaucuuuuuauaggaaaacauuuguggaauaaauuacacaacuaagauuuugccguugacuagguaucuugccagcccccauuacucagcaagccagcaugacgucucuggcccagggaccuggaaccacaucagccauuacuuucccggaggaacaggaagaucccagaauuaacagaggccaggaugaugccccugcuggcgggaucugggguuuuauuaagguaaggguguuggcuuuucaaauuguucuucuaaucguaaaccugacaggagcucguuagagaaacuucugagaacacaguauggaguaagggaaaagaagcccuugguggccagauuucuguagguguucuugucauuugucuaugugugucuguuugucugugcaugucuguacaccuguacuuauucucuuacuaagaauccaguuggauuagggacauggucauuguguuccuugucuuuaugaaguuguucucugaauuaaugaagacuagaagauuuuauuaauguccuccauuaauagaauugucugucugucugacucuguuucuugaguaccuuggagucugcuuauugggguguaugcaugcgggucuaugugugugcaugugaauguggaggccaacauaaccucuguugcccauguuauuuuugguuuagggcuugucauuaaauuuggaaucuaucaauucagccaggcuggcuugccagugagcuccgaggaugcucucacuguaucccaguccagagcucgggcuucagaccugugcuucagugcucugccuucugcaugggugcuggugaucugaaccgagguccucaugcgauuguggcauguaccagaugaaucaucccuccagcucugaauauucuuucuuuagaauauaguuguuuguuuguuuguuuguuuguuuguuucuuuucuuucuuucuuucucucuuucuuucucucuuucuuucucucuuucuucuuucuuccuucuucuccuccuccuucuccuccuucuucuucuucucuucuucuucucuucuucuccuucuucuccuucuccuccuucuccuccuucuccuccuucuccuccuucuccuccuucuccuccuucuccuccuucuccuccuucuccuccuucuccuccuucuucuucuccuucuucuccuucuccuccuucuccuccuucuccuccuccuccuucuccuccuucuccuccuucuccuccuucuucuccuucucuucuucuucucuucuucuccuucuucuccuucuccuccuucuccuccuucuccuccuucuccuccuucuccuccuucuucuccuccuccuucuucuucucuucuucuucuucucuucuccuccuucuccuucuccuccuucuccuccuucuccuccuccuccuccuccuccuccuccuccuccuccuccuccuucuucuucuucuucuucuucucuucuucuccuucuccuuuucuccuccuuuucuccuucuccuucuucuucuccuucuucuuccuauuauuauuauucuuuaauccuuuuuuuacaguuuagucguuaacccccuuccagucuguccucugacucuuccucaucccauuccuccuccccuaucucccccaucccaacaccaacagaccuccccacuccuuugggccucaagucucucaaggauuaggugcaucuucucccacugaggccagaccaggcauccucugcuguauguguguugagggccucauaucagcugguguaugcugccugcuuagugguccagugucugagagaucuuggggguccaaguuaauugagacugcuggucuuccuacagggucacccuccuccucagcuucuuuuagcuuucccuaguucaaccaccgagguccccggcuucugcccauugguggggugcaaguaucugcaucugacucuuucagcuacuuguuggauuguucagauggcagucaugauaagccccuguuugugagcacaccauagcaucaguacuagcgucaguccuugguuugguccugucacuggaucuccuucuccucagggucuucucuauuuuugucccugcaguucuuuuagacaggaacaauucugggucagaauuuuucacugugggauggcaaccccuugccuccacuugaugcccugacuuucuacugcagacggucucuauaaguucccucucccacuauaaggcauuucaucuaaggccucuuccuuugagucugagagucucucacaucccaggucucugguacauucuagaagccccuuccccccaacuuccuaccuccugagguugccugguuccauucuuucugcuggcccucagggcuucagucuuguaccccccccccucaauacaugaucauguuucccuuuucccuucccuauccccucucucaccuaggucccucucucccucugugcccccuuccccccaugauugcuuucuucucucucccaaguagguuugaggcauccucacuugggcccuuuggcuuguuaaccuucuugaguucuauagcuuauacccuggauauuauguacuuuuuggcuaauauccaaguauuagugaguccaugcauguccuuuuagucugaguuuccucauucaggauauuuucuaguuccauccauuugccagcaaaacucacgaugucuucguucuuaauaacuaaguaauguccccuugugugaacaaaccauauuuucuguauccauucucccauucuggggcaucuggguuguuuccagguucuggcuauuacaaacaaggccacuaugaacauaguggaacacuaugccccuguugcaugauggggaauauuuuggguauauucccaagagugguauugcugggucuucagguagaucuauuucugauuuucucaggaaccuccagauugauuuccagagugguuguaccagcuugcaguagcaauggaggaguguucuucuuucuccacauucucaccagcaucugcugucaccugaguuuugaucuuagcuauucugacuggugugaggugcaaucucaggguuguuuugauuugcauuucccugaugacuaagaaaguugaacauuucuuuaggugcuucuuggcuauucaauauuccucuguugugaauucucuguuuaguucuauaccccauuuuuuuauuggaguguuugcuuuuuuaaaaauguguaaacauuccauaccuuuuuaaaaaauuuuuuuuuauuuuauuguuuuuggugguauugaagauuggaccuagggccuugcauacacugauaagcacuuucucagccugauccccauagcccuacuuucauucugauaaagacucucaccaaguugccuagaucagccuggcauucacucaguaccccagacuggccucugacaauccuccuccuccugccuggcuugugacagggaucacaggcccgcaucaucgggccugauuaaaacgaucucuccauugagcuguacagugaucucuuaugaaucucauucugagaaauaaaacugccgagcacucuugugcuuacguccugaugggcuucacugacaucauaguuccugaugaaaguccuacugagugccccaggacuuccuauugcuuuccaguggccacacugcccugugauguucugcaucguccacuugguagcaaaagauguuauugugaaguacaguauuuuuuucuuuaagaaaagcuccuguuuaggggcugacgggagcaucagcaguuucgagcuaauggcugcaauggcuguccauguucaggaggcccugcuucacagcauccccuggcuuccacagcuuuccugccuccuccuauuccugaugcucccugcucuugcuuggagugacguuguccuuucuccuauucucagcacuaugaccugcuacgcgucucuuuaguagcauacauuuuaguauagaugccauauaugaucucuggguucugccuguaggcuuacauuuuuaaaaaccuacuuuuaauaagguuucucaaaugcuucaacccccccccccccuuuuaccuuucguccauagguaagggagaagagaugguaaguaggacaaggggaugugggcccguuuagaaguagucuuuccagcacuuucagucucgguugucaggacaccagcaguccaguucagcagugucaggaugccaaaaacaaaucagcaaugguggcacaauccagcagaaacaaccaguccucuucaggucagcacaagucagggggagugaccaggaccagccuggacaccaggcucugccgugccucaacaucagggaagacuugagaucagugaagcguugcaaggcaccccaccacuguccuuugaguucugucugugcucucuccaaacaucauguguccuucacggguuuugcuucagcaaggcaccaugugagucugugucacaggacccaaccagaaacuuccacuucauaucuccuuuuuguuuaaaaauuaucuuuuuuccuaacauuaacagucuacguacaguaaaaauaguuaugaaccauaaaacuagaauacauauuuuaaauaaacagcuuauauacaauaagcuaacaaaacaaccuuaaaucccuaucaguauacauacuguaaauaaaacaacccuaaauuucuuucaguauacaauaauguaaauaaaauuaaauuuucaucaauauacaauaaaaacaaaacaaccuugaauuuuuagugguauacaauaaaauaaaacaacuuuaaauuucuaccaauauacaguaauuuaaaccuaccacccuagaugauaacccaaaccaucugucucaacuuacaaugauagggaugacaguuuucuuauaauugcuucaugcugaauugggcugaagaauuucucuuuggggcccaagguguggggaaugauuaauccaaaacaaaagaaaacaaagagacccccccccaaaaaaaaccaaccuagcuguagcauuuguuucccagucucuguguuguccguccagucucugugugaucgaucauuugggcuagcccuuuugaaauugaugugcaugcauauuuuggagaccgggcugguuugagacagucugugagaguaaaucacccugacuuauuugcuuugugaagacauucaugucacaucugauaagaggguuuuccuggucagagcuaaucuuuauaaguuuuguugguaacccuauuuuuuccuucucuguagauacuuaaacauaaccacauccccgucuuaacacugucacagguuuccagucugaugugggcacagccuuacagucuauuggucagcccagguccucaguucucccgacaacccagugucucucagcugcucuuguuccuuuuucaccaacauuagggaauuuagagccagcaaagcauuauuuaaucugucgcuggggguuuuuacucucccuuuuuguuuaauacgcaucucuuuuaaggcacgauuggcucuuuuuauaacuacuugucccuuagugaggagcuauuguuaguggacaguugcugggugucucagucagguuuucuauugcugugacaaaacacuaugaacaaaaaucaaauuggggagaaaauguuauuuggccuauacuuccagaucauaguccaucauuggaggaagucaagauaggaacucaagcagggccggaaccuugaggcaggaccugaugcagaggccacagagaggugcugcuuacuggcuugcucaucauggcuugcuccgccugguuucuuauauaacucgggaccagcagacgugggauuuuuaccacccacuaugggcugggcccuccuccacuaauugagaaaaugccuuucaccuggaucucauggaggcauuuccucagcugaggcuccuucgucucugaugacucuagcuugucucaaguugacauacaaaaccagagggagaaugguucuuuuguaggcuguggccacugguaaguuuccugugcuccaguggauggcccacaucuacgcacauaugagcaguacuaaccgggccuaguugguuaucaaagaaaagacaugaaguugagagguguguggggacguggugaaaauuggagaggaacauuggaguagugugaucauacuuaauuguuugcguguaugaaauucucaaaaauaaaguuuuaaaaaguuccucacacuuaggaaagucaaaaugcccuuugccugaaaugaacguuugcaucuugcuuugugcagggcguagcugggaacccuauggugaaaucuguccuggauaagaccaagcauucuguagaaagcaugaucaccacgcuggauccuggcauggcuccauauaucaguauguacucgacugagacggugucggccaugccucuaaugugugucagugucacgcgccaagugcacuuucagcucaugcccccuggucacguaacuuaacuucuuccugugcgcuuacuucaaaucuauucccagucuucguuuugggugugacuaauuuaucuuuuucuuaauuaucauuauauaaauuuuaaagcuccauaggaugacaacaauguggauuaugaguuugauaguuuuuuuuuuaguaguuuauaugauuuuuucuuuauccaguuaguuuuaaggugauacuuuguuuacaggugguuuuggcauuuuuuucuaguuaccuauuuuaaucacgugauuaugcuuaaucaggaauaauuuuuuuaggcaaacccacucuagcaauuaauaaaucuugauuacuaaguuugcugggaacaauuuuuuagcugcuuucgagcccucaucgaaaaccucagauaguugacacaggcauacugcucuuuaauuuuuauguacauuuccaguauguagauacauauggguuagcuguaggauaaaccuauaguuaauaauaguuaauaaaccuguagaagccccuugcaaguuggagcuguguagcagguacuugagcagaaguuuuuauaggccauaaaaaggcaagagcuugucauuacucucuugguaguuuccugucuacuauguguccauuggucagaccuauagagauuacauacauuuuucaagugcuuguucugcuagacacugaugcucacaagagcgcugugacauacguguuuucauucaguuugggguaaggaaccuggguuuaaagaggccugaguuauuauauuagguuaugcaacuggguuggagcucuguugaauuuacaugugcaugcauuauucaucuauaucuguguaucucugcuucacuuccuguguagagggaauugaaucaggagauaaucagggagccauguauaguugcacaugccuauaauacucgcacuugugaagugggauguaacaggcuagccucaggaacauagugaguuuguguucuuaaaaaucaacaaaauacaacaaacauaaaaccccaaagaauuuucuguuaguaacuauccagaggauucauaaauuugacuucaccacauuuauuaauuuucauauucauauagcugaagauacuuauuaauuauauuuuucuuuuuuguguacguauuuuaagugaaggagugagcguuuuuggagcucuugcuguucuauugggcaugcuguauuagaacucuuguucuuagagcaagcacauugaggaagcaggucuuuuuccacaaagaaaccagcccagagucuuccgcaagguagugaagcuggugaaugggaaaacgcagcccucagccuuuggagccccuccuccugcuggcaccgucacccaccacagugagccugcggaagguggagcuucaggcagagauaauguguuuuggagccuucauagaguacugaagaacuaugcucuucaccggguaccacaggugacucggaaccuguagauggugugugccagccuuaggugacucggaaccuguagauggugugugucagccucaggugacucggaaccuguaggaggugugugccagccucagccuucgaguaagacuucagauaaugugcugaauucccguccuuaaaacucaaggcaaguuaguaguuugggucuaagcacagguggaauaguauaguugagugagaagguaggaaaugugugguuguaucagauggugugacagaaggagaauuuguguccaaacgaccuggguuugaggccugacagucguacuuagcagcuguguuaugguggguaaagcuccaccauccugucucauguguaugagauuuguaacaauuaguaaauacagugugagccuauggcaugcuucuuaggguuuuauuacugugaagagacaacaugaccagggcaagucuuauaaaagcaaacauuuaauuggagcugacuuaauuucagagguucaguccauuaucaucauacugggaagcacggggcaugcaggcagacauggugcuggagaacgagcugggaauucuacagcuuuaucugaaggcagcagaagaagacuauauaccauacuggguuuagcuugagcuuaggagaucucagucugcccccacagugauaugcuuccacaaggccacuguuguggaggggccuggugcuguuuguauguuguugcuaauucugcucuccuuggaaggguuguggacaaggagugagucuuccucaggugacuucuugugaaccaauccccuaugaauaaaggagccagucauuggacaaguaggcgggacuuccaggcuggagagaggaagagagggaguaggagagaguuagauccuuuuggacagggagagcgugagaacaagauguaauuacaagugucucccgguuuuaauggcggauccauuaggauucaccauuggaggauuuagaguuaggauuuuaguuguugcgcccagcgauugaguuacuguuguuuccgaaguaagucuguauagaguuuuuccuucacauggcucauccgggugcaagagagaaagguacagcggcaaagcauggguuugcaugaggugcaccacaaggguugugaggguuuugaagcauggggcuggcaugguagcaaccuggcagugcuugguggagagacuuuggagcucugagucagagagucucuacaagauaagaacagaucgaccauuucccgccagugcauggccggcuagacugucggggcaaagaguugccagcacaagcccaggaacaugccaguucguuuuuuaauauuucccgcaacaggccacaccuauuccaacauggacagaccuccuaauaaucaagucccugugggucaagcauucaaacacaugagucuguggcgcgauuucuauucaaaccaucacagugugguaguaauuacuagaaaguuacugcuuagauuuggaauugaaauuucuuucuuucuuucuuucuuuuuuuuuaauagaaucuggaggugaacuggauauugucguaaccucaaauaaagaagugaaaguggcugcuguccgagaugccuuccaggaggucuuuggcuuagcugugguuguuggggaagcuggacaguccaauaucgccccucagccagucggguaugcagcuggauugaaggugaggaauaaaagccacuccacaguaacgguccuguggccucugggagaguacugccuauuuauauacggaaagaccagcuuugucaggaguuagacaacacuguaaugcaaugaagagauaaaggaguuguaauugaaagaagaauuggaagaggaaagcagugucucucuaucacacuggugaacacucaucaggaaagcagucacguuaagaaacaacaagaagaauagauacucucaaaaggagucuucauaauuuaguauugauuuucaaagucacuuacugaaauuauaauaucuguuggaucccaguacacacacacacguacacacacauacacauguacacauguacacacauacacacauacuugcaugaacgugcacacauacucucuguuguacuuuuaccaggacacaaucacgcaggaacaaaugaaguugauggcaccuaaacacuuccuaucguaaagcaagcgaagggaaauccagcgaauucuuuugccacuaccccagucggguaugggggucccuggaaugagggugcuugaagcuagguggguaaggauucggcggugacaaacagaaacaaauacagaggcaguuugaaucugaguguauucugcagcucucaagcaggggauuuuauacauuaaaaaaaaaaaccaaacauuauaucucuuagaaacuauauccagugaaacaaucacagauaccaacaaaaaucauuuggcacaguaaagcacaaaaaucauccaagcauuacaacucugaaacuauguauucagugaaucaaaaacagaacagguaacaucauuauaaaccaucagaauauagcaauucuaaaaggauguauucagugggggcugcuguccaaggcuaguggcauaacggucagugcucuuaacuaccgagcuaaccucccagccccaugaucaauuauuauuuaacaucuaguaccugauuuuuuuuuuauaaaucuucaauguauaaauuuaaacuauuuuaauucuuucuaauuaaggcuuuccuuaccauuaccaaaauccaccuccgauuguacacauguagccauauggaauuuuauuguugggaaaguuuuuaccauaauaguuuuguaaaugauuuagaaaguaaaguguugguuucccugaggauaaggucauguuaguggccccaucucuagggaugguuucuuacccauuauucucgcuuaagaucuuggccuaggcuaccaggaccauguaaauaagaaaaggaauaagagaaaacaaaagagauagauugccaugagaacuacggcucaauauuuuuucucuggcagaguuccacaaccggguccagaaggccuccccuguuuugaggucgaucaccucagucuguggaacuugucacacagauccuacuggagguggcguggccuucuuugaccucacuuccccuguaucuuuuuagcaugcuugcuuccuuuugcagcaaaaugucugcaagaauccuggacauuuuuuuuuuucuaacucuuugguuucccagcugccuagccacacauuugcacucacaaccccuacgcugacuguuuauuugguggccagcagguggccguccuuucuguugucuagacaggcuuccuguagccaggcuggccucagacucccuguggagccaacacuggccuugaaaacuccuggucccacuucucucucuggaguccuguguuauagacauacacagcugugccugacuuucacuccugucuuuucaucucccauguggcuucuggggugcacacccggcuuucuuuggaguuuguuaauugcucucugcuuuuguguuuccugugcuggccccuccuuuuuccccaccuucccuuggucugugugucuaggcucgccuuuccugaucucaugccaucccuggccuuagccagcaucuugugcugacauuugcagcuuucuguugccacugagacuauuaugauuucuuuauuuacaugaaagaugucuuuuugacaacuucacuugaguaucccaaacucaaucuguccagaauagaacuuucucuuuuuuuuuauacuuccucccuacuuuuuuuuuaauacuuccucccuagucuucaucuuagucaauggcagagcccuguccguccauuucucagaggagaagaccuggcaccuccuggagagucucuccugcuuguuucuguucugucauucagucuuguuugcaagacagacuuaaguuugcugggguuuuugguuuuuguuuguuugugagguugccacauacucucagugaauaugauauucuucuuaccaagggcauaaaggauuagauuuguaggccccuggccacaaugcuuuuugcuagccugucaacauagaagucuuuuucuuuuuaaaugucugauucuguuuagauacagcucuauauguacagacagauaauuuauaauaaagucaaacccacccuguaacuccugauuggaugcaguuuauuuagcacauacaugucguucuucuaaaguaguccauagcccuccugugcucaggagcaucagacagcacuucagcauuauccuuggggcucuucggaaugguggcauauuuuacaacauagcaugguggcacacgccuuuaaucccagcacuugggaggcagaggcagguggauuucugaguucgaggccagcuuggucuacagagugaguuccaggacagccagggcuauacagagaaccgaaaaaccaaaaaaaaaaaaaaaaaaaaaaaaaaaaaaaaaagaaagaaagaaauguacaagguggcacagguauagcagcaccuacucguuuacaacaugcgaacuuaaacaagaagauagugcuguuugucugacuuggcuggaguuguacagcccagccaacuuaaaugguuuuguagguuugugcacaucugaugucgagauuaccaauauguuuuaauaaaucgucaaauucaccaguacagauucuagaauuauugagaaucaacuuuauuuauaauuuaaaacuuuguauaaaggagcauguaacggcuuaauucuacuguugccucaugaaucagacacacagauucuuuccuuguguucauuuagaauuuaugagaaugaggcaaauuggagaaaagccuggugcauugauuacaauuagaaguuaaaugcaaucucacacugauuuuaauucuaauagacucuguuauacaaaugucauguguuuuuccauuauaguuagaauuuauuuaagugaauggaucucacuucucugucucuccauucucugaauuugggacugucagacaauaguuaccuauauaaaugugaugugccauuuauaaugcaaaucacauuacauauuuuuaauucacaguaaucagugcuuccacagaguguugugucaaaccacauuacuuuacacugccuguucauacucugugaguguccuuugaucuugacauuaguggauguuuauaaaaaggucuuuauccaauauagugaagcuaguugcuaucuuuaggguuuguagcccauuuaaccuagaaaugaaaaauaguaaacuggagaaaauagauguguaaccaucauuauuguaaaccuucagauaaaucacgaauauuauaugaacgagguccauuugaaagguggggacaaaucccuugccuggacggagucucugcuuugaagauuucaaaauugcuuuugcaaaugagaaaggauuuguagauuugggccauaaacaucagaacuuuuaaaauagaaauagugagugcguuugacauuaaagacucaaggaauggcucuacuacacaugggauucggugcuggcauuacuuugugagagaguggcaaguggcuucauggauucccucacaaugguuagcugucucuggaagucagagcauaccugugggugcugggugggaggugcguagaaagacagcaguccucaggugugagucugucucuggagacuugagacaggggccacucuguaacauuugagagggugauauuaguuaugaagugaaguaggaaguuuguugcaauuuuagcaauccaaaaaaaaggaauuucacuacgugcccagguggagugugcuuuucauuauggugucuaagugcucggucugaguauuuuauaaggucagauaccauugcacaguagcauaugcaguagguaggcauuguaugggaaaggcugaugugcguuucuuucuaagaaaagccuugacagauauuauagguaguucaguugaucuugugauuuuuguuugcauuugccuuaauuuauuuugacuauugguuuuguuuuacaaauuuagaugugaguuaucuuuuuacaacuuuuaauaggggcucaaaauggaaagacauagcaauaugugaccugcccucuaccacccaccacccagaggaagcagagugggccucaugacaugaaaccuguugaaucuuaaauugaacuuauccuuauaaguuuuaacuccccuaccagaucuuauccgguaucaaugacuuucuaaacuaaaguuaacuuuucuuuuaaucuacgucacuauuuaagacaguaaauucaacagaaaucaaguuagcaaaaaggcuuggagugggcaaaccacaggguggauaagaacaucagcgggaguagagaccaugugcacaacaccagugagcacugugaugaugugugcaaugccagugagcauugugaccaugugcacaccagugagcauugugaccaugugcacaccagugagcacugugaccgugugcacaccagugagcacugugaccgugugcacaccagugagcaccgugaccguuugugcaaucagauugucagucugaaccaaguugcuucagcuacagcguaaguccugagcucgucuacaucagcucaguuggagauuauuuguguaccucaaaacugucuuaaucguggagcccuuauacugauaagaguagaaccccuucuccaaacauugguagggagugauacucaaacgucaucuaacucuagaggaggcugccuugaauucacaugcugguccguggaagagaggcgggcgggcgggcggcagcuuccuuucucuuucuuuugggaaauccauaaacaaacaaaacucgucugucaagcugauuauccuucuaguagauaccaacugucuguauaaucagcuaaaucccacggagugugacgucuuguguugucgcaugguaaaguuaaacagacacggcuguguucccuagaagcacgugcaaugcuuuguaaggaauagcucagaggcacguccagagggucagagagguggcccugagcaguuaguucacugaugggcucuuuuuacugaaauaaauguuuuuacugaauaaaaugucaacuccuuuuuaauccagguguaggaggacugaauuagguacauuuaccguguccauuguaaaggaugaaaccaucuguauucuuucagauucagcagccaccuccuguuucaguguugcgagauugaugagggaggccguacuuaacacuguuaauacacuggcuuuuccuguuucguuugucauguggcgaggucuuacugaacuuguguuugcucacgccuaaugcuggguguaggagauagaauuggucagaauugacagauggcauccacgcugcuguagaauccaauucucagacuucuucccaaacuggagucugagcugcugagcccauucucacgcaguggacucuucucuaucucauuugucucuuaaccauugugugaacagaaauuaagcaugacccuucccucccugccuccuuccucucucccucccucccucccucccucccucccucccucccucccuccuucccucccucccuccuucucucucucucucucucccucccugccuccuuccucucucucucucucucuuucuuucuuccucccuuccuuccugucugucuguccaucugucugucugucugucugucucuuaagucuucuguucucaaaaauaggcuuauucuuggcuaguuuuuuuuuuuaauuguguguauguguggugugugcacacacauguauguguauauacauacccucauaaucuggcuuuagcuucuccaauauauauucuuagcuuugaguaauuuguucaguuuucucaaaaccaguuuuggacucaugaaugacaaugauuuugcugagucagcuucaguguaccacauccacauguagauuuuuauuuuuuauuagucuuuaugucucugcauguauauuuaaaagggaauuagaaagacuggggaagcacaucuugaguguaggugugaccacagaaccaaaucgagagcaaaugaccaagcggaugccagcgcugagacgauuuuacuuucgaagaugaccucuugcuaaaugaacauuuaaaaauaaggcuucucauaugaauacucaauuagaaauuaaaauuuuaaaauaguccauuacauuaaaugcaaacagcacaguaauucaugaggggauaauuuggaaaguguaccguaaacaguaucaagggaauuucauuauuccauuggacauuuuuacucuauaccagugguucucaaccuucccaaugcugugacccuuuaauacaguuccucguguuguggugauccacagccauagauuguauucuuuguuacuccauaacuguaagcgugaugcuguugugaaccauaauggaaauauuuguguuuucaguggucuuaggucaccccugugacaguuguuggacccuaaaggggucuccacccagguugggagcgcuacucucuaccuuuauauuguuugaacauuacaguguguaaguuaaauaugugcauguauuauguaacuauugguauguuuaauauuaaugcuuguaaaaacugguuuccaacuugugcugcuguugccuagggcgcccaggaacgcaucgacagccugaggaggucgggagcgauccacgagaaacagacggcggugucgguagaaaacuucauugcugagcugcugccugacaaguaagcggugcggggcucccggggagucaacgcagugguguguggaguucguucacccugagcugacuguuuucaaagcccaagagggaagucugcuuggagggugggcugcugagcuuagcugacacuuguguucuugcucugcuucugugacugggcagugcagagccaggccugcuuucuaagacugcuuacaaucacuagauaccaagaccuugugcacguuggcuugggugugauugagcacugcggguaagcacaccacuuguggugacacaccguaguggcagacauggugggcaagacuugaugguagauaaaagguuggaguuacauaguauuaugugguuugcuuuaaaaagcccccuagaaaucaaaguuagcuuugcuuuugaggacuuuauaucuuuauguuuuuaauagauuuuuuuuuagauggaagaucuuuuuggguauucugaauuauuuuauaauaaagaaccauauuuuguugaauucuacucacauuuauaaugucauggugguaguagaaccuacuuagugcuuuucaaguauuguuauucguccaugcuaaguuggaaaaauuagucuucuuccacaucauaauaaugccaguguaaguauucugagaugaacagaucuagauuuugguauucaucuuggauuguuauugaguguacacauauguucucauaauguguuaagugcacuccuuuguugggaauugauugauggugccaggcagucuugcuguggcuucugagucuagugugaacuuuuucugcuaugugaaaugugucugccuugagccacagcccuuguuucucaaaucuugccuuaguauacagaacgggaagaugugaucagcuucgggucuucccucccauccacaguugugauccuguugaaggacuuuaugaaggagagggaaacuugaaaguccucauagccagcagauccagggacugaaacgaugggcguugggcacgcagcagucauugugacugcaggguuacagaggagggacugggaaagcagguuccaggucagcuggagguggggcucuccagagcagagguugcuguggagcucugaugugugcuggugccugggugacagcuccucagaaugcaaaggugcccugccuggcugagucagugcauacucugaugaacucugagcccagagccugcagaacgaggcaaaacaagguuuaggugaucuuggcuacauacguuuccuugaccaagaaacauugucaaaaucaaauaaugaaaauuugauuagcagucaaguagaauaaauauuauucuguguucauaaguuaaaacauuuuuaaagguaugaaugcugagacauuuacaaaguaccauuuuaauauuccacaguugcuuauuaugcuguuuucugccuuacuguuuuuuaaauaucuguauaucuccuuauucauuuuguaguucuuugugcuuauuaaaggugcuuauucuuuaaaagauagagacauugauagccuuguccauauucccuuacuguuuacauuuguuucagaguugcuuaaucauucugguagcuagaauuccgguguugccccaguuguccuaaguguguuuauaaugccuugguuuuuauaaucuccagucaguaucuuuaguggggacaguaccuugauuucaggagugcauuuuuaaaggccgacuccuggaggguagcuuggaacacaugauucgaagggauuguguucauuaggaccaaacacaugcuaauuuccugagugagcuuauuuucaauuuaguaguaacauuguuagauggcugccuguuuggugagaauugguaauacagauaauuuagcaaguaucacucaaaaauauuauccacaagcugggcgugguggcgcacgccuuuaaucccagcacucgggaggcagaggcaggcggauuucugaguucgaggccagccugcucuacaaagugagauccaggacagccagagcuauacagagaaacccugucucgaaaaaccaaaaaaaaaaaaaaaaaaaaaaaaccaaaaaaccaaaaccaaaccaaaacaaaacaaaaaaaaauuagccacaagcaacucuuuacauguucaaauaagugugaguuugauugauugccccauucccacagccccucccucccauguuaggaagaaaauuucccgugcucaguaacuucggcuuucucuuuugcuacugucuuccuuucucuucuuggaauuaagacaauggaguaauuuuaucuuuguauuuacggauugaccguuugcaaacuagaaaccuuuuuuuuuuuuguucucucugagaacugugagccuuuggggagaacagcagguagguaggacuugcuuuuccucuucgucacuuaacucccguuccaugcagcagguaagcagagugcugcucacguuucuguugcaggugguuugacaucggcugccuggugguugaagacccugugcauggcauccgccuggaagccuuuacccaagccacgcccgugccuuuggaguuugugcagcagguuggucuccgccuuuucuugagcucuguguuuauaaugaggauuacgcccuugacuccguaguccccuuuugcuugucgguuuccugauugucccauuuucuuacuuuccccuuuucaugguuauacucauagccuugaagucagagggaaaucagccuuaaauccgugucacguguuccuuucucuuuauucgucagcagugugcucguguacggaugcaggugcggagccagaggauagccuggugccccucucagcgccguccacacugcuuugccuuuucuuuucuuuucuuuuuuuuucuugagacaagucugucauagaccugaaacucaccagguacgugaggcuggcuggcuagagagccuggcaugcuccuguguccacuugcccugaacugggauuucaggcaggugccguuauguuggcuuuucuuaugugggugcuggguccuugucuuacaggacagucauuucaucaauuuagcuguauccccggccccuguuugucucggcuguauccccacuauuuugucucuuucccuucucuuugauguaguauucucucuuaguuguucauugcaguaacaugucaguauuuaaaagcuagauggaagccaggugggguggcgcaugccuuguaauuccagcacuugggaggccgaugcaggucggucucugagcucaaggccagccuagucuacagagcuaguuccaggccagucagaguuacacagugagagaccuugucucaaaaaaucaaaauaacaaacaaaauuuagaugaggguggagagguggcucagcaguuaauuguugagggaaauauuuaaaagaaacugccaaguucccaugcuccauccagcuacucucuucuugacaacucuuggggugggguugggggugguguguggccgggagcuaccaaguucccuucgcugccacaccagccccacacaaugacuguccacccaggggucagccgccacaacaacccuguagaaacaaaacccuagaaacuuaaaauuaacaagucagauuuauauaucaauaaauucucaagucacaagaugccaauacaauaauuucagaaccaauugauagugauauaugcugcccauuuagaucagacaaguuaucccaauuauucuaucccuauaugauauucauagcuaccuguggcuaaguaaaaccacacaggaucagaaucuucuuccuauccaucugccuccaucuuuccuucucugcuucccuccucugagucguucucugucccuacagcucuuugcuccgccucccuuuucccuguccaaucacaggcccccugcugcacuaguauuuuaauguaauuggacagggaaaauccugccacagcuguuggcugcucccacaugacaguaacuccaguuccaggguauucagugcacucagugcgcauguggugcaccgacaugcaggcagauaaaauaacucugcacauaagauaaaaaugaaguuuaaaaaaguggaguugagccgggcaggcgggaggcagaggcaggcgaauuucugaguucgaggccuugccuggucuacaaagugaguuccaggacagccagggcuauacagagaaauccugucucgaaaaaccaaaauaaauaaauaaauaaauaaauaaauagcguugauaggaauuuuagauuugcuggcugaaaaaugggccuaaucauguagccccagacacuuucucaaugaauuguauuuuuguaccuccuguaaauguucucgugauucgauaaugaacagaauggaaagugccugucguugagaucucuguacugggagcugcuccuuuuuaagaucauuugauguguauaggcauuguagacugugggaggaccauuaggauucucugagaaaguguguguguguacuacauuuuaauauaauguauggccauaaaguugcuaaaagcagcuagugguccuuccagauguuuggcaguguagaaagaugcuuggaaugagagcagggggcuagaggcuuguaagcugaugcugugcacauuguuaugcuaauaaaaccuagaguggacaaagaguuacagguuuucuaggaagaaguaaguuuuaccacuguuguaaaacuguguaaacagaaguauuagauggagccauauaaaguugcugucuuuaauagucgaggagucccugcccuguuugaugugacuuagccuaauuacuuccaugaggcacgacagggaaggcugccacccugcaguaaaucacuggcuaauugugauccagaucugcagacacuaaagagcaaauggaacucagagagucagugacacaggcagaacauuguacagggccucuguaagaccucacauacccugcucacagcagcuauggaaaucauagguaaccaacccuacuuagcccagaacaccucagagcacuguguccugucucaagagcuggagaggagcucacagagcagcugugugguuagugacaugagcagacuauagaagacaggguuucagcagagcuaaggcguuugcuagaaguagcacgccuguagucacaucguccuagcuaaucgggauaaagaguguagugugugcgcuggauagucaaagccaaucuucagucuauugcugaagcaucaggaggacugugagaguuguaauggcucccaucaccucaugguagacggagaggcagagcaggggugagcacucagugacccauggcagcucuggcccacugccuguuuuuaauguauuuccugcacauaccugccgaucuacuuacaaacuguuuauagauaguuguuuuuguacugaaagaagaaaauggaguaguaguggugaauacugcccucaaaaucuaaagucuuuaccauucugcuucuuucagaaaagccuucuuggcaccugugcuagaugccugagcauuuuuaauuaucucuuuuagggcuaguuggccaugcugcuuaaacagugaaaucggcucacacucacacacguguccaaagcacugacucacugcuaagugucagcacauuugguuggugcaggccucuuagcaggaggauucaagugcuuuuagaguacgugcagauggggaggcggguggcucagcaagcccugagcacaguuaacugaaaaguguuauuuaaacuguaaaauuugcauuuuguucuguuuaauuuuuauuguauaguuucagaauucccaggauaaauagcuaugugcauugaaauaucuucuguuccuagcuguuuacauuucuuggcuuuuuuuuuucaaacauaauauuuuauugauuauuugggaauuucucacacuguacucugaucacacuggcuacccauuccuccaggguccacccucccauccuuauagccucccuaacaaaagaaaaugaaaagaaaggaaaacaauagacuaaguccgauuuguguugccuauacacucacugcagcaugguccaacucccagugaccagcucuuuaaagauaacugauccccgccccccuccaucccccagaagccaacagcuguaaagagcuacccuucagcauccuuugcacacuuguaaaggacucuucaguggcuuccugaucugucccgaaaugucuuaugucugugccuggucacagguucauaguuuaaggugguggaaucauuucuucaacaaacuguagcugucagcacgugaugucaucuuguaauuucugcuucuuucuguuccccgaagagcccagcugcucuggguuucucuugacaaucaaaucacucagaaauaucaucuuugaccugcuucacaagggucaccuacagauuugacuaaaaauacguaagucaacgcuuccaagcccccucugcugaccuucugagucagggcugcacuucagcaagauccccaggagacucguguggcgcgugagaggcagacccagggccucugaagacccgauggaugucucuuugacgcccacugcaguguuuauagcacagggugcugcacuguuucugucaggguugcucggaagcugugugauguaacucuugacuauuugucuuggaauaggcucuggugguuucaauuuaguugucuuacgguaacuaaauugagccuaagaaauuaguuuuuugaggggaaaagaaagccccuacccccagccccgcccccugugauuggggaucugugcgcggugcagagccauucugcagauguucucugcauugcgcuuagcacucucaacaaaaccccggcuaccgaacacuagacuccguuugccuuucacugcuguguaugcgcagaugacuuucauggaagcaggggcaggcuggggcagcaguggcgagugccagugcuggugggugcuggccucgccugggugcuguuugggagcaguacugacuuauuggcacacuagccgguucugcgggcacgguccacgguccaccuaaauacagccuuccuuaaaugggccagaaacguaauaugcggucucucucucugcuugcaacuuugugacuauaagaauaucacuuuagacaaaccuguuauuaacaugaaguggcccuggauguagaacuggaguuuaagcccucaguguguguugugagcaguggaguucuuucaagccuggacgugcgcucugcccacuucuuccuccucagcaccacuaaaaagaugaaguacgugagggacugguuauauuuggacagagagugauggcuguuauugacagguguguacaggguuccuuaguuccucuggcccgugucacuuuauacaguugguggcagcagagcugaguuuuagaggguuugucauaaccuauauuagcaauaagcuggguugagacuuggagcugucauuucuagcauggugcguuccagugcugugucagugugugacaaguaacacaguucucuuuuuccauaggcgcaaagccugacuccccaggacuacaaucugagguggucaggccuucuggugacagugggggaaguccuggaaaagagcuugcucaaugucagccggacugauuggcaccuggcuuucacuggcaugucucgccgacagaugaucuacagugcagccaaggccguggcgggcauguauaagcagcggcugccacccaggcccaugugagagcagugcggggacacggagaccugccaucgucaccuugggcuccaugcagaggaaccugaguggcuuccgugaauccaacaguuuuuaugauuuuccuguaggcugcaguccuuuuaaaagaaaaagucuuuuuuuaaaaaauaaaggcacaaugucauuccaguaaagcaaaagaaauagauccucuuuuuacugucauaauuucauacguccugguucucagaagacauacacaaauauauuuacagcacaauucaguauaccaaaucuauaaaguggagaucuucguucacauauuggaugauuugcucuuggcucuucuggguucuuaauauguaaugaggucuguguguggucacuaucucgugagugcuuguuucugugugugcacacgaccgaccucagacaugcucagcaguggaccuuacgugcuugcugggugaggggugcacaauuugauguguuuuacagaauaugggccaaauuaacagaauggauauuuuuuuuuuuugucauuauguacauguauaguuuggaaguuauacuugcuucuuuuuuguuuuaaguuuugguauuuuacagauuuauauuaugaacaucagaaaauaauguuuuauuuuuuucauagcuaucuaaaaacugaagggcagaucaaguauaucuuagaucagaaauguauuugcguuuuuauuuuguuuauuuuuguacauugguguuugcuugccugugcauguguguacagugcccaaggaggccagaagagggcagcagagcucuggaacuggagucacagaugguugugagcugccuugugggugcugggaaggagcuugauuccucuagaagagcuguccauguucuugcccacugacacaucucuccagcacguucccccucccccauguuacuuuuauauaauggcguuagcacuucuauaagucagcugucacuacggcuguccaacauccucugcacuguaagagggaucccuucuuuugagacaguacacauuuucuucaacuaaagcuacaucuuuuuuauuauuugagaauuucaucaauguguucggauaacguuuaccucccaccccucccuuaacucuuccaucccuacuauguguucccguuccugucuuccuuuccccagcccaccaagugcaauuuguguuauccaaauaggugugaggcuguguccagucgaccaacaagaggugacacccugaaagaaacuugacugucccucucucagaagccaccggcugccaguaacaccccagcugugugcauugggggccgggggguguaagcccauccgugcugggauguuguuuggcugggauguguagauuuaaggcuguuucuuagucugccuuaagcacagucugacauuccuaacugugccucucugccuuuauuucuuaaggauguuuucaacgggaugauuuuuauauucgauguuguuuauguuuucuuccagauauacuguauuuuaccauuugggaaauuuacauaagucaaaauguaguaaauuuuuuucuuacucaguugagcucucuauauaggcaauucagauaucuuccugaugacaauuugauguguaaauguaauuuaacuuucuuuuugauguugaugcaguucuggagauguuagccuuagaggucucugcacucgcucuucccuguccuggcuugugcagugugccugccugcuuuucgguaauuacaucacuucugcuccuuuuacagaaggagacguuuuacuuuugagguggguacgugcugaucuucaagcacuguguguguugcuuggugagguaggaagggugcauugcuguggcucuugcggugcauggaccuggcccagggaaacguggucucaggacuucugguggcuucuugaugcauaagaaacggggaccuuucucuaccgcuuguuugcugugcucuggcuuuacaauuugggucuggggauguagcucugugacagaacaccagcuaaugucuggucccucagucagucucuagaacacaagcaugcaugcacgugcacacacacacacgcacgcacucacacgauggggggggggggggauuaaagucuguccccguguaacaguaucugauggggcauugucuggaagacgguguuuccuguucucugaaggcagguuuugcagauccagaaggguccccugcuauucucuucuuuguguaaccgaguccauacuagcucagugacuguuuuagaggccauccuaguagaugcacaagaggucacugacaucucauggggugaucgucuuccucgaacccucaaauaacaguggccaacuuaugcgauggcucguuugaaaccgaauaauugucgauaccuaguccgccuucugugggacggggagaagcaagagugaaggguggauggaagagagaaguguuugauccggucugaucucaguuuccuccggcccaggagcagggcugacaguggcacaggcuuuucuuccccagccucuaucugucacccucagguugugcuaaaccagaagaacagggagugcugauugucccuccuguagcucgcccaggagccugugugguggccuuuaggccuggccagcccaacgucaugguucccuccccagcccuucuguucuguguacuuuucucuuccuacgugucucuguguagcgucuacacugacaguuuuagagacuuuguggguggcuguugccuuuuucaagccuuucaggaaaaaaaaaucauguaaccguuugucacccuugccaugguuggugcuagcaucuuuugugaaguuuguuguuguuguuguuguuuuugguuuuugaguuccagauuauuggaaucuuauuuuaauuuauuuuucuccguuggaaaauaaaacaggaaaaaugauuuaacauccaucucacagaguugcuugacuguuuaguuccaagguccuccuguucagcuucuguugcucgucuuguuccugcucuggcuugcuuuguugguaacaaugcuggaccuggagccgagcgucucauuuaccggagcccagcgcucuguacugccacacacuucugaaguuggaaaagugugaagagcuaggacuugccugauucgcucaucguuauuuuuuuuuccucuuuagcuagagguaaguguggguguguaggaaaacaaaugaagacaccuaauguacaucuauucugaauuaugcaaauuagcucuuacucagggucaacuaaauuacuucacuuugcccuuuaguuuacacuuauuuggcaaaaaaaaaaaaaaaaaaaaaaaaaggaaaacuaaauaggacuguguaauuugugaagccaaauugauaaucugauguaaaaguugcuguauuaaacauaaauuauuaaguguagauuuuuuuuccuaggauauuguauucuuuuugugauauugcauaaaaugguguauuggauaaaaaucaauuuuguaaguauguaaauaugucauaaauaaauacuuugacuuauuucucaaag

SEQ ID NO: 8932 - RNA, 1004 nt, Mus musculus
uguuguuuuuguuuugccaagaguccacaauauuuuucauaggcauauuaaauagccgauugacaacaggcagacagcaucaaggaggucaaagcuguagaugaagggagugguaaggugucacgugagcucauuuuaggaguuugguguuccugggaaacccgaaacacugaaacucuuagaaaacauggcagugccucccccucccccugcagggcucggcuguaggacuuucugauuaggacgccauuugcccgagaauugaggcugacaguggacacugggaccucauaaaaguaaaaagcuguacagcuaaagaaccaaucagugaaugaagaggaagccacagaaggggagaaucuuagcuggguguucaucugccagguaagggagacagaccucccgggucaagcaguguuuccaggucagcauuagaagggaacuuggacacugucaugcuacugugaccucuaauuuucuuaucccauuuucaucuaaagugacugaaauguacauuaagccuuuuucucacaauguaacuuaccaaguaaacucauuuuccacaguguucuggauauuuccuuaagaguucuggacaccuaauaacucacaaauacaugugggauggaacaauucaaacaacaauggggcuucgcuucccugaguuucuaauuuuauuacuuguguuuagggcaacgcauuguucacccauagaucacauuuuuguuugaaagagcuguuggaagauucacugcuugugggaaacugcuuacaacauuuggauaauuugcucugcagucugagaaaccauaaaauaaguuuauauugaagcaucacauuugaguucaaaacuggauggucuccagugacaucaagaaguauuuugaaguaaauuuuuauauaacuuuaauucuuacugauaauagaguuuuuucauacaguguauucugaucacaguuucccccucccuaacuccuagauccucccaccuccccacucaccca

SEQ ID NO: 8933 - RNA, 3311 nt, Mus musculus
ucuucagauauugaugaaugcuccuuccaaaauaucugugucuuuggaaccuguaacaacuugcccgggauguuucacuguaucugugaugaugguuaugaacuggacaggacaggaggaaacuguacaggugaggacagccaggaucaacuguguuucauugcuuggcaccaguacuccaugcuaaacauauaaacuccucagaguuuuccggaaauaucuguacauuaggcugugcauguuuccaaaauagaaaaguauacucugguauauucaccuucuacaaugaaacgcauuuguguuuagauaagcagcuucauuauuuaaaacaaaaacaguaauuacauauguguguaugugaauuuuuacguauauaucacauuucuuauuuuuuuaaauaaaauuuacuauaaacaaccuguaguuaaaagccaucacauacuaaaauuaacuaggaccauggucugugccucucagugaacuucuauaugggcugaauagugauucugaaccuguggagcacuuaaauuucuuccucagaauugcaacuuuuaguuauugguuauauguuaggauauuaaaugacauuguugaaaauauuauaauuuucuaugaguuccaggacauucuacauagugaauuucaagugagccaggacuauauaguauaauacuguugucuccugccucccuacauucugcaaacacacacacacacacacacacauacacagagggagagagagagagacagagacagggacagagacagagagacagagacagagagacagagaugcaccaagcauccauuaaauccuuaccauugcagaaccuauuuuguguuuaggaugaaucuuagucuuuaguuagcugaguccuucacagugaccuuuaguaaccugggagagagguccacucaguuucuuggaacagcacuuuguauauggaaguaaagauguuaacacgggcaucuggaauguucacagauauugaugagugcgcagaccccauaaacugugucaauggccuaugugugaacacgccuggucgcuaugaguguaacugcccgccugacuuccagcugaaccccacuggcguggguugcguugguaagugaaagcuaagugaaauaaauagaaucacguaaaguugaauauuucaacucucgacaaugaacuauaauaggacaauuuugaguacaaaaccaagaaaggagguaauaaauauuuacaugaguagugacuaaguccuuacuaaaauaaugaguuuuuuucaguauagauuugcucuucuauaaacucuauuuuuaaaauuauuuuaaaacauuaaaaaggaucugcugaaugcagauaauaaagaacaauggccuuaacuucugaagaaccuacaaaccauaaauuugucuggcuucauaugccgaagauauuaacacacugauucuuugacagauguggguaagauuuguggugauacagauuaagaaaccaauuuaaucaacugugcagauguuuuuaaaugcaauccaagccaucaagaagcugaggcaggaggauuguguauuagagucucgccuaugcugcaggauauaaccucaucucaaaacaaacgagaauuauaagcauuuggauaucauagaauucaugcacaguuuguccaaagagcaagcaugucagauacgugacaaaaauguaauuuacugaaauuuuuaauggacgcauuaaaaaccguuuuuaugagagcacacacagaagcuauuaucaggucauuggaaugguccaggaggaaaagaaaaucaggaauggagaaugaagauuugaaagggggaaagagaaaggaaggaaugucgaaugaauucaaaccuaauaggggagggaccaugaguuaacuugggucucuguacccaagauuuggcaaccgaaaaaaauugaaguauaaccacgagaagcagccagauggcugugcuguguucagccagaagugaaagguacuuuguggacucauaaaaacuuucaaaauacucugguugggaugagaccucuuuggggggagggggcguggccuggcccagaacaguucuucugaagaauuacuuuggcuacaaagacaaaaacagauuggacuugggccaaagaugaaagcugagauacauacgaguugggaaaccauugcaaucaucuagguuuaaaaagaaugcugauauggggaauucaggcuaaggggaaaaggcagcggugacguaagucgucagaugcaucuugaagauaaaguuagcaagccuuauuauuacuggugugaaaggagaaugaguguaaaggguuagaaauggcagcaaggcuggacagcugaaaaagauaagggaaguuccaucgcuugaaagccgcuaagacagggggagagguagcacagagagaggaguguccagguugguuguugggcauguugacuuggaaacaaguaguaaagaaauaagcagaaagguuuagaacucagaagaaaggugagagaauuuugaacuugaggucaugggugggacuugggggaggaguaccaucuaaagccaggggucaagaugaugaguguaaauagagacaggcagucuucagagagaugcaguuugccagacugaacaauccgcaacuguugcagugaagauuaaaauaaaaccaucgggaggggugggugaaagguagacugagauuguuaacauguuacggacuuaguuacauuuguaugucuccgaggugugccaccacuucuucacaaacucaugaggcagauuaguaacaccccaguuucucuucuguucacacuacuugaaauguccagagggcccccaaauaagaacugccucacuuucuugcuuauaccacaaauagacagaaaucauucugugguuucuagugacugcugcucaccaucuuuuacaguugacuugaucuugugauguuuaaaagccgaaguuuauagcaaaagauuguauugugcuaagaauuaggauguaccuucccugucaacguacaaaaucuugaacuugguccuuuaaaugccuuccugagaauuucuccccacaguggggaccacuuuaagcucuucuguugcucugcagacaaccgcgugggcaacuguuaccugaaguuugguccucgaggagacgggagucuguccugcaacacagaggucggcguaggugucagucgcuccuccugcugcugcucccuggggaaggccuggggaaaccccugugagacaugcccuccuguaaacagcaguaaguauggaacagaaaggaaggaaaacacuucuguuucu

SEQ ID NO: 8934 - RNA, 2077 nt, Mus musculus
guacuccagguggcccgugucaccugccuaugaugugugucugugggaaguuagagccaugccugccucugccuggcuccagcagcugucacuuaccugauggcagaaugcucaguaguaguccaucuacguauagauuguuguauuaggaaggaguaacuugggaaugcagcuguuuguagaaugcuugccuaccaugcacaaagcccugagcuugaucccuagcaccacguuaaccagacauagugggguacgccuaaaaucccagcacuugggagauagaggcagauuugaggucaucauuggcuagacagugaauuuaaggccagccugggcuauacaagacuaucuuaaaagaaaaaaaaaagcuauaucucaggcuggccaugaucuguagcagaggauaaucuugcucugauacuucugccucccucucccaacugcugauugacaggcgugcaccccaugacuucccacuuacuaggacccagcuggcuuucgucugcacauucacucaacguucuggaaacaugcuccaugcuagacagugccagacccaggucucaaggacaugauagagaggagauuuguaaggcugagagcaaagugaccucgaagagaagaacccugagugaguuggugggauuccagaaacuucccagaagacuugaaccagagaacuuagagaaggaacgagagcccaccaaggaaagagggugugauauaauuauggucguuuuugguauguguugaucugggaguucaaguguggcaugugggagagagaagagguuguagcagagacagaggcucuacuggcaaaaggggcagaguuagcaauggccucauuggcuguuguguggugcccaggagcaaugcuagacgucaggaaguucacaaggggcaaggccugccaacaggaagggauaaaaaggggguagggggaugucagccugugauguccuuuauagaacagguacaaaguggaacacguaaugacaccaucucauccucccuucugaacagaucuuagcccaagugaugggacugugacuguugauagugaagugugacaaugucuugguggcucucuccauacccuguuccauagauguggcuauccauucgcuggaacaagaggagcaggacugaagaagcaaggguccaucaagggcucccauugcucuggcugagcugaugcccagucaaucuggaauuguggaacagugucauguuuugcgauuuaggguuuacuagugggggcuugggcaucccccuagcugggauuugguuuaucugagugguaugaccuugggaaagccauuucacacugagccucugcuucuccacccguaagacaaggaaaaguauaggucuuugaagggcuugagagcgcaguauaggaccgucacggggcucuauguuagauuucuugccccaccuguuugcucuguuggaauagaucugcaguggaugccauuuauaaagcaggcugugagaaugcaggauucaggucagagggaggcugaugauggaaggguuccuuuugacaggaacccuuggccaggcugcacagcgcacugcauguuuauucuguggaguuugacugcccuuccugguuccagggaaccaguagccugaaucuugcaauuccucgaaguugguguuuucucuuggauuuggggcugucaaggccaaguuuccauaaucuaaagaccaacaccaucuggcugguaggagggcuuggauggcuugugcaacucucuggaaggaaaucuaccugacaagcagagaacaagaugcuggaagguaggguccagcaccccaaaguaggaccucauuccuucuccugaccugauuuuugcuaauagugacuggcaucuguccggcauggcccauaccacgugccuucuccccucuaucuccuccauuccugcugacugcaggcaaaccccuggucuuuaauggaaccacccuacacgugcuguuaucuaacaaggaaaaguuuggauccugagaaagcaaauaaacauuucaaguauuuuggggaccuaacaaguccuucaucaaaccuaac

SEQ ID NO: 8935 - RNA, 64176 nt, Mus musculus
cgaacagcaccgaaucggccgggagagccgagggagaauccggguggaagcgagagauccagcccggcucgcggcgcccggucccgccccggcgcccgccgggcccccgcagcgugcgcgccccgcgccgccggaucgagccccgcgcacggccacggcgggggagguaggcgcgggccgagggaggcgggcggcccggcagccuugugcgcgcuccccacgggcgggggcgcgggcgcgggcgcagcgcggccagcaagggguuaagccggcccgcagcccgccucgcgcacgcccgggaccggcggccgcgcggccacccgcgccgcuucccccuggcgucccggccgaggcagguaagaggccggagggcccgguggccggcgucccggggccgagcgcucgcaaccggggcacggcgugcaggccgcgcgggggcccgagcggccccggugcaaguuuggugcgcgcgggcgccgggcggguggugggaggacaaaggggugggggccucgcggggccgggcgggccggggugcgggccgggcagcgcggcagcuguaggucacggauaaugucacccacgaggaaugcccccucccccuccccggcucccgaacaggggaaacuuuugucuggcaugggagggggcuagaggccgggucccagcuccgggaagcggcgaaggcggccggaccgguuuucucccgggcccugagcggccugccuggucccuaacuccccuccucccccagcuucucggaacugggacucuagcauuugaccagcuugaggagggacgccuguaggacgugggggucugagggcugccaagaagcuaggacucauccaucaccuggcucuugcgugccaggauccuuacagauccuaccucccacuguugguccuccguccugccccuaggcgagcuugggggacauccuggagcaguauuacccuguggacugagggcuagacagaccucggguguucgucgcuacccagcuaugugaccuugagcagguuccuuacuuucccuagccucuguuuccucaccuguaaaauggguguaucugucagaguugggaugaagccagggugugggaccucggaaaauguuggcaugcuuauauucaacaaguguucaguugcauguugccgugugugccgggcacugggcuaauucacuguuuuacauaguuuacagaauuuccccacauuacuuuuaggcacauuuuacaaaaggggaaacugaggcacugaauggaaaaggucagaaagguaaaaagugggugcugggauuuguccccucucccagucuuuauauaccaaguacagagcccuacuagggccuuugaugugacugaguuuauaguuucaguuuuaguugaauccucgccccaucacccuucccccaggugaggcacccuucucucuggcacuugccuggguuaggucccgugcccuuguucuguuaggcugguuagcuggagcaggaggggaggucagucagagccugugaucugagcuucgagaugguccaaguuccguugcuggccagguccugguaggaaaggucucccuguguggguggugguuuagggaggaggagucugucucucuggcuccaacuggggacagcugguggcuuugucaacagacuuuuccccagcgcccaggagaccugcagagccuuuuuaucucccuuuagaccugucacuuucagaucaacaggggguaagagguggggcucaagaguagaacccuugggcagaaagagaccuaaggucaaggguuuauguccuaaaugucuuagcuacaagguccacugccaaagugagagucaggccuuagucuuaaagguccuuggagcuaguaugaaggauggacuucgagccaacaucaagacugcagaauccucauggugauaccuguuuuugugugaccuggaguccugcuagagcgguacugggcaccuuuuuagccucucaggaaagaccccacuggugacugugaagacuggcucggauucccucugguuuccugugcuaggcaggcccagccuuuugggguguuguggggagggaugauaucaucugauuaccaaucaagcucugauuggggauuuugaguacuuacuuaaaagaugggcuacgaauugcuaauuaaugacaucuugaaaccuuggacccagggcuagugugaugggugcguugggugggggucucgggggugggcgguucuaacugcuucaaggcccuccagcccagagugugggauugacacgauucaugggcuuuccuuaggcccugggaauagagagcucuccccggcugacaucacugucagcuuguaggaacaagaauggaaauuccgccacuuagccacuuagcucugaaaagcgagggauuaagucgagggcuggaaggacuggaaaggguuuggggggggggggcuggggcugucccuuguuauguggucagacuuaacuuguuugucauugugaucagagcagaggcuucugggagagucaacagguaaagaaagucagcuacagagagaugcugagggagagccuccugucacagucuucaaauugagaggucaggaagccaagagagcaggugagagagacagucucagcagcccagugcucacgcugcccuggccuuggggacccgcuuugccucugcuuugggcccucacaaggcagaaccagagccagacuuagaaaucuccagggcuugcucagacuucuacuagguuggaauuuguuuuggguauggcuugaaauaacaggacuauuuggaggacuuggacauucuugacuugagauggggagucuggguaauuuuugaaauccguauggaaaauuuucuguggccgggguggggugggguggggcgucggugacagggcacaugaaguaggggugaagugcuugcuggauuucgacuagagagggcagacagggaucagaaagggguggccgugaagcagcgugucauagggugaucggcaguagaugaugcacucucaggacagugggaggcagaguuuccugguuggugaugucagcaaggguuccuagaggauucaggcaggacagugggcgccagacuggacuguggggacucacagcucccugcuccugaguuuggguuuuaugcuguagcggagaagacagaagguuguaagcagcuuguugcucugugucaggcauggugccaggcccucacagacaucccauugacuccccacaauaccccgcagaguagccgcugccggccaccccacccugcccuauuuguagguuggggaaauggaggcucagaggggguagucacuuaacacuggcagaauuugaacccaaaccauucugcuucugugccaccgaguugcccuucuuggggucguuuggccaaggaugguagcaagaguggcagacaggguggagaccagaagauccacgguuugugacccagcagagucaggguagucagcucaggccgacucaggcugaggcugaugguaggagaggggcugcaggaucuuguagcugccuuggggucggccaagguuuggggaagggucccagcagauucccugcuuuugaagccuuggaaagcucccucagagcagaugccguaggcuggucugcccuguaggauuuuuuuuuuuuuuuuuuuuuugagaucagagacaacagaaaggucaggucuagggcaucuaaccuggaaagagacugcccaaggacaaggggagagccucauugcuaagugucaacaggagggagagccuguugaggaugugggaggaugaacucacagggucaggauuggguggcugcuuucaguucccuuuuugccugagaacccagaaguaggggaguacucagcccacauccagccccacuguucuuucucauaguucuugaaguggccuuuccugugcagcucaggaaguaccauuacccacaggcccgcaccacuucuccuagagucccugugcucugaggacacccagcccagccuucuuccaauaauacugguuuucuuuucuucucuuuucuuuucuuuccuuuucuuuucuuuucuuuucuuuucuuuucuuuucucuucucuucucuucucuucuuuucucuuuucuuuucuuuaauguucuccaacuuuuguuucuguuucacgugauauggcuguuuugccugauuguaugucuguguaccauauguguguuagucuucuggcaugggaguuacagagaguuaucucuggaaccauccagagccuggccugcuaagggcuuggcuuccacucccacagugggaucagcuucuccaucuccgucugugagcagguacuucauccaucaugaguugggaaaggggcuccugggucugugggcuuaaaggugaggaguggggauggggugaggguguuuggcaagguugucccucccccccuccuugaggcagagguuaaaggaguguauccccuuccuuaagggaucuagaggauuccgucuccuucccuggggccuguucugaugucuguucaccacccuggguucuggaguuugggacuuaguagaagaguggaugugucuuagagcgagacacagugcgcuaccaaagcucuuuccuccagacagaagggaccaugcacgcuaaguugcuuuauggcuuguuacuuugacaugggcuggguuaaucaaaauugaaaauguucauggugacuaacacuugaugagguauggaagggacuccucuauguaauggcagucagugcccuaugucccaugccccucaaccaccgagcagagcccauucuuuuuccuuucuccagcugugucccucaucccuccccucgccucugcucaugguaaggaggcugugaggcugugccucaggucuuuuuccuuccuucccagccuccaaacucucccuggugagccacucuggggucucacuucucccguguagacauccugacucucugccguugcccgugcuugccaaguucaaggaaccuguuggcuggacccuccggggcccuuuuauccuugguuugaacucuaguuuacagaagcaccugaucuuuucccucuguguuccagaagcagaagcugacuggggcuugguuccagaggggcgagcagcuuucuggaguagaauccaaaguuguggguucaaaucccaguucuuucacgacuagaucuagccauuagcuaauuccuaaaucugagcauugauuuccccaacugcacaacggugaucaggauguuccuuuugggccugugagauggcucaacugagucaaggcguuugucaccauuccugaugaugugaguuagaucccuggggucccacaugguacaaggagaggaccaacuccuacaaguugucaccugaccgccaaccauggcacaaacauacacacacucccucauacccacucucauagauucuaaguguaaaacaaaaccagaaauaaaaccccaaauucccccuuuggaaaggaugguugguuuacagcauccagcaggcaguucauaguagcaggagucgcuuuuuacuguagaagacugggaagcgcagguaaggaaacugagucccgagugaguacuagggcgcuugcacggccugccguggccguggcuguaucuuagaagcuaggcaggauuuccucccuguguuaaugccucugauuucucucuuccauccugucacccaaguuaagggacucaagucccaucuccucccuggugaccauauugaguacugucuuaagcuugggccaggugaguugggcagguaggcuuaugguggcccucaugacuagggacccaucucuuacugccuggacucugggcuuggagcuucuuguagggaaggaugaaggcuugguggcagggagagguggcagacagggaaggagggacuuaaggcaguagugagguccacaccaagugaaggcugaaaguaagacuggauaccagacagccuggggccagguuccugcugucucuucugcuuacagagccuugggccaggaguuccguuuuuucaccugugcaaagggacagcagcuguccuuugaagcauuuuaacugcagacaaguuuugguuacauaugguuguugagacuuuuuuuuggauauggucucucugcagcacugcugguuggccuauaauguuacuggccuggaacuuucagugauccuccugccucagcuuucugaguguugggauuauggguauagccuuuuuuuuuuuuggugguggugggaggcaggguuucagguagcccccccuuugcccucaaacuugcucuauagcuaaggaugaccuugaauuucugaccauccuucccuuccuuccgcucagaugagagagaggcuuaugccaacacaccugauucacaaguguugggaacugaaugaacccaggguuuguguacguuaggcaagcacuuucccucucccugauaucugggguagauagugcgucuaauuuagucuaggaugaccuugaauucacugugaagcagaagcuggcuuugggcuucugaucguccugucucacuguugacauggauggcaucugucaccaugcucagcuccacgccuaacuuuuuuuuaaaaaaagauuuauuuauuuauuuauuuauuuauauguauaugaguacacuguagcucuacugauuguugugagccaucaugugguugcugggaauugaauucaggaccucugcuggcgcgcugcucuaaagauuuauuuauuauuauaucuaagugcacuguagcugucuucagacacaccagaagagggcguuagaucucauuacggaugguugugagccaccaugugguugcugggauuugaacucaggaccuuugaugucuaacuuugauaguuguuuaucagacacagacaggcaaggucuuacuguguuucccucacuggccuaacucacuauauagaccagucuggccuccaacucugccuccugugugcuugauuaaagauguguuccaccaagcccggcuuuguaguuacuccugucugaggugcucacuuccuucuuauaacaggggugggaaguggaguuggcaaucagauagggcagcaaagccuagagggaccaauggcuccucuuggggcuccucuggguaccuccuugucugugaagcaucgauagguugaagggucaauguaccagaggggaccaaucucaacuauguauagcauaucgcagaaggccaagauggcagcauuuguuucuggagggagcaaguaccauauuucugggaguggaucucagggcuggagagauggcucagcagguaagagcacacuggcugcucuuccagaggaccaagguucaaacuccaucagccacaugguaguauacaacuguaguuccaguuccaggggaacuucuaaccuuccugugggcagugcacacaaguuguacagacauacauucagguaaacacucaugcacauaauauaaaaauaaguuaaaaaaaauucuagugcuuaugugauucugguuuuucagaccugaagucugaccccaugagggaaggccuggauucucagcacccucaggcuggccaaggucuggcuugucuggacaggucuccaggugguguaggguggagguuugcuguagucuuugcucagugguagacaccuuagcuuguacccuccgcuuugcuugcgcacagcuaccugcccaggcagaugccaggcaagaagugaaugcuguccuagcaggcccuguacucaagcuguguucuucugccuguaugcccuuccuccugacgguugugacacccuggcucguacuuuuaugggaauggaagcaguggguggcuucccugccgcuccugcagguuuaguuggagugucucaaaguugggcuguggauuguuggcaucuguaucaccugggaacugguggaauguacagaccaugccucccuaccccagaccuccucagucaggugcugagcgguggggcccagcacugugugugugugugugugugugugugugugugugaugcaccaagaccacagaacuaggucauaagaagagucagggccucuuuccuguuuccagucuacucagauugccagcaccaggaggaacccgggaaagcccaguucguuucuauccuaggucauuuaaaaaagaaaugccucuuucuuuguacuccuguuucagcauuuucagacagguagaauaaccggggguggggugggugggauguucacagccugauuucucuccgcuuuuuccuuccucuuauuuauuuauuuauuuauuuauuuauuuauuuauuuauuuauuuuugagggagcccagccaugcuuguuacaaagccccggcuagucugauauuguguagaccaggcugaccuugaguuuauagagauccgccccuuuugccuccugacuaccacacccacucuacccuguuuugaaagagcugccauuuuggacuagugcccuuuaccuccagaaccaaucuuauaacaguauugagguacugucaaacucugugacaaauacucugugaguauaagaaagaacauugagacuaauuggggaagacgguagugggaaggggaaugagggaggaguuguguuggcaagaaugagugccaggaggcagggcaggguggcaugccuuuaaucccaguacuugggagacagaaacaguuucugugaguucaaggccagccuggucuacuuguugagcuccaggacugcuagaauaacacagacacuaucugaacaaggaaacagacaagugggagccaggaauaagccagcuguguucugggccuggcccagggcugggguccugcuuuagagaauggcuguguuagggaugagugggcgcacgcaugggccaguggcccgaugugcucugagaagccuuugcugucagcaguccgugguuuuaagcaucucagugauccagucaugaucauaacgacuacuuauaucuauugacaguuuaucagugcuugguagacauuucugugucaaauucucagaagcaauuuccagaacaauccucuaaauuagggaggcacuguaguccuuucuguuuauagauaaaaguaccuaggccaauagcuucaagggacucgauuuaggaauguuuguuuauuagagucucacuuuguagcccuggcugaccugaaaaucgcagagaucugccugccucugccuuugaucaaagacauaauccacuaagcucaucuuacuugcuuuugaaacgggaucucaugugguccaggcuagccaaagaccuugauucuccucuuuuucuacuuucuaaugcuggcaauaaaggugugcacugccauuaccugcuuauaaugugcuaggaacggaggcugggguuuugugugagcuaggcaucacugugagcugaacugaagucccagucuaacgcaggcuggacuuagcuaaaagcuggucucgaacuccugauccucuugccuccaccucccacgugcugggcuugcagauggauaugccccaccguaucuguaguagauuaaggauucuauacgauucuguagguuuagggucucgggaggaugguggcagggauugcuugggaguguuugugcagcacagcuagaguggagcgagcccuugauaaaauauuauucuaucaaaugaguaagagaagccugauaaggucauguugggugguuggggaucaaggucccagcauggggugagagguuaaguuuaagagauaaaguggggcguuuguuuggguuuuguuguuguuguuuguuuuucuuuugguuuugauuagagaggugggaggguuagagucaguuuacaggggcuguggagauaacugagccacuaaugagcacuuacuguuuacuuaguagaggcccagacugcaucgcagcgcccucauaaacaccuguaacuucaguucuaaggggucuggagccugccugccccuggucucugugugagggcacacacacgcgugcaugcaugcaggcauauaaauaaaaauuauuaagcugggcagugguagcgcacaccuuuaaucccaccacucgggaggcagaggcaggcggauuucugaguucgagaccagccuggucuacaaagugaguuccaggacagccagggcuacacagagaaacccugucucgaaaaacaaaaacaaaaacaaaaacaaaaugaaaagucuguuuccaaccuccuuuguauuuucuuuucuuuuuuuaaaguucucuguaucucauguuuguaucuuuuuuuaaaagauuuauuuauuuauuauauauaaguacacuguagcugucuucagacacuccagaagagggcauccaaucucauuacaggugguugugagccaccaugugguugcugggauuugaacucaggaccucugaaagagcaguuagugcucuuaaccacugagccaucucuccaguccccguuuguaucuuuuuguuguuguuguuuuuacgauuuauuuacuuuauuuauaugagugcauuguaauuguauucauucauacaagaagagugcaucagaucccauuacagaugguuguaagccaccacgugguugcugggaauggaacucaggaccucuagaagagcaguuaguguucuuaaaugcugagccaucucuccaggccuccucuguauuuucuugccuguguuuucuuucuuuuuuuuucuuucuuuuuuuuuuuaagauuuauuuauugauuauauauaaguacacuguagcugucuucagauacuccagaagagggagucagaucucauuacggaugguugugagccaccaugugguugcugggauuugaacucuggaccuuuggaagagcagucgggugcucuuacccacugagccaucucuccagccccuugccuguguuuucaaugcacuuucuaggagccccaagacuuccccuggugguacaggaacccuuaaucucacagucgaagagcuaagccgaaggcugcauagggugccagagucacugugaggaccagagcucaguauugucacuguucuuccuagccagggaaaggucuucucccuuaaacagucccauuccugguagacaauguagccauauucucuggguggcccagggcaauucugggaagagagaugaaggugcccugggagacagcugccaagaaugggugggacaguuuccaugaggaagcucaccaagaaaccccagacggaaaccaaauguguuuucuagguccugagaggauauuuggaacaauggugauagaugggggaggcuguguuggaaaaggguuucuugacauccuuaaacaaagcugagucuguagguuugacuuuuguuucucugaaggauguuuauguaauuucccgaaggcaagauccagagcucugugacguugucaggccuguuguuuauacauccagcuuuggagcugggcaagacuuccauuaggggaucuccccaucucacucggagacugugggauggcgcugucagaacuugggguggaaugggguccucuuggucuugccacccucagaucucugauuuguuggcgguagcaaggggcauggauagguggagggggagcgcuuuggaaagucauugcuacuaagggcuggggaagguuaaguuggucuucaacaagguggugggcaaaaggcuggauagaguguugcaagagagcacccuguccagauucugggccuagcuguguaccgccuacccagcagcuagggacuaugagucacacucaguggggggcacagagucacuggccauuguguguccugauucauucuguucucccaguuuuacagagaugacuaggcccuggccuggauugugcacauaacugugggugaagggcuccguagcuacaaauaugagaguccuagagggccugccugugagccucccucccucugcuccuugucuauagagcacuccguggucaugauccacauguucucccggguacaggggauuaugagucccugacauucaauguggcauuucgaaggcacuucuauauacugcuucccucccccucuuaaauuaaaaaguuuaaaucuaucuuauauguauuggugcuuugcuugcguguaugucugugcaccauaugcaugccugguauuuguggaaugcagaagaggaugucagauccacuggaacugaagcuagggauaguugugagccacugugugggugccaagaacugaaucuggguccucuacaggagcaaauacguuuaaucucuaagccaccucucuaggcuuucauuucuaagauaccccuguuguguuucuuuaaaaaaaaaggaaagagaaaagauuauuuuauguauguguguauacguguaucugaacaucuguaccguguuuaagaaagcgucccgucgguuugucagauugagagagugauagauauuccugugaugaguaaggcccuaugcacuguaggcuagagagacagggccgugucauacugauauuucgaguacggucaaagagacugcugucaguuuugaagccagcuccucccuuuaggauugguaugaccuuggcgacuuugaguuucagguuccuccuguauaaaauggcaaauacaaggauguuuauccguuuaaucugaaugugcguguggaggacuccccaucaccugcuacagaacugucacuugagaagagucugcuacauggcuguccuugcuuuggucugugguuuggcucugggucccuaucccagggcucaccuggcuccugggagcuacagggccagguuguagagcugccauagguaggcagugccuuggguaggcaguaccgguagcccucugccuucugggacucucagaccaggcccucccaugcuuuguccugaggcaggcuuauguaacaaccuagccuggccaggcaggacacagauucucaaucucauuuuauccccuccauugugucuuccucucccuucccccacggagcuguuguuggccggcuuccucaagcugccggucugaaaucggaccccugcuauucucccaccaauugauuuagucugauugauuuagucugcaggucugugaggcgggcagccccucccaccacucagagccugugcuugcuuugccggcuggcaggcaccuuggauuuuugaggaaauguuggcuacaagaugucaugggcuccuggugugaccugccagccuguagggccaagaggcuccuguucccuguggucccaguucuguaucuauaccuuuccuaagcaucccacccaccccaacaccucacuucucagcccagcccaggcaggcaguccuuccugguacagagaaguugucuuccugccuggucuccacagugcuggucacaccuccuguccugaacucuucagcaaacucaacaccaugcuuuucaagagaacagagauuagaggcuggcaggucacaucugcccuacgggcagauuuuguuuguuccaugccagauauggagcuaguagucaguagauuuuacucuauaaaauacuucuggcuuugccaggaaaaaccagaucuucaagcuggacauagugguauguaugugcuauuaaucccagcauuugggagauagagguaggaucaggaguugagccagccuugguuauaugagucccugucucacagcuugcgcuguucccauuagaagagugaacaccucaagccugcauucuccaguggcuccugcuggggacgaggucuaugcccuuuacugaccccugccugucacuucaugugcuucauaauucuuuaccacagaggcaucggaguuugccagccuguccuuagggcagaggcugcuuucucuccuccuugguaauguguugccugccugucuccuguggcucuuccugggcagcaagggugugcugggaaaagugcuuaggcucgggacugugcauacagaaggaguauaauaaauaauauccugugggaaugaagguccuuuggcugcugugaaucagccugcccugagcccugggguucucccuccaaauaggcuccagcugguguuuguuuguuuguuuguuuguuuguuuguuuguuuugagauaggaucucacuagauagcccuggcugcccucgaacucagagugaucuucuugacaggccuucucaguaguuauaggcauggaccaugucuggcuuucugauguggagcagccucugagagugcgaagcuuguggggcucagcaguucucugcuguaccauguauaggucugucccugugcauccuggggaagggaagggugggaaccggugcgcacagcucugguauuuacaucaguaggcuuuccuggcugcuucuugaugcuucauuuagccuuccgcuccugucugucuauucaagguuuauuggacuuguuuuuccuuucuucuuuuuuuuuaaagauagauagauuuauuuauuuauuuauuuauuuauuuauuuauuuacuuaugaguacacaacucuucggacacacuagaagagggcauuggaucccauuacagaugguuaugaccaccauuacaugugguugcugagaauugaacucaggacauuuggaagagcagccaguacucuuaaccucugagccaucucuccagcccccuuguuuuguuuguuuuuuuuuucugagacaaguucuuaauuguauagccugggauagccuagaacuugcuauauagaucaggcuggccuugaacucacagaaauccacuugccucugcuucaaagaacugggauuaaggugugggcuuccaagccaaugaagauuacacuuuuuggaaguggucuuugcuaauaaaucacaauuauucugugaauaugaaaacuuacagaaacugccuauagauuucuguucccugccucuguucuaggauauagucuucuccucuccagaauauccagccauggagagcucuuugaggucagauuacauguugagcauucacuguguuguaguacacagagcccagggcuuguagagggccucagaguaacuuuaacaggaacaccuccccucccccaccccuggcuucucuuucuccucugggccagcuguagggcuccucccugucucugugguuccucaugcuucuugagcaacucuucaagguagcgcauuaggcagguuugugagguggggugaaggcccagaggguuucccuucccaugggcuggcagcucaggagacagguacgccaggagaggugugcuuugucugauccggaaggggaagacgcuggcagcuuggcucuuagcagguaaguacugggccucugcucucgggccuuguaagaaaugauugguguauugagguccgguggcacaugggcugagacauuaaguacaggacggaacugagguucuaaagggcggagccugaguauaugcaaaucugggcuggaaccucgggucuucuccuccaagccgggcguugcuucugucuucauuuuccucugcacaguuaguggcagaucacccaguggagacaaucagcugauugucugaggaggaggagaagguuggggccuggaagacugagcaggcccacaguauccuggaggcaugaacuagccuggguaugugagugaccccuuaaauacccugcauccuguuucuugguuuucccuugcacugucuaugaugggccagcugucucugugcccacuucugccuggcacuggcuuugugcuuuccuuugagaacaaagcuaauuucugauaguuuuccugcugucagagaaggacagacaaggcccugguuuuccccuccaccugcugagagcauuugugggcuuugggggacacuagcggcagcccugugaggacuccugccaguccaagugucaggaccuugagcuucuuuccaggggcccaaggacuggaagcagagagaaauggaacauagaauccaguggucaccacugggaauuuggccagaacuggucacaugaaagccuagagauuucacuaaggcccgggugugguaucacccuucaggacucagggacuagaugugucugacuaagggaggcaguagucacauucaucacauuuuuacaaacaucugccucauucaggccuuuucuaggaacugacacaguacacagacuagaccaagucucuguuuucaugucacaccaccaagggggcagugccagcaaagcagcaaacacugugugcugaguggugaggaguacccaggagaagagaagagcuggccuggggauagcaggggggugucacaggagggaggagcaugccaggcagagggagcaccaaagcaccugggcaggcaggcagugggaggaaaggagggagggugggaaggaggguggaugggugggaagggcuucuuaucucuuaggaaggagaacuuugaggaaaggggaaccugcucgaggcuugggguggaggacucaccugcuuagcuuuucuugcagaucauggaucaugggcgggaagggcagggguuaugcaggaugucaggaggugaccaucccccccgccccccaugaaugaugguggcucaguggcagggaggggggcccacuaggaguugccucuggauuuauccuguaggaugagcugacagauuugcugagggauuagcugugggggugagaggagaguguggcuggcuggcggcaccggaaggacauuguugacacuaacugagaagacagggagggcucagaacaagcaggcuuuggagagagaacugcgauuucuggucaguuuuguugggguguagcacacacugguggaauguaccugggggcccugagagcugucgggucguaaggugugccuuguccugcccagaaucugcucugagacaauagucuaccucccucaguucugucuucucuuggcaaaccugccuuaucccuccucccgacagcgggcggcagauuguggugaaggucucaaacccucugucuggcgugccucuugggaaggaguuuugcuuuuggugggccucggggagcuugaaggggaggugggggccucaggcucucggcauugcucuacccuccucuguacagcagugucguccuggcgucuaguucccagggcaguaaggaauguuugaggagacagcguaguaaggugguuaagaguuugagcucgacucaggcaaguggacagcgaauacuuccucugcugcugggcugugagacucugggcaaaugaaagaaccucucugguccucuauuuucucaccuguauaaaugggcccauccuaacaccugcuucauaggggguuacuuugaaaguuccugauagguuugcagaaaauacuucacaaagauucaacaccacacccagaaggagcaguuagcagcaaagaccccuguggucugucagggugacagguucugccuucuagguuaugggugcugagcaagaacacaauuacauguguuuuagugggggggggcagcuggagguguugagaucugggauggugggguucuggggugugcuagggaucccuuuaauagcuaaguagggcugaagagauggcucagugguuaagagcaccgacugcucuuccgaagguccugaguucaaaucccagcaaccacaugguggcucacaaccauccguaaugagaucugacgcccucuucuggagugucugaagacagcuacaguguacuuagauauaauaauaaauaaaucuuuaaaaaaaaaauagcuaaguaaauugagggauggggaugcaagaugcuuaagcaaagucccggaagaccccuuaaccuugucuccuuuuguucuuaugagucucgcucagaauuuuagcaacuuccugugaacuucugccucagagugagaacagggcugucccuagcucuguaccuucccuagcugagagucuuuguggaguuggcauggcagcagcacaggucucagggaggagggugguaauuuuccuuuuccuagagauucuuugucucugcaguucaguggccagccuuaguuagggaaaugugggcgggaggccuggagggacaggugucacugaggugacuuuaagggcauuccagacauugaguuaggugugguggugcauaccugcagugcuaaguacucuagaggcugaggcagggguaucacuaucuuaagaguccaaaugugggugccauagcauuugagguccaccuaugauacacaauaagaccuugacacaaaacaaaacacaacagcaacaaaccagucagggcuguaaacagggcuggcuguggggcagacugggcuggaguggcauuccucugcguacuuggaugcggcuggccuuggcuccuggucuggguccaggcaggguggugccugcuucaguggagccauggagagguugacaaugaauggaauguggcccccuaaggacccacacacacuucacuggcccuggcaugccaguugaacccugggcuucugaaagccuuuuccagcaguuaagcugugccaggacauuucuuagucccuggggugacacugaccagugcugcuuuucucagcuucaggggucuuuaggugcgugggagagggccuuggagauaauccagccacuucccuuaguacccgaggaaacugacaccuagagaaagcaagacacuugaccaagaucucacauagccuuccccucacgucugccaccuccuucugucccugugucccuugcucagacuccuggccugcugcccagacagacauuuccaucagccucccucuuguggcuccccgcgagcuuuguuugcccuccuguuugcccuccuguuaucgucauuuugccaugccccgccaggcacucacacgacuugguaugucugaacucucguccccuucuagcgucugcuaguucugggaccuccuagacucuggagccacucagcuuggguuuggaccauucggcucuuuuguuuguguguagcacagcaauccugggccuaccagcccccuggacgccccagcauccccucugcacagugagaucagcagaggccugagcgggcagggcugcugauggaugaugucagugagaugacaggugccgugcuggcaagacgggagcucucccaugugcucauggcugucacgaaagccgguuggcuuguuggcuuggcaaggugagggugugguggacucagcucugcacagggaggcagaggagugcacucugaguuuaccauuaggggaaguuaugugucucugggaguccagcuuccuccuuccagggaugggggaagaaaucucuauuauguuuuuuuuuuuuuucaaagccgucaugugauguuaaagcagcugugugaggaaguguugccuguguguauaugguuuuaaaguggcagguggugguugguggcaaggaggacacuaaccauagugguggacagguggacagacuggccagucugcagaguucucagugcccacauagacucucuacccaccuguucccagccacccugcacuuuagugucaauauuauguacuaggagaucggugaggugcaaagaucuguggcuuuucucaggaccuggugggguugggauaacccgugaccagugccacugucagaaacuaagacccaagacaggcaccaauuuaaaugucagcuaagucuuuccuccaccgggaguuugagcaguuaccauaaccucugugagccgcagucuccuccucugugcaguuagacccugaagguacagaggcuaagcaggcagucggcagaggggaagcaguaggguucuguguucuggguggggugaccugggagauguguaggcaugggggagccacccucacccacagagccagcucgugccaugugucagcuguucccacaccuugccugcuucaucgagcagagccuugggaggaguguauaagaaucggcuucagcucuccagaucucgagccuucgggauacuuggugacacccagaaugcccugaucccuuucaaauggaucccgucugaaguacgucaggugcacccuuuguucugucucagcucucuagagaggccaugucuuccuucacuggccuguucugcccucucugcuagcugugccuccuagugacugcacugagccccucaugcccccgguguauugacagcaggcucuugucauggugacaagcuccagcaagucugaagggacagacugcuuucaugugggccuucaggaaauguccucugucucagcaggcccgugcugugcccaccaggccucuaggagauuaggggccucugccagaaucauuguagccucuggcuuuccucuguacuggccuuagggccugcagguuuuaguguccccagggcucagccaucucuuggcccggcuggcuuuagggugcucuucugucucacugcugcucaggauuuuguuauguuuucuguaaucuaggaugauauccgucucuaucgucuucucucagccucucaagugcugggccgcaaaugacuucuuaagaggugguuaaagcuauuuaucccguguagguguuuccaggauuuaucucuaaguggcagggccccugucaugcuuuuggugugacauaagagacuauaagguuagcccaguguccauccuggcaccccaaguaugugcacacaaguauguacacauuaucuuacuaucuuucugcuucugcugccgcucuugggccugagcuucugccauuagggaaaggcuguguucuuuuucuuuuuggggguauguguggggggugucuuuuagaaaacaaguccaagucccuuugguggacacuucugauuguugguugccuuugagcuguccccgcuggcccgaccuuucccagcuuacuauauaaccagagccaagcugcugcugcucucugggucauggccgcgugaaaacuuugcagcucuaguguguguacgcucagagggacucugacacccucugugcuucugccagucaccuuucuuccuccucuguggggcgggacagugggaagggccugucagcucagcuagggcggggucaggagccaaaugccaccgucauggauacuuugacuuccagaugguaccaagacgggguaucggucuuuccuccuuuucucaggacagguaggaaaacaggcuguguggggagguuacaugggaagucaagaguagcaggaacuugguuacacucaucgauugcaaggucuccuucaguuccucucugcuaccuuuucugagagggaccagagaagccagaagcuccuagggucgggacaugcauuuuccuuuguacggaggguaccucccgguagcuucuacuugcucugggggucccuguacuuugggagaccugggagguccaggaguccuggcuggcugcccugcaagagaguugagugaacaggagacuuccuggaacaaaguuguuggcucugggcgcccuaggaccaucuccuuuucuccucuuuuccagaagggaacuaggcagaccucaaugucauuugucguggcucuccgauuaggugcagcugugugaagugaguguggagcccuugagagaugcagccagacacagagcgucugaggagccacugccugaacaccugguggcccugucacucccacccugguuccccugucugcgcuggccuucucggcccucuuaacaauuguccucaguuuccuacccugucuagucugaauguguggguuuuguuuguuuguuuguuuguuuuuuguuuuuuucaagacaggguuucucuguauagcccuggcuguccuggaacucacuuuguagaccaggcuggccucgaacucagaaaucugccugccucugccuccugagugcugggauuaaaggcgugcgccaccacgccuagccugaaugugugugaaugugcagugugugugugugugugugugugugugugugugugugaguagacccauauagcuggugccuguuguguacaguaggcuccugagccuggcuuggaguucugccugucaauaggaggagaaacagguuccaugaguguccuggcagcaugagccgucauagaggggagugcuggccugguggguuacugaagaggaugagaaagaagagauggcuuugagggaugugaaggggaaggacuuagcucuauagcuuccugggauagcugaggagaggggguucgacagcaacaccugaggcaggcagacucagacuuccuucagggcaguaggacccuggggugcugaggucuaaaauacuagcuguuacacauguagcuuuaguuccaucaaaccagaguugugugucuuagucauuguucgauugcuaggaagagacaccaugaccaagguaacucuuuauuuauuuauuuauuuauuuauuuauuuauuuauucuuuuugagucagggcuucuuuguguagcuccgggcuaucuuggaacucucucuguagacuaggcuggccucaaacucagagaucaucugccucugucuccugagugcugggauuaaagguuugugccacugucagcuaaaggcagcuuuuauaaaggaaggcacuuaaugggggcuuggcuuaacaguuucagagcuuaguccaucaucacuaugguagggagcagggcggcacacauggcccuggagaagccggugagagcuuuguauccugauccauagguagcaggcagagagaaggagaaagggagagggaggggaaggggaagggagaggaaaagacagacagacggugagacagacaggcagacagauagacacguagacacugggccuggaaugggcuuuugaaacuucaaaguccacccgucagugacacacugccuccaauauggccacaccuucucuagcaaggacaccaccuacuuuuaauccucucauacaauuucacacccugguaacuaaacauucagauauauuauuaaucuucagauuugucagagaaaaaaaguucuacuuuuuugggccaaauuuaaagcaagcuuuauuaaauguuaaguacugaccaagaccaaaauggccccaagaccccuugagguuugaauaggaauggcauuauuaggggguguggccuugcuggaggaaaugucacuguggaggugggcuuugaggguuucauaugcucaggcugcacucagugugacacacagucuuuccuggcugccuuugaaucaagcuauagaacugucagcucacucuccagcaccgugucugcuugugcacugccauguuucccgccaugaugguaaugaacuagaccucagaaacuguaagccagccccaacuaaauguuguccuuuguaacaguugcccuggucauggugucccuucauagcaaugaaacccuaagacacacaugcuacaggaauuuauaaacaaaccuauaggcuaccguacuuucuaaugaggcuuuuguuauaguccaagaacuacaacucacagcauuucaggaaguucugugguccuuggguagguggggcuuacagguuaacuuggggcauuacguuaugaaccuaugagguauuuauucaguccaccacacuggcaugccaaagagaaggcccuggagauccaaguucuuucuuuuuuuuuuugguuucuugagacaggguuucuuuguguagcccuggcuguccuggaacucacuuuguagaccaggcuggccucgaacucagaaauccgccugccucugccuccccagugcugggauuaaaggcgugugccaccacgcccagcugagauccaaguucuuaacuuggguuuugguagggacuggucacgaccauccagaauuuguggaucuugggagagccugcuagccacugucauagcuucccacaauagguccuaaacuccuccugcugcggugcgcacaccacgucacagugugcagcuggggaaacaggcuuggcagaagggauuagccagaugucuuccugcuuugcuguuuuucuguuucaccuucuaguugguggaggcgagugugcccucuuauccccaagucuaacaccuggggagggagggcagggugcugauguggcuaacacaucggugugugugcuguuucucaaaaccauaggggaugcuugucagccuggagugggaagacaggaggggauggcauuuccauuuucccugaaaggaaggcagagcagagacguugaaggcauagauugaucucuacugggaacccaugacaagacguccugcuucgaccuguauucuuucccuguucuuuagcaugaggccucugacuggagagcgugugugcauucccuguuucucaguagggcuccuacugggguggggggagacaaggcuccuccggcuguggaccuggcugaagaaugguguagaaugcugcgcaggggcucugaggaguuuaugaguguacuucguaaguggccugggagggccauucuagcucuguguccacucagcugugugaucuuuaagucagucaccugcccucuuugagucugugcuuucuuucuauaaaguauacacccagugaccccaccuaguguggugggcacagcagggguacacaccacagcucagaucaguucucucuggguuaguggcugucaguggggguggggggcuugagaggguguuauaaagaaacgcucuuuuucuuuaagcucagauuucuuucugugaucagaacccagggaagauaauugggcuggauuuaaugguuuuaggcauacuggagugagcagagagagcccuguuuuggggaaggugccucuggagcauagcuuguccugccuuggcuuguuauccacggagcccaucccccucccgcuguuuguuugcuugguaaaccuuucuucagagcugguccagagauaaauuuucaacucaggcccugcugggaguaagacauuagccacccacagucuugggccugccuuugccugccaggaggagacccagaacaaauucccagcuaagaagcagggugagcaaugcuguuuggugugcuggcugauggagggagggaaugugggacuccgucuagagagggucccugcaugugaaacacaguggacagugcaggaguggagaagccgcgugucgggcacggggaagcagcaguugucucugugaauugggccacagagaaagagccagggcuaggugcugagagccuccagagccucaguuccucauguagacugucagggaaauagaggucaccgguaugagggugaucucaccgugugguuguccaggaaagggaaguggcuguaguuaguacagcuggcugagacuccugccucagacugaagaggaagguaaggguuccuugccgugagcaccugcuggagacauggaagcucucugccgugggaggcuuguacaguagaggaggccccucauccauguaccccugcaagccaccacagcccgucugaggcccagcaggacuuggcuuugaaggagguggggugggcaaggcuuuaguggauaagaaaaggggucaggguaggugggagcagggcguuccugguugguacaguuugaagagucccuuccauuuccucacccaggcccucagagcccuguauacucaacugcggguggacuaugcccuuguggcccugugaguccaagcuaaaccacuuuggcuaaugguggcuguggagugguggggugaccgauaggcaugucacagcuuggccacaggccagucagagcugcggggaucaugggggaugggagcgccacaaauucuaccaggaagggauugcuccuagucuuggccuccugggagaacuuagaaaggaacaacucucccacagcugggaaguaaauguggaaggguggggcagaccaggccggguggcugugggguguggcuccacuguagggugugucuggguggugggugguagugugacuggauggugggguguaaugacugggaagaacugggccagcuguggggcauggcucuaggugcuugugagacuagugucuggaccugcagaugucaccacucugucuucccgaguccuuggccaagugcugucaugaagacccuuuggaacugccugcaggguuuucucugaucucagagucuguguucauggaaguccacagugcugucuuuuagcauggcucugugugagugaguaugccggggcaucugcuggaacuaggguguguguacuggaaggcgggugcccagcauugucaggacuggcucagauuggaaauaaaaucugugcugggcuaugaggaccuucccucacacaccccacguagcauuacacuggagaccuaagacuccugaagcucccagaaaucuucccugaagcucugggucaccacugccuccucagugcccugugcugugccuggcaccucaugguaugugacagacagaccgagggaacuggcaggucaucggcgugcuugcagcuccuagggugaugaugucacagugacacuuauuccugaagcuucuuguccugccuuuccuuucuggcuucauccucuuaucuucuagaccgcagaucccauuuuguuuuguuuuguuuuguuuuguuuuguuuuguuuuguuuuguuuuguuuuguuaugggacaggguauuacucuguugccaugggugccuugaaaauucuuguagaccagucuggccuggaauuuacagagauucacaugccucugucuccuuaagauuaaagguguaugccauugugucuggcuucauuuuuuuuuuaaagcuaauuuggaguuauugucuuuaauuaauuuauuuuuucauguuuuuauuguuaauuuuuaaauuuaugugaaaaguguuuucccugcacaaaugucuaugcacccuguguguaccuggugucugugggguccagaagaggguaucagaggcucuggaacgaaacuuacagacuaguguaagcugccaugugggugcugggaaccgagccugaguccucuggcagagcagccagugcuccugguugcuaauccaucucuccagaccacaagaugcuuuuggaauguggugcauagguuuauaggcuaagauuaaaaccacagguaaaauggccgaaagauuccacuccaaaguucacagggacgcuaaggacuguguuucgaugacugugacugugcuuuguaaucuugcuugugagaguuuuuguuuuucuugccugcccuccuucccucccuccuucccucccucccucccucucucucuuucuuucuuuuuuucuuuuuucauuuucuuucuuuucuuuuucauuuuuuuuccgagacaggguuucucuguguagcccuggcuguccuggaacucacucuguagaccaggcuggccucaaacucagaaauccgccugccucugccucccaagugcugagauuaaaggcgugcgccaccacugccccgcuugcccuuuauuuuuaagauagggucugggacuagagagauggcuugguggguaagagcacugaauuuggagcuccgacacccaugucagaaguagguauagccaggcauagcuacaugcaucggggagcugggauagaaacgggaggauugcuggagcuugcugggugucagccuagcugaaaaauggcagauuccagguucagggggagccugucucaaggaguaaaguggagaguguagaggauggcagugucuuccuuagucucuucacaucuugauugugagcauugaggucugcauauucucauaaacugcauacaacacauauguuuguacaugcacacacacaccaccugcacacauacacauauaccugcuuguguacaugcacgugcgugcgcacacacagacacacacacacacacacacacacacacacacacacacacacacacacacaggcacgugccuuaaagaucuagagccucaagcuaucagaaguccuccugccucagccuccugugugcugagguuauagguauaagacacuacacccagccaucauguacuagaaaagacuguggcacaauuacuuuuuaaacauuuuuuauuuuauuuuuuucaguagaggaagggaaacugagguucagagaaguggagagacuugccuaaaggucacaggcugguaaauaaugaagccaggaucccagccuggcaggcugccuucagccugagcccuaacuguggcuagcagccacuuugcuucuguuucugauggcguugggaagaugaucacggagugcuuuuccggaccugcuggcacauggugacacacuucacccucaaaucuacagcucaccccgucuguucugggggcucucagccucaauccuggaggcccucuuucaucugagccaaguuccuugcccccucuccugcugccaucuuccaaacagcuugcucuauaagaagucuuuaguuuccucuggguuccaaggaguguuguagagaaacuuugagcuagggauguagggaggagagugacuuucaacucuggagcaguggccacauuucccgaaagugcuggguugccauggugucuccaugacaaccagagcaucucauucauuaucuccagcacuuuggcagggaaagcuaaggcuaggauugggagagugcaguggaagucaggcugagggcuggagggcuuuguggcuguggucccucccaagcugcacagcuaaggguccccuccuuuucauggggucuggguucaaauaucaacugugcaauggucuaguuuugugauuuuugggaaaaugacagugucuaggccucauuuuucucaucuguaaaugaggauaucaacacauuaguguaaggauuaugugagauaagguauaaaaguuggcaaacagagugugagcucauaguaaaugcuucacguguggugacaguaccaaucgucaugaugauaauuagaauuguaacuuguggugguuauuagaggaaugaaagacuaacucaaagucaggaagaaucaaaacuuagugguuuucccgggacuguaacggacccucgccuagagcuagucuuccuaugugaagacaucaggaucugagagagcgugggugcuuccacggugacugagaccucgguccucaccuuugugugacagggcagaaacaaaguuuauuuucuagggcucuuugaagccagucaggugggcagggucucaguggauggcagauguggggaugcacacccagucguuucuggaacaugcugugugcugugcguguguugugcggguacaggcgugcaggcaugugugugggcacacagguuagcaagugcacauguuggcuguggaggccaggggcugaugucagaugucuucccugguuacugucuuccuugcacacugaggcaaagucucgcucuugagcccagaacucucuaguuuggcuugucaagccagacacccugcuggggaucccauccucaccuccugagcacugggauuacagguggucugccgugcccaccugccguuuguguuggugcucaggaucuaaacucuagcccucacucuuacguuugugacagagcuuugccuccugagccaucucccuaguucugggugugcccuuuugaaagagaacuuaggaagguucagaccguuaggagacaucuccuaaaugaaagaaaaauguugugucaacuagagaacacacaucuaccuacugguuccaggaccagaguucccauccuccggcaagggguggaaggcacuaaggucugggcuugggguaggaauggagugguugggaaugacuucagagaggccgugacaggaacugggaugugacggaugacugagugucucaggagguugggggauggggacaucaugagcugucugacuaauauggugacuggcuggacaaggcucugguuugcagggaagagcccagcuggccucagcuggccggaagccuuggugauucuggaaagaguggaugccccccgguucaucgccccuuagguccuggugcucuguaguggagaaggugagaagggcuuucaguagcuacugugggaccauggagugugugcagaggccuuacugggaggcugggcgucugcuugguuuacgagggagcaggugauuuucuccucuccuggucuggacuuugccaaagcuuugucccucuccugcuggggaaucccagccacaaccuccaaaauuaggaauuuuuggaggaggaggaggagggaggaggaagaagaagaggaggaagaggaggaagaagaugagaagacagcuagcugcaugaacugcacugagcugggcgaggcccccugguguauggagcaggcgcccugcuucugggcuuacucuugcucugugaaaucagagcuugccccagcuagguuccaggccugcccaaagaugagcucugcagugcugagugaacuaagcuguuguccauguugugaggaucacugugagcguguuaaggaggcaacggggucgaaugcuaauagcagaggacagcucagcgcagggugccacgcugccucucagcccgcuucguguucauaagccugagagauaggauguaaucgcuuuggcuuauagguaggaaacugaggcaucgaauaguuaaguaaauuguccaggauugcacagcuccugggugaugcggccugaugugaucuggagcccgcagguuucugaagguuucuuaauguaggacucuggguucaugcuuggacuugggacaucugcucugaguucucugguauuuuugcguuuacaguguauguccguguauauuauuuuuauuuuguauugagugugugggagugcuaaugggggcuagaagagaguguuggauccccaggagcuggaguuacaggauacugugagcucccucccguggguagguggagggaaggaauucagguccccgggaagagcuggucacugcugaacuggcucuccuuuucccaaagaacauuuuuuuuucuuucgugggaaaacuguuaggagaguaguguuccuugcugcacacacagugucccccauuaucagugaccccccaccaccgcagcagcgcaguguuacagcucuuaagucugugccuagccccaguuucauuuacagcagggcucacuccugaugcuacacuuucuguggguuggggcacguguguaaggcuaggauuucagcauugcacagagccucucacuggggaagaagagucagcuacacucugccagucagccucccaguccucacucaaccucugccagccacucacaguuuuaaaaugugcacuuuuccuuuuuuaucugaaaaugcuguccgauucccaucagggcccuugacccucagaugcccggggccaugaacugcauuauuaacaagcaggagggcugcuaaugggacagacugaggccagugauacacacuugagcucacuaccuccucuucuguaagggcuagauggaugguaugggcaggaccauuaggaacaacucccccaccccccaugucccugggcgugcacuuuguguucccguguugacaugguguagggucaggccuggccacagcuguggcuguagauagccuuuaucauugguaagugagaugcuggucacaugagccuuccuggcucuguugggucaccuacccuuuccuccacuggucucuggcacugcagggaguccuggaaagcaucacauaguuccuuuucucuagcuugcugcccaugcccuuccuucuuccaugcuuggcuccuccuccuucaggucugcucaaguaccacugaccccacgaagccuuccucuuuccuccccgucucuauagaggcugaacgcugcucacuucuagaugucacguuucucucccaccagccaugcuugcuugcccccuggcaucgcagaugucugcuuucugguaggcagcuucuuucccuacugaagccuccucuaacaggcaggaagcucagagaagggcaguguaugcaccgagucacagcacaucauagcacagguuggaccaacuccuuauugcaugacgaagcaacaugaaaaucaccagagaugccaguguuaacauggguuugugugacaguuccuaaccuguauguaaaaauauuuaacaaaaauaaggauauucauacagauuguuucaauuguguaugugccaaggggcuggggagguagcccagccagcaagguguacgcaucugaguucccuccuaacaguucacgaagaaaaggagcaugugcuugcaaucccagcacuggggagguggaaacaggcaggucccucagguucauuggucaggcagccuagacuaccuggugaguuccaggccaauaagagaucuuacgucagaaaaaagacauuaucugaagaaugacacccgaggucuccuagcuucuacacacacacacacacacacacacacacacacuugcaucugcaccccacaucccaaguccguuccagauguuuguguccuacauucucuguuugccuaggauccucuugucacauuaggauuuccuguuuguuuguuuguuuguuuuuuacaauuuguuugucuugagacaaggccuagcuauauagccuugguggacuugaacucacuacauguaguggucaucccaccauguccucuugaugcuaagauuucacaugugccaccaugccuggcuugcaauuaugguuuugagagucuacccccaucuuggcacuugcuauuauaagcugcacugagauuuggauucuuguagagaauuuuuuuuuuuuuaaaguauguguuucuuuuuuauuuaaaaaaaaaauccacuccguguuuguuuuaugguguguaugugugugauagugugugacacaggccuguucaugccagagcauccguguggcggucagagaacaacuuuccacaguuggcccucaucugccgucuuucauuuuuuuguggcagggacucucugguuguugcugcuguuuugcugcauccucgaggagagcuggcacacaaacuuccuggcgcuucuccugccucccacugugacguaggggugcugagguuacagcuccuacugccucugccuucuuaugugggcuguagggauccaagucaggugugcuugucaggcacuccagugcacugagccaucucgcugguccuucguaggagcuuuaaguuuguaaacaaaaugauggcuuucuuuuuggaauuguaugcgaguuuuaaauuuuuauuuaaagauuuuaugguuucauuauggguguggguguuuuaccuguauguaugccuuuguaccacaugcauaccuggugccacagagaggcagaaagggcauuggaaccccuggaacugacguuacagaugguugugagcugccguguggguguugaaaguagagcacagauccuguggugguagagcagcuguguucuuaacugcugagccaucuuugcagcccuugaacuuuauuuuucuauuugucccuccgucuccuucccccauuccccacccugucuugcuccucccauggggaaaucuguacaugcuucuucagugauuacauccaggaugaauuccuagaaguacuacucuuggcugucugucugucauguggucccaugcugggccuaggaggagcuuagagaucuuuacccauaaggccaacccccagagucucaguuccccauccggugccucggccuagucuaucucucuucugugauuucuggcauggggagcuucaggcuagcucugcaggggugcccccaugugaagucacugugguuuucauaggggcgggggagggggaaggaggguggcggcguccaggccugcugugggaacaugggaauuggagccuuugcacaguguguguggucuuugcucacucuuuccagagagagagauggguguucuggcuuggacaauccugguggggcucaggcuggggaaagagcuagaaccuagcauucuggcucucugaguggguaaggcccagaagagguccuugccugucccaucaguccucagguacccacugaccuaguuugccaaguauguaugugggaaggagagauuucaugguugcaucugggcaaaccgcccauuccugaguguccuuguaugaggucccuuagacacauuggcuccaucaacucucagccacaccccagcauggaaggacccucacaggagaguucacuggugcuucagagguagugacuuccugcaggcuuuuguacacagcucugccuuggauucccgcucuggcugcuucuguuauugaaggggguugcuggggucacuuagaagaaggcuggcuggcuaaggauggaaaagcaggagguaggaagguuagugcacaggaggauguguuguuugguccugauacagaauucuaccucuuccuccccggucuuggaauugugcagugucauauuuugauucuggauuuaaaaaaaaaaagauacuguauuuguuuuuauuguuuguaaauuagcccacauguguguauaugugucauguacaugccuugugucuguggaagccagaaaaggucacugaguuccuuggaacuggaguuuuagaugguggagagccuccuccaugugguggugggaacugcacccagguccucugcaagaacagccagugcucuuaacccgagagccaucucacuagcccuacaguuuucuuggccuagucuuggccuaauaauaaugaaagccaacagcuacccugauggaugcuucguuacguacauucuucaugauuccuaggcauugcuggccuucauuuuccgacuccuuaugcuacggcuguucuuguugcuuguucugucucccacauggcgagacugagguucagagagauaaaggaggaccaggucggguggcaggucuuaagugugagcccaccuugucaagaccuguauaucuguggucaguguacucugaaagcccacucugacucucugcuuuucuccccagcaucccagccuuuacccugugggcccaacgugaggagugugaggagcggcaugcggcgcccccuggcugguucggugucuuuugaccugcuguugacugcucccagggggcccugacgcccuggggcacuuuugcucugcacaggaccacgcugggguuugccauggugacauaaagggguguagaggaaggaaggagcaagaccagccuguagacugugccccuggcugggcaaaagggccaggggcccggagccuucccuccacugcccucgaacgccucacuuccuaagucucugcauuucucagucaguggacagcuuuugggacucuugugugaggacuuugggggaccaggccaggcugggccucugcugauugagaucuugggauccagaaugccugcccuggcgugccuccggaggcugugucggcaccuguccccacaggcuguccuguuccugcuguucgucuucugccuguucagcguuuuugucucugccuacuaccuauaugguuggaaccggggccuugagcccucggcagaugcuuccgagucugacuguggggacccgccaccugucgccccuagccgccuccugccaaucaagcccgugcaggcgguugccccuucccgaacagacccacuggugcugguauuuguggagagccuuuauucacagcugggccaggaggugguggcaauccuggaauccagucgcuucaaauaccggacagagauugcaccgggcaagggggacaugcccacacucacagacaagggccguggccgcuucgcccucaucaucuacgagaacauccucaaguaugucaaccuggaugccuggaaccgggagcugcuggacaaguacuguguggccuacggcgugggcaucauuggauucuucaagguacucgggaagcaggcuccugagcaguccccagcccugccccugcacucgcuagcuaagcacagaucaguucgcagugucaaaagagugcagugguagcacuuagcucccuugucaggaaggguaaaugguugccugccuccugcuggugaaggcuuacuaaguauuuggaggcccuguccgugacuauggggcucaguguacaguaggcccuugccugaaggagacuugggucugggugcaaggcgggaaaggcacacucugcccuggcggucaccucagaggauggucaagggaaggacaagagggucagguuacuggugugaagcaguuugguuuucuagcugugggcuuccuccuggagacaguggaggguggagcuugugcagaaugaacuaaaucagagccguuuugcacaaagaggaaggagaaagaaaacccacuguguaggcgaggcacugguaugggcugugaaguucccugagccgcccguggcauggggucaucgcugagcgcucgccauggagggucugcccuugaggagggugugggagugauggauauacggugaugcaagaugaaugcaaggccagcuagagacuggccuugggggcucugggggacauuuguuuacuggacacuuccagaguccugggcccugugcuaggaacccgugcauagaggaaugaguggaaacaggcaagccacagcugagguuuuaacauaguagggauggauggagugggugucuggcugcacagaggcuauggaggugugauccaucucuuaacggaagggcacagagaaggguaugcaagaguggguggugggggcaaugcuggacucugugggcagccagggacguugucccccaugaaguggccugaaggggcugggaagggcagaaggcugaaggcagcuauugcauggugugaguacagagccagggguaggauccaggcagaagguccccaugucccaagccucccugugcauuguuucuuuguucagugccgggagaggcugcuuuagcccaggcuccccacagcaugcucuuucaugcacuaauacagcaggaggcucugccacugaaaagggagagugagucaaaaaaccaaaggcccuuagaaagccugcagcggggcggcccagugugauuuguuccucagccagcuugaucucuuucacagagcacccucuggggagcacuggccugguuuacgggcuucacagaagcagaaaguugggcuggcuccauugucucugugcuuuuuuuucuuuuccccugcucucuauacccuucccugccacgaacuucauuaagguugacucagagccccaggccugagaaccaucagaacggcagacaguuauugagagcucauucagugccaugugcugcccgccugcuucacacaaaugaacuuaccucacacugauaagccaaucuccaaggcaagcagaagguaugcugauuuaagagagggguaaacugaggcagagacaaguuaagaaauguauccgagcucacaaguauuauccaggauucgaguccagaaagccccaagccacauaggccuggucuuucugagguuugaguccaggagugaauuugauuacucaguggagcucugugccagaaacucugggcuguguucuagacuccaggccuggagcguggacauugagcaugcuuaaaacaacagagcucagacccuauguaaugccagcuccguguugaaggugaacauggaugaggcccauugaaaagcagggacacacucggagagucucaccggggucaguggcaaaagcagcucccccuacucgguugccucaagucaagcaagacucccagauuuugggcugaggcuugugacuguucuguuaggaugugcgccuccugguggcugaggcgcaucacugcucuuucugcagagccuggcuucggugcuguaccuuagacuugucagauucaagggccuaugccagagcucaaguuccagacucucaaggcagggugagaucacaagcuuaaaaguccagccucugggccaagucuuucugaagcucagaagcagugugaccuuggucaggauguucagcuaauggcacaaguuucagcuccugagggccaguaccuggagucgcucugucaguggcagcugggguggugugucuacucccuguguaguaaacacagugucguccuuggccugugucuccgagaaguccuugagguggggguggggucgucaucugugcccguuccuagcccuguugucuaucagccucacagagaagaugggcacccugcauccagauacaccaggguuagugaaggugacggaccguucagugcccaggacguugcuuugcuugcucugucacauagaguagguaggcacuuuguuuucagauaacaugacaaaaaauuaaguggcuuuaccagagugacaucguuaguaugccacccagccaagauuugacaacccggcuuacugcuucuaacuggaugaccucagaggccacauaggagcaaacugauuagagacucagagaagggauguaggacuucucagagcagaucgccugcuuaucaggaagucagugcucugucucacuccucgcucugccauuuccuuacgccauuugggggaguggcugucuccuuagugcugaggaguaggaaggaggucuagucuagauggacccugugacagagccggcaucuccagugccucggccuuccguccguucucuucccuggcuggaucucuucccggcugccugugguagcugucguggccuggccucuuccacaguggcuccgcaucuagacaagcuaucagcaccucucagcaagcucagggccagggcuuugaaaugggauccccgagcugcagugucucaguggcuucccgggccugagcagugguagacagggccugaucugucucaggcccccacguagguuacacucugggccagugcugacuuaggguggggagguccugggagccccggggagguugccucuguggaugggucucaagucucuugcuucucaguacugaagcggccucaggacggggacuuggcaggcauuccgugcaucuggagauccagugugguuccuuaucuaucacaguuuacaaaaccaggccccugcagaggcuuugcaggacuagaaaacgccugacuguuaagaugaguaaccagcucucucugcaccaggcacaagcgacugaaaccuaccgugacucuguucagcguggguccaggccuggugcucccccgggcagccccacagguguccuguggguagcccuucuuccuucuccggaugcuaggaacccaugaccucguucacaacccucgcuagcuccagggaccuggcucucccuccguggccuuccugccacuuuuccuuuuuugaucucuccgugacuccucgcuguuucuugauccugcugugcucucuccugccucagggccuuuucacugacuauucuuaggacuugaccucuaccuccucccaguugaucacucauccuuuagcacgcuccagaggcccuuuccccaggagcuuccugagccagcugucugcccagcacgugcuggccuacagcucuggccucuuccaugugugcacaccguguuuuacucuuauuucgugguuuccaugguugucccuccuuccugcuugacucuaaagggagagccacaucugcuuuucucaguuuacacucuguuuccugucugucuuuuuccucacuauaucucauuaaauacuuaaugucuggugcaguacguagcugcagacugauaauuagcccugaaaugcacagcuaucagguguuagguauuggcaguugucuguuccucuuucauuguuaaaaauaguuacuuaucaaauaauugugugucccuguugggugucagggagccgaaguaagaaauccagcuuuguucucauguagcuuaugcuggaaggagggaggcucugaacccagugcagcagccgaggcuuugccaugaucuuagggaggccgcuggaggaagcagguacauguguuggcuuuugaagcauaaauaggaguuuaccagucccaggggagaucauugaaccaguguagggacaagagcaccacauuuagaggcagauguucagaagggugagggagagcaugauggaauggugagaccaggaagaggagaugauguauggggcguggggguagcagcaaaucccaggggggaaggggaggugguaaagacuguauugcucucaguggugacuagugggcaggagagcugccuuucccugugggaggguggccuucucaucagguauauguauaugugugucugugggugugucugucugcaugugucuguguaugucuguguguaucuguuugucuguaugugcaucuguguacaugugucugcaugucuuauguguaccuguaucuauuugugcacguguguguuauguauauaugucuguauaucucuguguguauguauucaggaauaugguagcucuugugaaguuguaaauauuguugauguuacuguuaucaacugugccugacagcuguucuaccccacacugcuguaggccaaugagaacagccugcugagugcacagcucaaaggcuucccucucuuccugcauucgaaccugggcuugaaagacugcagcaucaaccccaagucaccacugcucuaugugacacggcccagugagguagagaaaggcgugcugcccggagaggauuggacuguguuccaguccaaccauucuaccuacgaaccagugcuguuggccaagacacgcuccuccgaauccaucccacaccugggugcugaugcuggccugcaugcugcgcugcacgcuacugugguccaggaccugggucuccacgauggcauccagcgugugcucuuuggcaacaaccucaacuuuuggcugcauaagcuugucuucguggaugcuguggccuuccucacggggaagcgccucucacugccuuuggaccgauacauccugguggauauugaugacauuuuugugggcaaggagggcacacgcaugaagguggaggaugugaagguaaggagagacuuagagugcgucauggagccacgcccaucugugccuccugugcuguuauucgcagaccuguugauccccacuucagccaauugcugucuuacuauguacaagaggcaucuaacauuuuguugaaguauuaaauaugaaaggauuuugcauguguauucuggaauucaggaggaagagacccaggcagaaacaaaaaugaaucuggcaaggguuguaauuggccuuuuaacccagaugugauuuuuuuuuuuuuuuuuuuuuuagagacagaguuucucuguauagcccuggcuguccuggaacuuacuuuguagaccagguuggccucgaacccagaaauccaccugccucugccucccgagugcugggauugaaggcgugggccaccaccgccuggcugggauuuuuaacucuuaaaaaaaaauguuugcuauugucaaaacucccacacgauucuucagaauaagaccccaagucacucacaugcaguguguuuuaaaagcuguaugccgauagugggaugcuuauguuaaaaucugaaacaaucuaucaaauuguuugcguaggcucuuuguaaacacagggcugcacacacacguucuuugcuaucaccaaaaaagaagccugcuagaggccauuguaagaugcaguugucugcagucaucugucuuccuggagacugcagaggagacagcaugcugguguaagggcaccaguguagguugccaccacagagggcaaacauaacaaugaagcagaugggaauagaacaggggauugaguccccgagcugcugccugcugaccggcuguccccucucaggagauuaacaggacuagggguguauuagccccagacacagaccucuuugaugcuacaagaggcuucagacaguguggcaggcacuuucucugugcagugcagagccauuggugcugucuuccugaaccugaaaccucuggcagggcuggcccaaggucuggaaggaaggguccacugggguugugacccugcucagaagugaacucugcaaagaggggcgugguggaugaucuuggggagugaagacccaauuuuagucaccuagucccagugugacuaggugacuuggagaugucccaaccugucacugagccuaaagaaaggaggagugccagggagggccucggacuguuuucugcacuaggcuuacauagugggggcugaccuuggugagggaggggcguguccacauggucaggaucauggucagacuccuuccuccccuacucccacagcaggcuugggcaguguugauuuguuuuuauggacaacgccacuacugacuuucucuagugcucuccuguuggggcuuuuaaguucauuccaguugagccuuccugccaacgccaucaugcaaugcccuuaccagccagcaguuggcaguguaguucuggcugcgcaguaucguuuagcuaggguuuggugaaugccggguucugugcucagcugccugccaucguuggaucuucacagcagagggagccgagggaugagugccaucuuaugaggaggccacuguggcucagagagauggagaggcuugcucaagacaacauggcuggaucaugugucugucaggcagugacugaccucugucagaugcccgagguaacagugcugucugaaagcaggcucuugcaggcaucgaagcccuacgagcaguacaguccuaacccagaggucagccccucccauggacuagcagggugcuagaugcguucacacggggcgacauuggcacacagagcacauagagcacguccuuggaagggucaggauccuuugauauagucuugcguuccucugaggaagagaaauccuucaugugaagauauugcugccugugguaucaguaacuucaccguaagcucuccucuucaugacuuugcuaccacaaaucaggcagugucacaggccaagucucacuucuccgaagagccccgugaggacagagauggucugguccccuuugcgauuaaggccuagagaaguucaagagcuucccuggcacguguugcugagccaggcgggagauagaguccggggcaggagguggcauggggcuggcuucuuaggugugcagccuguguuucccucaaggcuuuggcugagacgaucccuguguggcugagcccugccggcaucugcuucauguugaagggcccaaccuuugcaucucguggccaugcugaaaaugaaaccccgggccucaggugugaagugaagcagaugcuacaucacagagcuagacaccggccccgugguggguccugugaguccugugggugguccuguuauagagcaggauaccccgcagugcucagugggcagacucuggccuccugaccuccccucacugcugccucuccucugucuguccuaggcccuguuugauacacagaaugaacuccgcacacauauuccaaacuucaccuucaaccugggcuacucagggaaauucuuccacacagguacgugguggacugccccuacaaccacacaaccucucgggcuucucccaaacugccccuuagguuguuguuacaagagcaccagauagacacuggguuaagggaagggugacuccagaauucaugguccauaagagagauccaagcagagggcauuuggggacacuuaacagcaauaagguuugcauauggccugguggccuggguaacccuaggugacguaucuuccuucuuucuccucacccuuaccuuucaaagugauuuuucacuuaauaaaagauaagaauugaguuuuauaacauccuuauuuacuguguguacacauauguuuguauucaugugucacaacauguguggaggucagaggacagcuuggggguugguuuucuuucacugugguuccuggggauuaaacucagguugucaggcuuggucauuucauugcugacguggcacugcugagcuuuuucagugggcauguuauagaaguacauagugcagaaauggaaagcacaaauggcuguccccacccccagcauggccgcccuuauccuguguuuuguuuguaggaccgagguugaggguucuuccaaguucuuuacaugcuggacaaaugaaagggaaccagcucuuaacugauagucugcaguccucagugagguuagccucucaaguucuagcgagggccaucauggucagcaguagguagaggcugaaaaugugcacagaggcccaaagguaccuagggugcuaugguggugucugcacuucuguguucuuagccccgagcagaucagaggugguuguaguuguaccucugagccagagguuuaagcauccuguauccacgcagaacuuguauagguuagugggugagaagguauauauggcccaguuuggacccuuggaauaggaugagaguaggcauaugagagacagaagaaacucuuggcauugcugacuucaaacaccaagagcccacagaggagaugauguggccaagcuacuuacugagggaagggcagucuagaguaggcuuguguuuccccugggccaaagcuuaguugacucuuccauacagcuccuaggugguccauggcugaguauucccccugcagucaggggccagguuggaggcuguguggccagccagccaugcugaacgcucugugcugcugccauagguacggaugcugaggaugcuggcgacgaucugcuguuguccuaugugaaagaguucuggugguucccccacauguggagccauaugcaaccccaccucuuccacaaccaaucugugcuggcagagcagauggcccugaacaagaaguucgcugucgugaguaagauucccuaugggacagaacuggaggggagcaggggcugggcagggauuuguuggccucucagugcuguugcgguccaguuugauagaucuguuucugugccagggcgggggggggggggugagcugccacuguccccuagacacugccaagagggcagccccacuuuauaaacacaaaacuaaaguucauggggccugaugguacaugccuggaaucccagcauuugggaggcagaggcaggaggaucaguuauggccagccuggucuacaugagacccugucucaaaacaaagcaauaacaaaauccgaaaacccaaauaaaagcaacugaggcucaggaggucaccucgggacucacacugaggccuguucauuuccugggcccaaacacauguagaagaagaaccuguggggacuggcagagguacuuacggcaagagcgugucagaagacgagcuugggccacacuagccagccgaggcaggagacggcagggacgugaguccucugggcuagguuccagguguauguccugaaucagagucaggagaccuguggucuaggcuuguaucugccagucacucuugagaguccacccccucccucccaugucaggccucaguuuucucaucugcaccuaugggcuuagauagaccacaugcccugucauccuagccguugguuuuuuucuuguguucuaaaaaaugagaaacaagaugcaaagggaaagacucccguucucauccuguacggccauccccucugcaggagcacggcauccccacagauaugggcuaugcgguggcgccccaccacuccgguguguacccugugcacgugcagcuguaugaggccuggaagcaaguguggggcauccgugugaccagcacagaggaguacccacaucugaagccggcccgguaccgccguggcuuuauccacaauggcaucauggcaaguggcugggaagggcacggugggcacugucaauacaggguaggaggcguggcugcaguugucuggccuacggguuuggggccaguuucugcugcuguucugccucagaggcuccgucauggggagggcagauugccagcccuuagcuucugugacaggacuaggaaagcuugcucgcuuguuaaaaauguauuuuuauuuuaaguguguguauguguguguguguguguguguguguguguguaugcauguguguguaugcaugugugcgugugugugcaccugugggcaggagugcagauaccugcaggggucagagguaucagauccccuggcaugugaucugauuacagguggcugugagguacccgaugugggugcuggggaucaagagaagguccucuggaagcacaauaaaugcucuucaucacugagccauccuuccagccauggagaguauuauuggaaggggguuuaaugagggucagggcucuaucacaguuacuugcauguucaaauaauccucuugaaucuuugcugugugucugucccuuuucuagaggcucggagacacagaagugaaaaacccagacaagucucugaccucauagacccgacacuucuguagacagagagacagacaagguggucccaaguguggaaagccugcaguuggaagaugaugagaguaccuuggagagagccaagccgggaagggaugcaguaacuuccuggguugagcuaugcagcagaggccagagggaaagcauccuaggcggaggaaguagggaguguaagggcgccagggcagagugugcgugagggcauugcuugaggcagaugcagugggggucagagaggugaugggccaggugcaaggcuggccagcgaugaacuugugccuuaagcagaagauggaaagguuuugaauggagcauggucuaguccauauugacuuaccuguugggaggggcagaguguguaagguacaaaauggaagcaggaggaccagccaggagucagcaucaggucuccacacgagagaggugguggugcuuuggucucagugaaagacuccuauacacugucgcauaggaguagaaggaagaagauguagaagguagaggugaguuggauuuagugucuaggaaaaaaggagagaccagggugacuugguaucauggcuugagacacuagaaugauacauugcugccagcugagaagguguaggaaggcagggcuucugucugucuguccaccugcccacccauccagccacaccugccucuguaguaccugcaacuuguauuuuauuaaaaacauuuuauaucuauccuauuuguguguguguguguuugugcuugugugugugugugugugugugugugugugcgugugugugcgcauguauguuuguguguguaggccagaggucagacaauguauccgagucacuucucuuccuccaccagcgggauugagcugaggucgucagacuuggugaccagcacccugaccugcagaagguucuugcugccuccaccuccuuuuuaaauuuuuauuuauuucucuauuuuauuuauuaaagacuuauuuauuuuauguaugugaguacacuguagcugucuucagacauucagacacaccaaaagagggcauuagcucucauuacagaugguugugagccaccaugugguuucugggaauugaacucaggaccucuggaagaacagucaaugcucuuagucgcugagcccucucuccagccccuucauuuuuuauuuuaaggcagggucuuauagcccgugcuggugcugggauucacauuaacuuugggcaugagguaguuaugcucauucccuguucucagaaccugguuuccagaaggaagacagacagcaugggguuaccugagcucauagcuacuaguuuaaguagcugaggcucugacauuaccugcagugcuguguuagagggucaaagacccucacugcaaaugguccaaguuucuagaaacuuuuaugcuacuuuugggccuguuuauuuuguguagagaauagcagcaaaggauaaggcaaggacgaugguucaccuggguggcacugcaggcuguagagcccuugggaagaaggacucccaggaguagggacuggguggccuuagaggagagcaucucccugaggaggccccagcccuucuccugaggaagcagccuuccuuucuugaccaugacuggagauaccauggccucucucgugcuucuucucagguccucccucggcagaccuguggccucuuuacacacaccaucuucuacaacgaguacccuggaggcuccagugagcuggacaagaucaucaaugggggcgagcucuuccucacugugcuccucaauccugugagugcucuacagcccagggcugguaggaggagggguauugaccuaggaggcuucccagacagggaagaguggacaggcuggcauggggaccuggcagccaggagguccacuguuuacuugugguucugguguccucugcagugugacacagauggaaaaaccacugguaguccucuuggguaauuaugaauucuuauagcaauguuaacacuuuuagcucagguuuucuucugauucuuugugugugugugugugugugugugugugugugugugcgcacacauauacaugcacaucuuacacauuucacucgaagcuuccugggucccucuuuucugauuuguaaguggaacgaagucuucuuacucuaacgauaugaaauaagccgugugugcauuacccuccagccucaugaucugcauaccucucagauucuguguacaccccugugaugauucacaaaacaauacagauagcuccugccccaggccaccuuccuacccuagggcuguaaugguagcagucaguuagggcugaacugaacgcagcccaaugucccacaguuuguugauagucccuguguaccuugcccugggugucaauggccaguaacagguggggguaaggguggccuagaagcugacccuguccccccucccccucccuucccuggaacagaucagcaucuucaugacacacuuauccaacuauggaaaugaccgccugggacuauacaccuucaagcaccuggugcgcuuccugcacuccuggaccaaccugaggcugcagacucugccccccgugcagcuggcccagaaguacuuucagaucuuuucugaggagaaggacccgcuuuggcaggugggcagaguggacaggugccuugcuaccacagcaugcccuucuguggcaugggcuucaggcaugggcucagggcuaaggcaucacaguugauacucccucaggagugugggcaguguaugcacauacuguauaugcccccugccccacccauaaacgugugcauacacauucauacacagccaaagaacuggcgugagacucaugcaugcaaagucuagagagugucugcccaacaagugaccacucaugucuucuccuucagcugguaaaggggcugagggaaggcuuaggacaguccuuggggaaaucuauaccaggacgacuaaacacuggaagcggaagcuaggcucgggccagggauccacacaccuacccgugggccaagucugguuuguggucugucucaguaaagaaagcuuuguuggcacccagucacacuucuugugugucggucugugccaucuuugugucagugcaucagagaccagaagaguacuguaagccuaccauguuuacgaaacacuucccaggagggcaaguuugcugaacccuggguucaggcauagcuuacacaguuaaagucaacaaguccuuaugaguuccuguuagugaugagcacagagcuggccauugccgggcucgcuggaauuauagcauuaaccagaaaugcuuccuugucugucacagaguggcaucuggaggugaggauguggccagagcgcaggguagcuaagagucauguaagugugguguguggucaugcacgccucuaauaccagcacuugggggcagagucagguagaucuucaugaauuugagucggagcuggucugcagagugacuuccaggccagccagguuuauauaaugagacccugguuuaaaacaaaccagcagauaugcccacauauggagggagcucacucaugggccucaggccucccucacacucucuccuuugcuguuuuaggaucccugugaggacaaacgccacaaggacaucuggucuaaggagaagacaugugaccgcuucccaaagcuucuuaucauuggcccccagaaaacaggcaggucucucgacccuugacccagcuucccccacuucuguuaucucagccacaggauucuggagaccaccuugcucaggucucaaucauauauauauauauauucugucucuuuuuuccagaaaugggagcaauguggggacgaguaugaauugccugucacuguaggggugggaagcagaggagacguggcauuuauuuugaaccacagccucagagaacacccaccauguccucuuaggagucucugagacaagccaggaaggaucccuaaaucaccuacuccgcagauuuaauaagugccagacaaaagugggucagugcaaagaggacugugaucaauuagucaugucugucagaaaggagugcagacagacggagaugcuaaacauuugcuguccacucugaggcuccccgaaguuaagagacuuucuguaacaugguugggaagugugaugguuccagcucuuaagaccugacuucuaugacccagaagcuuauauugaucaucaccaaacgucagucugucucucugugugugcuggcuacacagacgcccagagaaugaagaaagguccucucaaagaggaggaagggaccaugacagggaggcaccagcgagaagggauagcaguccugggcuuccugguuucuagagauuuugaugucacaggcauggugucacaggccuguaagccccagcacucagaacgcugaggcaggaggaccauaaguuuaacauagccugaguuauauaacaggaccccaccccgucagaaagcaaagccagcaaacaaaagcagcaauaaaguagaggauaagagcuucccaaggacagaccuggagggcugugcuccugucucaggcuguuccaagguuccauguggacagaggcccagagcuaggaaagaccaguaggaagcaccugaugcugagacucugaggggacaauaauuagcugggcuuggaguguaguagugagaaagacucugaggucaaguuauuguuuugugaugaagaugcuguacuagauuaaugauaucuggaagguuauaggacauaacuguguauagaucuuacagucugcacuuaguguauccuuuauuacacucaugagggagcuaagacuccagacgggaagggguuuucccaggccuucccagugaauauggaagacaggcccagagccuguuguugucuuguuguuggggguugggcugaggucucagcugcccuccccucucguaggcaccacggcccucuaccuguuccugggcaugcacccggaccucagcagcaacuaccccagcuccgagaccuucgaggagauccaguuuuuuaacggccacaacuaucacaaaggcaucgacugguaaguggccuucuguccccagccgggcagggaggccaucguggagccagcuggaguguccaguguggccacagcaggaagcagcugggacuugcucacacucggcugagauuccuauaaacagggacaaggcacagugagucauggugcaacagaguugugacaaacagaacacuggaugaggaagcccuuuguccagggucagcgcuagcugccagccucucucugacugccauagagucgucagggaguggaggucacacccauguggcagcagggugagaauccagguguucuuacugccuguuucuguguggccagcugagggagaggagucucugugggcuuugaggacucucugggcucgguagaaucccaguucccaucagaacuuccaaagagggcacugugcagggguucccacgggcuggugugacuccccagccuuccuuuccucuuuguauuuuuucccuguccuugccucuguaagccccaugagcacacacucuaccauuaugcauuauuaguuaaugggcucccugcgugcagggacuaugggccuguauuugccuuuugcuauauuucccacauuguguccuuucauuuaccauaucaucuguccauguuuaucaauccuucagucuauauuuuuaacaaguguguccuccuaccuaaagccuuguggacagauguauuagugcgagccaguguguuuagagaaaggaaauguggaugaacaauccuugcugcagcgcaccucccucccgccugggcugcagcguccccagcugcacaccccacgcuuaggaaaggaguccuguguuuugugagcuuucuuaggucagguauuacagaugaagaaagucuaaaauaagagauggugacuucuugaccccacucccaagacuugcuucuauagguagcucuggggugggaugugaaggucugauagguccuaggggguguguuuaaaggucaccacugaagaaaugugcacuuuuuaacuagguugugcuuuguuucccucuugguaucauagaaaugaucuguaccauuuggguggagguggggccuaagauggaaagcugggcucacgcacagccguccaaagugaguggccugaguggcagacagugacugggaaacacugucauaaguucagaagcggacccucuuccuggacuugcccuuuuugggugggagucacuuugagccuagcuugucccgagagacagagaagucggggccacgggaucaucugugcagccgcagagcuucccuccuacagcccacaucacacacuuuagaaucuccagacuuuugacuccaugacacccacugagaagaagcgaaucugggauaggagacugccaaguggcagcucuucccagagucccgcucagagccaaguccuugcuggcuggggcaguguagcuugccuugcuugauuuugaggaaaauccaccuacagugaccgucacccuguugcccuguauuccuggggccucuggcuuaggagccguuggucuugagccgugucucugggcuuccugcagguacauggaguucuucccuauucccuccaacaccaccucggacuucuacuuugagaaaagugccaacuacuuugauucagaaguggcaccacggcgggcagcugcacuguugcccaaggccaagauccucagcauccucaucaacccagccgaccgggcuuauuccugguaccaggugaggcgcuggggcugagucaccgagguggggugggcucugucugguuacucaagcaacacggagcaagaaccacugugcugggcccugggcacaucgccuggggugugaagggugacaguggucuugccacggugcugcuucuggccugguaauggugacaggcacaauugauguugaaugccggccaccaucugucuacccauguucuccaggcuucacauggguccugccuuggacucugauggccguaagaguagagggugaguagacuuagaggcagccuagauuauccgugcugugguuuccuacccauaaugggagcggggacucaggccaggaugaaucccuccuagggggucuaagaaggccgcucccaccuggccugcaguacgagguccagacagaggucuucuuguugccguuccugcugugucucugccuggcuugacuucugcgugcacuccgcugggcucaugggaaugcuucucacccuggcauggggccagaagcagguuucccucuccugucuucucgcucucucuugggagugugccacacggucaggcucugugauuaaguggccuuggugccugaggcuacuuccuggccaucugcaucaagccaugagacugggucugaccuucaugcuguggaacaccugggccucagccuauuguuaccugggagguacauacuguccuggcuggagagguuuuuucccucuuagucacucguaguggcucugccaccuucugaaucuaaucaccaaaugcugcaguggcugcugccugggccccugugaauccuguguagugugcagggcuccgcucuccucuccuggucccucagaacucccaugcuuagcugugauggcagggagcccucuuuuucucguucuccaggaugcugguuuuuacuuugucuugccuuuccuggggucuuugucuuuaugggaacgccacagugcagcaggaagcuucucuuucaucugugcguucaccugcuccaacaaagcaggggcggcuagugggcagcucaugugcggacauguagggauugagggugcugucauggguccagucagugaggucugguaccugugacaagcaguguguugcugccucccuugaacuccacagcaguuuucuagaaagcagacaaggguguguguguguguguguguguguguguacgcaugcgucuguccuuuacauaggucuuaugugguaguauaguagaguucucuaaaggaacagaaccuauuggguuggcuuacaugauagacucugaaucgucuagucugcauaaucuaguagugacugucucacacuggaguggcugagaacucaacaaucccagugugccaccgaaggccugcaggauucacggagagcugcuggucuucacuugacauuuggaagcuggaagaauucugauaugagggaaggaccgcagaauagugacaguaggcaaaugugccagugagagucaagacagacauguggaagccaagcucugucccuccccuucuuucuauccaccagagaccuuguccacguugcgguggggugggucuucccaccuuagauaacccuuuccuuguggcuuaccuguuaguugauuauagauuaugucaaguugacaaccaagauucaccaucucagccggcauuuuggacacagaucuuguaaaccuaaggccuuacuuauucucuuuccuguccaugaucaggggaguaagugccauaaggagaaagaggcugcuccauucugggaggguuuaagaaaguucuaggaagagaggaagggagcuggucugucuucaaaaagucaggaggagggcuggugagauggcucaguggguaagaguacccgacugcucuuccgaagguccagaguucaaaucccagcaaccacaugguggcucacagccauccguaacaagaucugacucccucuucuggugugucugaagacagcuacaguguacuuacauauaauaaguaaaucuuuaaaaaaaaaagucaggaggaacagagguuauuauauauauuuauuugcauuauuacccagccugcccugccuugagcugugugugacccucaguggugagcagggucaguuaucaugggcaagucccuagccucuggccucugauugguugaugacuuacagcauuacagguuggucagccuagcauuuccccuucuaugaauucugucaguccaucuagugucuaucaaggacuguccuguucucucuuucuuucuuucuuucuuucuuucuuucuuucuuucuuucuuucuuucuuucuuucuuucuuucuuucucucucucucucucucucucucucucucucucuuucuuucuuucuuucuuuuuuuucgagacaggguuucucuguguagcccuggauguccuggaacucacucuguagaccaggcuggccucaaacucagaaauccaccugccucugccucccgaguacugggauuaaaggugugugccaccacgcccggcuuguccuguccuuccuaagaggcagcacucugucucagcaugggcagggcacuuucaaugcagggcuuggaucugguauuuccaucuagcuggcauuugagaauaugguugcauuauuuaucaauagaugcauucuauauguagcagcugacucuaguuuuccauuuuauagagguuuucuuguuauuuggguuuaguaacuuguaagaaggaaaagugaggccuggggcugggguuuaguugguagaauguuugccuagauguacaaggucugagugugaucucuacacugcacaaaacuagauguggugacacaugcuuguaaucuuagcagugaaucagaaguucaaggucucugggccauucucaaauauauacacagugaauuugagaccagcguggacuaugugagacugucuugagggaugggggcuuggggggggggggcagggagucacuguauugauguugguacuugcugguuagaaggucccuagaauggcaggagucucugagacugucagugaagagcauuugggaagcugguguaguacaaccuccuaccgugcacagauauggaacuuggggcucugagguugaugacucccugaggcuaaagcagugagagggagaagcaaagacagcagccuaggccacccucuugcuucugcucagccugugauaucccuauccucucucuccccucaccugcagcaccagcgagcccaugaugacccaguggcccuaaaguacaccuuucaugaggugaucacagcuggcccugaugcauccucaaagcugcgugcccuccagaaccggugccuggucccaggcugguaugccacucauauugaacgcuggcucagcgccuuucaugccaaccagguaguuaccugcccugccucugagaaagcaguggcuuuaauuuaaagggaccuggagagcccuguggaggauuaggguggaggaagaggaggaggaggagccugagccugagccugauuggaggguuggcaggguuagaucacaggaggauuuuuagagaagccuugaaaucuggagcaggagaaccgagugggcugcaggcuuugcaggaggcuucaggagggcauugcagggguguggggagcagggguguggggagcagggguguggggagcagggauguggggagcagggguguagagagcagggguguggggagcagggguguagagagcagggcuguggggagcagggguguggggagcagggguguggggagcagggacaugagggcauugcagggguguggggagcaggggcagcuuugcugacagcuuagauucugggagagaauaagauggagagcuggcagugggcaaggaguugagcauguauauccuuggcagaggaugccgaguugggguaacucuggaugcucaggguccuguguuuacagccaggcuauucuugcugcagugggcauggacacuuugccaugggaugaaacacauccagauugcccuuucccuuucugucuccagauccuggucuuggauggcaaacugcugcgaacagaaccugccaaagucauggacacagugcagaaauuccuuggggugaccagcacugucgacuaccauaaaaccuuggcguaaguguugccuuggccuuuucaugagucgguuucccuggcucugagucugggccaggaaaacaaaggcuugaauggcugggagagaacagggguugauucaaguuaguaagaaaacaugcacuucuuccccgagaugacucuguaacagagaagugaguguucagauggcuucagccauggaaguaaagcuuuggccuuaggagaaggggcagugacucuccugugcucccaccuuggaacauccucuucaguguaagcugggcucugucuaaacaagguagcuacauaguaagcgucagccuaggccgcaggggcuugggucaggggaggcugccucccagugcugugcaccgucagguagcaugucccgggacgggucccaggagaggggaauacacuuguccucauuggcugcuuuccugggaguguuaccuccucaccggcaaggaaaucagagcuggaacagaaggcggugcuucuuguggaggccggaagccacagcacccugaguggaggcugcucuguugcugcuauuugguuaggaccgaguaggaccauuccguuugguuuucuuccucgcugaguucugcagcuuuugacaaguccucuggguuuuggagucuccacuugucacucuggagguggggauaaggaaaauagcucgugcuuccgaggauuggaucgcuggacugagugagaagugugagccacucugggcuccacgccggcuuguagcacauguucucuauguggcugcugccaucuugaaauuuggggguuaaagaaaucuugguuucaucacaaaauuaaaaaaaaacaaacccuacuguauaucaaguuagggauugcuuagcaaaugucucccugaauuaugugggcuuggaaagaguccacagggauuacagaaggaacaagagcugcgcagccuggaccagagugacuuagaacauggagaaaggcacgugcccaagccagcaggagcuacagauggcaagugucaggcagcauagugacagagugugaguggaggaggccacacgccagaacaaggacguggccuugaggagggagggcagaucgcuaaccuauaggcuucugaccucuucagguuugauccaaagaagggauuuuggugccaacugcuugaaggaggaaaaaccaagugucugggaaaaagcaagggacggaaauauccagagauggacuuggaugugagugggggguauggucccaagccgcuggguguggggaguccguauuuggggaggccuuuucucuuuauccuugaguauggcaguggccuugggacucuuacacagcaggcauccucuagagaaggacauaggguugggcuauaggggauagucaguguuucuuuagccacacaaguguugguuaauucuagcguggguggcacugugggugccuccucaugcuaggaagcggagucuaagacaggggugcccccacaugcacugggcauccugagcaaggggugugggcauaccccaggauuuaaaccaggggaagggagagauggcccacccuugcaggggagaacauuguaagaaaucacguucaggaaggucacaagucacagaccgaucuugguuuucuuuucuuuuuccguuuugucguuagcuuugaugaaugcucucuucuuugcuguggguuuugaccuuggguguuguguuuuggugccccucccacgugagcaucuggaagcaucucuauaggacagagugugguguuacggaggggaucauauauuggcaugucaccccugaucugagcuuucuucccauugcagucccgagccuuccuaaaggauuacuuccgggaccacaacauugagcucucuaagcugcuguauaagaugggccagacacugcccaccuggcugcgggaagaccuccagaacaccagguagccuuggccaccacagccagccagaacgcuuguguucgcagggauguccugccucacacugagccagacugaccugccgagaaggaagcugggcccagccagccaaaagcgacgagcaauacucugcugaggcccacaggggccggaagcccaggcaggucugcaagcgccucagagcauccaccgcuggaugcauggccugugggaccucugugguaccagagguccauuccguuccuucgcagccucccugccuggggagagcacuuccuguuguuggaaggucauuuccugguaggaggaguccuggaggcucucuccugucccucacuguguccuaccguuccuguccuguccuuugucacccccccucccgcuccaucaggauguccccucaguauuagcugccauaguucuucuguccuccagacaguaaaggggaagagcgcagcugggccuuucgcccaaccagggagaaagacugggcaugucccugaggguuuugagccaggcccugccaggguuuagcuaggcacccagaugcacucauuagacugaaugugagggugaccaucuugagaggacauacgacucuguauuuggguuauuauuaucacaucucaucuccucuuugggaaaagacucucuggucccuauuguauccaccuaguagugcucauggucucucguaggcccugggccacugccaugccacugggcccagagacgugggccuuggccccguccugcucaccuggaugugacaugugguguuuccugugguaaaggcugaggcgagucaggagucugccaguguucauagucccguguacauagauuguuucacagcugccgccucggcccagcagacauggcagucagcaagcagugcuguccgcugcuuugccuagcaaccuguggccgaggguccccagagacccccuaaccucccaaauacuaagaagcuaaaguauuuuaauauuuuguguuuuuuuuuuuucuuggugccagaguuuauacccugggugcuggggucgcacuguguuuuauauauauauauauauauaugaaauguguauauauauauuauauauuuuuuuugguuggguuuguuuuuaauucagucauauacaaugauggcaagcccgagccucaaagaaugucguaucuuaaugcuagagaaugagguggaaaggaaggugagugucuaugagcacccaggccucagggcgaagucuugaaggguccuucuucccucuucugcagagggaccagagaugcuaagauggaaaggaagaccagcucucccaaaauaguauggcuuuacaaagccuaguggccgugggguguuugggccacagggaaaggcuggcccggggugggacaccuggggcccugagcuggccucucccuccccugucacauggugcuagguuggggucugcuuuggaguggggugcccacagggacccacagaacugucuccagucccugaagacacagggucuuuggcugguuucuguuuggauucuguuucugucccccuuuuaacaaugugaagugacugagguuggauuuccucuuccugcuaccccaagcccccacaucucuuuaacugccaguccaguguccaccagccauuuguucugacauccuggccaugcaagggucccaagacgggcacaaaguggguccaggcaugggagguggccuuggucaaugucacagagcuguuggaagcagugccaagagcuaaauucaggccccugauucugagccccgugcucuuccaguaccacacugccucugagccugccuucgggacccuacuguguuccaggucccgucugucccucagucacauagcuguggucauuccaggacauggggacaaaccacucuuucccagccaggugccuuugagccuucccuuccaagaccugcacuuuucccgcuguguucucuuguuuccagaguccauccaucuuacuagcuggggucgucuucauuaugagcuauuccuuccuggaguucuccacugugguggagagugugggaugcucagagggaccugcgugcaugguuuuggugugcagagagccaugucacaucauguuucucacuggggucuuggaaccuguggaucccagucccuaugugauaugcucaaaugcccugucaacaagcuagaaccagacucaggguuaggucagugugcaugcccuuagccacacuucccaccugucagugaggauggcuccuauauucugaaagcuacucugagacccugugagagcugaguuagaugguuggaguggccuuuagauagcaugcagcucuguuagucucugcuucuggucuccauugaaagcaagcagguuugagacccuggcagagcaggggagugguucucucugguccauuucccucuaagacccuggaaacugcugcugugucccuuucagugcugggccuagaggcugccacaaguugcagauguggggucuugggaaguagauacguucaucuuaguaucucucaaugacaauguccacugauugacuggaaacguuuggaaaaacacaaaaacaaguuggaaggaaauuacuucuguuguucaggccacacccugucccuucuucagucucuaccaacagcguuugccuuaugggugcagcucaccggcagcugccucauucauuccagguucuagagcuuucuauggggcggguaccucggugcgcauagggaaugaggacgaagcuaaaauggaccuuucaaaccccgauguaugagcaaugggugcuugugagucugcucauuuccagaggagaaguccuggccugccccacccuagagccccccaggugugugaguggcaagagcaagcucagaaccgucucagcgcugggcugugacugccagccacccuucaucuagacugaaggagguuagcauuugccaguguguuuucucucgauauucauguacguguauuuuaaaaguaaguugcaguaucaugagacuauuuaucccuaguguugcccuaagagguagggccuuuuaccagaccagccagugccacagccaagacaguaguccugucccacuaacagccauugucuagucuguaccuaaaguugucucccagcccccauucuaccccauuauuuuaguauugguauuggauccaaucagggcaagaacauuguauguuauuaaaaaguuucuuugaaagcuaaaaaguuuucccucugcccaacucauuaaaaaaaaaaaaaaaguuugguuuuuguuuguuugagacaaggucucauuauauagcccuggcuagccuggaauuuguuauguagaccagguuagcccuggaacucauagagauccacuuaacucucaaaagcugagauuaaaugucugcacuuaccaggcccaguucaaaaugguauuuuguuuguguuuuugagacauggucucaucauguaaaucuggcuguccuggagaauguuaugugaaccaggcuggcuuugaacucagagauccaucugccucugccuccugaguucugugauuaaaugugugugccacuucucccaucccccaaaugguauucuuuuuaaggccagaggguaugucgucgucuagaagucccacauuccagaucugauuguuuccuccuguagcuagcccacaggcuuucaagggucauuuuccuucuuguguggauguggcauuuccucuugccuguagugagccuccucccacagccccccaagugagggccaaaccagcuugggggaggggaaggggcuccccaaagaggcaacaucacauggguagggguugagggcucugugggaugggaugguccugcuggacugacccuggagggccaggcuaggcacagcuuagaggagcccggcugccccaugcuaagcacagcauuggucuuucuccaucucuucccucuucugucuguguuuugguuucccugcuucuguucugugguccuggggucuucauucucuagauggucagugugcacuggaacagagaugagaccucaagcuaugacagggaaggccuaggagaaaggcguccucuaggcggaggccugagaagagcaccgggugcagcaggcggucacgugacggucuuccuccauaaaugagauggaggcuucagcagggguuucacauccacgcaagaggcagcugugcucugugugaucugaggcuaggagucugccuccuccccuuccacccccaggccuuccaugcagugcugggguuaggguugucuggcugugggcuugauauccuugccagcucugaguagcccggcaaugucugagggccagcgggaaggccaggggagacucccugaaaugguucaccuaagaagcuucccucaaccucucccuggccuggaggaggaucccagaggaaaggguuuucuaugacugagcuagcuuuucuuacgggcaagagggcucuuuuuguaauuugugcaugaaauucauguuauuuccuggggagagaagagggccaacugaguggguggggggcacgugugggaagcaggcagagguuuccuucccuggagggguggggagggcucgcagagggcaugcuaccuagcucaccugaagagggcucuugaaccagccguuuuggguuguguuaaaugugggaacuuuccuccauuaauguacaaucuugaacuaacugcuaauaaaaugggauucuguuuguacac

SEQ ID NO: 8936 - RNA, 561 nt, Mus musculus
gagccuuuuccggucacggcgcugcgcggugaggagcucgugcuugugcucagagcuaugcugcaguccgugcaggucuucggacgcaagaaaacagcuaccgcuguggcccacugcaaaugaggaaaugggcucaucaaggugaagggacggccccuggagaugaucgagccgcgcacgcugcaguacaaguuaccggagccuguuuugcuucugggcaaggagcgauuugcugguguggauauccaggucugugugaaggguggugggcauguggcccaaauuuaugccauccgacaguccaucucaaaggcccugguagcuuauuaccaaaaauauguggaugaagccucuaaggagaucaaagauauccucauccaauacgaucagacccugcuuguagcugacccccgucacugcgaauccaaaguuuggagguccuggugcccgugcccgauaccagaaauccuaccgauaagcucaucucaaggaucaggguuuaccuuuguaauaaacauccuaggauuuuaacguuaaaaaaaaaacaaacaaaaaaacacc

SEQ ID NO: 8937 - RNA, 35236 nt, Mus musculus
cgcggcccggugacgcggagccggaagugaggaacaugagguucuagggcgcgagggaagcggcuagcgggggcgagggggcgugcacgugaauccccuggccagaucucuggcauggccgaggccaggaagcggcgggagcugcuuccccucauuuaccaucaucuguugcaagcaggcuacguccgcgcggcgcgggaaguaaaggagcagagcggccagguaagcgucagauggcccaguacaagaucuagagagcaguagcccgcuccccucccgggagaccuggccagcgggagucagagaugcgggcuaggguggaggaagaacauuaagcucugcucuacucccugcgacuuauagccacuucccagggcucaguuuccccaugggugcagugggcgggccggaaacugguccaacuagugcagcuuuguaauucccgcccggguucccgguagcggcagguuuaaguuucccuaguaucuggccacguggcucuaugcaguuucccugggacaccacaugggaguccagcuggaguggauugucaccacuguuguugggaacacggagacgaagguccccuaaguugaugaucuagaaugcagggcgugcaggcaggcccuuggcugucuucgguuaugacaagacuugaacccguggugcggugauuucaaaguucauucauuuggcaacuuuuguuuuguuuuguuuuuucgagacaggguuucucuguauagcccuggcuguccuggaacucacucuguagacaggcuggccucgaacucagaaauccgccugccucugccucccaagugcugggauuaaaggcgugcgccaccacugcccggcuggcaacuuuuaauuuggcccugucgugcggaugaugaaaugggacgcgccaguuucagacuccucugcccgucucacagccuaauagcugguacaaaaaaaaaaaaaaaaaaaaaaaacccaaagugacuguacaguuaacauauuaagcuauagaacgagaaauuggagaugcuaaaacauggguggaagaaccugggugggaaauauccaggacugcuucccuaaggauguaguagcugaucugagaucucgagggagauggguauuagaagcucugaugcgaggcuucugaguguccuagccaccagaaaguuugcugagccugaaguuugaaauacaugacuuggaauggagucucccaaagcagacagacaggaauggcugauggguagucuucccagaacugugugugauuaagucacuggugaaauggauauugaccuggaggaucccggguguuguagugucugccuuuaaucccagcacucuagagguagaagcagguagaucuauuuuuuuugggggggggggcagggggguguuuugagacaggguuucucuguauagcuggccuugaacucagaaagccaccugccucugccucccaagugcuggaauuaaaggcaugcgcaaccaccgcccaguugguagaucucuuaaguucaaagcuagccuggucuacauagugaguucaagaccagccaagguuugcauaaugagacccuaucucaaaaaaaaaaaaaaaaaccuuaagcugggguugggugcacccugaguuggcccauaacuuuaaucccaucacucuggggaccaaaaaggauggauuucugugaguucaaggccggccugaucuacauagugaguuccaggacagccaaggcuacacagagaaacucugucuugaaaaacaaaaaaacagacuuaaagcccaaaguugcugggcccuuaagauguuaucuauugcuuucuuaaucuuccuguaugguucuccauguccauucauacucaaacuauaaaacagaggaaauggguuauagugcccauuguugugguuccugugcccaagccagaguucccugcucucacagaaaagaugcaaauacaaacaaacaaacauacauacauacuuaaauacauauauguauguguauuuaaguauguauguauguggcuuagcauauuguggcaggugcuggccauaauaaggcuaacaagugucagcccucgguuauaauuaagauggucagagaagcuuuaauggggaaggugacguuggaguagagacuagaaggaaaugaggagauaggcugugugguuggcaagagaaagucucaguagcaagaauggcaaagcccuguuaggaauugguagcccaauauacuuugucaugacgauacaguuggagcaggauggaacugacugacugacugacuggacugugcccuucagaccugacaggguuucucuguauagcccuggcucuccuggaacucacucuauagaccaggcugaccuugaacucagagaucugccugccucuuaucuccugggaguagagggagauacuauccauuucccucuuacauuuauggugcugugaagaaggauccugaaguuugcagagguagaagaugagcugagcgguccaauaggugcucucccugacuccaggccaaucuguuucggugcuagcauguucuuuccuuugcacauggcucuuuggaguccauuggagcuauucuucagucuuaauggucacacagaguguguccucaccuuaggccuggauucuaccugucaaccucuguuuuaacuccgacccuagcacucagucucuuuccagacauccacuggguuccguuaugucacguggaagcuuucaggguuugggcugucuuguauuugggggaagauugacuagccaggaagcccugucauguggcuuccaucccuguacuguaguaggaugcuggguagugcuaguuuggacuguugagugccuaccucucagaggcgccccuuucugauguauccuauugaaagguuuguagcuggaacuguuuguccuucuugacucuggaagacugugaauggugcuggugaagcccagaggaccuggaagagcaaacggcauuuuccaaagcacuuguugcaggcccugaugucagggagcaucaggcccagggacgaugccuaucguguuggguauuuuuuuugaagcucucucucucucuccauuucucuacagaagaguuuccugacucagcccgucacccuucuggacaucuauacacacuggcaacaguaagucugguggaauggaagggagggagcagggauacccuaacacgucaucuuugcauugagcuaauaugugaauguguucuaauggcccacugugggcauacuugucaccuucauuuggucaguuccaccucccccacuuuccauguguguucuguuuuaaagagaggaucucacuauguagaucaggcuacccuugaacucacggagauccuguugcugcugcugccucuugcaugcugggacaauuggagugugucugggauuaaaggcgcacgccuugggaggcagaggcagccugguuggucuacaaagugaguuccaggacagccagggcuacacacagaaacccugucucaaaaaaacaaaacaaaauaaaacaaaacaaaaaaccaaaugcucacaccuuuaaucccagcacuccggggauauugagguagucaggucucugaguucaaguccagccucgucuacagagugaguucuaagagucucaagaaauaaaggaaaagaaauggaacagcuggguuuuuauuuuuuuauuuuuguuuuguuuugucuuuucaagacagagucccuggguagcccuggcuguccuggaacucccucuguagaccaggaauucaaagauccaccagccucugccacccgagugcugggacuaaaaggcaugagccugcacggccuggcuuguuucuucuagguuguaaucaaugcggcaggcacaagucaaaggagaugcuagugguagugagaacuagugaaggcaggagccuggcgcccaaccugagcgcuuaccaucugagcugcugaaaagugagguugguagugacaguucuaucauggcagcaccgaaggcaggggaugccaggcuccggaggaguacucgggucagugaaaauauugcccacccucccuccauacuuuucaugcuccucugcugcucgacaagcucggagcacgggugcguccuugcccagguguguggguguugcuuucugugcuuccuuccccagcaaacuguuggagcugugccacacacaguuuccugccucugcccccucugugggugagggguacagagugggccaaagaucucacccacugagccaguccagagcagcgauuaccuaucaagucaaacccaguaaacgagcuacaugaccuugagcaacguuugugaccuccuagaauaacaucaucuguaaagugaacucuaucaucacguauugggaagaaguucaaacacagugaucuauuugauaacaguccuaaaacuggccagugagaucuguccuggcacugguccucagauacuacauucuugauguuacagagaacaagcaagaagggggggaaaaaaaaucccuguucuugugaaauucacauucuguugggggaugggguggggggguggaacaaacuuauaccuguaauaaagccucuucuaacagcuuccuggcagguggccuuccuaggaagaaggaaccuggguaacacagcccaaacuguggacagcagugucaaacccagcuaggaagaauggggcuuaaugacuuccugccgguagaaggguggaaucaaaguucaagggacuaagcugucugaagacuuacagcacgcgugcgcgcacacacacacacacacacacacacacacacuccccacucugcuuccuuccagacuccaguucgauggugguuccuuucucuaggugugugccagauacugggugggaugcuguaugcucucugggggccuguuuguauaguaguggagucguccagaaaucaaccagagaaggaaacgaaacugaacgccagggcggagugcuggggggaggggggaaggggugucagcaaagaugcuucacgccaaacucgagaguaacgagaguaacggaggcuccuuccucuuugaugacucuagcuugugucaaguuaacuggcaaaaccagucagagcugggcgugguggcgcacgccuuuaaucccagcacucgggaggcagaggcaggcggauuucugaguucgaggccagccuggucuacaaagugagugccaggacagccagggcuacacagagaaaaccugucucgaaaaacaaaaaaaaaaaaaaaaaaacccagucaggacagcaccacaagagaaggacgcaguucuagggucgggagaaccuggaugguucugugcagccuaugggcuguggccagucagccgauaguagugagugagcugcugccguccugucaccucgucggcugcuugggacccugagacugguuaaggugcauuaggaagcgggugaagaacagaucauuucugcacugugucggcgccacuguuuaaacucugugugcccauuuccuuugaaagacugaauagguaaacagguaucuuuccaaaccucauggauuugucccaucuccccugcccugcaggaccucagagcuuggccagaagcagaaggcagaggaugaugagacccuucaggcuaagaagucucgagugucggauccuguuagcagcucagagagcucggaucaggagaaggaagaggaggcagcaaccgaaagggccaaagccaguaagagcccuccuugcugugugagauugggacccgccuuggcaguugcgggcuucuagucugcucuaccggggugucugccucugaaucauuguuuagugucaaacaagaaaagguggggcuucucagagggagguuguaguaccugggaggccuuccuuuggcaggcauuuuaaccccugagggcaggcauucuaauccucugaggauccaaggaugaauccuaagaucccaggaggcuggguaaaguggcgcacacuuuuaaucucagcacagagacaagugaaucugagaauuugaggccagccuggucaacauaguaaguuccaggccaaccagggcuacaaagugagaaccugucuccccccccaaucucccuucccccaaacaggauggcccacacagucaguugcucaguucacuucacaaggacuguuuccacagcuccuggaugcugcugcuagagauuggcuaggcaugggggggugggggggaggcauuugugcagguguugaguccauuucagaagguugauaguucuggcuucuguguggcccuggggcugcuuucagacuugcugguuguuuuaguuacuguucugcugcuaugaggaggcaccgugagcaaagcaacugacauaaaaggaagcauuuagcugaagggcuggcuuacagugucaggggaguucauccaugauccccauagcagcagccaggcaggcauggcaccguagcaguuccugugagcuuacauccugaucuguagacagugaacagaaagcuggagacugggcuugguguaggccuuugagaccuggaagcgcacccccgugauacaccuccauccaccaaccaggaaccaaacauucaaauauagucucauucaaaccaccauacuaauuguccucuuauuuuggcgguauguggugggucugguagcuauguggccucuucucuccugacagaagcagcuagaaugcuacacccagcaacuggcugugucucugugucccacaaauaucauauugcuuauacagaagacaguuucuugauuuuuaaguagguuuucugcuuauaaaagaagugcaggauuuauuauaaaauguucauuacagaacauuuggaaguuguuuuaagaaaaggcaggggagaagucacccacauucuugacaucuauacccccacaaucuugucuuucauuauuccuccuguguauguucugucagaugcucaagaggacauuuucggugcauauuuuauaucuuaaucuuaaauuauaaaugcaaagcagguccaguuuauagacagaagcacagagaagggaaauguaagaauccuuguugccagccccaucacuuccuacccaugucucuuggucggcagcccauaaaccugcccuguugcuuccagucaaacaggaguccagcugugugcauguggacugacccacagcgggcuucaaacagaaauggcaaaugcuugugcuauuagguaucugauaguaaucgguuuuuuuaaaaauaccuuacucuuuaacaguuucauacaguauguguugaucaugcccaugcccagcucccccggggcacgcccccaguauguccccucuccuuaguacccucuuuuuguuucccgaguuuguuuuuuuauuguugcaaucaacuggcuggauccaguuagugcugccugcaggguguugacugauccuguguaggucaccgggcuacaucagguucaugaguaugaccuugucgugaccauguuucaucagcuuugcauucuuuuguuuuuguuuuuguuuuuuuguuguuguuauuguuuugguuuuuuuuuuuuuguuuuucgagacaggauuucucuauguagcccuagcuguccuggaacucacucuguagaccaggccggccucuaacucagaaauccaccugccucugccucccaagugcugggauuaaaggugugcaccaccacugcccagccagcucugcauucuuuuuuuuuuuuuaauauuuuuuuuauuagguauuuuccucauuuacauuuccaaugcuaucccaaaagucccccauacccuuccccccacuccccuacccacccacucccacuuuuuggcccuggcgcagcucugcauucuuaacaccaucuauucuauaaugcucccugagccauguaggcuugauaaaugucccacugagggcuaagagcucaggugucacucagucucaacuuugacaaguuaggagucucugcauugcuauugcagaaaggugaaugugugugcaugcguguguuugaaauguucucauggcaaacugacaguaguaagucccaucacuuauacccccagccuacagucuugagcuaguagucacuuuuaagaauuauuuauuuuauauauauauauauauauauauauauauauauauauauauauauauauauauauauacacacacacauacauacauacauacauacauacauacauacauacacacacgguaucuagacacaccagaagagggcaucggaucccauuaacagaugguugugagccaccaugugguugcugggaauugaacucaggaccucuggaagagcagucagugcucuuaaccacugagccaucucuccagcccuauaauugacuuuuuacauuuuggguuuuuguuguuucccccuaguucuucuugcaacaggguccugauguguaccccagacuggccucaaacucagggacguccugccucagcuuucugggugucuggcuuaauuuaagaguccucagaaguauuuauggguaacaugacagggugugaaguucuucaaaauaauguaugauggggaagggaaaaugagacauugggugaacugagguuggcuacggguugauauaaaguuacaauaacagcugaggcugcauaucauacauacacacacacacacaaaagcuggaguuaggugacuuugguguacuucugaauauuuuggaaacuuugcucaugugcagaaaagggagugucaaagagccccgaaaugaauucaguccugccguucauuucaacaccugucucuuuagugauaacuucuuccccugaaugccugagauccaaagcaccguuucuuaaaacccucgagagucugaaucucagugucuccuacuagucccaggcuccugggucggcacaauugacgaccacauagcuuccucuauggccuggggcuggcugcuugaccacugcccugccugccagugacuuaucaggacugaugaugguuggcacccaacccaaagaguagucaccagaguugggcaugucuugugguggugggugguaagauuauaagccuguccuuucccucugggggccuccagaucucaugccacagaacagcugggagucccucggggaugcaggcacaguaaccaccauggguucugggcgaggccuucucaugguucugggcuaggccucagguccucauacuagcaccaagcaacuaguaccuguaggaccauuaggugguguaaagucugcccaucuucuuagaugagaagagcccaccuugcucacagcguuugugucuugcagccccaagaccgacaccugucaauucugcaaccgcagcuuugccaucaaaaguaaaagaaaaggugaguuuauuuccgaguuacucauuaccugugggagcuguauccaguggagcauagucugccgugucaggauagggucgugugguucagcgugugucucuaggugucugugacuucaucuagcuaugccucgggugccuuuucugugaaacagaagugaugccucaaaccacacacuugggcaagugccuuccucugucguccuugcacccacucaccgguuguauaaacagcuccccuccagucccuggugugcuacuaggccgucaguaccaucauaaggaaugcacuguacacauuuucuagaucaaaaaauacuucaaaaaugucauuuuccaguaauccauacacacuguugcagacacauaaaugaugugucacccgaaccaggcgauagcuaucguauguaaaagcaaugaugaaauaauaauaguaucacagugaacuauagcuucauguaaaguaggaacuacucugacccagaagcaguaaugcucccuuaaugcuuguguggaaggcaucuuugucuugcuguagagaugagaugacaaaccaguggacugugaaaggccagagcuggcugcucuuagucugugggagaggugggacacucagagagcucggaagucgccuuguaggacccaguguccuccugaugcuuuucacauguccugucaugacagagugcucaucccucccauacucuguagggaaagaccaagacagccaacaagacggugaacucugugucgcacccuggguccggaaagacggugguccaccugcucucugggaagucacccaaaaagucagcagagcccuuggcaaacacugucuuggccucagaaacugaggaggagggcaaugcccaagcccucggacccacugccaagucuggugagacccccagagccuggggcaaggggucaggacugaacacuguggagagacauucugaguguggguuugucucugacagccagggucuuacaacagccauuuccaccuuuucugacuuccuagacuauuuuaaauuuacuuuuauuuuauaugcaucggugauuugccugcauguacaucuguaugagauaucacacuuuguaguuauagacaguugugaacugccauguaggugcugggaguugaacccagguccucuggaagaggagucagugcucuuaaccucuaagccaucuuuccagcccgcuauaugggcuuuuuagaggguggcguuuccggccuucucucucugguggauuauagggaacacuguggucaccuggaaacuaaaugaaaagguguaggucuugaugcaaaauaggccuuugcccagcuugucccccauuccccaacuugauagcaaauagugacuugauuaacuagcagguacuucuagccuuuccaagaccucagagaggccugcaaaaauagguagugagggucccuguuccagcuaggggacuuugggucagagcagauagcaagcccuguacaguugagaagcaugugcuaccuagguuugacuaacaaccugcauggaggcucugggaggggagaggacugugggaaggauccuuaguccccuguguccccccccucaggaacggugucagcgggccaaggcagcaguuccagugaagauuccuccaucucaagcgaugagacagaugucgagguaauugccacccauccccagggauugaucucuuccagcuucugacccucucuugccaguguucagaucccaguggccagucaucagcccagcaguuguguccgacagcugcaugguuacagacagggcuaggcaguuggagaaugaggaccucaguacugcucuggauaugcuggguaucagaguccagugcugggagaggaagacacgggagcagagaccugaguaggaguaacugggacauguggccagggguaggacugccucgaggauucugagcccaguggugaaugugcguuuggggauagaauuggaugggauccuuggucugcagccuugucucuuuguaggaucguuggggggguggggggucaucacaggguuuuaugcaccgaagugagguggccuggcucgcaucucaaaaagauugcuguagcguggccuggaggaagauuuagaguaaaauuagugaggcccacuggcagacugucagguaacagccacaggugccaguggcaggaaccaguaugccccauauguaugacauauauuauuuggcauaauaaccaaccucuaccccaguacaaagccacaagcuuauaaaaacaaaagacaaaaaccaugaggguguuuauauuccaguuguuggaucuugggcaugaacuuuguaaaucacaagacuguaucacacuuucaaaagguuggacauuuaaggggguagcaggagccagggauagacugugccuacgcagcugccccaccaaacccaguggcccuguguagcccgagccauccccuucuguucaagacuugaccacagcuguucccugccugccgucucucuguugggcccugaguguaauaaggcccacgggauuccucugugucccuuuacuccaagccuugcucccacaaauccagcuccuacguauacguauacagcacguguacagcacuggcaacaggaaaccagcgcggagcuccugccgcugcguuugaaagaggguggugccauaggcugguguggggcgugaggggcagcgugaaacaggcgcugacuggccugcuggcuaccucaggccugucgggauuuuggaaugcuaaggaagucccaggaagaaguucaagucagugcagauccaggcuccucuguccggaaaguaccucagucagaugcuuuuuaguugaguggccccucaggauggacccucuuauaaacaugucagugggcaggcaggcgcgguggccgaguucugccccaaagguagccagggguccuuauaagccuuuugugcugcccuuaaaugaucugugccuuuuuaggagaaggguguaagauucugucugccucugggagauggaaaggaacaugcuuuuaagaaggggcuuguauuccuuuucuguugcuaagaacagcccccauaggcucaucuaucugaaugcuuggucaccagggaguggaacuauuugaaaggauuacaaggguuaggagguguggccuuguuggagaaaccccaucaccgcugggggugggcucugaggucucaaagguuuccaaaguccuuuugucuuugucuaccuguggaucaggcugcagcucccagcuacuucuccagcaacacguucuuccuuuuaaacgaccaccuuggucacggcgucucugcacagcaauagggcagugacucagacgccaaagcaaguuuuuuaagaaaaaaguuuaguugaacuuaugguuucaaaggguuaagaguuugugacggcagagcaaaggcacaagaacuggaaccgcucggagcucgaaccccgauucacaagcaggaggcagugagaaaacgcagggcauaagccuaccccagugacacacgcccuccagcggggcaaacacuucucguaguugggagccuauggggccguucccauucagauuggcagagagcugacagcagagggggaaggcucuucaugugcugcaucucuugccugcuucuaggugaaaucuccagcaaaaccagcccaggccaaagcuucagcagccccugccaaggauccuccagcaagaacagccccaggcccuaccaaguuagggaauguggcgcccacaccugcuaaaccagccagggcggcagcggcagcugcugcugcugcuguggcugcugcugcugcugcagcagcagaagagucugagagcagugaggaggacucagacagugaggacgaggccccugcuggucugcccagccaggugaguccaggggcugcuauccgugacccgcugccuguaguucccccccccccccaugcuggcaaagccacugugugauggagaacuccugaagagggcccauucuagagagagaagcaauggcaacuggccagggggcuucggugccuguggaaacguccacugggcccacaccgcagccagaguggcugaugccuuuggggaguugggggguuguccugcaccuacucuggugaugauguuaauuuucuugguuuucguguguggucaguguagcugcccucagcacagcugcucggaagagaccugaggcuuucuucauucugagucgguuucccuauagcccaagcuggccucuaacgcauucucuuccugccugagcgccccaaguuugggggcuacaggcacgugcuaucuugcugucuuaaguuuucuaucgcuucaaagagucgucaucacaaagcaacuuauaaaagcgagaauucaaaugggugcuugcaguuccauggccguccugacugagaacauggugucagccaggcauggcacuggaacaguagcuaaaagccuuaaaacugguccacaggcagagagaacgcuaccuucaaagccauuuaguacaccuucucuaauaaagccaggccuuccaaacgcucccaccgauggaagggguggggaugggggagacacagcaaguauucagauaucacaugugucccagugaguccugagaauguucaagggcuugguucucucuuuagccaaaccagacccugagccggcaaccaccagagagaaucucuuuuguuccucuucuggggccuuucccauggaguguaauucagauagcagucucacaguccugcacacaugcugggcggagcagaaagggcuggaaagcuuuuagagguagaacaagaagaagugaaggggucuguauccaggacuggggcagggguaggggguggggcgggggcauggcaguuauuaaaauguuaaagaagaguugguugacaacaugaaguggacaaggaaggacccagaaggagaugugaccacagaccuauaguugaaggguguagaggauauaguuggcugcugaaguucuguggcaauaacuugggacccagccuacuuggggcugcauuguggguauugguucaugucugaagagaggagccaaaugcagcuuguguacaauuacugccccuccacacagaaggccuuagaagguccaaagccauuuauuuucuaggaagcuuagggcagagcggacaaggcagucaugagaagacuguagaagcuuguagccacccuaccaaacagggaggcaguggugagccuuuggcugagaacagugaggagaauggauaaagaggaggccagugaagggacugcaucuagaacaguaguucucagccucccucaugcugugagccaauacaguuccucauguuguggggacccccaaccacaaaaucauuucauggcuacuucauaacuguaauuuugcuacugcuaugaaucaaaauguaaauaucugguaugcaagauaucugaugugugacccccacagggggucgugacccacaggaugaugacagcugaucuaggaguccugucuaccacaggaagcccuggggaguuugagccuuuuuccaugcucaggcuguucuugaagaacuuugcauacaccccuucucugccuugagcauugcugucuaguuaaugagccggacagucucacaggccagugcuuguacccacagaacagacuauuccagcuaaggauuuaaccauuuacgugcuagggcucuguccagggccagaaugaaggccacuauauggugucacugggugcugaggaggucagugcucaggaagccgagggccagccgggguggcuggggcaccagugaaggugagaaaggaaaguguuaucuccagaaccucugggcuucuuccugauggcaucaccuaaggacugaaaaagaagaacgggcuauucuuucucuucaccagguaaaagccucuggaaaagguccccaugucagagccgacucggugucugccaaggggaucucugggaaagggcccaucuuagcaaccccagggaagacugggccugcagccacccaggccaaggcagaaaggccagagaaggacucggaaaccagcagugaggacgauucugauagugaggaugaaaugccagucacugugaauacuccucagguaaagccuggggggagaagggaggcauuauagcccagaccugaaggcugcuaaccugucuccucagcuggucccagccccugucccuucuccucagcugggcccagccccugucccuucucagcugugcccagccccugucccuucucagcugguccuaaccccgucccuucucuucagcugggcccagccccugucccuucuccucagcugugcccagccccugucccuucuccucagcugguccuaaccccugucccuucuccucagcugggcccagccccugucccuucuccucaacugguccuaaccccugucccuucuccucagcugggcccaaccccugucccuucucaguuagucccagcucccaucccuucuccucagcaggucccagcccccaucccuuuuuacugguaaggcucccugcuccugucaggucucugcccacaucugccuaaugauuuacuccucaauuucucauaccaggcaaggacuucugggaagagcccucgggccagagguaccucagcccccgccaaggagucaucccagaaaggggcuccugcagucaccccuggaaaggcaaggccuguggcagcccaggcagggaaaccagaagccaagagcagugaggagucagagagugacaguggggagacaccagcugcugcgacucugaccacgaguccugccaaggugaggccaggugugccuugugcucugccuagaaaggaaggccuccuucuucaaaaccagagcacguccccugaucuugcccucugucacucccaggugaaaccuuuggggaagagcucccaggucagaccuguuuccaccgucaccccggggucaucgggaaaaggugccaaccugcccugcccugggaagguggggucagcagcucucaggguccaaaugguaaagaaagaagaugucucggagagcagcagugcagagcuggacagugacgggccugggagcccagccaaggugaguccucagaggucucagcccgggagccuacauggccuuacaccccaggucugucgucugggucucuaauugcugccugucuccuaccuggggcucccacugaucucauuccaggcaaaggccucccuugcgcucccucagaaggugaggccuguggccacccaggucaagacugacaggggcaaaggccacucagggagcagugaggagucaucugacagcgaagaggaggcagcaccagcagccucugcugcucagguggggaccagggaagagaggcagucuggcuguccuggcccgccccagucagaaaccccaccucucagaauuagauggguucugguuaguaaggagaccagggggagcugcaucucagaacgaauuaguccaggagucucccccaaccuccaucugcacuuucuccacaggcuaagccagcucuggaaaagcagaugaaagcuuccucuaggaaaggcacgccugcauccgcaacaggagcgagcaccucgucccauuguaaggcaggagcggugaccucuucagccagccugucauccccagcucuggccaagggcacccagaggucagauguggacucuuccagugagucugagucagaaggagcugcucccagcacccccaggguacagguaagggcuggauuuacccagguaggcucacucccagcccccauggggcaucucuggcccuugagaaacucuuucuucuccuugacuuucuaggggaagucugggggcaagggccuccaagggaaagcugccuuggggcaagggguggccccagugcacacucagaagacagggccuucggucaaagcuauggcucaggaagacucagagagccucgaggaggacuccagcagugaggaagaggaugagaccccagcacaggugagguagggaggaagcagccugaaccaagacuggggaugagcucaguggaggcugcccuuggcccuaggagcacagaauccugggacucaggcucaacuaagucucacguucucacacgcucuuguuuccugagcccccuggcucuagguuccuacacaucugggugugccacgcauucugcccacugccacucuagacagaagucuguggcuuuggccuuggggaaguugccaccuggggcaaggugugauauaguacacaccguuacagcaggauagggaugugcaguagggcuagccaagcaugguacccgagauauuuuaagaggagugucaugucggugaggaacugaaagucgucuggugagguagaggguagacucuuugcagaagccaagaaaguuggcucgggucgcaccacaagcaggauuaaauggcagaggccaagagccagguuaccugggcucaaguccaguucuauuccuggggccuuggcuacagucccaucugucaucaauccacccuuguggguauggguaaggccucgccugccggaagcccggggaccugccuuccuggccgugggcuaggcugcugggggcagaguugcaaggcacaccaccuggcccgagagagcaggaaaugaaaaggagcuugucacggucugcgcuaugggggaccuuccuuaaguccuaacucugucguacacaugagaggcauugggaguuggagcuacuuugaaacuaacuagauggugauaucugagugagucggggccuuucucagguccacacucaccgaauugcacucagagccuaucagugucugucuuacucuggcugaggccauagcuccuagcugggugguauaguguuugccuaccaugcaccaggcccuggguuccaucuccggcacagcacugacuccguaauguggguuuguacaagcugaacacccugacaggcaugggggggggggugagauuaagcagaagcaaugacucuaucguguucuguuaaccugcccaguuccuaguuccugggcugagacggaugcuugagcucugcauuucagggagaagaaagcacagauugacgauucuauauggcacucagcuuccauucuguagaguagaauuuaaugacagacacggagucuaguugaaagggaaccuaaaaagcaguuguguuuggguaggaguauauuuaaaaggcuuuacagugcugaauuugaguguguguuagugccaguuagacuacuuaaacacauagucuguuuaaucuuugcagaaaucccauagauaauguuuuauuuuuacacuccuuuuauagagaugaaagugaggccugguaagauuaaguggcuucuucuugguuguguuuuguuuuuggaaucaggucucacugcauagcucuggcugucauggaacuugcucuguagaccaggcuggccucagacucacagagcuaugacuaucccugccuaccaagugcugguuaaagucgugcacugccauaccuggcaucagggacuuccuuuuuuuuuuuuuuuuuuuuuuccaagacaggguuucucuguguagcccuggcuguccuggagcucacucuguagcccaggcuagccuugaacccagaaauccuccugccucugccucccaagugcugggauuaaaggcgggcaccaccaucgcccagcaaucuuuuuuuuuuuuucuuguuuuuuguguuuuguuuuucaagacaggguuucucuguguagcucuggcuguccuggaacucacucuguagaccaggcuggccucgaacucagaaauccgccugccucugccucccgagugcugggauuaaaggugugugccaccaugccuggcuuggcaucagggacuuuuuuuuuuuaaacauuuauuuauuuuauguauaugaguacacuguagcugucuucagacacaucagaagagggcauuggaucccauuacagaugguugugagccaccaugugguugcugggaauugaacucaggaccucuggaaaagcagucagugcuuuuaaccacugagccaucucuucagcccaaaauauugguacaucuuuuuuuuuuuuuuuuuuuuggcuuuuucaagucaggguuuuucuguauagcccugggcuguccuggaacucacucuguggaccaggcuggccucgaacucagaaaucugccugccucugccucccaagugcugggauuaaaggcaugcgccaccacugccuggcuuggcaucagggauuucuuaaacucacacugcuguuaguuggaaggaggagccagcaucggcucagugucugcagcaucaguguucuuugaugacugcucuguugcccuuugcccuuccuaauucccuucccuuccuuccaggccacgcccuuggggagacuuccucaggccaaagccaacccaccucccacuaagacaccuccagcgucugcaucuggaaaagcuguggcugcuccaaccaaggcaaguaggaccagaaaccacaagacacguuaggauaaaaucucaaagggcguagucccacagugauccagcauggaccacccgcugucccacccccugugauauuacagccacacacuaguagaaggaugacugccgcccuuuccuccuccaauaccauugccaccucucgauucagggaaaaccaccuguuccgaacagcaccgucucugcaaggggccagcggucugugccagccgcgggaaaagcaggggccccagcaacccaagcccagaagggucccguggcuggcacaggggaggacucagagagcagcaguaaagaggagucugacagugaagaagagacgccagcccagguacccacccagcuggacuugggguuagagcaccauguguuuuggcccaggccuauaggcacacuugacaugccucuccccuugcuguuucuccagauaaaaccuguggggaagaccucucaggucagagcugccucagccccugccaaggagucuccuaaaaaaggagcccauccaggaacccccggcaagacgggaucuucagcuacccaggcccagccagggaagacagaggacucagacagcaguagugaagagucugacagugacacagagaugccaucagcccaggugagcucugccaggcccgagagccaccgucaccaacucugcucauaaacagaucgugccccagaggggagaaagaacagauagaaguccuaacuccaggaucccuugccuccagguccuccccaccaugccccuggaugaaaugagcuguaagucccaaaccaaggccauccuaguauaggacauccuagguacuccuacagcuccgcaggggccucugcagcacugggcacggcagucccaugcaagcugagucagguucugcugaggaaccuggagcuauccugcaaagacaccccugucagagucaccaggaagcuugggcuacggcgcaagucucugucuaagaagggcccgucucgcucagugaugccuaggcccaaggaguggaaaagaaagagaagcugucucauacucaaaccauuguccaguucucagccugguugguugcagcgagcaguggggcuugcucuggcugacagucucuagucugagcucaggcagccugguagaaucgguacgugauggccucuggugucgcaccuuagggagguggcagcaagaucagaaagaaaaugguugguccuugucaguuucagccgaccguggcuuuauagaaacaaagggaaugucacauauaaguggagauuuuguagcuucuccugagaaacccaguccuacuugccgauugagcacaggccacccgagcagggagacauagagcccucccugggccucccuuaaguuggcaucaccaccagcucuucuucacugauugacaaguucuguggcuuuggaccacccggcccgugaagaaugcucuuaacagggcuuaagaagugucacucuuccgcauuuuccccucacugggaacccucccgugucacgugcuuacucaagucuuguccccuccaaaggaugcuaucucccagccugccagaggcaaagcgucagguccagcguccccagagaagagcauagaaggguccucagagagcagugaugaggaucugcccuccggccagguaggcuguagcuacucuaaaggcugccccuggcugggccaggcugccgcucucugugagagggugcagcuucccaacagggauagucucaccacaugcagguagcacuucacagcuccuagcugucuucugauacacuccugguguggucgggccucaggcuucacaccccuggcuccacucugcugcccaggagccuuuuaggacucugauguuuuauguaaacuggaguuggucauggugcccaggcaccugccugagcacuguuaggcgggcacguuguccuggcggccuguucggggccaggguugaggccccuuaucuucucgugaagaaguuugaggaacccagaacacuacugcccaagccucucugguccccauggacaguuggggcucuagauccucccuugcgaccuucguuggaaucugugggccccaccccaggucaggccuaugcaauuuauggcaccugcucauugucugcugguccccacuccugccuggccuuguucccaagggugagguccgggacaccuucucugauuucaggagcccaacauagccaccaagaugguacaagcucugugugaacccaggccuuuguagaggcagcacugcccucuuucugagggaguaggguauuuccauuugaaggagagaggggccugugacucugaggcagcucagagaacauuugaauccuggcagucugcacuuucuccugcccagcugucccuuuagcccccuuccaggcuuggcuuuugcccucuggcucugcagucuuucugagguaccucccucacuccuaaaggacagacagccaguauggaagguugccuugguuuuucucugugugaguagacuugcacaauuaaaaugagcauuaugcuaaaauugaaccuuuaaaguggucuugcagaucugggggucucuauuuugaaaaaaaacaaagccaauaauuuucuagguucccagaaggaauucagggaaacgggcacagcccaggaagcugugguuucccucugggagagugcuagccuacgcgggauugcugucgcuguugggcauuuaugaagcacuucucuauggagagcugcagaugguccuuccuagggcuccccgucugguugguuguuuuucauuagccuguccgugggagaaaaggccggguaguccagcucugggccagcucugaucccagguucuguccugcagcucuguguaaugccguguggaguguaagccucaagcugaggcuggcuggaacccgggguggcuacaaguuagaaagaagugggcaugugagguaaugcaggcacgagacggcauggcugauccauucuguuguagccauguaucguacugcgucacgcacauagucaugcguaaccucccacauaaauuauuauuaaauguaucagcguuugccugcauguauguauguaugugcaccacaugccugcccggugccuguggagacgagaagagggugucagaucccucuggaacuagagguacagacaguugugaggugcucugugaaugcuaggaaucaaacccagguccucuaaccuccgagccaucucuccagcccccuuaaauuguuuuaaaggcuacuucagcugcuguuuugccaaaacaaaggcauaggcuauguccuuauugagugagaacaggggaccuguuaaaaaaaaaucuaaauuuuagaauuaagucaaggcuugcaugguuaggucuggcucccagagcgcuuccuuccaguccuguaucuugaaaccaguuugcuggucguccuggacgaggugcuuguccacucugagagccucagccucagcuccgagucagacugggguuuauaaaccucaggucuccuagcugcauccccagaaagugucguuucuaagucucauggggaaggaugagcccccagguaauagucaucuuccuccucucuggggggggcggggagggguccucagggggucccagugcugaggacacacccuccacugcacugcaccucuagccccacaaagcugcuuugagggaagcucucggugacuguccccuucgacagagcuccaccuccccucucugccccagacuaacuggaauaaguagauagaagcccagcuaagacagcgggcagugggcaccgcccaaaagggccccaaaucugcuucuguaagcaucauuccugcaaauagguaggguaucccccuaaucugcucucagcaccccagggggguggaggugagaugcucagguggcuguggcgguagcguccucuuccaccgcuuugccucucugaucaaagcacagcccacacccgcugggcuuugugcuuuccccaggugaccacacgcagcacccaccacagaaugaggagcagaggcgcuacagaccuaagcacugccccugugcccagcccacccucaucagccaggccgcugccuccucuaucgccugcccgucgccugucgucccugccucgagaugggguggugugggcagguggggcuggaggaggcugugcugcagagcugcuuuuaacauuccaagacgcuauuguuugccucaguggguuugcugccucucuugguccccaacaaucuguucuucugucuucucacauauauauagaucccccucccuccaccgcaagccuucucccacuuuccauccuucuccuucucaucacgugggaagggaaggcucuggaaguggcagcucagagcagccgcgggggaggcuguuuggcaggguagggagggccugagcgcagcggugccgccgccacacuugguggguaccauagugcuaaaguuuguugcuuucucugugucucacagccccuggggcggugggagcuugguaaagcacugcaggcaggaggguguccguggauagagacccagcuaccccucaggcagcccucucauuagccagagcaccaacagccuucagccagcacuggcguuuggagaguagaaaguggaauucuaguucccuaacuacugccucuguaccuucaucggcuaggacucugaaaggaaauagaucuggaguccccugguauguuggugacauauuugggaaucugguccacugccaaauugacccucccaguacuaggaucugcugcugcucugccgucucagugagauacagagcagacccacaggugaagugcaucagggcauguuagaacauaucuguaaucccagcauccaggagacaagguaggaauaucagaggccaaugugguaggcuauacaaugagacccugucucaggauuaaaaaaguaaaacugaacccuacgcauuaucccaaccugcagcugucccgguccugagcagguuggcuuugugcacauucuacuugaguccuugacuuugaagcuggucucaggcccgucacgucauccaucagaauuucaauaugcaacucaaaaugauaagagucuuccuaguccuuguagacacaaccacaagacaguaucucggcuagaaagcugaccggcaagcaggccuugugccuguuucuccaaaguaucugucugaugaguggcauuuuucaugcuuguccuguuuaagagugagucuaauaaauaagguuaguauguggagaucuguuccucuaauuccagcaguggaggcagaggcagguagauuucuucauccaaggauagacuggucuacagagcaaaaccugucucaaagcaaauaagggccacauauacacauauauccugagcgcucuagucuguuggcuggccuacccaucccacccccccuguuacuccaggcaguuuguguacuaaagaaacuaguucaguauaacuggggucugcaugcugagccacaucucagggaggaugcugucagggucucugggggaagggacaaugagacuccagggaaaucauacagucacacuguuacaggaaaugcuuuuuagaauuccccacucagcagguggccaucugaugucacuagaagaaaggcuaaauuagacauuccagcucucgccuugcuuccuucccauguggcuguguggccugggcgcuccucuucuccccucuggacuuaaggcuuuccuguuaggccaguggaguggguggauacugcuuagcuuggggucacugugaaggucagcugggcucuaagagcucugaagugcugugcugugcugggugucuggcuguuauggggugggagugggccuagaagaccccaacuccuugaaguuugcauuacaaagccccucccucacccauuuccucuccccuuccccugaccaagccuuuaaucagaggcgggauguuucuguuuuugguuuucaaggcgauuaaauccccuccaguuucugucaaccguaacaguaguccagcugucccagcuccuaccccagaaggaguccaggcugugaacaccacaaagaaggccucaggcaccacugcccagagcuccuccucugagagugaggacggggacgaggacuugauuccugccacacaacccuccaccuaugguaagcgcugcugcagugggugcuguucggccaggacgggccccagccacgcaugcccuccccacugaggccagaaggcacuaaccagguggccuagcagaggcauuggcgaggacuggggacucagccuuaggcacuguauuguucccuuaaugaggaaagcucgucugccucauuuugaaggaauuacauucgaggcuucugugugcuggcuccaagccugaaagccagagggagcauucugguggcuacaggaaccaggcuagucuaaaccagagcucugcuauagccaccuggccgugggguacacuauuagccuggcagugagcuuccauccccuuagcauagaaaaaggagacagguaacauuuuauacuuauucucuucccagaaccuaaggugacugagugucuuuguauguggcgaggcccucugguagcgcaaucaucuucaguuauauaucaggacacugugucgugccgggcggugguggcgcacgccuuuaaucccagcaccugggaggcagaggcaggcggauuuccgaguuuaaggccagccugaucuacaaagagaguuccaggacagccagggcuauacagagaaacccugucucgaaaaaccaaaaaaaaaaaaaaaaaaaaaaaaaaggacacugugucguuaaguauggacagcaagauuccuacugucagcaaaauacugcuguuuauuuggcgaguacauaguggugacaugagcucacauuaggcugugguaaacaucucagcacccagcagcucucccacugguccuaacugagcaguugcucacugugaccugcacaagagaaaaagaugaggguaaggcuuggagucaccgccacagcagccauuuucaaaugacauggugacagcugcugucuggaaggcuugggaagccagcguccccuuuaugaucccuaagcucagcauagguccgagggaagagugaucugguaaugccuugcuggggaguccuacggcuuuguauccugaugugcccccccuucuccuccguuucagcucucagaaccagugugacgacgcccgcagcccucucacgagcagcuucccaacccagcaagagugagcagucuagccggaugccaaaaggcaagaaagcaaaggcggcggcguccgcucagguacugucggguaagagagggcugugguggggucacucucugcugccuugccauguguccucaggccacacgccagucacuagcuugcucccagcccccuggcacugucauacaggccaggagccaagcucccaaaucccaugguguuguccggaagagcgggcugggagcccgaaggcaagcggaagccccuguccucccagcuugccugaguguggauucguuuucuggauuugagacgcugaaaccgacucuugaguugcuugccucucuuaguauucguaauggaaguggccuuacuguuuccuccagccuucacaguccagugcauuauuaauaucuagggcaagauuaguggacaaugucuaaauaaaacagggcucaucccaccaggguugguccaggccagaaccuggguccuccagcuccaagaucuuugcucuggaggccuaaugggguuuguuaacgugagggaagagucuaucggacacccaacacccuaaggggcaggagaagaaggcuguacugaagccccucccagcuucggggagcuacugugccacccuguuacccggugcaucacagacuagcccaaaaagagccucuggcggccgggugauccaguggguagugagauggccugagcaucugcccugcugggcaccgaggcugcagcaggcacgagaccuucacggaguccuaagccagcagagacacagccauuacacagaaaaagcagcauaaauuaguugucaccaacugcuagguguugcaaagggaacagcacagaacagagaauaaugggugaccugcuuuagaaaaggcgggcagggaaggcuucucugggaacaugagcagagccugcccugcaggaagggaacccagagguacuagagcccuaggugauugacauagggcggguaagauaaaguagcaagggggucaggccauaccuggacugcuuugugucugcagcuccaggaggcuuagcaaaggcucaucuauugucugugugcucuuccugacuucuagcaggaugggaagcaggggugcccugagggaccaccuagccagggacacaucccagaggagacacaggugauggccacuggaguuggggcugcgcuguccuccccugggcccagauuagagagcaaagccauagcucaccaccugguacccaucuuuccagcugcgauggcuccucuauucuccaccuuggccucagggcuuuucuugcuugaacaucccugccucuuuacccaugccagucauuucuggcucaggguagcacagaugcuguucugagaaucuaugggucucagggccuccucguaccaucaguggauaacagagggacccugggucucucccacugguguugaaagcucauucuuaaaaagccaguaagcagggggcuggagagauggcucagugguuaagagcaccgccugcucuuccagagguaaugaauucaaaucccagcaaauacaugguggcccacaaccuucugaaaugagauaugauacccucuuccagugugucugaagauagcuacgguguacuuauauauaauaaauaaaucuuuuuuuuuuaagccaguaagcauggggcaggggcacagcucacuuacugugcaagcaugaggcccugagcucauucuccuguacccacaggggaaagccaggcaugguagugggcguuuguaaucccaauacuggggcacguuaaccagccagccuagccuaauuggugagccccaagucacauuaaaagacagaaggcuucauaugacuggguucucuucugcuccaccucagugaaaggccagcaugguuguguguguagucagcagccccucuuucaccucccugggccucagugugcuagugccagguaaggagccacagugcccaccagagggcugugggaaagucauagaaagccaugcguagugcuucccacguggagccuggccugccguguccuucucacuguaacuuaaccuuguguuccuacuuuaccaaacuagaccagcagugccguggaaacacuccccaugaugccuccccagagcgcacccauccagcccaaagccaccaacaagcucgggaaauccaagcucccugagaagcagcagcuugccccaggcuaccccaaggcccccaggagcucggaggacagcagugacacuucuuccgaggacgaggaggaugccaagagaccccagaugcccaagucggcccacaggcugggugaggauucccagagggagggugggagaugaggcacagccugguagaacuguaggcucuggccuucucagcccacccuggccuugucucauccccugauaauaccuuuacaacuucaaagacccaacugcuguucgacagcuggcagcuucuugguguuaagcuccgauuauugaaggccccgagucccaggacucugcuucccuuaggggggcgggggcagaaaagugggagccucaggaaccagaggggaaaugaugccauucgugugucgggccaggugcuccagacuagcauggguggacagcaggaggcuucgugcaggaggaugaggaacagagaaagacccaggccucggaggccuccuggggagcucugccuggccugaauaacagggccgccagggacucacacucaacgggaaaccucugcuuccacacuagauccagacccuucccagaaggaaacugugguagaggagaccccuacagaauccagcgaagaugagaugguggcccccucacagguaacugccaggcagggcuggaacuuggaagcugccuuuagacuucagccacccccuggaugagugucuagauccccauucccagggcccuggguaagguccugucaguggggugccucuaaucaaucggauagaaccucaccucaugcucuggggcccagggaagagauucagauggauucugagacaugaccagagaagacgacuucuuaggucucucuuaaggcucuuccuauacaggacagacuccagugacuuucucacguguggggagugggugcguguuggggucaguccucuccuuccacuuucacgaagguuacuggauuguacucaagcugucaggcucgacucgugucagugccucuacccucugagccaucuugccagcccaaaaaacguuaaccaucuucugugaugguacuaguccauuggcaauaagaaaguccccuuuuaaugugccuuacauaugcguuaauucacauagcuuagaaggcacaagcugaaggccuaugucccccgugggcucagugccgcccgcucaugcuuggcuggguuggccugauccggggucaccgacugauucccuugagccuugccucugggauacggcuaggggcucgaugcgucuuucacacuggacuucuucagucucuccucucagguuacaugacucccggcuugacuguggcuaauucccaggcuucaaaagcuacuccuaggccagacuccaacuccuuagcuucuucugccccggccaccaaagacaacccggauggcaagcagaagucaaaaucccaacacgcagcagacaccgcacucccuaaaaccggugaguggggacagcaagacauggagaagcagggcugcuggucccugcuuguuaugggcagcauuugucugugucccuuccaagagucucauauucgagccugugggguccucugggaacuagagguacccuuaaaugcagcuggcgcccaggaccagguugccagcucugggcagucugggaacagauauagccagccauuugaagcuauuucuuuaaagcuuguggaggaggccuuggcucuccguccgucccuacugacuucucagucaguggacaaggguccuggguauagggacccagaaugacucagacuaggccagcagccuuguuuagagaauucaauaccuagaggagacccuggauaagggacaggccuccgggggcugcucuggcucacacugcuguagccuugacaagcuccugacccugugucuuaaucacacaagguaagagcaaugccaucgugcagggucaaaagcagagcauaaagaaaacugucacaugacauuuggagggacccaggggaagggacuguugggagugcccacaucccugacuuauauaacaugaagcaucccgucccacuccuguccgcuucuccuuaaccgcacucacugcuaggguucagccccugugcccagcauguaggcauuccuugcugcacaggugaccugggaggccagcggggguucugggcccaggcucugggggcugguaacuucagcuucccagcgcugggucagaggcggagcuguugcucacuuucuucgccaguguucuugucuaugugagaggcgggugcgagcgacaaggagacauuuucgagggggcuguggaagguuuuuuuuuuuuuuuuuacacguguagucagcacacaauuaucaaaggcaagcagaggcguagaaaauucuaaacaaaggcugcaccagaagccacucuggcaggcaguaaaccugcuuagucagccacugcaugcauacacagcauacucaggagugccccccaaucugccugucgccccagccuugaugggcuaaggacccauggugugucuacagacgggagcugagcauuggucuguaggacccccucguguguuauaacccacaguucauggcagaagacaucauuguaugucuagcuucuuccucuaaggugggaaacagccuugagggacugugacgccuugagggacugugaccuggccaaagcccuacacuaaguugauaaaggcaguccuagaaccagugucacccaugucccaccuacugugcccuccgucucauuagcagacuucagguccucuccuuagcauucugggaucucugucgauccacaaacauagcuaagcauaggagacagauagagcagagugaccccuggaucucaguuucccauuuaugcaguuguaaaguacacccccucaguugucaugcauugugcaagaucucacccucagcuuuccagacuugugaccuccaagaccugugaucuacagguaggaaagaggccuccucgggcuccacgccucagaagcccaagaagcucaagaagagcaccucaagcucgccggcccccacacagacacugccgaacagcaucacccagcgccuccuggagcaggccuggccccugagcgaggcgcaggugcaggccucuguggugaagguccugacagagcuucuggagcaggaacggcugaaggccacagaggccaucaaggagagugggaagaagagccagaagcggaaguuaucaggggaccuagaagcuggggccccaaagaacaagaagaagaaggagcagccagugcccagggcaagcgcuguuuccccagaaaaggcucccaugacuuccaaggcaaaaucaaagcuugacaaagggagugcugguggcaaggggaaggggucuccuggcccccaaggagccaaggagaagcccgacggcgaguugcuggggauaaagcuugagaguggcgagcagagcgacccgaagagcaagucgaaaaagaagaaaucccucaagaguaagugacugcuuuccaguacgcgcugccggugcaaccuggguggcagggcccugccccggcucuuuaucucauucuuuccacagagaacaagagccugggaagugguuuguccagaguuuaacaagugucugguggcaaaggcaaaaggagacuguagagcuggccugcguccccugcccccacggccccuuacaaugcccaguauuuagccucaggguuuggaaaacaaacucaaccccggcuucacaacagggagcucucugcuccagcagaguccacggccagucccugggguguggacuguccccuggguucucauccagagcccaucuuuacucuagaauucaguucuuuggugaaaacagccauucguugcccuccaugcgggaaccugcacccagcaggacuucugagucacucaccagcccugggccucgggcaguguuguuuuccuuuucuaaggggaaagcaggcucugagaaggaaagaccacuggcgcuaggcagucccugcuuuaguuuugucuuaagacagggccucacaauguagccuugaccggccuggaacuuucuguguagaacaggcuguucucaaacuuacagcaauccaccugccucugccuccugggugcugggauuaaaaggguacucuaccacgcccagcauggaaguccugagcacugccauucuguggcaggagaugugucaccugaucucucccagguucuugucccuucccucacacucaagauuagauagauagacuugcauaguucugaggccagauuguguaguccacagucaguaagaguggagccuggcacauggaugguauccuggcccuaucagggccugauguuaagagccgcgagcugccgugggccuccugacgcugacccaucagugucaaaaucuauugcucaggaagcucgcuuucuucccacagaaaaaaaagacaaggagaaaaaggaaaagaagaaaggaaaaaagucccuggccaaagacucugccucgccgauccagaagaagaaaaagaagaagguagauugaguuccugaggggucucagggcuaggaauucaaacccuuccccuucuaacaccuagaccaggcccaugccaccuuuccagucccuuaaucuaauggaccuugugaggaggagcaggggaggggugaugggagagaccuccacaggcgggacaauggucagcuuucagguuggcuggccagcggggagcccacugaagaaacagccagccagccgcuuccugggaucagaggcaguucugcccagggcugguaucagugggucucgauccuuacaccuaugggggcguggauccuucgagggaguucuguccuggaccugugggacagcgguggugaggagaagccacagaacugauagcuugcuuccuucucuccccacagaagaagucagccgagccugccgugugaggcccaacgcauagagcagguaccugacugcguccagccuuucugggcagcuuggguaggcccagugggagggaguuggagagagagagggagagggagagagagagggagagagggggagagagggggagagagggagagagagagagagagagagagagagagagagagagagagacuucuuuccucagguugguuggacagcagcugcugcugcagcaugcagaggguccacccugagggagucuggugccuaagcuagcugccgcccaucccucccuugguuuuguucccuuuuguggagauaaaggucggcaaagcugaccaaagccugguuuguuuucuucuccuagaaucuuggcagagugugaccauccauccccaggccucugaccucuggccagcgugaauugggccuggacuuuuuaacuuucccucccucagcagaagaugauggcuggcgcgugcuggccaaaccagugaacccgcagggaagcugcaguaccaggaggaagcgaggugggacacacacccccucugagugcuacgugacauguguauaguauaucuauuuuuuuaagcgacuugccucucucccuucaaauccaccgugcccagaggccuccggaccucccuccauguuaucugcagagccagcaaggucccgcgugugguucaucccacacccuggaccccuggcgcagccugaagccuugccccaucaauuuuuccagcuauuuugguuuuguuuuuuaaagaacucagaauaaaagacuuuaaauauaaagguuugccuuccccaugc

SEQ ID NO: 8938 - RNA, 3882 nt, Mus musculus
ugggcuuacugucccguguuuauucuguaccggauccaugacaguggucgugcuacaaaguuuucuuuaaaagaaucacauuagggcuggagagauggcucagagauuagaaguguguacuccugcagaagacccggguucagucuccacugcgagugucauggcauaacugccugugacgccgccagcuccaaaaggucuagaaaccucuuccggcuuccacgggccguugcacugaggugugcacacugccccacccccgaccagcucccagauaccuaaaaauaaaaucuuaaaaauaaacaaauaaaacauauuagaaaaccaaccaggaaaaaucgucucauggaauaagcacagacggcagucccuugugguuuaaaaaucgaaacacacaggugguccugcaaggacuccaggugaagcccaguccugucgcucagaagacauuugccacauggccaagagagaggacaugauuuguccaagagaagccacaaagcacguugcggaccuagaucuguuucauucuggugcccuuccuuugcugaugaggccauucugucaccauagcagcaacuccccagccucuggacuugcauccccgcuccaggcuugcaccucucugacugacuguauuuuaauuuacagagauuucaagcauucucccuccccccaccccccaacacacaaaagcaguuaaaggauagguuacauuuuauuuuccuuuucuuuuuuaauuuuuaaagauuuauuugucuuauguaugugaguacacuguuguugucuucagacacaccagaagagggcaucggcucccauuacagaugguugugagccaccaugugauugcugggaauugaacucaggaccucuggaagagcagucagugcucuuaaccacugagccaucucuccagucccagaaguuauuuucuuaaagaaucagaccugauccuccucacugaauguggagacgcuguucuuaagagaggaagcuggaucuuggguccucuuacccuacucugguuccccacaaaugggaucaucgugguugucauuaugccucuguccucugggagcgcuguuucucugcugcuacccucuagucuccacccagacagagaccaccaagggguuuaaauucagaaagaggcuccuguuucuggccugcuuccugcagcaagugucaucucagcacuggcuccuagacucuaagcuuaacuuuuaguuacuucucaggaggacucauaggggcaugccccaguauagccuuucuguccuccagagcuaccuccuauugucuguucuuuccugcccagcaucugaccuugucucccaccuuguccaugagaaggggguauccuggaagcugcuaaucuggucaagcaacaccauguuaugucagggucccugggauuccagccaugagcaauaaugacagagcuuagcccccacgacgacgcugcuaaacuguuugucccuucuggaauggauugggaccuggcaugucccaaaccacacacucugagcucgacacuucugcauuucuuucagaaaucaauaacucggaccaagugagaugguagccuuggauuuaauuuccauaaagauucacagacaagucccugccagccucaugcaacacauucggggacauuuagggaagccucaugaacuuuggaaaggggaagcuuggugaacuuuaaccucuagaguuaccauaaggaucuacauucucugugucugagagcucagaauccugagccuguuacucuguuuaucugguugagggccugggcacacaaugauuacaauaccagaggguggcugccacuaguugcuucuucagucuggggggguggguagcuuaccuucuccaggacauauguaguucacaaaucuuuuuggauaauagaaucagaauguguggguggggaagaaagauuggugucacagggucucaaaccggggugucuuggguacgguuggagccauuauuuggguuacacuaggggaaguguucucaucugagugggagccugauggugucugucuaccccugggucacuguccuccugugcuuuuguuuuacaucuuaaggaacaaugugagaguuucuagaauacuauggugauguugaaaauggaggugggaaccagucccaggcacuucgguuaguugucaugacaacaagaucuucccgugucucucuagcccuagagagcucuaugaccucacuucaugaugaccaauacaaccccccaaagccgaaaguucgaagacucugcaauuccauuuuccucaaaccccccacuuauauaauucaguaguccgaaauaagaguaaacacagggugggagaugucuagauuacagacauuuccgguuugcaaacuguguuacauuugacuaauauaacaguaguuaaagugaaggcuuuucauaugaaaacccaaaagagauuuccacauucucuugagcauuacggugugaaacccauggaaacccagaggagcucugggcaaggugccuuguagggggacauguguccucuucaucauagucccccucacucccuacugucucccuggcccagagguagagacucaguugccauuuaccaucuuuuuuuuuuuuuuuuuuuuuuuuuugagacaggguuucucugcauagcccuggcuguccuggaacucacuuuguagaccaggcuggccucgaacucagaaaucugccugccucugccucccgagugcugggauuaaaggcgugugccaccacugccccuaacugccauuuaguaucuuauacucagcucggccucuaucguuuaacuggucccaauagggaucuguguuaaagaaaaaucaaccuuaccugguucaggaaauugucuggaaucauguuuuuguauggacaagacacugauucuaaaauccccccauguuugaacaauucggcacguccgaagaccacuguaccuuaucugggaugugguauccuguuaucuagguuauguaaugguucugccuugacuccgggguagccgaucccuguuccagagaucccccugcugcaaaggcgucagguagacacagucucccuccaaggggaagcuggaagcugagagaacaauggaaugaggcaggaguuccucucuccaccccccuccccacccccuaccucccucccucccacccccucccgggguugccucuccucagccccucccguuccugccccuaguguggucccggaacagcaagcccgugcacaccaccauccugaacccucacauccaccugaugggugacgagucagccugcaucgccuauauccgcaucacucaguaccuggaugcaggcggcauaccccgcacggcccagucagaggagacccgcgucuggcaccgcagggacggcaaauggcagaucguccacuuccacagaucuggggcgcccuccguccugccgcaguaaggauucuuucuuccugaaucucuggggugcauuaaggguauugccuuaguagaggggcaugccccaggggaguggagguggggugaggguggaggagcaggcugcugccuucagucuccaaauugcuccagaagggugagaaggcuagagaugugggagaacuggguggaaggcagaaucgaccacgucuaagguuguggguuuacugugucuuacaguugaaggaccaggccagggucccugcguccuugcuucgcagagauccgcucuuuguccguggaauguggcugcugguucuccuuuggauuuugcuggaauucucccugucagaucacccuaccauugccaccuauguacucgcgucacgaaaaccugcuuguucacagaagucgccacgacaucaca

SEQ ID NO: 8939 - RNA, 39927 nt, Mus musculus
uggugguggggcagagaaagcccacaguggugugagcucuggggcugucuguggccacagucccggcuacccuaucugggaccuaggauugcucugggaguaacuuugagagagaggagaacagagaggaaacaguccagagccagagcgggcccagaccagucgucagucuccugccugccagcuagaccuagggcggccccucgggcugcuccgcuccucccggaggaugcuuuuggagugaggaggggccgggcugcuucucaccccugagcacccucuccauuccccugauucucucaggguuuuccgcaaucaggccagcccuucuacugcuguccguuuuuuggguccagcaaaauaacagaagacagcgagguggacuuccuggagggggugauagcucacaucagaagccaucuguagcccgguaaguccagggagaagaaaccccaucccguguuuucucccccuguuccuagcccgugccucuuuaugcaggaaaaaaagaaaaagaaaaaauuauaacaaauucagacgggagaggcagggacucccuuugauaacaggguugucccuccauccuccauggguggcuccugcucccucaauccugcugccuacccaagucucuucagacacccacagagcuuucugggcaccaauugaacaggaccuccaaggcacagcaaagucugugggggauggggagagguagcaggggcgagagaggagaauccagagguagccagcugcuuuugcagaagccaggaccucaggaucauagccccugucccucggaccuagccuaagacuaagucuggccacaggccagucaaccuccaggccgacuuuggagaucuuaaauagauuugcaaauuuuccagauuccugagacauccuuccaaaccucuaaccgcugccgagaaaacucugggucucaaaguucuggauggagggaaguuuacaaacccgccuaucggucaugugucugggguggggucuaguuccgggcugucagaucugggggcuccucugugaggagggauuguagcugguuuccuucugucacagucuguuguuuuccuauuuguccucuccuuuggugcucgcucacucacucucucacucggcucuuucuccacccuauccuaaaaucugaacugagucugauaacacuuccucccucuugcccaaaucucucugcuucuccccagcaucuauagacuggcaagccccaccuucucacuacagaaggaccaaacccagcacucugaguguccccugugaugcucaccugcauccaggggcauggaugcuuccuuucucuauguugaugugacagacaccuaacuggagccacagcccaguagcagggcugaggugacuauaaguuuccucuaccccacggccccagacagaccugggcccuuggucccagccugcuuucuuacuuccagauggucagauuccagcauuugugagaggaauuuacacuacccugccuggaggcauuugcccuccccucauccgccucggaauguucuuccucaucauuucccucuccugggcccuccaaccacgucucuuccaggcagcccucccugguuccucccaucuugucuagcacccuaccacuggccuccacucgaccucucugccacuguuugcacagcacagcucugugccugcccugcuccccgcuaucccggauccagcucuggguugucagugggaaugcgguguccaggaggaaggauucacugaagccuccaaccaaccuuuguaaagugaucaguccuccccagucuccagggaaagagcaaucauggugucacugucacagugagccuguugcacguccacuuuguauuccuuacagcgaggcuuccuagccaguuuuguuaccccuguuuauggaaaaggaaacaaaggcuccaggcucacacagcagagcuaguguucaggccgaggugcaaguaaacccaaggcugugccccuaugcccugguacugcagcaucaggccgguuucccuccuccuucuccugcagagcuuccuccuggcuucugucauccccagcagaaaguguagcaccaggccuagaugcuucaagaccaccccccacccccacccccaucccccgccccaaugucugguccugagcaaggagggaggcugucuggcaggcucacacacauuugcauggcagagugguguuaucagcagcccucuuuccucugugggaaaaaaagcuggacuuguaauugcuagcagauguugggaggcuguggaaagcccaggggauuuaaagucaaaagcccauucuuacauaagcacccuggggcuagccuggcaucucugggcugcuccauaccuaggcguugugagcacacugaucaacagcagguguuaacuguuuguuuagagacagggucucucuaggaagucccgacucuugacuguacugccgcucacuauuacagaccagauuggccucaaacgcacagaaaucugccugccucugccuccugagugcugggaccaaugguguguguuacuaugcccagucauguguuaauuuuugaugugggcugaguguguugccucucugggccccauucuucucugugaacagugugacaguuugugggcuuagcaagauacaagauguuagccugauuacugcaagcuguggccacagcugaggacagccaacacucaccacuuccuguacaucagcauccagauaggaaaaugaucuauagcccuagaaaccucugacuguggaagggaccuagacacucgguaccuguauacaggcuggguuugagacuagcugccaucaggcugugauagggaaccugguuccagaccagcugcccucaucuuuuguucuagguaggccccuuggugugguggagaggaaagaaagagaagccaccagauauuccagaaagacgguucugcauccuggcagugggguccuuggaaugggacuuuuuuuccauagucagcuuacccuggaagcaauuagguaggagaaaggagucguugcuccccagaggcccccuguggccccucagcuaguaugggcagagccaauguggaacaguuguuagguaugcuuuaaccuugugccuugaagaaaccuugaaguucucucguugguccucagugcuuggcauucacauuugcuaggcuaacuaaaucuugcaaucuuaaggaguagauacaaauccaccccauuuuacagaugaggaaguaccugaggaggcuuaaucaguugcucagagucccgcagacagauaguccccagauagggucugggcuuagcauuuggguguuucuggcuucagagucucaugaggaaaggcugggugggguccgggacccaguauaaacuccaagggcuugucccaucuguccacagcauuccagaaaggggcuccaaucccagaaggccaugugacagccgugggccuccguccucucucagucaaacaaagagguugaccccgaugaucacugagcuccgugccaccacagaacaauuccaggauuccaaacccugccagccagcccagacuggcagcggcacaagcccugcuguguacucagggaucaugcauauuuaacuuuacaaugaaaggguuuuuuuuuuuuucuucuucuucuucuucuuacccuuucucuacacauugcagaaagaggucuggaucaauggcugcuaauggaaaaccuuaaccugcaauaaggaggagaacuuucuaaccuggagaggcuccuuuaaugcacucgguuucccgucccaggguguguuccugccagcuucaugccuauuucccuaagagcaaggagggcugugugagaaugaccuguagcuccuauccagggcugagcuauggaagaggaagcaggcuuuuggcccaaaacaaagaggggcacaaacaggaguggugucuuuggacccccagugagccaccccuaugagagcaauacaaaauucacacacuugccacguguacagaaacccucuagguauccuucccccauaaggcuuagggucugagacucagagaacggcuuccuggucacccagaccuggccccaaggcucuucuucucccaagcacuuucuuaggggcacagauaaugcuuagucugauggaggugggagaaaaucaaaguaugucuguguacagcuuuaaucacauuaauacccucgcuccuucugccucggaguaugccuguuugauguccugauacuuggcgcuuucaucugcuggauguucuagcuucuccauucugugaugggcagacagcaccgucccuggggaaggucagaggcucaagaauuguccgaaugucagagaugaaaagguuugcaggucucauuugguuugauuucccuaugguaugggggguggacccaaggucauaaauaaaaggcaggaugaaucucaagccgggcagaucacagguaaugggagcaggcauguguccauaccaccacccaaaagacacagagggguccccgcuccaccugcugucuagggaccagccuucaugccucucugggagauaaagcuacaggacaaauuuuugcagaagaagaacaaagcucacccccacuccaaaccucuccuugcuccaggguuucaggugucgcagguuggcuuggccuucguaaccaaggaugaccuugaacuuuccaauccuccugccucugccuccuaagugcuagguugauaagcguguccccccaugcccaguuuucuauagugcuggggaccaagcuuucuugcauagcaagcacucugcugacucgggcacaacccaaagagccuguuugaaggaugggacgcccuggugugguuuucuggauuguagaacucccagacccacuccuucuccauucugaccauaggcuucucuucugugaagaagggaagaggaggggaaagauaaauggcuccagcagcccacccggcucugcuucuagcauugaaagcccuuucugggugccaugguggcagacuccuccuuuucuagacagggucuuauguagcucaggcuuaccuugaacuugauacucagaugaaguucaccuugaacuucugaccuuccucucuccauguccuguguggaggaggggcaggcacacaccaccacucagaauuuaugcagaguuggggaucaaccuggaguugcucacaggcuaggcuaacacucucccaacugacccacauacccuguuccuccugccaggcuuugugaggccguuggucacguuuuguuggggaccuuauuacuuuucuuuucuggcaaguggguucccaagagcuguagucccacaagcuccuccgcuuuccugaggcugagcuuaaaugguacagaggcagcagggaaguucagaccacuccagagggaggccagccuggucuacagaacagccagaacuacauagagaaaccuugucucagaagagaaggaagaggaggaggaagaggaggaggaggagcaagaggaggaggaagaggagcaagaagaggaggaaggggaagaaggaggaggagaagaagaaaaggaggaggaggagggagaggaggagggggaaaagaagaaggaggaggaggaggaggaggaggaggagaagaagaagaagaagaagaagaagaagaagaagaagaagaagaagaagaagaagaagaagaagaagaagaagaagaagagggaggaggaggagacaaaacaaaccacacccccuucucacuuuauaccugccccacauaauauauaccugcuucuguugggggcuucuggcgggguuuggaacaacuuccuucuguaaacaggacucugauucugucccugugccagcucacaaccucccaugaaauaccugcucaugcuacucuccuaugugccccacccccacccagguuugccauuauggcacucucaccuccaguagcuagccauucgccaucacuguuaaaccccugaaaaaaugauucauugcuauauccaaggcaaaggucaaauccucacccagugccccaagccauucccaaaggcuugcccuccuucccugccugccacccauaacuuggcugauaaaccucaguucuagucuaauagaccugucgcugccuuucaccccacaugcccucccacuucccaaaggucgcucacacagaaugcugugccauggcuugcccuggcaucauucgucauagaacccaacuaaaccccagaggccaagccucacagaaucacggcagcuaccauuuacugaucggggaacgacgacacaggcuccucaucuccucuaacugccauagcaacagcagaaggcucucauggcacucuuccggaaacacaggcacaagcuaaccucagagcugccacagcaaguccagguaggagaacugagauuugguguggacgaaguagcuuuaugauggaaaagcucucccagccugccugagcucccgugccauuucccuauccugggugccaucagggacagcccacuggcuucaggauaccauacgucugucuauucugcucccaacagcugccugucuuaucaccaagaggaaaagagucacccuugucugcccaacccaguccccacccuagaaaauacugucacuaggugauagcugaggaugaggcuugaagaagagaagggaucacuuugcauagccaauccaucccgugcuguguaggcgucaacgaagggagcacugacuacagacaggcucaguucgacauugggaauuuggagagauacaaaauaaccauuagguuuguucugugguuuguggaaaaucaaauugagggcuagaggaggcuuaggugauagccacagaccgggagacaucuaucagguuuagcuuauccuuaggcugaccacucuguggguggcugaggacacuucucacugagccucagaguagcacaggggaguggagcuguggcaaccucauacugucgguggcucccacuucccaaggagcccuggcagcuucuacuucccaaggagcccuucucugggccuucccaagccaucuccuguauuacugacuucuuuucccugaccacacuagucuaccaggucucagcugugcauucgagacaggcugagugagugaguucuccugugggcagagagggguagagaaggugaucucugacuuuguauggggguacgagguccuccuccaaguuucugcucgcaugaacuucauucacagucucaguguaaaggccugguuuacagccuguuuuaaggcccggagaaggaaccaugaagaagucgaguuaacagucagagggagaaccggagggugaagcaggaagggauagggaagagaugcugagaacguacgggagaggagaaggaaacgugaacacacuuuccuucccaauucacugcccaggagggcucugaggggaaucucaaugcucuauaauuggcacggauuagugucgggguuucuucguagccagcagcuccugccuggucugugggcuaugggcuggugggggaaggccgugugcuggucuuccaggcuugggauucgaggucugcuugcccccugcccacuuggcucugggagcacauuccccaugagcuucccccccccacccccccccagcccacggcugaucccgaugguagcagccagggaaacagaagguuugcuuguuugcgccugcugcacucaucccagccccagcccaggaccccucucaggggcuccuuuggcugccagggccuggugcucucaguugccauggcacuagaugaggcucuagaggggggugguaggcagggagggcagccgagggagguggaggcuagaacucuguagcuucccaggcucuggccugcuguggguauucuaggguugcuggagccauagaggcaggccugagguagagcuggcaacucacugagccagacucccuagaugcucuaucucaauggcccuaaugacaagacuaaacagguuuuucucugaaaggauuuccuucuguuuuuuggauagaaccuuacuauacagucuuggccugccuagaacuucgaauguugaagcuggccuuggacucauagagagcuuucugcuucugcuucccgagugcugggauuaaauguguauaucagccaccaugcccaggcuauggguccuucucuuaauacccuacugaugcucagauucuauggugacgucucaaaggggcucugacuccugucucaccuugucuuuugaauugcuucaugaccagcaggagcaggucccccugugcacugcccucaguuguguugcguggauaccauguguggauacaacuguuguguggauaaaaugaaaucugugggccacuucauuaaacagaaugucuggcucuacauuaguuggggcuuucauuugucuucagaucggaacagugggugggaagaaagguucagaggcuaugggaagguugguguaagguacagaguaagacagacuguacucaccauaguaaaaccacugugguggucugcucucugaggacccugagcugucuagguagaaagggccacaggggccuuggugagauuccugucucaggcugugugcaauugcagagaagguggggauuaaggcaugugugaccccuacuggcccuaagauuguagcauguaugacugucaaugucuuugucuuuggccuagcucaaaagagagugugaagaccagaauaggaaugaacaagcagcagucaugugacuggcaugcaguuggugcugcuugggcuucuacugucuguucuguaggcguguucaguggauaugagaaggcugguagacagaagcagggaccaaccuguuaguccugcaggagaggcagagagugaguggguggguguugggucuguguguuagagaggcuuggggacagccuaccaaggauuucgcacuguaaccuucgcugggcaaaugauguguguccuuucuagaccucaguuuccucaucugugaagugggaaugcagcagggugugguggauuggaccgagaaccugacaagcucacucucgggagagccuggaacagguggcaggcaaggucuuaaauaggccuucugugacugugcaagggguucugagcccagaggggauggcccaagguagagcugcuaccauguuggaacuccccaaggccaucuaaguccacauuucuucugaaauaacuaacaagggacgccucgauuaagcccuggagacuggaagccaggggucccagggcaucugcagagccaggcuguauggccugaaacgaagccgugggggcugagccugaggccggcaaggcgccugaggcagggggcaggaagugcuugcucugcaggcgccugggcugugggcagaggcaugguuggaucucccauccuccucucugaccuccuucccaggcuugguucccagcaugcauggggacccagguccccucccuggggccccuagugcugucaggcacacacugagacuuucccacaggcuguuagaaugucauucaauccccagcacacacacucugugggggcugggguggggguuugcgguugggggggggucgguuuguucuuuaucugccugguuccuuuccagacagauguuucguuuuauuuuggacuuccagaaaauaggggccguuucuuuuccauuuuuuuuuguccccuggggaggccuccaggggagaggagcacagauugaguguaguucccuggggagcagaaaggacggugaccuccauccuggcgauggucccuauagccgcuguggcuccuaagcggccugugccugagggccacagagagagauguggacaggucagggggauaacaggaucagaugggagcuacagagagagggagugaggacagaggggacaagggaaacuaaguagggaggcaagggacauggagaugcuccugagaccccauggaggggauucacuauggagugacagcaugcugggacuucuccaguaaaaugugcccuaggguggagggaugggucguuuccuccccagguuucucacuccacuuauaacuguacccucacccuccagacccuccucuggcuccgaggauuaggguggagcggggcagcuuccuaacugguacuauaaggucagcuggcuccgggaaggcuagaagugccaaacucuguuaggugcagaccaagacuauugucacuugcucacuguccagcugcuggccgaggauuuugucccuggcugcagauuccucacuccccccccccgccccccacccccgccccaacgcccagucuagaacuggcugacucuucugagcugagucauggcaucccagucuggguugaagagacucacccccacccucaccccuaacccagcauuccaagcucacggggcaagggucccgagagcuguaaugucagucuggagaguuuucccacucuucuuguccugggcuguaaaaugggacgacugagaggcgauaaccagguucgcguccaucugucugggggcugugaagaagccuugauuuggaacauaggacaaagccaggaagcaaguuuguguccacuuuugucagugauuuuuuuaagcaggucacaccucugaaucucugucacgggucucccccugucugggucagguuaaggaaagugacuguucuguggagagacagagcuugaugauguagcuggacccuagacagugagcaggcgcugggagugggacccaggcgggcaggugagcuccaacggcccauagcccacuagagcccauccugcugagagccagugggacgucucauuucccuggcccaacccuuagcuuccccaucuguacagugagccacagaaagggauagguagauguuuccuggccacagggcacuggcauccaaagauucugaccuugugaccccaggauugggccucccgcuuggguaucuuguuuauucagaacuuggugggaccgaagcuggccgacuccaccaaaugccccuuugaacggcagcuggcuuucugcucucccaucccaucguguuuuuguccgaccugaccucugccccgacucagugccaacaaaacccuccacauuugaaaccagcucugcggccacucuuaagcccaaguauugucucauucucaucuuagaacaugguuuugugcuccugucguaggcacucauagacuccauaccucugggaccugccucuuggguccuucuaacaugcagucaccaaguucugcugacccucagggacauucaucucaaagccaucugucucagucaguccccacccacuacccucugcccaaccacacacuguaucaagggaagccagcaggggguggcaggcggugagcaggcacgcugccucguuucagccucuucguuccucuugucuggucugcauuucuuggcaauuucccaaaagcaguuucugucuucguucucuuaccaacaaaaugggaauaauccuucuaagaguugucagaggauccagugagacugaacaugccaaguacuguacagcaagaaaggcuuggggcuccuuuaugcuuguucacagauacgugggcagagggcgacugugauuuuguguacacauggucuguauauguccuauguuagggggcggggggauuacaugaguaacugauauacacaagggcgucucugauggacaccugguaaaguuuccaagcauccauccgugcaguguacacgugcacugggcacugagggggcugugugcacgugugucuggugugguggugugggcacgcacaugguucgugccugagugacggcugggcacacacccgaagagcuacacaugugugcagaagaaugugugugugugugugugugugugugugugugugugugugugugugagagagagagagagagagagaaagagagagagcguaggcagcaucugggcugugugcauguguucgccguaugcaggacuccuuuuggcagcagugcaggccccgcucccccacccccccuucccaggcugcuugugucgugggagccucaggaccccagggaggaaagcugaugcuggcggauguggccaagauggguuagauuuauuuagauuaagauggugggaaaggagugggaaacucugagugcuugcgacaagcgggaaggauggcccgagccucugaggaugacuugucccccuggggcucacuccuguucccuaaggggugucucacagcuguugugagaagcugagcagacucccaucucugaacauggccugaagaggacagcacugaggucuuccugaccacagcaaggcagugguauguggguuuuuuuuuuaacccacucugaugaguccucgaucuguagcuugcuguccaugccuucgucuauaccccaaguucauuugaugggaugucaccugaaaagucaucuaacucccagcgguguagagaaaggaacuguggccauuuagacaaugugucugaaucuacacccuggaucagugagaugagaugggucauggauucccagguacuguaagcuuaaacaugucaucuacauucccgaccagccauuucuucuucgggccgccccacugagaauaaugguggccggaacuuucuuuuugauaagucaaacagguagaacuuuugaauagugacagcucuuuaagaucacagagcugggcgugguggugcaggccuuuaaucccagcgcuugggaggcagagaggcagguagaucucugaauuggaggccagccuggucuacagagugaguucugggauagccaaggcuacacagagaaaucaugucucaaaaacaaaacaaaacagcaaaacaccaaaacaaacaaacaaacaaaaaaccaaaacaaauaaacaaaaagaggcucaucacaaccugucugggaaugaauaugcaaacaagucccaggcuggcaggagaucgggucauugucacagugugucaagggccuggugaggggagccggucuuauuucagagagaaucagacuggcaucauugacuugcagugucccuuagcuccugugcuuugucuguucuccugacagcuggacuccacuuugugucuaugugaccugaucacaauucuaagccucuuugggucucuacuucacauucaaggcuccuucccaacuuggaguccuuacuugcuaccccagccuuauuccuugccagagagggccugagaagggaagauggagggccacaaagcagaaggguaggggaacugcaugccaugagguuccagccuacagggucaacacagccuaccagagucaggccagccuccuuacagugaccucccauccccuggccagcaggccaaauuccuccuuuagaauaauaaacaguguggccagccagggaggcugggaggggaggggaggggaggggaggaaggcugagaugagcccucccccauccugggcugcuaaugauuuucuuuggcccacaucucuggcaggaaguggggagccagaggggcacccaccaaggggaagauggccucuguggagccuguuggcucugcacccaaaugccgucuggucugugcagcuccaggaugccugguguccagcuggagggucggcaccugaggguugugaugggggaggacugagauuggggcaucaggaagggacauucuaagaggagaaacucagggccagagggggccucgggcaggcugucugaggauggguuaaagaaggaaaagcagguuugugcagguugcuucuuagggucucgaacagagcugggguaccgccuuguccgugucucgugcaccacuugugacuacaguccuugcggauggugcauucauuagcuccucucuggcuggaggcucugcccagagacuuggcccaggccauggagcucaugaaaccuggcuccucagccuugcauagcaaacuagaaagagcaacgugauggagcacaaaggagacaaacugguccaggcugggcagccuuacagucucaggauucuccuuguugccugucacaugacugccuccuauguuucuugaucugugacucugaccauacccggcuauuggcaauuaucuggaaucugaggaagauugagaggcuguugagaggaaggaaggacggacgaaucaaagacucacacgauacaacaugcccuguucccaagucuccucucucucucucucucucucccucucucucucucugucuuucucuguucgcacuauucagcugucucccucuugaacaggcucuguugggaaccuuggggaaacgucuuuguuccucaguuuccccauauagacacgguagguggagguggaaaguggccuccaagggccuucaaagcuugaugaauuagauggggcuaagaaccuggcuccucucuccugggccuccuuugcagcucugugcugaguaggggggucagcccacucccacauuccacaguccugacccccgcccccuccccacuucccuucccacagacaucccauuuccuguugugcuuguagagggagccgugggagcucuucaggcucuggcucucccccuccuacuccuccaggccuuucaucacacuuucccaaauauuuguccuggcagauaagugccugguauuggaacugucaccgggaggacggggcugucagagcuggcuggcccccaaucuagcccaauucccccaccuccauugucacauacagggaaacuaagacucauaggcuaaggacucaaccaaggucauguaagauguggaagcagagaggagagcauuuggggaccuggaugucuucccagccuugagauaggaggauggaugcccaggcagaguugacccuacaggagccaggucuaaggugggcccuggcacugccuuugcccacacuggacccugaucccuguuuuacucugcaggacaccauggggcuuccaggagugauaccagcuuuaguccucagagguaaguaagcuggggacaagggugagggcuccaaggaugccccuagggagcuggcaauggugaugcuugguagacaccaugaccugagagucuggaagcuccacagggcucuugagccccgugucccuggauugggagguggucuguggaggccucuuucaucuguucagcuauuagcuuuucuuuacauccacacaauggaucucuccuugcccagaaccaccagcucaaguuccuugcuuauucuccugcauucacaguucccucugagacaccccagccuccccuacuccucuucaguccagcuggaugccugccuuaagcucuccaaggucugggcaaaugcugagcaucaucagugaugagccaguggccugcccuacugaccacuguuugauggcccugccuacuggcugcaucuguccugacuuuuaucacuagagaacaugaggguguggugaacaguggugaccauagcagcuuaucccaauacucccagaaggugcaugacagaggcaccaauuauuugacacauacacaucuuaacccuccccagccccuguccuucaagcccccaggggccucaguaucuuaauggcccuaagucugccccaacucuaagcuaggugagaaccccuuuccuauggucuagucaacugugagcucuacaggaaccuaagcaucuacagagaagaggaccagggagugacccggaaggcaaugcaggaacuggagguccagggauugcuuccacaggauuuccugccccuuucuccugugugcugccugcacauagcauagcugagggguuuggaggcuggaguccaaagaggcagagaccuaggacaggagcccuugagggccugacaguggucaagcaagcagcuugcguugaaugggaagauguacucuuuaaggucuuggaaguuagucagacaggcuucccagacagcuuugggggagggguuaaggucuccuugcccugaccaugacgugugacucuuucugcucaaaggccaguuguugcuguccguguuauggcuccugggaccgcagaccucccggggccuagucaucacgcccccugggccagaguuuguucucaacaucuccagcaccuuuguucugaccugcucgggcucagcuccggugaugugggaacagaugucccaggugcccuggcaagaagcggccaugaaucaggacggcaccuucuccagugugcugacacugaccaaugucacugggggagacacuggggaauacuuuugugucuacaacaacucacuagggccggagcucagugagaggaagcguaucuauaucuuugugccagguaaggacacuagccugugugccuauuccuuuacccucaucuauacagcacauagcacaaaagaaaacuugaagacuaccucagggcucugugagaugcagccuugugacacaggcaaagagcagcauccagccuggcucaguccaggagcaugcucuuuccaccgguugucugcucgcucccagcccucucugaucucgccuuccaagaauucugcauucuccguugguuucaaccuguucauuuuggcucccauaucccacugacccguucuuugagcccuagguagcuuaugaccucuuuacuccucacucuaacuccagcccugucagcaucgaaugaagaacaggaaaugaccagugagaacaucuucuucagucucgcugugcuccuagaacaggagauccaagaguauuuguaaaggacagaauugaccagcacacuguucugguguggcaagggccagcaucuagcaagggcccccucaagaucuagggaccagcaucuggcaagaauaucuucuuuauuuuuuuuucuucucuucucucuuccucguccccccaccuuggucucacacguagccuuggcugguacggagcucacuguguaauccaguuggcuucaaacuuauagaaauccaucugccucugcuuccugagugcugggauuaaaggcaggugcugucgcacugggcaucuuucccuuaauuuuugaggcagugucuaguuguuauauggccagcgaugaccuugaaccucugacccuccuaccugcaucaccugagugcacuguggcaccucuuucaugaaugcuaggcaggccaucuacccacugagcuacaucucuagcugcagcaaaagccuugcucccuuauaucauggaaaagacugaagggcaagaagagaagaggaggcucaacuuauccuuuguaacugcaccaauucgugaugccuuuaagaguaauccacaugccucugcuuuucuuuuuaacacuggggauugaacccagggucuuggccauacuagggaaggauguuaccucugaacuaagauuuauuuguuuauuuuauguauaugaguacacuguagcugucuucagacacaccagaagagggcaucagauuccauuacagauggcugugagccaccaugugguuguugggauuugaacucaggaccucuggaagagcaggcagugcucuuagccauggagucaucucuucagcccuaaauuaauuauuauguguauauauuaauuauuaauguguauaaugugcacucugugugugcgugcgugugugcauguguuuguaugugugccugugugcgcaugcauguguauguaugagugcaugugugugugugugugugugugugugugugugugugugugucagccacacgaaggccagaagaugcuguuggauccacuggagcuggaguuacaggcaguugugagcuacuugaugcaggugcuaggaaaaaaaugucaaacuguccagaagagcagcaagugcucucaaccccuaagccaucucuccagaucccacuauuauugguuuauuugguuuuuuuuuuuaacucuuuuauuuugagguagaguguugcuagaucaccaugacuggccuugaauucacccaggagcauuggcaggccucaaaucuacaguucucuaaccucuccauucugcuucacaaguagcugcgaggccaggccuucccacccaguccaucugacaaucaucccuuaauaauccuaccuguaaacacuguuauaauggcaguuauauuugaaugcaguuuggaggggaccaaugucaaaacuggagcagcauccuuauucugcauugaggugacugaggggcagagaggggaagagaccgcucaaagucaaaaagcaguucacgggacagcuagaaacccaccgucccagcugugauuaaacaucaugaccuggccaguagcaauuugggaagggaagggucuacuucauuuuaauaucuuacagucugucaggaagagaaguuggggcagggaccuggugguagggauugaagcagagaccaugaaggacugcugcuuacuagcuugcuccucauggcuugcuuagcuugcuuucuaauauaccccaagaccaucugcucaugagaggcaccacccacagggugcugggccauuccccaucgaucauuaaucaagaaaaugccccacagacuugccuacaggccaucgcaguggaggcauuuucucaauugagguuucuucuucccagaugucucuagcugaugucaaaucgacaaacucuaaccaggaccuucauuccuuggcucugcucuugacagaucccaccaugggcuuccucccuauggacuccgaggaccuguucauuuuugucacggaugucacugagacgacaauuccgugccgagugacagacccccagcuggaggugacgcuacaugagaagaaaguggauaucccccuacacguacccuacgaccaccagcgagguuucacugguacuuuugaggacaagacuuacauuugcaaaaccaccauuggggacagggaaguggacuccgauacuuacuacgucuacagccuccagggugagccucgccuucuggcccuucauagaagaauagcccaucaguucacuaagugcacaacucugcaucuuauuagauucucuuguagcagugggagggaucuaguguccucaacauucugaaaaggaaacuggcucagagaaaggauggaguugguccacagucauugugcucuaagggccgggcugggcugcauaagguggggacagagguguaggcuuggagcccgcuggguuuggauaccagcuuggccauuuugcaucuggauuaguuugcacaaggcacacgguccccaggagccugacucccuaccccucuccccuaccauaagaugagggugagauuaaggugcuuagcgugugaaaaaugcuugguaaauuuagauucccagaagacuggauuugggcuuccagauuuggcuaucucauugucagcuccaugaaggaagagguucgucugugcguucucuccucuagccccagugucuaggacaguguuugcauauaaugguaguuuaauuauuacugauauagacucagugcaugaaguuuuuacaauagccgacguuuccccgugggccacuugcguuucccaagccuauugcugguggcuggcuagugaugacauccuuggcccuaauccagucucucugccccacuccagugucauccaucaacgucucugugaaugccgugcagacugugguccgccagggcgagagcaucaccauccggugcauugugaugggcaaugauguggugaacuuccaauggacguacccccgcaugaagguaaugccgggcaaagguuggaaggcaggcugcacaucucagcucccgccagcuucugauuuggggccuugacuuugcagagugggcggcugguggagccagugacagacuaccucuuuggagugcccucccgcauuggcuccauccugcauauccccacggcugagcugagugauucgggcaccuauacuugcaacgugucagugagugugaacgaccauggcgaugagaaagccaucaacaucucugugaucgguggguuccuuggacucaguccucuaccucacccugagcuggaucagacucuggcgcagaccuggggucuaucgcaguauuagaccccaaugaaguauagcagucccacauacaacucugagcccaaccuagacuucccaccgagccuaguucauucucaaccccucagugcagaccuugacagccccguugccagagucaaccucugcauuaguuugaaguucccuugcacccuguauauaauauagacccagaauagaaaacuucaacuccacucccaaccucagcucugacccuaacacuaucaguuagggucaaauuccaucccuguuuccguuccagucaaagcuugcacuucagcucuguugccuaaagaaaccgugcccuaguuuuuagaagcccccagaagguguuuaucuugcauuuaguccgcgcuggccuccaggaacccuccacuagagaugggcaggaugcauuggugucugggcauaacuccgcccacagggcccgccccuaacuguuguaccuuccgcagagaauggcuacgugcggcugcuggagacacugggagauguagaaauugcugagcugcaccggagucggacgcugcgggugguguucgaggcuuauccgaugccuucuguccuguggcucaaggacaaccguaccuugggugacuccggcgcuggcgaguuaguuuugucuacucgcaacaugucugagacccggugagcaccaguuaguccacuuauguuggaagcuucaaagcugccaggcagccuggggccuucagucaccaacaaaccuaggaccuucuugucugagagccuguugugugauggacacaugccagguacuagguaugaugcuccugcaggagcaacgcaggcugcucugcuccuccuaguggggguagcagacacugacgacuuggccacucagagguuuaguuaaccuugugaugaacagaaccagcagguaauggccaaaagcaaaaacaccggauaggaagaggauuuccccaaggcuagagaucugcagacaggcaagaaugugccccucugauggggauaagcuuuugagagauggguauacacccuggcccuucccaagccuuccugguaguuuaggggaacuggccguggcugaggacucaggagacugaguggauccugacucugcuguuaucccuugcgcgaccuugcugcgugaccuuggcaaggguaucccuccccuuggcauucuacaggaaggcgaggaugcuuuagggguuccugcaguucugaucgcagguccccuggccuggccugcuccgcagguacgugucagaacugauccugguacgugugaaggugucagaagcgggcuacuauacuaugcgagccuuccacgaggacgaugagguccagcucuccuucaagcugcaggucaaugguaagggccaccucccuuucccucucuccccucccucccuccuccaucucucuuccuuccuucucugcccauccacccacaggggaggcuggacaaagggcccggaacccacgaggcuacauuuuagacgguugaucuggcauguucccucucugggccucaguuuccccagauguagaaggugacugucagacuguacuggagcgcccccaaaucugggccauuuauguauugaugguacaauuuuacuucucacacacaaucucuacucugcugagugguuucaauauggcagucuguucagaguucuaccugcuaugauuugcauccucauaggggaagagaaauagaaaaggaggaguuuccacagaaaacgaagaaagguuagaaaguaacaugaaacuguaguggguggggaaggagauagauggauagauagauagauagauagauagauaagauagaugauagauaaauagauagguaauagauaaguuaaaugauaggcaguugaucuggcacauccccucucuggggauguagaugauugauagauagauaauagauagaugauugauagauagaugauagaaagaugauagguaaaugauagauacaaagaugauagauaauagacugaugauggauagauaauagauaaauuauagauagaugauagauagauagauagauagauagaugaucaggguuagccuuguucugcaggugacauuugugagacuugaaggagggagggcauuggacaaguggguauuaguggaaaggacacuccagaucaugugucaccccuugucacauugccagagaaauaggaggaaguuggguguggccagaucagagggcgcuggcauauaugggggggcaugagguuagggcagaaauggagggguuggaggggguagucguuggguaagagcuuguggcucgguauagacuacagcuccauacaaggcggcuuuggcuucuguugggacugacaggaagggcuaugacagggacuggagcagagaaggacaugauaaccacuuaauguuuugucaauucgcuuucuaaaaauaaauguauuuugaaagacaaauuuagcaucucaauuguagauggaaacucagugucauaugccauaaauauaaaaaacacucaaauacauucagagaaaacaaaacagugccuagcuucaugggcuuggcugccccggcuccuggccuguucucucuuugaagagcaguucucagagggauguuaaagacugacucugagccuugcccuuugaugugccccaaaggaaccugucacuuucacacugggacuccuagugucugaggcucaccugccauccccugccuggggggagggaggucaggacaaagaggacaggacacucuggagggcauccuccugacagccuuuccagugcucuguucugaucaccucacuuccugauccugcucucugauuguccaguccccguccgugugcuggagcugagugagagucacccugccaauggggagcagacaauccgcugucguggccggggcaugccucagccaaaugucaccuggucuaccugcagagaccucaaaaggugagcacaccuugacgccaagccucccacaauagacacagcugccuagaaugcacagguaggguaaucuagaccggccucugcaccugagaggucuaagccacaucuuagaccaguccucugccuuccgggagauaccgugacuaaccuaaauuucuccuuuucuuacugagccauccucaacccaggaaggagcagggucuggcucccagaggugucuaauucacccagugaauguuuuguaccuuugaccagagcuagauguaauauaguguauagaguucaggguuugccuuucuauccuugaagguccaauaggcaaauuuugccguuuaggagucucaguucuagagugggagcgcccucugcugguugaucuaggcagcacaguaggaaccugcuuaaggagcaagcacugggaaaucaagccuauucuuuggacccugcuucaagucuuacuuucccucauuugcagaggggaaauuaagagagccugcaagccaguccuuuuguguuuccuaguagguguccacgaaaacugucacccacacccuuggggaauaguuccaaggaggagagccagcuagaaacgaaugugacuuucugggaggaagaucaggaauacgagguggugagcacacugcgccugcgccacguggaucagccacuguccguacgcugcaugcugcagaacuccauggguggagauucgcaggaggucaccguggucccacauugugagugccccaccuguggauggcucugaugacucucaccccuuccuugaucccgccguacugagccugaauccccaaagcaggccaagucggcauacucacaagcccaugggaacauuacaaaaaccuaccagaguacguuccuaugcacacacgcaaaauaugacgucggcccaggugcacaaacacaacucuaaacaccacaaacaugaaaugcauugacucucgugugcagaaggugaacugguaugcacgaugcgauccugggacucaggugcacacucuucauguguacauuugcgcugugcugaggaccuucagaauacaugcauguuacagaauagcauguuagcaucuacucaagcauguccagugcugcucauguauguaaaacugcagaauauauuuuugugagccguguguaugagccugcucaaaucuaagacuuguauguaaauccacaaaaugaaugacauguacaugugggagugcaguccccauguauguguauaaaacacgcauguaugauuccugugcaugugcgaaaacuggcacggcgcaugucuguacucacauaauugcagcauaugaaacauaccaaagcacuugagcacaacucuguauacauacacuccagacaacgugugaacauuagugggcacacacacauguacaaguacugcaccuuugaacagugccugccagaguccagaugugugucuuucucccacgcaucccugccugcaccucugugugcacauuucaucauuagcaucauucaguaagugauggggacccaaacucgcuaggggacagaggucgaugggacaauccagaguggggaggcagaccaggaguaaaccaucccacacaggaucgcugcuuccagggaaaaggcccugagaaagaagaggcccugugccaaccauggaguugaggaaguauccccucaaaaaggaaguuuuacaucaaacgcugcaagaugaguagguguuagucagccugugagggauguggaaaagccuaguggcugaguggguucugagaaauuaaagcaaacaagucuggcugcagggcaaacuguguggauuuggggcaggacaggggagagggagggaagugguaaggaauggggcuacaggaugcagaauacagauacaggauacagauacagacgucagagcaagcagagccucaaagagcauuuuguacacaaucagacacagacacaagugcacaugcacacaaacacagagacaugcacacauccacacagaugcacacacacccagagguauccacagacuaguacaugucugccuaugcacaugccugucaccugcccuuagaagaaggaugaacuuuuaaaacauccuuacuggggcuggagagaugucucagaggcuaggugcacuugcuguucuuuuaaaggaccugaguuccauucccagaacccacaucagguggcuuacaacccaacaccuguagcuccagaucccauggaucuucuaccuacuggucuccaucaacauccacacauguggaauucagccauacaaaugcacacauauauagauacaaaaauauauaagaaauguauugauugcugugggcaucacggauccuuuuggacuugcucugccaagcacauaaguccuuacugucuagauauuaaaaaaaaucaaauguccuauucccccauacucucauccaugcacacauauccaugagcaagugggcacagcggaauugugcagccugacauguagacucacucugagccugaguaaaugcagaagaaaagucaugugugacgccugcacaggacaccgugugcuguuacacagagacccaggaugacucugaugggucccuggagggugcaggcuuccuuuguaagaccagggugcgggggaugucaggaagagagaacagaaaugucagucagugacccuaagaaggaaaggauggggcuaagccagaggaaggcucccugaggaacagaggagggcaggaagaaacaaauucccagaacacagcagcuauugccaagugggaaaggacagggguuggggguucagccaggcugacuagggaagcagugcagugaggcugaagucucgggcuagagagaacucaaggcucagcgaggccuaaguacaccugcauguucaccucagugccccaggaggugcacacugacugcaccaccacacagacuagcgguccccaaggugaggcugagaggaacagacuucuuucuggguguggauucaucagacugcugacguucagagucagcucuuucuggagacacucagugucucagccauuugguuaggaaugacccaggcaugacagccccaaaaggcauggacucagaugaugggguggcauggccugguccccagggugccugaugcuguaagaggcacaggccaugcucaggaaccagaagagaguuuccccagccuagcaggacaguguagaagccagccugagccugguugucaucugagaggggagucacugaagggcuuauaggaaagaccagaguguggucccagaggccagcuaucuaggcaguaagagcuuaugugcugggcagagcaaguccaagggaucagugauggucacaacaagauggagagggcagcuacccagugauuguuugcuuauagccugcucuggucucuguccucagccuugcccuucaaagugguggugaucucagccauccuggccuuagugguccuuaccgucaucucucucaucauccucaucaugcuguggcagaagguaagccugugggugcagggugguacccauauucccucuuggugucacacaauccgacccaaaaggcauaacauggagcucagcugggggcugacuuggagcaucauugagucuccaguucccucagucccugcugggcuggcauggucuggugcaauugguccagcacuccugaccccugcucuuuccucugccuagguccuuccagcucaacucaguccuggggcaaauggugcuuuguggguggacuaucauggcaccaggauucuuucagcucuuauccacagagacucccaugagucacaagaaugcaaucugaccccaagaaucuguuucaacacucuauucugacauuuccccccucuguagcuccaaacacuuaagauuccugaauugggacuuuagucccccuucaucuugucauuauaagauuccaauccuaugacuccaagauccuaagauguccacauccaaaggcuguauguauccuuuugagaucccacagagacagaguugacauuuggaaucuguccuaccuuaugcuauguucaggguaaccuacucgucccgucugaggaguaacuggaguucagagagaagcuggugaagcagcugucaguuccucucuagaggcugcguccucaggguuucucagucacacuuuccaccccuggggccccugagugccaacugccucugagcucauugagaccuugguuuugcuagccauucauugcaucacuuucaaacaucccuguccucgcuggaugcccgagucucuugucucaucugccaucuaaaggucuggaccugauaggcucaaggccaaagaugcccucugacagucucaucuguuauuggucuuguccugcagaagccacgcuaugagauccgauggaaggucauugagucugugagcucugacggucaugaguacaucuacguggacccugugcaguugccuuacgacuccaccugggagcugccacgggaccagcuuguucugggucaguccuaagagguguuaagcagcagugggcacacucagauuugcucccaucaugguugcuacuagcuaaggcauagagcugauaucuugcauccucuggaucucacuauccuuucuauauggugaagauaaggugaccccauagcaccaaaacucagggaucccaagacugauaugggaccccuucaggucaaagaggaaguccuuuggauguaggccagggagucugaggcaggugcaaaggaguugugcgugucccuaagagacaggaggucuuucagggacuacaggggaggcagauagcaugcaggaucuagaggagacccagaggaugggaaacuucccaaggggagcacaguagggcgguuggagggauguggagggugaucuaagggaauauuccccaaccuaaaugggaaaugggaugaagcuugaagcuuuagcuuccaggagcugagggucucuaugcauccuaggacgcacucuuggcucuggggcuuucggacaggugguggaggccacagcucacggucugagccauucgcaggccaccaugaaaguggcugucaagaugcugaaaugugaguccacccgccccuucuucacacccgaggccucacucggucccucccuucccugggcuuuuuguuucuucugaaggagccuggcccugagguugugggaccgaagggugcuucuuccuccuucucuccccgccucccaccuucuucccucucuaauacaguccacccuaggacacugguggugugacaggauggggcagaggaagcagaguaggcccuggcagggccucuauaccaccucaguggcccacccaggcugagucccucuccccccuccagcgacagccagaaguagcgagaagcaagccuuaauguccgagcugaagauuaugagucaucuuggaccccaccugaacguggucaaccugcugggggccugcaccaaaggagguaccgaacccacaaccuggaggauucuggggcuccucucuuuccuguucucccucaguccaccagcaacacaggacacuccagcagaauguccacacaccugccgcucagcguucuuauugcacuguccuagauggacuuaguuucaggaucucagaaucacaacuccuucaugaugaagagauucuucaggccgcuaguuccugcagcuuuagaauucaagucuuuuaugacucuuccuuccuuccuuccuuccuuccuuccuuccuuccuuccuuccuuccuuccuuccuuccucccucccuuccuuccuuccuucuuuuuucucucuuucuuucucucuuucucucucucuuucucucuuucucauucuuccuucucuccuuuuuuccuuccuuccugucuccuuccugucuccuuucuuucuuucuuucuuucuuucuuucuuucuuucuuucuuucuuucuuucuuauucucucucuuccuuccucucucucucuuccuuccuuucuuucuuccuuccuuccuuccuuucuuucuuucuuucuuucuuucuuucuuucuuucuuucuuucuuucuuucuuauucucucucuuccuuccucucuuccuuccuuccuuccuugccugccugccugucugccugccugccugccuucaugaugaagucuugccuguaugucaguguuccugugugugugugugugugugugugugugugugugugugugugcgugcauauguaugugugucugguacuugagaaggccagaagaggucaucagauccucugaaacuggagugacagaugguugugagccaguggguaggugcucgguauugaaccaagguugucugcaugaacaagugcuccuaacagcugaccaucccucccaccuccuuuuucauauuuccacaauacauuuugaaaaccgugagaaaguaacagagcccauccauguacuaaccaggaacuggcuuuguuuacaucaguguuggaagucauucugccaacugcgaugaucugagggccugguuacccacugggcugucaacaucguaauaaucaugaaguuauugcccuuugcagcugcuuguugugagaucugggauuuuccucgguguuguguaaucagccuaaauacagaaguacauugcgcauggacuguugucugugcuugcaaugaccguauuucuuuuuuuuuucuuuuuuuaaaaaaagaauucuuguaucuuuauucaugaggguucuacuucucuuauaggccuuuuauauuucuaucaaggcaaaacauacuucauuauaaauaaaggaggcagcucccuccacuuucucaaguaauuguuuaaaacuaauauuggaggagcuagagaaagcucccaaggagccaaaggggucugcaacccuguagguggaacaacaacaugaaccaaccaguacccccggagcucgugucucuagcuacauauguaucagaagauggcccagucggccaucauugggaagagaggccccuugguccugcaaacccuauaugccucaguacaggggaacaccagggccaagaagugggagugggugggcaggggagugggggcgggggaggagagucugggggacuccugggauagcauuugaaugcaaaugaagaaaacacccaaucaaaaguauaaauuaaucaaaaacaaccccuaauauuauauucauacuuaaauguuugacagaauucaccaguaaagauauuagacuuagaauuuucuugggauuuuauuuggggaacaguagagagaccgaaucuauguacgaauuguccuggaacuugcuauauucaccaaaauggccacaaacucacugagacaugucugcugaaagcuggaauuaguauugugcaagccccagcuuggaagauuuuuuuuuaauuuuuuaaaauuagguuauuuucuucaucuacaccuccaacgcuaucccaaaagucccccacacccucccccacacucccccacccacccacucccacccccuggccccggcguuccccuguacugaggcacauaaaguucacaagaccaaugggccucucuuuccaaugauggccgacuaagccauccucugauacauaugcagcuagagacacgagcucugggggguacuggcuaguucacauuguuguuccaccuauaggguugcagaccccuucagcucacuggguacucucucuagcuccuccauuaggggcccuguguuccauccaauagcugacugugagcauccacuucuguguuugcugggcccuggcauagccucacaagaggcagcuauaucaggggcaaugaccguauuucaaaaguguuauuuucaucuguuagauggcucucagugcauugaacuuaaguguaaucagcaaauugcacuaacagucacguucaccugcucuauguagagcagaauccgaaauguguaccagucugaaaacagcagcagcaaccgauaucauaggcuugcuacaugcugagcccucaaaggcaucucaggggucuucaugucaaccccaaggguggauuucagccccuggccagguggacagaggaaggacccuggagaugaacagcuugcuuacaaccacagaggcagggaaacaacccagguuugcaaggugccagcaucucugccaucuugcuaucugugucuccacacccaagacucuauauugguuuuguggucaugcugggaagacugaggccuuccucagaggcugucccugagccuguccuccugcagggcccaucuacaucaucacggaauacugccgauacggugaucugguggacuaccugcaccggaacaaacacaccuucuugcagcgacacuccaacaagcauuguccgcccagugcugagcucuacagcaacgcccugccagugggguucucccuacccagguacgagggaggcagcacccagugagugccugccaggcauaugggcgcuccuuguccaggaguccaagaugaaaguaugggcacuggggcagucacuugccagagccagcacucugaccagauaguaaugaugaugaugggugugugugucgucucagugagccaggcuccauccuaagccuucugcagaugugaccccuugaacccauggaccauccuuguguccuaggugucuuguuucuaggugucuugucuuuaaggauauaagggacagagagccaggcucccagccauagcuccccuguccucuccaagccagucuccccaguacccuaugggcaaacccaccucuguuucugaugacuucugaugacugauguugcuuguugacuuaaaaggcuaacagaagagcagcucuggaaaggugcacacagaggaugugagaaugcacccccuccucccccccccccccguccucucugacacuggcccaucuccuugcaccgccuauuuaguucuaucacucccugggagcuaaggcuguagggaggguguguccaggugaggccuugcugccauucuagacugugcaccucccagcccccugagguagguggugcuagagagacgccucucuacagacccacuuaacacacugguccuggcuguugcaaucacuccuuggggggugugaacucugagaauagauguugggucuuuugucauucuggcagccccagggcacagcucagggccacacagguuaguugaagggguuugguucacagucauucacacuguauggugacagacagaggagaucagugacugaggaaaugaaucuacaaaugacaaggccccaugggcucaggcuguacaggggacaggagcaggaagaaaaaaccauggcuuuucauuaucccauucuuuugccuacagccacuugaaccugacuggggagagugacgguggcuacauggauaugagcaaggaugaaucuauagauuacgugcccauguuggacaugaaaggagacaucaaauacgcagacauugagucccccagcuacauggccccuuaugauaacuaugucccaucugguaaguggauacuguuaucacgccuaaacaggcucauccaauacgcacagcaaugucuuccuuucaaaguccuuaauguaccauagucuuggagcaacccugggaggaagcuagcucauuucauucacguggagauggaggcuggcugccugcccagugcuucuaugcaguggagcccugucccaaguccuguggcugguuccagagcacgcacauaacgggcaagaaggggagagauggaugaagguggucuccuagggccuggaggaagaucugaguugacccaugguggugaauguccugagaaacaagcagaagaguuuuaguuagaggucccagggcuaagaccagagguuuuucuugacagugcacacaaugaaagcagaagagaugggcuggagggauagcucagcaguuaagagcacugucugcucuuccagagguccugaguucaauucccagcaaccacaugguggcucacaaccaucuguaaugggaccugauacucucuucugguguuucugaagacagcaacaauguacucacauacauaaaaucaauaaauaagucuuuuuuaaaaaaagaaagcagaagagauuuggguuagacacuuaggaauuuauucuccccagggaacacuuagagauuuagcagucacuaguauugccuguucaaauccacaagccuaaagacagggcucuucuaagcuuaugguacacgcaaaguaacccauaacccucugcucucuagccccugaaaggaccuaucgcgccaccuuaaucaacgacucaccagugcucagcuacacagaccucgugggcuucagcuaccaaguggccaacggcauggacuucuuagccucuaagaacguauguaugguccugauggggcaaggcaaaacugugaggagagagggcagcuagccaaccagagccuuccacauguguggccccaugagauagcucccgacucucugauggacaagggcauugagaaaccacacaccugggaaggcacacauuuuuuccuaaagugcugacccagagggucuucccccacaacugcuccuuggcuucagcuccccucuuccuugauccaguguguucaccgagacuuggcggccaggaaugugcucaucugcgagggcaagcuggucaagaucugugacuucggccuggcucgagacaucaugagggacucaaacuacaucuccaaaggcagcgugagugacuucaccauccgugggguuguccccaggugccucugucccuggguacagguucccuccaauccauguggccacacuucaguaugggaccacugcuuacuuuuugugccaguagagaugccagugcugcucagcuaugagcagaggcuggacaaagagccaccuagcuuugugcacagugggaaaagauggggagagggucaggaccacaugucacagugggggcugaaucaggaccagcuacagugggccccaggugagcaggaagagguauagacagagauguaaggugaacagaggaguaacccaaaugauaugguaagacaggucuugaaguccaguguuagaauaacuacagaccccagagaccuugggcaugucccuggcuacccacuucaaggcauagcacacucuuggggcuucccccaggguuacaggcuaccaggucucuagacagugaguuaggaaacagcuucccaaugcucuggccaggagugugcuuagagccuuagaguggagugagaaggaauuggugugggagcugcugagccuccuccuucccagggguggacuggcuagagacucuaugugcucagugccugucuucacuucuucagaccuuccugccucugaaguggauggccccagagagcaucuucaacagccucuacaccacuuugagugaugucuggucuuuugggauccuacucugggagaucuucacacugggugagccacuucuuccccuagccccaagcuaugcaccagagcaucuacccuuccacuucuaucucccuccugauugcuccucggccuggaaguagaggacugugggacagaugcucagacaugagccaggacuuaggggcaaguccagacagugccacucuucuaauucuaaggcuuuggcaaguccucugccaacucugggucuuuauuuucccauccaaguaucaaagggauuagacauaucaaaaacaugcuugaagccgcuguaaugguguauagcuguaaucucaggauaugggaagcaggaaaauggaaaguuugaggccagccugagcuaccuagacuccaucuuuaaaaaucaaagagaagaaacacaaacacaaacaaacccugcuuagauaucuauugcuucucuguuuccaucucuguguggagucuauuuuccaaugccaagggcauuguguucucauauaugccaagacaguauagcaugccugagaggacaccuugccacuccccacauccugagacaguaugucccugucucuguuccaugacagguggcaccccuuacccagagcugcccaugaacgaccaguucuacaaugccaucaagaggggcuaccgcauggcccagccugcucaugccuccgacgagaugugaguggaaccuagugcauuugggaggaauuugaggauuccaggggggcaugcaacucuaguucaaagguuaaaugaguauugcuagaacuggaucaagguguucaaaauggcaccaccaggaaguucggucccagaccaggucuccacuuucucuaugcuggcuucaaauucaagccugcccugcucauguggcuaccauuagcaccacaauaccuuacugcuugcauugcuccagcaaaagaccagcgcugagcuuuuaagggcucaguuuggucacauaccaucagaacuggugcugaguugggaggaugagaaucccuauuggccaaauucagguuacaguguucuuccccaugaugccuuagacucugcugaaucaugugaaugggggaagcugggaagacuucccaagagaucaguaagaagcaaugauaggauaaacaaggcgucgggagcuccucccccagcaucucucccugcaccuuguucugaggcugugcacuccacagcccugccucugcagaggggacucugacucucucucugccucccucagcuaugagaucaugcagaaaugcugggaagaaaaguuugagacucgaccccccuucucccagcuggugcugcuccuggagaggcuucugggugaaggcuauaaaaagguauguggagccaaggcaggguggaagacagaguucucauccaaacccugugcaguuggcuugauguaaugugcugggauuuggggaggaaaugauccucacccaggcucugggccuggguuucucugcuggugcuagaaaggguugagccagaacuacuuauuuauucuaaaagaaucaaaaaauguggaagcugauugaucuguccaagagaggugcaguagauaauccugucugucaaaccugugaacccugacaacacugggguuccuucggaagugugagcaaccccagacucucuggaacccgcacagcaacuacuugaaccuuguuccagguucacgcaagucugacaggacgagucuguccggaccucagcuucuugucuucccaucuggggugguccuagggagauagagacaaagagaagccaucacuguuucauugcaagggacacugaccugcagccacaacaggagguugugggagaccauaguaguaugggagcccauaucuguuuagucugaaguggguugggaguuagggucaugguaaucuggcuaccgugccuggcuacuaugcuugacuaccugcccucccuagggaacucugaacuugucuugggaugccagguaggaaggcugcucaccagggcagcuuuguguaggaccucauucucugagcauaaacgaggguauaggguuucuaagacauugcccaucaaacuccuuuuucauucccuguccuacggagcagaaguaccagcagguagaugaggaguuccugaggagugaccauccugccauccugaggucccaagcccgcuuuccggggauccacagccuccgauccccucuggacaccagcucuguucucuacacugccgugcagcccaaugagagugacaaugacuacaucauccccuuaccugaccccaagccugacguugcugaugaaggucucccagaggggucccccagccuugccagguagccacccugacccuuuggccccaggcacucaugcauauagugcguguguucauguguguguguguguguaaccagacuugccacagaaggacugucagcuagcuagaguaaggacuaacucuugccaguggcuaguaaggcugaaguuuacucagcacuuagagcugcagguaagaaaggcagacuggaaagaaacaaguuauucuagaacccauuugcaagauagcucuuccuuuuaaggacaucacaacuacaggacccuuucuaggucuugugcuagucccgaggacaaagaggaaacauuuagcauuucccaacuguuacuugggguuauggcugcccuugacaccauauccagguagccuguuuguagaagauggaagagcugcaaauccagguuagaacucagacaggggaagggagacauggucugccuuggguuauaguagagcccacuaagggaugcauucuggggagcccuaugccuuuccuggauugauguucagccagagagggaacuccccaaaaucaagaccuagcucauggaugagugguaggagacacaggcuggcuucuguuucuagcccgucacuaugaaacuuggauaggccuugucucugagggccucaguuucucuguaggaacuagcagugcauaaaggccuuugcaggcccugaaggucucauuugccucucguuaaugagacaggcauugucaggcgggcaugggguggguguggggcugggagguggguaggggugguguuaggcugagcagggucaacucaagaguucacugcgaggucacuuugucucgugaccucagaccagaugcuccgccuccacaaaccucaguuuccuuuucuguaaggugaaaacagcccuaggggaggacugagauacugucaucucccugagcacaaagauggauuccugacaagcggggaugagacagaaacuugagagccuggucuucccgcucucaaguucuagcucccuguacucacccgcugugugugguggagccaugacauaaccucucugagcugugcuccccuugggguacaggccucucaguguguaaagacaacacacggaaaccucuuagauaaugcuguuaucuucuugggguuuccccgguuccuuucugacuuauucccuuccucuaguuccaccuugaaugaagucaacacuuccuccaccaucuccugcgacaguccccuggagcuccaagaagagccacagcaagcagagccugaggcacaacuggagcagccacaggauucaggcugcccaggaccucuggcugaagcagaggacagcuuccuguaggaacugacaucacuccauuuugcccgaaucucccuucugccucccagaacccaacccucuuggccuggccuggccuggccuggccucccagcagcuacacugccacaagcuguccccucgaggaaagcccuugguuugcagcacucaagguccagggacccagcuuagcuuaggaggcaagagaacucugccucgggaaggucaugggacucugaaccaggguuccuccaggggacucaguuuccccaaauguaagaggaagaguuguacuuggcuacaggacaggucuggagcccggauuccugcagaaauccacgacuguacggugguguguucauauccuccuguguagcagcugccccucagcuggauugcucuacuuugaucuuccuaagaaucaggcaaggaccuggugucuggcuccuggccaaacuguaaccagccuuggacaaggucuuuucauucagagcccaccuccccuggucuuagcuuucccaggcccgagcuggucuggggccagccaugcuuaaugaaugcuguuaguggugaagguaggccgaguacagaaugcucuggccugcagcccugccugggcacucagggcacaccuggccacaggaagcacccacuccuuucagccccaccaguccuagaauaguccccaggucacucucagcugacccacccaccagagucugcagggccauuguccacgccugugauaggcuaagcaucugccugaaguguguaccuaccacuaggagcccuggcucugcgcuggaccugcuaugagaccuugggggcuuuccuuguucucucuggggaccaguuuucuuuccccuuugaaaagcaaguuggacacauagacucugaguacccugucaauaguacaauucuuguauguucugggaguuugcucuugucccgaggaagcagggucaaguccuuaaacugaucuuucuaggggucagcugagcucuuggaagaucccugauacacuucacacucuggggguucaggaaccgagccucuucuucaagucuccaagugcaacugcccagaccuugacuuggagugacagugaguguccuaggaaacccccuuacagcuguccugaggacacagaagagaccacgagacccuuuuuucauaucaugaagccagcaagaguggcagagaaggcaagccagguuaccucgggccacugucaccagcagcguguggacagacaugauggacagugaggacagacgucccaugcaggacaagagacuugagaugggcaaugagaggaagaugcugacgggauuaccaccucaacugccagcugcccccguccccagggagcaccccacagaaacaguucuaacccugaaccaaugaacauugcaagugccuggggacuagggaguggggggaagucagccuuucuggggacccucccugcuagcugguuggcuagcuggcaucuccccgcuuggagcagcagaggcuggggaguacugcucacaaugguaccaaagauagaaucaccuagguuuacaaguacuuguaggacucgagauaacccacauuuagacaccggaagugcuauuuuauaugcuguuaaguuuuccuaucuguacuuuuuuuuuaaaugggaaagauuuuaauauuaaacuuggugcuucucacugaauaaccgau

SEQ ID NO: 8940 - RNA, 46753 nt, Mus musculus
cggugcgccgcgagggccgccgggacgggucucccuggcgaucaguggugugcugucgccucugccaccagcgcgccggugccacggagacucguguccuugcuaccuucuucgggcuucccggggccugauccccggggcccucggcaggcgucagccgagccugugcgcgaaccugcggcccuccgcucgcccuucacgacccggcagcgcgacucggacucagggagcgaaagggacuguggcgacuccgcgccgugugucgccgggcggggccgcggggccggggcuccuccagcccccgggaugcgugcgcgagcucucgccuccacuuucucuuuaccgcugucacgcguggagccgccucucgccuacagcggggagcgcgagugcacagaucagcagcaccccugucgagccccggugccggguacccccgggaaugugagccgcgaggcucgcaagcuccuccggguaaguccccgcccucuaggcucaccccgccccgccgaugugcccaggcaccugaguuuggggugcugcggcugccuuuccagcuucuguuugcccggugcuacgaggggaaccauucccuuuagucucuaacuuagggacagcccagagagggggaaaaaaaaguagcccguggcucaguugcuaaaagccauccucugagguuccacggaagguuugguaggguaguuaaagugucucauuucagguguggccuauucuacagaugagaaaagaaagauuuaaagagggaaaguagccuguuuaaaaggucguauagggaucuguaauagugcuauucaacgggggugggaggagcuaaauuagggcucagaccuuauguccuccaaagggcccucuucuuaaucuucuugcuuugguguuugagagugucucaugcaucccgggcuggccucaaauucacuauuguaggugaggugagcuuucaacuuucuguccugcuuccgucuccuaaguccuagaacuguaggcauuccccaccacacccaacucacggagcuguuucuagccuuccuauuuuucuguaucucuuugcuuugcucuacugaggucuaggaacugaacacaaacuuauauccccagauauagggcacuguagucaaacaaacaggaacccaagaugguccuuucuugucuccaagguaugggcucuugguuaguucaggaugcuaagauaacuggcucuggguuaguuguggcuguuaaaacuuguuccguucuuuacacgcucacuccugagcaauacugcuuucuuccagaggcuuuuaagggccaggauaccaguuauauauaggacaaaaaguuugauccccauauguucuuggugugcagcugcccguaaccaauuugccuuuugcuuacagagccacauugugggcugucuucuuggguuucgcuguaacuguuaggaagcaaaucuuuuguuuuuuguuuguuuguuuguuuuucuuuuuccucuuuguaagguuuuagggaaggacggcagaagagaagucacuguagagcugacacaauuaaggcacuuagagcugagacaacuauaaaauaacugaggaauauguucuuaaccugggguauaucuuuaagauggggacuggaaagauggcacagcaauuaagagcauuaauugcucuuuuagcgguccccaauucaguucccaggacacacauggcaguucacaccugucugugacuucuuuuccagggcaucucacacccuuacacaggcauacacgccaucaaaacaccagugagcguuuaaaaaaaagaacaaaaaaugggacuauagaaauggcucuguaguuuuuuagguuuuccuccuuuuucuauguaugagggggugcugugcauacucaugugucauggauggaaguuugcaacguguggacacccaagguaacguccagaaucuuacuagaucacucauuugaagcaggguccuuaaucaaaaccagagauggacaacauggcuacucauccuccuggggccccgucuccacuucccaagacaguuagcauacacauaggcuaucacuuccacccaacauucaugugggcucugggaaucgugacucucacccugauagcugcugaacaggugcuagcaccaaaagaaauacuuuugacagaugucagaaccccuccucuacagcacucagacacacaauguuucacccccauuaaauaaaaaaaaaaaaaaaaaaaacaaagcuauuuuacuuuguguguaugagugguuuugccuguaugucugucuguguaccacauaugugccgggugcccacaaaugccggaaagugucauccgguccccuagaacgggaguuacagauaguugugagcuguugugcgggugcugggaacugaacccgggcccucuggaagagcagccggaaaccucucuggcuuuccauaccucuuugagacaugcacauguguauguauggaugcacauacaugcucacauuuggggacuggggagagaaugcccuugcuguacaugaagggaagguuucacgagcccuugugaguaacagugggggcagggcucuuccgucccaaagcuuaggcucaguuuauucaucaucauccucuccuaggagaaagagcugagacuuagguacaaaauacacuugacucuguucaggugguaagaauuuccgauugcauccaagucucccggauuucccuucucuuuucucaucagauaccauuucugaggucuaagugaguugugugugggcaaacauaucaguauguuuacuguucauguucacugucacaacuccuucuccuaagauuuguucucuagauugacaagaacaaucguguuuccuucucguaaaauuuaggugauucugggacuuucucccucuaaggaucaaauuggugagauuccauuuuagugcuugaccgugcuugaccaugauuagcaauucuugaacuauucaaguauuuuaugcuugcuuuucuuagaccaaaaaaaaaaaaaaaaaaccuagcuccagagaacuguguugguuugucagguuacuguuuguuuuguuuguuuguuuauuuugucagggucugauguacuguuguuuggccuugaacuccugauccuccugucucugcuugccaagugcugggauuacaagugugcccccaacacaccagcaagggcgccguuuagaucggugcugucugacacuacagccacuagccauacaguuauaguuaaguauacugaaaauuaguucguucugccugcgagcccuauuucagauucuuaguacgcaucugugacuaguggcuacuauauuggacaacauuguuagagaacguuuccaucagaguuuauugaauaguccuaguguagaagauugccacucaaggugaguggcacuguaacauugugaagaagagaaccagggcucaauuuuuggauuaaaacccuauuuuugauauuugggccucgugggugggcggguuguuaaauaucuuuacuacagaugauagcccuuaauaaugagcucuuucauuagugcaguccuuggcuguucuccaacaguuacgugaucuaaauccuuggaguccuucauguaaaucugugggaaugggccucgcuggugagacaguuaccauggguaaacauaaggauccaaguugaagcuucagauguuuuuaaagaguggcucgcucagugcuaggcagucccugggcucgccagcuagccagcccacacagggugcugagcuucgggccaagaagagacccuguuugaaaaaacaagaugggcagcgucuaagaaacaauaccaagacugaccucuggcccccgcaugcgcacaccggccccucccaugcauuuugugcuaccaguuuuuaugucagcucagcaaaagcuggagucauuuggaagagggaaccucacuugagaaaauacccccuaccagaucauccugugggcaaagccugugauguauucucuugacuaagauugauguaggggguggcgggcuugagcugacuauggcaggaccaucagcccugggugguauaagaaagcagacagaggagccaaccaguaguaaguagcccuccuccauggccugccuccccuuagugauggacuguuagauggaaccaaacucuuaagcuaaagucagcccuuuguuccaugaguugcuuuugguauugguguucuauucuauuagguuuaauagaaacccuaggacacacgugcacccacaguaacagcacccuaacacaugaacacaagucugagaaaggugagcccacuauuuuuuuuuuuuaacaaaguuccuauuauuacauguuuaauugaaucauugaaacuuauuuaggguggugaaacuguaaggguaggaccagaacuuuuaacucuuggccaggcaauguaaaaagaagucuggauuuugaugaaguucucauuauaugggacagcuguaucccaggagggaauguaaaugaagggucucaaaaaccugugguaccaaacuugccuaaacaaaauacucguuggaggcauuuauuugguuuucuuauccucuagagcgucucacucaggagggcccaaguggagcucugaacucuguaagcaucaagcaccacauguggaguuugggaaccaucuaaaccuuagacccuaacgguugcugauuugcccuggagucugcugcucuuuuacacuggauacuuaaaacucuguguucaccucugucuccucuagccauggaugccccguaugauggugcugagguaacuguccugauggaggaaaucgaggaagcuuauuacacuuccccugggccgccuaagaagaagaagaaguauaaaauacauggagagaaggccaagaaacccagguuagccauaguauuuugguuacugaugguacuuaucaacaaauuugcuuggggagcuguguugaagaagacacaagauucauuuagagugcauuugucagagucggcauugauguggggaagagagacggucugaggggccauugauacgggagaaagggcauugacauaguggagggggagaaagcgauaaugugugugugucuguguguuugaguggucacugauguagggcagagacuuggguugcagagggacagaguuuguauauguuacaagacugcuagacucuguagacucuuuuguauguuauuucuauuaugcaauuacuauuugaauauuuuaaagaagacauuacgaguauuauaguuaagugaugccagugauuucuccagauguucuacacuucaguuuccuucuggcugaguuaacagagcugcaccacuuugauaauuaccugcuuucuugauggguuagguuuggccaguuaggugaccaaaggcagaauaguaauguguguguguaauaagcccgaguaauccgcccccacugucaccuuugccuucgaguacaaugacagcagcccugcauauuuggcuguauuugauuauuuaacagggguguuccagauuuucaccugguuuuucuugcuuguuuagaaacagugcuuugaauggagaguuuggcuuugccucgcuuuaguggcuuuuggcuagcacccuguugcauugagugcggcuaaagucagggagguuguugguucugcaggucugccuaccuacuguacuacuacgacaucuacuugaaagugcagcaagagcucccccaccugccccaguccgagaucaauaagaagauuagugagagcuggaggcuccucagcguggccgagagaaguuacuacuuggagaaagccaagcuagagaaggaaggguuggauccuguaaguauuuuuuccccggguccccuucucccucauugguuuaacggguagagagcuggggaggccagcuccccuguucccaugacucuuuacuucuugaagagcuguuaaauuaccuuucuugaaccuggcauugugucugccuccguacccaugauguucucucugccuucuuuuacauugcagcagaacagagagccgacauucucugaguucucuauggugagccuuuggguccuuuucugaauuguucuguaacuuggagcuccuccuauauccucacaguaacauuuuuccuuaauguagugguucacacaggcauuucuucugcaccaucuuuucauaugacugacugagugcggccugcccaguuuauaugugguugugacuggugucaucacagucaggaguuagcuucauguagagagcaguggagccgagcugcuguguaaccccguguaccucugucuguugguuaugagcugcacuggaaggaagugcagggugacagccgaggcugcugcuggggccuagggcuucgaguacuagcaagggugcacuuagacugaugucugucugccuuguguuaucuuuaguucaccauggcagaguauacugaugaucacuuaaacugauaguuuauuguuuugguuuuugggggcuggugaaagaacuuaagguuucauuuauaguaggcaagugcuuccccuggcuuggcuuuuuaacacugacauucccacaggaaacucucuugugguugcuggccaaaaucuuuugcccuaaacguuuuucuuuuacauuagacaaucauuucuaacuuccuuuuugaaaaugugaagaacaaagauuccgaccgcugugcaguacccggacuggauuuuuccuuaauggcgucucucugccacugccagucagauucuuuguccucgaugucuagauauuccuccuccuccaguagcuuugugucacccacagucuggaggaugcugguguauuucuaucccuagauggcuuguuuauaacaaguaugggagcucaccucagccaaggcgggacuggggagggaacguguaagagaaguguggcuuucacagucugaagucuguagucacagcacuagggaguuuaacucacuggcagaggaugcuuggcguguuugcuauggguuccacccuuagugccaaccuguuuaaaauaauaaggcagcagucuuugugucugcuaaucucagcuaacgcugugguuucuaccaagauuuaaugcuguagucaugugcgguggcugucgucggugcucaugugcuuguuuguuuauguguacacuuuuucaccacuaccccaggacgcuagauaagugacuuucucaucuacaaaagggaacuuguagcacucauauacuuaaaguauacaauguagggcuggccugauggcuuaguguugaagggcagguguugcucuuacagaugaccugggcuuggcucccagcaccagugaugcugggagccaaagaugguggcucacaacaucuaugacuugagguccaggugaacuacccccugccgcagacacaccuaagcauacaguaaugcauagccauguaggcagaacacucacacagcuaaacagauaaaauagauaaaguaaaucaguuaucugaguucucgccacauuaggaucugcuccauaagcuucucuucaguagauaaaaaaauccaguacugggacagagagauggcucagaagcuaagagcacuuggcuguuccugcagagaauccagguuugauuuccagcacccacauggccacuuacaaccaucuguaacgccaguuccaagggaucugaugcucuuuucugaccuucuuagauacaugcauacauaccagcaaaacauuuacauaaaauaauuaaaucuaaaaaacuguuuuuuaaaaauccaguaccgugugcugagccguggcuaagguuucuguacugaguuuugacuucuugauugucuggugugcugacgagugugcaccuucacagacugucacaaguccucuggcaccugucugucuuaguggcccgucggcacuccuguaggaccuguaacuccugugccuggugcuguuuuguuucagucaggaccucucuauucacuugccaccauuuaaucacucugcccuugugugacuuccgagguguuuugaaagcgccauuucccuuuccugcuccagugaaagcacacaggacucauuccagcccaccucccuucacuuggucugaggccucguuccccuucccucugagcgcugccucugagccuuggguauucccagccacucucccucugacuuuucuaagauguucuuguaauugauuuccgugugccuuuaaaggaugcuuugaaagcuuuuuuuuuuuuuuccguuaaacuuggauuuuuauuuagcuauucacuuuguucuguuucucuuacuggaugacuuaguuuuaaauagaaaaaaaaaaaaacaaaucaaacaccguuuucuuuuggauacugauugcugugcagggcuguuucuaguaccugaucuuagucuuuaaaaaacaacaacaacaacuggucuggaguucaggcuuuuauuucuucaaaauuuugugucuuuggacuuuuagccucaugaaguuugaccuugauuuccucauguauuaacugguaauacuaauagugcuguuuuaaaguuaaaauucaguuacaaauuucaguguauuucugaguuuuaagaugcuaggucucuuccccugcacuuccuuaacacauucagcaccuuaccagauaguuccucgaccuuuauaguuucucucucacaacgcguucuuagcucgguaaccuguuuaucccuguaagucuaaauuacugaggcgcaaauccugagugccagcauguguuccauuucagucucuguucaguugcacuucaugcuuuuuugaguuuucauuuaaacucaaaaaugaaaucuaaaaaucuaguaggacucaguuugguauuugaaagaaucaaagcuuaaaagaaauucacaaauugccagguuccuuuauaaaaacuccaacaaaaacugacaggugguugcuaaagccuucaagagggaauagaauguguucaagacuaugcagaccugauguucugagcagaccugauguucuagcucaguuuuagaugccaggaucuaugcccccccccccccccagaguucagugccacagauguaaagcauuugccuugaaugcacaaggcccccaguucaaugccuagcacugcagaaagaccuagcaacagagucuaauucauuuuacaguuucuuaggcaaguaaagucuguugauucgaauaaagauggcauugcuguugaucuuugugaauuagucaggcaguagaauuugguucguuuugcagacaaaaaaaaaggaaaaaaaggagcucauaaaaaugacuuggugagcuguucagccauuuaucuguguuuaucucccucugguucccucauucucagaacucuaagcucucugcacugacugcugugguuccggacaucccagguuuccgaaagauccuuccccgaucggaauacaucaucauucccaagagcacccugcaggaagacaggagcugcccgcagcuagagcucuguguggcucagaaccagauguccccuaaaggaucuacucucaugucuaaugcuuccccagauguaguagccagccaugccggcauggcagagcagugccuggcuguggaggcccuggcugaggaagugggagcccuuccccagccagguacugugcaagagauugccaccucagagauccucagccacgauaugcucuuggaggaggcguccuuggagguaggagagagccaccaaccuuaccagacaagccugguaauugaagagacuuuaguaaauggcucaucagaccuccccacuggaagccuggccgugccacauucccagguuggggagagcuugucagugguaacagucaugaggguaaguggcuuuaacugaugucuucugcuuugucuguauucuuuaaaagucacagugugguuuugaacaggguaaugaaggguauagguauggaauuugguuuuuuuuuuguuuguuuuuuacauuuaauuuauuuuauguauaugaguacacuauagcugucuuuagacacaccagaagagggcaucagaucccauuacagaugcuugugagccacugcgugguugcugggaauugaacucagaaccucuggaagaacagucagugcucuuaacugcugagccaucucuccagcccauggguacgguauuuuaauguuucugggccuuagacuugcuccauaguucucaguuucucgggcaucuuagcaccucucagccuggguuacuaagauaacaggugagguacgcuaggagagugggaaaggguacuuaagguauccgugagucaacgccaagagcuucaugcuucuagugccugccaggauuucguguccuaaaaucucuuucaaaaaaccacagugauaccuugaacugugugugaguuccugaguggaacucuuggcuagagaugagaauaggagaacaccuucucuucaaggucagggcuauggaacuaggaacugagaaacaaagacaaaucuggagccauugagaagacuugguggguaaaaguacuugcugucaaacauggaaagccaaaagcuccacaagcuucccuccuaccuccccaggcugucaugugaauacccacaugauaagucaauuaaauguaauaaaguuuuuaauuaaaaaaaaaaaaagcaagcucuucuccacuguaccaagggauucucggcuaaggugaaaguaaaaacucacugguuuuuacucagggaaacgccacaggugaccuagaucuauugcuguaacuaaaguguuugccugggcaggcuagcauccuagagaaacgggaguccucuucaggauaagaugacugggguagaagcaagcaggugccccagagcgcucuguccagcccccguauacguguucaguaucuguuuucucgguacugucucaggaucaugaugcauugccacugguaagaaggugcuuuuuaaaagauguaugugaugugugagaguugcaugcaggcaugcaugccugggcaccaccucugugccugggacccauagagccagaaaaggaguuggauacucuggcauuagaguucagagcgauuuugagcuguuucguggguuugggaaacaaaucguguucuagaggagcugucaguucucuuuaccauggagccaucuccagggccacuuaauacagugcgcuacuaacauugcuaggucagaagaacggaguccgcuuacggguguugauguggucugggguuccugaccauuacagcuuuacuuuuuuccccuggaaaaugacaucuucuguagucauuuucucuugugucuaaguucucuucuuagguugaaauaacgguuuauuuugccaagcauauugaaugagcacauugucgggaguuuugugcuuaauguagucuuuaguauugcgggugaccuuggguguucugcacccuguguaagcaacuguccucucguugcccacaggacuccagugagaguagcccgucugcuccagccacucaguucaucaugcugccucugccugcuuacucggucguggagaacccuucuuccaucaagcuggucaguaguggggaacuggggcuccacgacaguuuuuguuuguuuuuguguucuuugcagugcaggacauaaaauguguuaggcauguccucugugguugaagcugcauccccagccguuauccuuuucuucaucaucuagaucuucugcugugguacugaauagauagaugugcuaaagacagguaccugggucucauucuuuaccuuagagagcaaggguucaguccuuacuguuaaauaugaucacuuaacaauagaauuuuguauuguaguuguccuuuaucaaguuuaggaaauuuccuucuauuucugauuugcuaggagucuuuuuuuguuuguuuguuuguuuguuuguuuguuuuuucugucuuuuguuuuuuaaucagugguguauguuggauuuuucaaaugcuuuuguguguuuauagagaugguauggguuuucuucucuaguugguugaagugguagauuucuuuuggguuuguuuuguuuugagacaaggucucacuuugugacucuagcuagccuccaacuuuguagaccaggcuggccugaacucacaaagguccaccugccucugccucccaagugcugggauuugaaggaugauaacaccacgcccagcuggacuggucagcuucauuguguauuaaaugcuaaugcuaaccugcacuucugggguaagcucacuuguagucaucuacaaauaugaacuuguaguucacccucuuacaucuuugacuuuuguuuuuguuguuguuguuguuuuucgagacagaguuucccuguguagcuguggcuguccuggagcucacuuuguagaccaggcuggccucaaacucagaaauccgccugccucugccucccaagugcugggauuaaaggcgugcgccaccacgcccggccacauauuugauuuuguacagacuuuuugucuuuacuucaucagggguauuggucucauaaagugaguugggaaacauaguauuuccuagacgaguuuguguuagacccucaguauuccuuccagaguuguuuaaugaccagacaagucagagaagacuuuguggacaaguuuuuaauuuaagucuuaguuuuaaaacauacgcagaaguagauuacuuauuuacuuauuuggaguauuugaguugggggucugagguuggccuggaacuaacagcaguucugccucagccuugaaagugcuagaauuauaggugugggucacugugucccauggguuuuuaguacuuuaagguuucuaaaaaaguuaauuuauccauuagguuguuaauuuuauuuauuuauucauucacucagggacucuaguuuugcuacauacugucuggccucagagauggucugaaacuuugcuguaggccucuaugccccuauaacuccuguauuuuacauggugcagaaccauuagacagugcugcucacucaagauguaguccuaccuacauacaccggagcuuuaguggccucuaugugccuuggcaguugaaccugggaaauguucaugggugauuauuuuugaguagggaacuccuucagcaacucucccaguccagacugucuucugaauuuguauuuucaagaguuggagccuuugaggugggggucgugccuucagggcaucuugacagugucccaggguagaguuaaaggcuucucuuuaccaguuacagugauguucuccacgucugccuugcucuuuccucaucccucacuguagaucugaauaagagccgugggccuuggcugugcuacagccuaaauauuaagcuucucugcuaaagaaguggcccaucacuuuuguucagucuuaccaaguaaccaggccacaagcagaaugcagacacacuuucugaauauaauaccccgggauucuagcccaguucccaauagagucccugaucuuuucuggagccugacgacucaggcgguccucucugcauucuguucuuaacuugcaccagaauugcucggugaguucugcuuacuguuuuggguuuguuuguuuugcccauagguucgaacuacuugauuucucacacaaaacaggccuaauggccuauaagccacauggucauguagucuaggaauggcuccagcucugauaguguuuuauagagcaauggaaccucuguguguguguguguguguguguauauguguguguguguguugucugcauguugccugcauguaugucuguaccugaugcccaaggaguccagaagcauaauacccacucuaauggcaucgcugagagauugagcgagauucugauacagcguugagcacuaugggcugccauauucagcugcagccaucgcugcuggcaccucugcagccguggggaguuuguucuaaaggaacucuuuuaagagucagcagagucuugggcuggauucuuggcuuuaacucuaauuuguuuguguuuacagacuacaacauacacccgucggggccacgggacaugcacaaguccagguuguucuuuuaccuaugucaccaggcacaaaccaccuaagugcccuacuugugguaacuuccuaggagggaaguggaucccaaagguaaggucuauuccacaacaggucccugagaacagauguuuuguuuuuaaguuaauacuggcuuguuuuaaaccuugaacgugucugugaugcacauggguguauguguacacucguuugugugagugcgagugugagugcaugcgugcagugucacacguauggaggucagaagacaacccuggcugucggucagugcuuuucacugugugagacaggaucucuuggucacugccgcacauuucaggauaagcuguuccucacgcccuggucugcccaggagcacucggauuguggcugcaggucacugcaccugcuugugugggugcugggcuuagaacccagguccucacacucaugcucaggcgcuuuggccacuggggccuccucuuucaucuuuuuuccaagccagaacauuuaugacuaacugaaauccucaagaugaccuggaugcuguaacagcugccuucuuggguuuaaguguuccuucacggaguccaugucugaaacugggauggacaguauacaggagccccaucugcccgguccccguaguguuuugucuccuagccucggugcuccaguuggacuccuugugcuuggcggggcagccacauuugccacaggucaccuucuggaggcaguaggcuuggggugacgguggcgggcggcacagugugcgucuucuuuccacaggaugaugauccuuugucgcuuugcuucuacugcuaaggccagagagauccgaagagucaccuuuuucauuucuaguuagugucguuaguuucauuuucauuacagauaagucauuuuucuauucagcaguuucuuugaugaaaagaaacaaaauuaaaaaguuauccacaaucucguaccaucaaaagaaaagccauuauuaaaggucauuuucuuauguuuaaguuauguggcauuuuucccucuuacuuuaugccacugguuuuuguuuguuuuguguuuuaaguacauuuauuuaucuuauguguaugagggggguccuuugugccacacauggagguaagaggacaacuuuugaaagcugguucuccuucuaccauguguguucagagaaucacaugcauuaagcuuggugacaaguacuuuaacccucuaagcaaucuucuuggcccaccauuaaguauucuuaaaaauacuaccuuuagccaggugugguggagcacacgugcaauccuagcacuagggagguaggcaggauuggaaguucagaaccaccuugggcucuguagugaguucuaggcuaccugaacuuuguuauugcugcaaaccuuucccguaagugacuacuguucccuugcaguuaauguuggaggauggcuguguacccuguguucuagcugcauaggcacuauucucaagccuagcuuguguuuucccacgcuuuagcucaagauccaaguccuucaccugauacucagaguggauccuggguucacccccccccucccugcaccacccccuccuuuuccuuuucuuuuucauucauuugagaggguguuguguaucucauguugaccucaaacuggugaacuucuaaacguccugccuguagagugcugggauuacagguguucaccaucaugcccaguucaugugugacuuuaccagguaccuccuucccaucaucccuucuucccauaucuaucugauaauauagucaaauguaguuggauuuuaugugcuuaaaaccguuuuuuuuuuccugguuuccucuggaacaccguuaauuuauucucacucuguuuacccagguauauuuugccagccgcaccagggauauugacuuguagucuuggucucccuucaccagcucauaugggccgcugcagugcccuguuucuaugcuuguucauggcagagcaugagcaggcaugggaggcuuuucgaucccuuagcuaccagguuauuuuguguuuguaauuuugaaguguuuguuguaugcuuggauuuuuucaaaccuacuuuaauaaggguccuuaaauacuuuaaccucccugcuagcccaccacgccccagaggcaguggaaaggaaagguuaauagggcaaagggagauguggaccuguuuagagauagugcuucggagcgauuccagucuucguuaucaagauagcagcaguucaggucacaggaaucagcagugccagcucgauccacucacaaacaccauucaugaaucagccacagcauuucaauucaggagaaaccacaaggcuacguggaagaggccgcuacuggaauaucuuucgguuuuuuucuacaaagucaugacuaauuaugaugagugaagaaggccaggugaaccagugccguaguaucagucagcgaagaccagagucagcaaagcucaaggaagaccagcaaagacuggcaaugcgaaccagugacacagugucauccacugucugucccguuguacuuacacccuuuccaaacaucacguguucucgcaaggauccacuccagcagagcaccacaugcccguuuucuaggcagcuuccagaaaaacaccagguguauguucucagcaaagcauccucucaggacaguuuccaucacgugacgcaacugaaucuccaaagaaaccaaaaauuuccccuucguuuuguuuguucuugagauagguuauguggcuagaacuugcuauguagagcaggcugguugcaaacucacagagauccauuuguacagccucucgagugcugggauuaaagguaugcugugcauugugugugugugugugugcaugugugugucacuugugcgcuuugugugugugcuuucacuugugcucacuucaccucagcaugcauguggagaucauaggaaagcuuguaggagcagguucucccucaagaacuaaacucagguucuccggcauggccuuucccaccgagccaugucccuggccccccagauucugguuuaacguugacuuuucuucguuaacuauguaugcacuugugaggacaugugugccccuugacauaagaugcccgugguuuacuuaucacacgagaacguucuguuuagcuucuuuaucuugacuuccugagucagacuucuuuucccugaccaacagugaguaugagaagaaaguguagcauccauguaacagaucauuguagguguaaaggcggcuuugguuaucggcuacuucaauugaugacacuuuucugaggaaaauuaaagagaaguaacuuccuaaauucccacagcuaauuaugcagcaccuuuuccacgaaaccauacuuucucagguaucaugaucuuauuagcugcagaaucuaagacucagauuuuaauuuuugaguuaggcauaaacuguuuuuugaagguacaugcacacacaugacaguuggaaaauaauuggcccuuucuuccguuguccuugggaucagacuggcuaaaguuagccugagaaauacacaccccgguuccccaugaguuaguugggauaaaagcuagugaguagggcuguguggcucaagacuucauuuccauaugcuuugacagugacuauuuagcugcguguguucaguuccaccuuaaagcaacauuuaaacaguucagguugagucagugacaaaugugaaauugucuggauagugcuuguucaauuuuucucauuaucuuucuccacaaacaguuuuaaauagccuacuugguaggcaguguacugcucaaagauugcaucuuaagaggugaguuuaggcuguugguuuuggguugacuuuccccuguguugcccugaauaagcucugccguuuacuuaguccccaauuuucaugcuuguuccuccagagcuagucuguguuagaaucugagagugcugugcuguaaagcuccuguaaccgucacugaaaggucaucuguuucuggucauuagccaggaaaaggacacuguccagauggauggagaagucugaagggauugugguugaaacuuuaaugacauuagccacagauaauguauuucauacagcaucuaggcaggcccugcagugaagaauugggccacccagagugcuaucuugcucugucggguuuucuaauguccagugucuuucagaacugaagugacuaaugucaaguccaauagaagccagagguagucagcgcuggagcugagucucuagccaccagccaaggcuuuuguaggggccacaauucucuuccuaauuacgaaugggcuugguaacuaaugcuuguauucccuaccagcaagagucuaguacaccucauggagaacccaguucugccauuuaugagaaaauaauucagauaaagcuugcacuagcucacacacagaauuaggaguggaacccaucuuuagauuuucucuuaguucauguauaggaccuuucauaaaaccuaauccugagacaaguguuuaaaaaauuaguauacauauuuguauacguguguauuuguguauaacugcuguuauucccccaguuguacuuaccgaauaaagcagaggcugcaaggacuuuagaaauagaucugacaggcaggaauggcaucucaugccuauagucucaucauucuggaggcagagauagacgaucucuuaagaguuugaggccaguaugguguaugggucuguauagcaaguuuuaggcugguuagggcuccacagugagccccugucuaacuucugacauaaugagcagguauggguuaguuugacuuuuugaaguuagugacuuauguguaagucauuccuguugucucacccagaagaaucugggacugagguuugcuuuaauggagugaagagagugaacuugagcacauugggacaaacugaaccucauagaaaagcucccacggcaaaccacguggugcgacagaggucagcucaggcacguugggaagggguuugucuaccaacuccugcgguguccagugcuugagugagaagauccugaggccggggccuuagauaaagucacuuuuacacucguaaucuuaacucuucucgcugggcucauuuccuuaguuauuacccauguguuuuuaaaaagggaaucaaaagagaauauuugucagcuacaaaaugccuuuaugcauacaagcucuuuuauuuuuuucuaggaaaagccagccaaagucaaaguggaauuggcuucgggugucuccuccaaagguucugugauuaaaagaaaucagcagucugucaccacugagcaaaaccccucuaaggaaaaugcuucaaaacugacucuggagaacucagaagcuguaagccagcucuuaaacguggcuccuccaggagaagggggugaggacagagagugggaggaagugauugucuccgaugcucauguuuuggucaaggaaguuccugggaaucgugguacagcgguaacuaagaugccuguugucaagaguggugcccaggcugagaucucucuggggacaacugagaaugacaguccuggaccggacauacugccaucggcugaggggaccagcuccuccaguuuacuccaagcucacaaaaagucuccaggguaggcaugcgaguguaauuaccuguuauggggacuauguuuagaacagcagcuaagcagaggcccacguuugcucuguuagggauccuuacagcagucccgagaggggcagcagagcccagagaggcucagcaccacugccuagagacacagcauggucuacugacugcuccgccauccgggccuuguacaucuuuucuuguuagucuuccgaacaguagucuucagcuagucuuccuagcaguagcucagaucuuacugggacagcuuguggacagaguuuaaaaaaacaaaacaaaacaaaacacaaaaacccacauguguuaccaauccugaauauggaauuagaaagagaggacuuauuuuggcauccugugcaaagauucuuugacugguggucagagacucaguuggaucugaucucuggcuucuguuugaccuuugguauauagucccuugaugucuuaugacuaguugugaaagaccuugaguuguaaagaauauaucucacagauuauaugugacugauuauaaacacaggacagauugcuuguaaagcauucaggcuggcgccuuaaaaagaggaaggcaggaagugugggcuuuucucccccuuuccuuucuuauuagaggcuuaauuggcuucugcguguagugucgcagaaucugucucucauaacugaagacuccuugcucaucucaggaguucucagcuggagcaacuuugcccacaggggcuguugugguggugcugggagguauugugguugucaccgcugggaagagguuugcugcuaacgugucaguggggacggacugcuaaacaucccguagcacaaggguagccuccgccccuggggaacuggccucugugagacaucacuagcuccacguuugguuucuaguaggauucguaagguuuuuuuuuuuuuuuuuugauugaaugacuaggaaauauguucacauaguccaaauuuuaaaaguauaagaaauaaacacauuuuuuaaaaaaaucuccucucuguccccuuauguaguccuuauuucccagggucagucaauauuuccaguucucuacugugucaggaauuauuuuaaacaaacaugcaugugaugcauguauuuccuacguuuuuggacuuacuguuaugcguauggguguuuugccuggacugggugucugugaagccugugugaagucugauguccuugggauagcagaagggagcaucagacccuuggagguggaguuggaagccaccucgugggugcugaggauugaacccggguguucuguuguucaaaagcagcaaguucucuuagccacugagucucuuuggcccguuuucuacuuucugcacagauguuagcaguguggguggacugccaaguccacacccucucuucuccuuaaaacagcauggacacucuggagagaguuagcugugcuaaagaugaaggccaggcaggguucauuggccacgacgucagugccggccucaugggagcuugauaggcuucagguagcacuuguucuacuuagaggugaauucgagaguacagcuguacugccgccugucaucacauaccacggacagugcuuuauaccggcauaguacuuagguauuugggcuguugagaccuuuucauggagccuagccuacccuuguccucaccauguagccgaggauggcgugaaucccucagcuuccuucuaggauuacagaggucuuugugaugacucacagauacuuacuucaccaaauuuaugcuuaaaaccuuggggucagcaggucuacauucauucaguuugucuaaaaaguguuauuuggauguuauacuuuggcuuccuuccuuucuccaaauuuucccacuuuccuucaugguuguuuuuuuuuuucccccuccagaguugaccuguucaccacuggacccaaagccccagagcugaaaggcagagcacgaggcaagcccuccuugcuggcugcagcgagaccuaugagagcaauccuaccagccccaacaaguguugggcggggcagcggcgugggacugcccagggccaggcaggcuuucccccuggguaagagcuaguucugauggggaggaggggcucucugguggugaggagccaggaguggugguggagaacaggaaggagagagcuggggaaaccgaauggcuuuaagucaccagguugguuucugguucucucagauaagacucccucggugaggacuuguggccuaaagccaagcacgcugaaacagcugggccaacccauccagcagccaccuagcacuggugaaguaaagguaagacccagucccaaaaggagcgcuguguggaaguguccucaguguugaauguuugagucacagggcacagacaaaaggcagacgcugguuucugcaguaauaggccucuaggaggaguaauaaaacuguaauuucacuucuaggugaauacauacuuuuaagcuuuuuauuuggauaucuauaaguuuuaaaauagacaaaaacaaaagcauuuaaugagcacccauaaaaucuuuacccauaaucaccuguuaacaugugauccugugccaggaagcuggcucagcagguaaaggcgcggcacgugcucuucccacaugggagaaggaggccaccagccuuugcgugccugcuccuccaugugcacacaagacaaauaagugcaauucuuuaaagacuuacuguauuuuuauuuaugcauauaucugugacuauagauuuguacacaugagugcaagcguucuuggaagucagaggcuuaaaggcaguuguaagcuacugaugugagugcuaagaaccuaauggguuaagagcagcacaugcucuuaacuacugaacuauauauccagccccauccccaaauguaauuaguaacaacuuuaauuaugugagucccauuugcucucuuugugcagaaacuuuauucuguaaugcuucuuuguguauuucuuaaggacagggauauucuuucguuaaaugguaguguucuguuuuuagauucauacuccaacuuggucuuuuaacugggcuuguuucccauuccauauaggaauagggucaggauauugcugugaaaguccaguugcagguguggcacacacacaguaaucucagugcuuggcagccugagcuagaggauugaaagcucaagguuguccgcacugcacagugaguuagagccaaagacaugcucaagguugucugcacugcacagugaguuagagccagggugcacuuagcaagacacaagcggaguaggagugaaggagaugcaugcuuaucaugaaauuaucaaagaauacauuuaaaacaggggagaaaaguauagaaauuuuuauauaaaagaggaaaauaacuucugucaugacccuccuuccagaacuaaccaucuugaaacucugguagacugaauuucaguguuccaauucuuguuuuuaauuuguguucuuaaaaaaaaaaaguguaugugugugaguguuuuggaguuacaauggaugugagccugcaugugguugcugggaauugaaccuguguucucugcaauagcaauguuccaguuaaccacugggcucucccaguaagguguguuccuaagaugguuucuauaaaacacaguaugguuuuuaacuguuuauuaguuugugcccuguaacuuuuauucaauuuggugauuuccccuauuuuauaauuccauuuacuuuagaacauuuauuugguuuuuaauuuuaagauaggauuuugcuauauaauccaggcuagccucaaacuugugauccuccugugucaacaucccagguguuggaauuacaggugggugccaccguacuuagcuuuccuugcaauaugcaucuagaguaguuuuuuaaauccccuaagccaguauuuuuucagacauuccagugguccucagugguuuuuuguuugcuugcuugguugguugguugguuugguuuugguuuuucgagacaggauuucucuguguagcccuggcuguccuagaacucacucuguagaccaggcuggccuugaacucagaaacucagaaauaaaagcugccucugccucccaagugcugggauuaaaggugugcgccaccacugcccagccuacaaggauguuuuuauauuucagcccagucagugcacacauggaacaguuaauguaugcucacauugguaguuccccuucccacuuacaaaguggugucuucaaccuugugacccauagcucgaaaacugucacaguagagacugaaacuagaaaacccacccaccaucuuucuuccaugcuuuuuguuggguaacuuucuccgacugcucugaauuugucuugacaaguuuaacuggacaguguucuguucguggcccaguugcagugacagcugcuguuguauaugggucuuggguacaaagaaguccagugagacuccugcugucacuucaagugccucugucacuagacaaaucuucaguccuucugugaagaguuccuuuugcucagcaacauuguucaguuugaaaagucacaucucuguuucucauaaaccaauuaucaacuuaaauucgcuguuagcgaaucguuuuaauuuacaaugccauaucuuuucauuauauaagcauuauauaugcauuucuuauaaacuauuuguagaucuugguaaagggggaaaacaauaaucuuccauuuguuucgugacagcuuagcagauagaccucagacuuccuucugugcuguuuuuaguuauguauuuauaugaacagcuauuacaaaucuuauugccccaaagcagguguaaaucuguaguucaaagcuacacagaaguguggcagcccauagaccugaaucugacauucagucuuugguguacuggugacugccagaaagcauucuuacggugcauuugggacauagguuucuguaguuuuuuuucagaaguuauuucaaguuguuucaggacccacgaccugaugauuuuguguaaggcgcagagccaacacugacugacuuacucugauccacagcuauccaacugcgcaagcagcaggaccccacaguugaaaaucguagaggucaagccugaccuguucccuccguauaaguauagcugcacugucacgcugguacgugaguguguccuacugcugggaaguuguguucauuugugcuugaagguuuguuggaaugggggggugcgggggggggggggugccaggagcgguagcaggaagugagugcaucaggggcaacagcccaucagugacacaaugguagcugcugggggacugugcugugaguguguguguguguguguguguguguguguguguguguguuuguuuguuuucagguagauauaaaguaugggccagaacauuuuuaaagaguagucagagaucagaauccagucuagagauaauauguuaaccuagaaaguggauuuugggacuggagagauaguucacugauuaagagcacuggcugcucuuccaaaggauccagguuugauucccagcacccacaugacagcucagagcuguuaguaacuccaguacuggagaaucugacaccuacuuuuggccuccgcaggcaccagucacacaugugguggugcacagacagacauucaggcaaaacacccccacccauaaacuaaaguuagagagagaccgggggacggauauguucacaaacaaacuuaggaaguaauacacauuucuucucuaaagcacaaagauaaaaaguaaucaccuuagugggucugagagcuuuugaagcagccugucuggcucacggcacaggagucucccugccucccugucgcacuguuuccagagcugggguugaacccauaaccuugcgccaugaccaaacugcacuacauacacccuuaccaccuuuuguuugguguuuuugaagacaggguuucucuuuguagccuuggcuauccuggaacucacucuguagaccaggcuaaccucaaacucauauagagaucugccugccucugccuccuaagugcugggauuaaaggcgugugcaccaccuauucgcagugcuuucuaaaugauuuugagacaagacuguuuuuuaggcuggcuuugaacucacucuguagcacuagccuagccagccuugaaagugucguugguguguaagagacaagugacagauagacagacagacagacagacagacagacacagggccagaaccagcucaagguugaugccaagacguuuuagaggucccugauacaguucauccugcuagcuaguuugcucugggaaaccccauuucugccuuccauugccgggguuacaagugagcugccacaccuacuugguauuuauuuggauucuagaguucugaccucugggcauuuuacaucacugcugagccaucugucucuuccuuuuuuuuuuuuuuuuugaggcggggucuuauggagcucaggcuggcccugagcuugcuguggagucauugggaccagccuuggacuccugcucuucucucccuucccaagugcugaguacagcugugcaccacacagccaggggcuugaguuucugaauguuggagucaacucccuuguuucacagauagagaaggacuagauuugcaucuuuuacugaaagagaaagagggagaaucuuuagaaauuaggcuaaaucugauuugauuugucauuuccuuuacacuaauaccuggccacccugguuuuugguucuguucaaguucagucuaauuuuuguaguuuaaacauaggucuuggcuuuuuuuuuuuaggauuugggccuggcuacaucgagaggacggggaaagugcaaaaaucccuccuguagcuaugucuacaccaaccgacacaaaccucggauuugucccagcugugguuucaaccuugccaaagacaggacugagaaaacuccaaaggccauugugaguuccuucccuaaacacuuacuuaccuuggacuugaguuaugcuuuggacuuuaauacaugguuagugguuacugucaucaucaggacaagguuguagguucugaacuuaacaaaauaacuucucucugggccuuguccucgaugccaaaaugggacuugguugaugaccuaguccgcuuuaugcuucuauaacaaaguauccugaauuggauaauuuaauacagagguggguuguguacuuagaguucuggaggcugagaauucaagaagaagguguugguugagaucugcuuagugucugauggggguuuucucuguauuguaacaugguagagaaaggaccucacuucauaacagagguauccuaaaguaacuuggauccguuaauuuaucauggauuaacccauuuguaaagauagaaucuuuguaccuuucaaguuccauguaugaccuguacuugcaacucuuguaauuaaaauuaccaucucuuggccagaguggccuuugguccuucugcucucaucucugguuccaaaggaauaaugugacucggucucauugcagcagggagucggggaauccguggccuucuagcccguucugaugauauguucucuuucacggccauucauucauccauaugagccagguguucagagaugacugccaacugccccuucccugaggcacuuucagucuagugcaggagaaaaauaaggaaccauacaauuacaggcagggagacagaaguuguucuuagcaaagaaaacauccucuuguuauuuggcaguuagcuucuacagaggucuauaacccaggucucuugcugguuuggagaaucaauaggcaagcagguccccgugcucaucagucggggucacugacuguguuaguuaccuccccucauugcucugaccaaaugccuggcaagaagcaccuuaaaggaggaaaggccuagcugguaggccaugucuuuaauccagcacuugguggaucucuggaguaugaggcuagccugaucuacauagugaauuccaggacagccagggcuacauagugagacccugccucaaaaagaaaagaaaaaaaaaaaaaagaggagacuguuuugcucaagguuuaguuuaagggcuacaguuuguugugaccaggaagguggguggcagaauagccggaggcucugccacugcgacuucgaugaucaggauucaagaggaaugcuaguguugcccugacuggcaccuuacagcuuaugggguauauucucuccuuccaccaugugagcuacugggaucaaacucgggcugucacaguugguguccagugucuuaaccugaugagccaucucucuggucuccuuuuuccucuuuauucaguagggcacucagcuuguggguuggaagaaaggggucuguacauuuucagguugaucuucccuccucaguuagcuucucuggaaacacccucacauccagaggggcgucuccgaggugaguucagaugagucguguugacugaagacggcagugaaggcugcaucagggagcauggggaaggcaggaggcccacucagaacccugucccggacguguacaaagcucuucuuacccucaagccacccagcauugaagacaaagacuuucuguaguccagauccauaaguguugauacuuccacuccucguccucgcugaaucacaggcacuuugcugcuuggaugacuugccauaucuaaaugaaucuguacagcggugcugaaagaucaguagaaaauguuucuuuaaauagaagaaauuuguauuuuagaguuguggaagcugaaauauccaagaugcuaacagaacucagugucugacuagggcucaccuucuagcuucuauguggcacccucuugcuuugucaucacacaauaaaagguacagagagcuucccugauacauucgauugguugaacagcauuggccuuaaaucuguagucuuccugucuuguccucaugaggcuuggccgugacucaucaccuccugaggucccaccucuaccaaguguuaggcuuuugacaugaauucuggaaggauauaaaccaccaagauuauagcaccaaagacccauuccggaaaagugcaugguaaaaaagccgacuuugagcauccuucguaccuuuucacuggagcagggaaaguggccucaguaccucaagguagugauuagugaacagaacuccccccauucaauucacucacuuccccugggcuugccugccucucuggaagguagguggguuugggguugcuguccaucucuaacagugcagucgugguagcccguaggucagucugccugcauguugcagugccagcaccagaacacuguuuuccaugccuggcaggagcagugagcagagggaggggauucuagagaauugcccucaucucugccaucucuucgcacgccuccugcgauugcuuguauuuuuguccucuguuucacagaugaagauaccaaguuucugaaaaaucaaacugccucagggucccacauguauaaccacaguguccucuccagaacugaaccccaggucucuuauccucccagugagugggagcuaacaguuaaaucuguugccaggagauuugcuuuauugguagaaaacccgagucccagagagcuuuuggcaguaugaggaguuauuagcagaacugagaaacguuauuucccacccugagucaugggcccaccccucugcucuuuguucacugaugacucuccugaggccaucucuaaccucugcuuggugacuugaccugcucuuccucaggaggcgagcucaccacaccccgaugugccaaguaccacagaagcccugaacccaacccagagggagguccagcgucaguccacacugcagcugcugcggaaaguccugcagauuccugagaacgagucagagcuggcugaggucuuugccuugauucaugaacuaaauagcucucgacuuauccuguccaacgugagugaggagacagucaccaucgagcagaccucuuggucgaauuauuaugagucuccauccacgcagugccuucucuguagcagcccauuguucaaagggggacacaaguaagcauuacuucacucugccacgcugccucuuucucagacagcgugacaguuagaaccugagaagauguuaccuugugcuucccauagauuuccuucaccuucucaauggccgaugggaaaauaauuagcaauuagggacuggaguuugcucugagguuaagagcaauucuugcucuuauaagggaccccaauucaauucccagcacucccauggcagcucauaacuaucuguaauuccaguuccaaggaaucugaugcccuuuucugaccuccauggcaccagacagcaugcacauggugugcauacauacaugcaggcaaaacauaccaauaugauaaauauuuuuuacauuuuucuucucuucaauuagcagucaauuuagacaugcguaaaguuuguuaucaccagccugccuaggguuuagauaauaucuggccugcuuagcauagaauuuguuugaguuugacguggaaaucacuugacuccuauaauaaugcgagaguuagaauuccuuguaaguacaguuucagagcuuagaucucaaugaaguggagacauucaccuagaaucucuuggaaacaaaggucagcacauucuuuugcugguugcagaguuuugcuucugaccguagcccguggccugcauaaagaggcugauuucccuucugguuuucuucuggguacuagcucucuggccgggccccaagaaugcuggcuccugacagcuaaccggcuacagguggugacugcccaggugaagaugugucugaacccucauuguuuggccuugcacagcuucacggacaucuacacagguaggugccaaccuucuauguccucaagcaccccagaucagguuugggagccaccuuacuggucugugcuugguuccuccauccacugcacccaucuuagcagcuucugaagaaucggucuuugcccugacugccucugcuccagcaacagucgggggugggaaguggagcaguaauaacccuucacaaccaagauaguuuaaaaauaacaccacucgccaaucaguacugacauaaccuuuaaucccagcacuggggagacagggguaggcggaucucugaguuuggggccagccugguuuauaaguagaauuguaggacagccagggcuacacagugaaacccugucuugagaaaccaauaaaauaaaaugaaaugaaaugaaaugaaaugaaaugaaaaaaauaaaaaauaaaauaaauaaauaaauaaauaaauaaauaaaauaaaauaaaauacagcucucagcucacuuuuuaacuccagccuucaggaagcacaaguggaguucuguaaguuugagaccagccuggugugcuuagugaguucuaggccagucaggucuacuuaaugagacccugucucaaagcagaucuucauuuuaagaaaaaagcugguaaauacacaaguuagagaaaccaacgugauccuaccuaaggaaaaaacucuugccacaacucuguucuucaggcauguucauugucuacagagucagggcuagagacguguguagcacucuaguuucucugaagagagcacacuggguaugcagagcgugcuaucuuaauuuaaugguuuagcaucaacuccuuccucugccagcggauagagaaacaaccucuaaaaaggauaauggggacucugcucuacagucuuuacuguugaagaauuaaugccugucuguuucuuguggacucauucucaaaaguggcguugcuguauuucagcugcccuuuauucaccaugcuaaacuguagacagcuuuuccuuuccucuuuccuaggcuggcuuucucugguucucuggucucuuucccugcagcucccuccaaacacgugguugcuuuccuacuuaguggcuggcugaccugcaugucagcucaacuccaggcguggcuucuuucaccuccugcguucuucuauaggcagcugccgagauuuacaacuuccugcccugggguuuuucuuuaaaugcacaaauaaaauuguuuuuaauuaaaauucuguuuaaauuaacauagagugcccagcacuuaggaggcaaaaacagguauauauaggcuauauaggaauaguaugaucacugugaguucuggguaagccuggucuacauagugaguuccaagacagcuauaaccacauuaacccugucucaagaaaucaaaaaauaaaaccaaaacaauaaaagaauuccuuuguuguauuuuccgugaguccuggcagauguacugaauccugaggcagucgagccucuuguuacauugaacucaccucguuugggagcuguuaacucauucuuguggugcccuucacucgagagcaaauauaauauauaauguaaauauagcagcaguuuguguccccugacccugguuccuguguuuuagugugcgucagcaagagccuuguuaucagugacuaaugaauuccccuccccguggaugugccugcuagucuguccuaccugcugaaugguguuugauugcuaccacguuuuggcaauuacaaauuugcuauaagcacuuguuuacagauugugugugagcauguauguucauuucuucuaaggaaguacaugaugguccaaaugguauguuuaguauuauaggugacugccaaaccauuuuccagagugacuuuuccuuccaucacugugcgaucguuuugguuugagcuguaugccagcacacagugguguuuuuagcccucccaauuaugugugcagcgguauuacauuauacuaccgcagugaccagugguggauguguaguuuuugaaguuuuguuuugauuuuacucuuucucuguguauuugugccauggugcacauguggagaucagaggagacaaccuugguguugguuuucuuucuaccuuguuagagacagaguuucuuuuuggcugcugccugggacagaguggguugcccagaauuauguugacuuugccucccauguuccugugggagagcugaggcagagcugauagacggccaugcccccuuuaccuggguucuggggaugcagacucaggcccucaggcauggcauauacuuuacccacagagagaucuucccaguccuuaauggguuauucuccugggguuuauucugugcccaggaaggccgaaaaaccuccggaauaaaaggugugcuacuccaugcccagugucuuguugguuuguuuuuauauggccucaaggguugagccuagaucagggcaucacuguacugauggaauugcccucccggccccuaugauucaucuguuuaauuguauaaaacgauguauuuauguuuaugccuuguguguauauaugagugccugcaugaauggcuaugaucgauguggcauugguaccaauggagaccagaagagaacguuggauucccugaaacugaugguguaggugguugugaguuacaaccugggugcugggaacuaaacccagguccuccgcaagggcagugaaugcucuuaacugaugagccaucucuccagccucuuuaccuaacuucauuuauguaaaguguaagguccggauaugugcauuuguugcauaugaguguucaguuuuugcacuagacuuuguaagagggacaauccauuuuccguugauuugccacuguuuccuuccugaaccucacuugcccuguguccacgagacugcuucaaggcuccagaaugucccauuguuuaucuuugccaguguacacugucuacuuguucugucuuuuugguuuuuugagacagugccuuagggcuuuacugcugugaacagggaccauggccaagguaacucuuagaaggacaacauuuaauuggggcuggcuuaccgguucagagguugaguucauuaucaucaagguugagcauggcagcauccaggcaggcauggugcaggagaagcugaguuuuacaucuucaucugaaguucacuaggagaagaauggcuuccaggcggcucagacgagggucuuaaagcccacacccacagugacacgcuucuuccuccuaauagugccauucccugggccaagcauaaucaaaccaccacagggucucaacguagccuuaacucucaugaaguuugcuguguagaacagguuggccuugaaguuccugaggucucucugccucugcuuagauuaagggcacauacuuccguagugggccccagugcacacugccucugccauugcagccacagaauaaguccugucagauagcuugaguccuccaaccuuguucuucaggagucauuuggcuagucuguuuaucaguguguauaguccggcuagaaacuucaugggagcuuugaugaauuuauagaccaguuugaggaauauuguuuaaaaguauuaagucuuccaauccaaauauggucuuuccuuuuuacauuuuauuguauuaacauuuuuguuuuaauuugccuuggagacuguuuuucuauuaaauaccuucucauuaagaauuuuauauuuuguuagacuuauaucuacauuuguuuuguuuuaaguguuaaacaguuggauccagcuguuugcuguugguagagaugcuuguuuguugacuugguauacggugucaccaaacccaguuuuaucagcucugagaguguugggggaugcuuuucuaaaguuugccaauuacagauuaaaaacugguauguuguuuauugcuuuguuuuauuucuuugauuaaucaauagggcagagaucuuuuacauaacccuaggaugacguuacucuauugugaauuauauuugugaauguuuucauuuuccuuggcuuuuuguaagauuucucccaguuuauugucuuuucguguguggugauuuggagaacaccaaggguuucauuuguuuaguuggguuuuuuuguuuguuuguuuguuuguuuguguguuuuguuuuuggauggccagagcuuugaugcugugauuucagccuucaccacugugccuaggaaggcccuccccacccugugaccuccgugacuggagcaugcgcuccauugguuuaugucacaguugugcaucuuguuguguauaagugacccugaccugaucacauuuaaauucaccugaguuuuuaucaccagggugaucuuacggccuguguuaggguccccaccuucccgugcugagggccacccugacguccaugcuguaauuauguaagagcugggaagaauaagcuggagacagagaacccuuuuuuuuugaaauugggguaaaacaaaaacauguuacacacaguguuucauucagcaguggcuuaugcagcacuucauaugagagcacuuaggugcacugcauuguucuguuucgacuguguugugacuuaguccucuguaguagacguuccuuugcuugcacuguuggugcuacagugaucccuuugcuuguguuaaccugcaggucucuuuaauguggggaacaaguugcuagucagccuggacuuacuuuucgcaauccggaaccagauuaagcugggagaggaccccagagugucugucgguguugugcugaagucugugcaggaacaaacagguaaaggucuugcccucuuuuccaguucaguccugaguacucugacuagccgggaguucagaguaguccagucuucauucagaguuuuauaaaugccaaauugacuuuggaaaauguuuucaugcauccagggaccuuuagcuagaaaucacaacugacuuagcaccauguccuucaguccuaaacuuggcuuuguagccuguuagucagacucacucugucucccaguuuuaaggcuccuguggagacccagguguagggaccacauccuuuccuaccuaggaagucagucuucuaucugcaguccucaugcuugcuccucacuugucccaugucuacaaucucuaguccugugcuuugucucaggugggacagaugagacaguuuaaggcuuggcuaugacaccugguggcaguguuguuuugagcaauugguucuguguaucuaucuagucauaaaagacggcaguacuaacuccugguucauaaagaauuaaaaucacuuaagaaauagcuagguauucaaagcccucaauacugacaucuaguaccuagacaguauuaguucaagguagcugcccuccaauuggagggcagaaaacuuguagauugcuguucuugcuggcuccuggcuggcccuagugcuuuuagggucucuucugugacugcuugcuguccuuccagagaagacccugaccucagaggagcugagccagcugcaggagcuguugugcaauggcuauugggcuuuugagugucucacuguucgcgacuacaaugacaugaucuguggcaucugugguguggcccccaaaguggaaauggcucagaggaaugaagagaaugugcuggcccugaagaguguggagguaagucccucucagccacuauagccacuuuuaaaacuguccugucacuuggauagcuucccucaggcuucaugcuaucucaaggauagauggcuucaguucugucuaugugaggccaguggcuuuuuccuccuacagcccaguguuugauuugagaaacaucagagagcaacauaguuuggcgguuucuuuguuuuguuucauuugggguuuuuguugguugguuuugguuuuugguuuuugguuuuuggcuuuggagacaugguuucucaguguagcagcccuggcuguccugaaacucacuuugcagaccaggcuacccccaaacucacagagguccaccugcuucugcuucccucaugcugagauugaaggugugagcugccacaccaggcucugcucucccugucucuccauuccacacacagacuuacuuuuugugaugcuggacauugacuccagagccguaugcaugcuaggcagacacacuacguaaagaguuacacuccuagacuuuguuuguuuucuucacucagacuugaacugaaacaguauaggaacaguauagcaggucaugaugauguagggaguaaugaaguaugugagguuugggggugugggaguggacccuaccuauauaggcaacauagcucuuuaaggacggguaaagagugaaaugaagagccgccagaggugcuuggcagguagugugagcugguguugguucugaacuacagucuacacgggaugguuuuguagguugugauaaaaguccaagguacaacugugaucccugucacaguuaagaggauuugcugcucuuguagagaaccuguguucauuucccaguaccgacacuaggcagcucaccaucaugcuaagggcucuagugccugaucuggcgucugaagcaccuuacauaagugcacacacaaaaauaaauacaucuucccuuaaaaucagacguuuuaauagaaaaaacuagagcugauuauacauuaaaaauauagaugccuaagucaugaauaaaguaauagugcaucugguccaacaccaaauggaguaguaauauacccuggcccuggccacacuuacuaucagagcuaggcaucucagggagcagagcuagcaucucaguguguuugcagguuagauggcucaguaguuaaaagcacuaguaagugcuuggugaucugaguuacaccccuugguugguaccaacaugguggaaaccaacuaccacaagaaauccucugaucuccacauuuuccccgugugcgugugugugugugugugugugugugugugugugugugugugugugugugugcgcguguguguguguguguguguguguuugugucuuccaucuccacauuuugcccgugugcgugugcauguggugacuuucccuugauuacagcaaggguauaugcuacuugugcuggucacuaauuggauuaagaaucaccaugaacacaaaccucggcaugucuggaagguguuuccuaggcagaucugcuguaguagaaacacccccuagccgggcugugcacucaggagagggaagcugagcaccagcagucaccugcuuccucacugcaggugcggcuccaucagcugcugucuuaggauucugccacagcaacaagagugggacuaacgcacugguauuaccuuggcgugagguuucugucucucguuccaccgugguaucuagaggaguggcucaugaaguggcaggugcaguggggugaauagccccaguaugcucagcaugauguuuugucuugguugguuuuguuuguucauauuccugucuuagccuucuuggagugggcauagcuuauacuugcacauauucuuauuguaugcugauuucuguucaaaggauggaauggcuaggacuugcuucauugcuucaacagaaacaugccaccagcagccuaaggauggaaggguugccuuugucucacaguuugagaguaugccucguacagguugaaaaguggccuagcauuuacauuccgugcucgagcuugauccagggcuguguauaugcugagccaguuccucacugucaagcagcaccugcccugcagcuagugagucagccacuggcucugaucagagcaguacagcuagagccacacuuggaggaccguguaaggugccguguccuccaacagcacagcacauauuuuauaauuggaacgacgaagagauuaguguagcccuugcacaaggaugacaugcuaguugaagcaaaaacuaaacugcuuguaagaaaagucgcacagcacugagacucgguaguaggaugcuugucugugcucugugugaggccagguagaugguguccgugacugcagagacaagggggcagcuuaacauaaaugcugggugccuguaguaguuaaggcuuugcuccgggaggggagguaagagcugaguguuguccauguccuggagagccugaagaaaggccucacgaggcccuggcagaccauagaguucuccuaagccgacuucuguuauccuugguggcuaggaacugagacugugguuugaaaauuaaaccuaagucaacauuccuuucuuuuucuuuuuuuuuuuuuccuuuucuuuuucuuuuuuuuaauucuguggagcugcaucucguguagguguguguagguguguguaggugugugugggugugugugguguguguaggugugugugggugugugugggugugugcaggugccuuuggagggcugaggcuuuggagucucuggagcuggacuuccaggugguugugagcuuccugauguuggucugggaaccaaacucaggucugcaguaagagcaguaagugcuuuuaaccacagggcaugccgugaacagagcuguagaagcaaggggcuuauuauuauuuggucgggggguacgauagugcgagaggaagaaacaguggcuugguauugaauugacaaauucagggguaucuugguagugcauagcugucagguuuuggucucccagagucuugauuucauggugaguuauaaagaucauacuguguuguuacuaaucuguggaucauacacuuugccuguuuaucuuuguuuuguguuuuuuuuuuuuuuuuuuuuugccuuuuuuaaaaucuugaccacauuguaguuuaccuggccugaauucuugggcuccagugaggugaacguagaggacuuuuggaccacaauggagacggaagugauugagcagguugcguucccugcgagcauccccaucaccaaguucgaugccucuguuauugcucccuucuucccaccacucaugcgaggagcugugguugucaacacugagaaagacaaaacccaggacaugcagccaguaccugguaagaccaucugguggcuguuugaauuaagaggaugggucagucaaggacugugccuagcuguggcaaggcaugguaguauacaccuuuaauccuggcacucgggagacagaggcagguggaucucugugaguucaaggccagccagccaggacuaugugauaaacccugucuccaaaacugauagaaauacuuuugacauuaugacccagaaugacaccuacacuccagcaugugucacaucuauagguagaagcuuacacaaaucgguaguuuuccuguacaaauauaauacaucuguuuuaauuuuuaaaagucuagaaacacaaauuauuaauuuugucagugcucuaugugacaggcugguuguaaacauuguuucuuaguguuagcuaaugagguuucucucccucacuucagcuacuucacuucugagcucugcccucugugagcuaggucaggggcauaguauguagagaacaguuuuuaaaugacaucacugggccuugugaucaagaacauuugcugcuuuugcagaggaaccaaguucagugcccagcaagcacaugguggcucauggucacugugacuccagcucuaaaggaucugcuacccuuuucugaccuccaggcaccgggcacguacauggugcauauaugugugugcaugcagucacagauagagauaauguaacauaauagcuccucuucuuuuuguuacuacaacaucugaaacaccugagcucuugcuucuaaaaacagacuguggguuaaaaggcgaacuauuguggggucuuagcaaugucugucucuguuaugaaauauaggugcuucagggccauggccuagugagagccuucacuagcaucuacauuucaguaaaugcuucagguaucagugaagcacacacauacaugcacacaugcugcuccuugccugccacccugcgugucucaccuccccguucucagucucaagcgugaggaacuagccgugguguugcugucagcagcgcaucccaucagcacuguucuguguuucaggcaacggcagugccuuggugagacugcugcaggaaggcaccugcaagcuugaggagcuuggcuccuacaguggggaggaacuacaguaccuucuggagcagugcgacauccccuuuagcccagaagacucgagggugaguguugggaguggagacuagggauuugggagcaggcagcugaacuccguuugguaugggauguaagccccauaugauugggcacacguaucggauaggggaucuggaacucaggaaacagauacagcagcagccucguagugucugagcucggguuuuugauccugguucuuacucuguauggugguaaaucacauuuuaagcuuguuaaccccauuucuaaaaucaaaacaacugaaaacugacauagcucuuauaaaggacacuucacacacagacugguuuuagggucauaaaaauggcugcugugaacguggacuguugccauguguguguguggacucuguccauaccucgcuuucucuacuacugaaaugaaaagaugcuuccuucaaauucagauucaaaugcuaacuccacuuggaacguuucucugacuuuaaaaaaaaaaggacaagcccaagucaggcagccuccucccuuuggagcguccugauguuagccugugccuagaggaagggccgccgaggccucaggcccagcaguugaugccuuugcguuggguucggagagucguuugauacaggguaccuuagcguuugugccugagucgugugcaucuucccuucucuccaggaucagcucugcuucuccuuguuggcccucuaugaaucuguacagaauggagccagagccagaccucccccagcucauuucaccggggguaaaaucuacaaagugugcccccaucagguaaggggagcaucgggcaagucugcucauguugaauugcccacagagaaucugagccaucccugugggacugggacuaguaucacagugcaaccuggagagucauugccauuuguggggcuggagaggagguaggauguauuaaacacccuacugcgugcugccuaaguguccagugguaaacggcagggaggccguuugucccuaguuguccuccuauugucauggaguuagguuaccacagccugugaugcucgcuccagaggacccagacagagcugaggcagagagugguggcggaccugcccggccuuaggcagccagaggaggccaaggccuggggacaaagaaagaguccagaggggaguggcuccugagacuucauucugaagauggaguugaaugagaaauggggagguaaagugacugcauauacacagcuguggcacagauggcagaauuggccaaggaaggugucagaauggaaccccaguucacagugcugugagagccaggcugagcuggcuggagaaagaggcugaggcagccagucacaggaacaaagcuggggggaggggcggcuuugacacucugugacagaucagcaccugcucagggcauggugcugugugcccagugucaccuucugagaagcaguggacaguccagggacucaagugcuguccugggccuguacuagggagcacuucccguggaggugacaagaugggagggguacagcacaguucuccaguacacucagaccuguccugucauagcaaaggcugcuguuuuucagcccagugagcucagaguacugguaguucaguccagaggcccugagccuuguguucacguugguugccagggugguugccagggugauagaguaggguuuagagauguuugaggugcuggugguucuagcuguucuuaggacaaggaugagcuagugacuucuuuuagaauccacucuggaaggagagaacagacucccgaaaaggcauaccuuggcgcgcgccaaggauaguaguuaaaagcacuaguaagugcuuggugaucugaguuacaccccuuggaugguaccaacuaccacaagaaauccucugaucuccacauuuuccccguguguguguguguguguguguguguguguguguguguguguguguguguguguguauguguguguguguguguguguguguguguguguguguguguguguguguguguauguguguguguguguguaugugugugugugugugugugugugugugugugugugugugugugugugucuuccaucaccaggcugaucuuccuugagggaagugaaugagggcuauugcagcugucugcaugcugcuuccuuaacucuaaaugauacccuccaucucccgcagguggucugugguuccaaguaucuuguucgaggugaaagugcccgugaucacguggaucugcuugccucuucccgccacuggccaccugucuaugugguagauauggccacaccaguggcccuaugugcugaccucugcuacccagagcucacuagccagaugugggggaagaaccagggcuguuucucuaacccuacagagccaguugugguaagucaccuccuaagaacugaaauaaauccauggggaauaaaagcuaugucugcccacacccgauuauuaggagggccugccugggaacugugucuagcagccuucuuucccaucagcauuugaugcaccagcauguauguacugcagacacauuacaguccgaggccagaguguaucaucuagugugcucagggugucccaaaccuaggcaucaugugugaaaauaggcugcuuuccagagaauccagaaaauugccgccucugggagucauuguacacacuggccacccugaagggcacuguuaauuccugagucuuagacuuggcuguuagaugcagauacguggucuuagaagaagggacguugcauccagaacuaugagcuaguaaaccugcuuuuuguuuuuuauuuuuuaaguuuuuuuuaaagaucuauuuauuauauguaaguacacuguaguugucuucggacacaccagaagagggcgucagaccucauuacagaugguugugagccaccaugugguugcugggauuugaacucgggaccuuuggaagagcagucagugcucuuaaccucuaagccaucucuccacccccauuuuuuaaagauuuuuaauggaggugguucugggguucagcacuaaucuucucugacccucuccuuucauuagaaaaggaaaauaagacccagggagggaacuagagcuggugagggucacccgacugcugagugauggaguccuugacuuuguguguuggugcaguguaccaggagguaguuccugcuacaugcaugugugcucaaggccugccuuuggccuugaccagaagaggcacgagaaaugaugcaggagagaagagucauagaggaaaugagggccucuacccaggugcauuaugggagguaaaggcuuggcucuagacauucuccuuagcccuugggcuuucaugcuccaagaaauugugguagagacccaaaagugucugaagugucccaccgagccagauccuccuauuccucuggugcccacauuguccagguacagugaugguauagcucucaaacaguccagcaccugugcuggggggaccauuuuccuaugcccauucuuacaugaagaaauggggcacaggagacacaguguacacagccuuuaggauuuaaacggggcugccuggcuucugcucucuccagcaagguucucccucagucaucccucuuacagagcagcuucucuucucucuuguagaguguguccugcccugaacucuuggaccagcauuauucuguggaugugacagaggcugaaaacucagugcagcauccagucaccaagagugcgacacggcguauuguccaugcaaacacaaagcccgaucccagugaccccagugcuggccaccguuccuuaucacugugcccagagcuggcaccuuaugccucuaccacggacagcaagcucagcaguguccgccagaggcccaucgccuuugacaaugccacccacuauuaccucuacaaccgccucauggacuuccucaccagccgagagauugucaacaggcagauccaugacauugugcagagcugccagccuggcgagguggucauucgcgacacccucuaucgccuugggguugcccagaucaagacggaggcccaggaggaaggagaggaagaggaaguagccucagugguggaauaagccagguuuuuauguacagggccugcaucaucucucucaagccauaaucuggcccuugcccagggcaguccuauugagggaccugcaguccucuuuagggagggccucugacugcuggaacugaccaaagagcuuccauuucaugagcacaguggggccucgaccucuggggcucaggagaggcgcugggaagccucuccuugaccugagagagcacguggaggcaggacaugauguucuuaaggaucuggugcugauaggaaggccggggccugguugcccagacccacaaccacccggguuccugcaccagguggagccgccauugagcuaagcugucccgcggggaggagcucuggcuccugucuugugggcuuccuagccugccuugcuggcuuauuuacucuuggaaucccuuggggcccuucauucucccuaaaggaggggugcauucucuguuccuccaacucucccuguucccacaccuuggggcaguugaggagaaggaacagcuccuccaggacucucucagccccggguuugggggaagagaauccuuccuccuuucucuggccacugcuacuauacccuacguccucuggguccucagacccucaccacagaggggauguggcccgugguugugacauagcugacaagcaguaggaaaacucccuucugugaaggggaagcagauagggccauaagcaaacagcagcaugggcucaggugcccgcgguuugcuuagggcccaggauuggccaagugcuauuuaauuuauugagagggugggauagguggcuuucccucucguucuucccccaacaagaauaaaguuuauuaaauuaucugguuuugaugaagcaagagccuguucaaugcugugucccuuggcucuggaagugggugcuuguuggucccuugucaggaggaauagguggaaggaggucgguccuagggagcuugaaggcaccugugugcugcaaagaaccagacccugcuggcuguguuaaugcuguuaguuuaauguugacaguuaaugaggacgagucagcuuggagaggagcacacgguguuuguugguguggucagccuugcaucaggccccauaccuuccagucuagagugacagggcacuggguagaacacuuuuagcugccgcucaguacaagauccaggaugaggcgggacuauagacagagugaaggucaagagugguggccacuccugugagcuuaggaaggggccaccugucccaagaagccuguagucuaagcaucugucagggaggcaagccuucagcuuacccacagccuuugagacucuugucuuuugagacauaaaucagucuuuccauugaaacacgagaguuugggacggguuuuuuaaaaugggaauaggauggagaaagagaacuaggggugcaccaguuggcauaguaaauauagaggcuagcacugugagaaccccacuggcagugauggcccaggcucugggaacaaacggggccucugaccuccccagaccccucauguucugaagugucagagcugggccaagcugagggcgaaguccauauguucuccccaugucgcccgugccauggaggaggccaagcugggacguagagagcggcaggacucggcucucccucccacuucagcagaacugguaguuguuaggcugcagcaggggcugggcgauguccccuggcucacagcaggccagguguucacuggagcucuccucuucuggcucacugcugcugccaccgcugcugccaccaccacugucacugccgcugcugccaccgcugcuuggcagguuagcauaguccuggg

SEQ ID NO: 8941 - RNA, 3752 nt, Mus musculus
aggagcugccccugugguucuccuagugacagagcacgccugcuugccugugugggaaauagcuuuccauguuuccaguaaaagcuucaggguagaaaaugugcauuucuggugguuauguugauaaaauccacacuggacucuguccuagaguucugcaaauguugacugcugcuggcuuguucuuuugucucccuagcuuuaugaauaauugaaaaaaucacaguauccuagccauuuuugaaaaucccucuugcccuuuccucaggcauguuggaauuaagccgguuagagauguuuaauacucagagacagacugguaggcagguacacggucaguggggcaggagggguguucaggaguuaagagcacuugcuacucuugcggaggacccaaguucaguucccagcacccacauuaggcagcucacagccaccugcaacuuuagcuucaggcaaucuaacccucuucuaaacuccaucacacacacacacacacacacacacacacacacacacacacacacacacacacacaccucucuuucuaaagcacuuguuuaagauaacuguauaauccauucaacaccagaguagaaaaagaauuuuagcugaguguuuggaaagucucugcccucugacugacuguaaggucacaguguggaccuaacugguucaggagcuuuacauacgcguuagcuaaucuucgaguucucuucugauuuguguuugucccacagaagcgaacaggagccuacuuuucaguagccauuuuaaaaugcgauugcgcuggagucugcugcugccuuucucuuaggguugaucucuuccuaaaucgaacauuaaaacugauuuugauugcugauauuugaaggaaucaaauuuagaaccaaagccuaauuuaccaccagcaucaaaaaacaagccauuuucauuuccuuuuugaugcuuugaacauauuuauaaaaguuaucuugcucacuuugaacauuagaguguaaaauauuuccugguuguuugcagagaaguagaacccugaaugcuguuaaaugacuaucguuuauuuaaaauacagaguguacaugucuguguauuuuaugacaaggucuuauauagcacaggcuggccucaaauacgcuaaguagccaaggaugauuguaaacuguuggucucccugcuucugccuccaggugcuggaguuaacagguccuagggauggaguaagcuagugaguauacagaccugcuaugaaaggaacacaguucaggggagugaaagguuagaucaccaagaucuguacuguccagaaaggaagagaccuggcuggaucuagauccugguaaaccccacaguaagaucagaguucaggagcuugccuccaagagcaguguuagaaguagguccuguuucuagauggggagagucccagguucaccacagcuccaaagagcucagaagcauaugcucacguuguagccaaagucugggugagccuacucaggaguacuguccucccugugagccgaguggcuguagugcugugcucaggaguacuguccucccugugagccgaguggcuguagugucucggacagaagaagacuggcaggugccgaguucauucuaagcagggucaaugggacagguaugauuuauauaaagucuuucagcacagugaguggugaacuuugagacugccugaagugauagaugaauucaucagacuaaugcuucuggcuacauuguagcaaaaccagugagccucugcagggauguuucuggcagcuugacauuuaagaacauguuaccaggauuaacuccuaagcugcaaaggacagaaaagaguagguuuggggacuaaugccucuucauuuacggcgacggcucgagcucuccacaacacccauccagccacccacacacaccggugaguguccucacuucugaguucucaaggaggugcuguagggauagcugaagacucuuugcauggaagugaacccuuccgcauagccccaaugucugggagucugguguccaggagaacuuagaagugcuuuauggagaguacuugagcugagggcaaauggaggccugagguggaggagugucacucugguaugugcaggcaagacugaaucuccagaaaaguagaauucuccaggugagaagcuuuacaguuuugccuaauuuuuuuguucuuuagugcucuucuuggacucuuaauucuggugguguuuuaauuugaacuugggcuuuaaauuaaguugaagagaggaugaauuucgccgggcgugguggugcacgccuuuaauccuaguacucgggagacagaggcaggcggauuucugaguucgaggccagccuggucuacaaagugaguuccaggacagccaggacuacacagagaaacccugucucgaaaaaaaacaaaacaaaacaaacaaaaaaaaaaaaaagaaaggaugaauuucuacuuagacucaaaaugggcacaguggccugugaggcacuugacuuggaggcuggggcaggaaaagacuuugaggccaaccugagauagcuguugagaccuugccaaaagaagagaaaagaaaacuagcuagcuguuggagacccauuugucuuccaacucauuuauacacacacacacacacacacacauauauauauauauauauauacauauauauauauauauauauauauauauacauauauauauggagagagagagauuuuaguaaauuauugaucauagucuauuugagugcuaaguuuaagcaugaaaauuauaauggaacaggacaaaacagcgcaccaacuggcuuguuauaggcuauuucauaaaguaaaauacaauugaauuacuuuguguuaaaaauaaaauuuuaagguuuuuauaaaaaguaacuuguaaauggaggcuuuagguguagaaggggguguauuuaauaagguaauuuuuaucaugauaacuauuuuuuuaccaaaaguauuuuguaacugaaauuuuaaaguaaaucugcuaaguacaauuaaaaacucaaacauuaugcuaguauauuuuugaguauguauuuuauacccuaugacuuaguuuaagugcauugaagucugcagagugagagugagagugacaaauacuuuuauuagagacacagugguagagaauacagugguauucuaagucugucguagcugcuaggucacaaaggguuuuaaccugaaacuugaacagacuugcucugggauaaucccacaccguguacugcaucgcuaagcagaaauacagaaccaaguagcugcuucccccucuucagugccagucauuugggaaauugggaucugguccugaugcugccccggcuucugggucuuagccgugaguguaagaauacccacaagccuggcuuucccccuucguagcguuguguacaaaaacagacaccacggagaaggguuuagccgucgccagccucuacccggccugguuacuauucggaaugcauuuuauaguagguuuuuuaauucaaguaagugccucgaugcugauccuuagaucagcacucaaccauucuucagacaagaaggagguguuuccuguugggggagggaguuguuaaucauuuccuucuggaagaauauguuuguauugcuuauuuuacaacgucuucuauguguuugagauuuaaggaugccauuucuuuugugaauaaauuguuguaauaaaauauuacuguguaaauuau

SEQ ID NO: 8942 - RNA, 1737 nt, Mus musculus
cgugcgugcgugcagugggaagaggcucggaguacuuaaggggguuggggugaaaaaaaaagcccagcguuaacguccccccccccgaaccgggugauuaccucgccauuggugauguugaucgcuagauaaauguccccgaaagagccagauccgaucuuccgcaccaguuuguauuuuccaccgacgauaaauucggccuuggagccgcugcugcucgccauccugagacgcgaagauggaggcggggggccgagccccgacaccucaggaagaggauggaagccuccggggcuguuccacccgcggcagaagugagaagcgcggcgggcaaccuaaacccaaggcucugucggcgucacggggcgcacaggcggcagagagaagccggaucgccgccgccgccgcucgcugaagggccaggccgcgguucgugaaggguggucgcggcugcugaagcucggccgcuuguuguucucgggcggccgccgcugauuuuuuuucguggucgcggcgacgucgcgggcugggaaaggggcgcggugaacgagggcgggcgguaccgcugccaccacugccgccggcuccggcccggagggaagccgucacuccgccgaggccgccaucuuguuacucuagcuccagccaacacaaaaugcccccaguccccgggagccgcuucuucacggcgcggagcacucugggaaagggagcucgggcgcucucuccguagggugggcugacaaggggagggcggaaccggauucgcgacaggcgcagcccacgcucccggcgucacccagucacgcccagcugcgccugcgcgcugcaaugccugcagacugcgcaggcccggugcggccugucuuucccaccccucccaccccccgcccgggcucacuuccacuuccggccggcgguggcucucuucgugcuaccuguuagucacuucggaccccgggggcugugucuugcugugcgucaggagaacgcguuagggagucaccuucuuuuucaaauguggccaaugaaagcuucugcccuccuugggcgucgagugaucuuucuuuccgcguuugaagcgguuuauagccuuugauccuuuuuuuuuuccaggucacucuggggccguccccuuuugcagcacaguggggucggaauaggucguggccucagacggaaagagaaaagcuacccugggcgagcuagguuuaggaagugguugguuuagcuuacuaguaauuaaaaguccagggcuccugaaguguugcuaacuccccuccccccauuuuuuuaagggcgcauaaagaaccuggaauuaguacucucuguucguaucccuuugaauacacuggauuggaaaggaacaauucugauagaaacuucauaauauuaugcauugaacaggaaaacuugacaagaaaauugcgcauaguaaaauuuguuauaccgauccccaaagaaacaguuucgucuugggucauguugagaaguacaauauuaaugcaaacgguacgaauaaauauuacaaaguaaaaccgacguugcuuaaaacuuaagguaauuuuugauuuaaaacggauaaaacaggacuugaccauauuuucagguacaaaauuuuuuacugaaaauugagugugagaauuaagguuuacaaaagcuuccucgggugcuaugaaacacgaauauagccugguuuguaaacauuuaagucaacccuaaaauaaacauuaaaau

SEQ ID NO: 8943 - RNA, 35145 nt, Mus musculus
guugaguuacaauaaacuauucuuuauuauucccagcaaucuccagggagaacagccuacuggcuuagacuacaccgucugucucugcaguucaugauuuaucacaauucagcucguguuacaguacacucugaaauauuuacaguaugauagacuuaaagcagagaggaaaucacagcaaagauaagccuuguauguccacuugugggucauaagagcauauucacaaccacaugggagagacaaccagccucucccuucauauauauucuuuuuuuauuuucuuauuuuaccuucccaaaacagagacauucaacaguaguuagaauggccaucucccaacaguuaaaaagcugcaucacccaauggugaacaaagaaaagaauggcaaccuaaaguucagcugagccagccacuguggauggagccuuuaguggugaggucuuccaaucucagagugaugucuucaacauacaccaucauuuuaguggaaaaacacaauugauuuggugaaaugagauucauuuccagacaggauuaguaacugcauucacugaauuucacgcucuucuuugugaacugugaagaaaaugaaugguagcuagaagaucaacggauuccagcuccagcuguagaugggacgacaaaauaccaggacagaacauuucuagauucugagucacaaagcuaacagcaguuucaaaccugcaacuuaaugacauaccaacaacaccacaaccuuuucaaauggcaaaaauacaaaaaaguguuacaaaaauauuucagaaaaagugcauagucuaagugcauaguaaauaaaagcacugaaaaaauauccugcuagauagagagagggaguucaacuuggaaagcuauugccaaagcugaacaguuuuauuuuacacaaacuauacucaaaauagcuuuaugagacugauuucccgcuaaaaguaucaaaggguuuauuagucaagaaacugacaagcaugaagcugccaccccaccaucagauccaccucagaagauuauuucagcuuuacgguaauaacacaucucuuggugacagaauguggcaaucauggaguuaauuauugcuguuucaaaaaaaagggggggggggagaagaaaaggaaaacuacuacaaaucaauucugauacaaucuuaccaaacaugggucaauuuacaauucaagauuauacacaacaccuaguuacacaauaggcuccuggcagcauuuucagacaaauuuucuuuuuaauuuaucuugacaugcuguaaaugaauaaauuacaccauuuaaagaauuacuguaaguuuuuccuucucuuggaucagagaaacaacugaagagcaaccaagaaagacugggggaagcgugcacagguacuuagagagguggggcuugaggaucaacaaucacuaacuucacacuguaugacaaccuuacagccauuucacagggauuuugaagaaacauauuuuguaauauaguuaaacccuuuaacacuuucacugucaucaguucaucugcuagucaguggcggcagaagucaaugccaaagcucccacagcuguagcacgggguagugugccugugagcuacaaacagaaagccaaagaauaccuuucucuucagaucaagaacagccccccccccccaaaaacccaaaaccaaaccuuuugcagcaaaggaauaucauauaacaaauggcuugaaguagucuaucaaaaaauuagggaaagcuggacaugguggcucauuuuuuucagucccagcucuuuagagaggcagagucaggaggaucugagaguucuaggccagccugaucuauaaaguuccaggccagcuagagcuacaaaaugagacucugucucaaaauauaaaacaaaacaaaaaacuggggaugguauauauaugugugcauauauauguauauauauguacacacacacacacacacacuucauagugagucagccaaggcauuuuguuguuuaaaaaaauuucacuuccuuacagaaacaguuuuuaguuuuuaaugaacuuguaaacaaaaagcucccauuucaaaauaaaaacaaaaucccagaucguauagauguuuacagugauuacauuuaucuaagcaacacacauacauguucaguuguaagacgguaacuaaauuuccgugacaaauaugcuuuuuuuuaauagcaagaacauuauagaguuaaugcagaguccuaaagagaaucuaguagucgcuauguuuuuuuucuuaagucuucacuuuagaugcuguuauuucuagcacagguaagcaggcagagucuuucaaaugcucaaacacuggaaucuuugguugcuaccauaucagcuggcuugcaaacaagaagccagccauuuaaagaauguuuuaaguuaacaacuugcaaaccccagggauggaaaacccuaagaacacacaauugugaacauuuacaaccaucacaacuguggcugaagacuguucaugccguucuucugaaaugagaucucaaagcaguauaguucaaaauaaaagauuuuaacaaaaaaauaaaauaaaaauuggcauaugcacaauuucuccaccaauuugugugucaaccauuuaguuaacuuuuccacuugaaaaaaaaugcaauagaaaaccggacaccauguuucacuaccucaguuaauauucacaaggacaguggcuacagcucaggauccgcagugcuacccagagccaguuuauaccgaaaugaaguucuuuacaccaaguaaaugguuguccacaaccacuggcuaguguacauaugaacuaaaaugucuagguuuggggagaaacaaacgcugcuccaaucgucugcucugcugcuucucuuccacaauucaugcuuagaaaccuauuaaaaaauugaaacagaaaaaagauguuacaaguacuccccaaauuagguacaaguaggacaauaaucacuuggaaaugcuguguuuuuaucuggaaaaucaccaaccuaaacuuucacaaggcaguacaugcaucucugauuaaagccacuccccagccucacucugaauaacccaggaagcagucuauaaucaaucagggccucagcacccaacccuaagcuauaucagaguuguuacagucacaagaggaugcccaauucuucuucuuugauaccaagaacacacuaaauuuaaaaaacccaacaagcaaugaaaaagauauuacugcagcacuagaauaugauucuaacuagaguaaaugcaugaauuucuguguacaccaucuaauaagagauuacauaauagaaagcucuaaugaauucauuaaacaugaacuuuuuauaccacuaagaaaugauuucuauauaaaacccucgugcuaaacuuacuacuuuucuacuuccauugcugcauuaaaaagaccaagucucaugacuaacucccaaacuagaaauacuccauguacuuuccaaauuguccugauccaccacaguucucucuccucaugagggaacccagggcugcuaccuuuaauggcuggucuuuuuuuuuuuuuuuacuuaagacagaauaaacagucuaccucuuaguaacacaaacaucccauaaaggccauuuggucuauucccuuccaaaccugaggugaccuaacuacauuucauacauuucagaccauuucuugacuuuuuaaaaacaaaaccagcacgcaaaccacuagcaugacaacccccacgcuucugucaguaauauacugcucccccucccuuuccucuucaagcacuggauuuuuccuuugggcuucaugggauauauaaaauuuuccuacuacuuacuuuuuauuacaaauguuuucaagaauaaaauuguaaagacauuauuacacauuuauaaucaucauuuaaaaaaaauaaauguauuuucaccuguuacuaaaaacuucucaucugggaggaagacuagccauccucguguacugauaaacacacuauccuaagcucugagggcagagauguguuuuaccccacuucccagaguaucuccuaugaaagaacaggcacauagccaacccugauuccauaauccuaagauggcauaaagcaaacauugaauaaagaugaaauagcacugguaaacuuaaaaaauaaaaaaccaaaaacguucugugcucuuuuauguguaagaugcuaaaaucaaguaucuuuccagauggcucaccaccuuguauuuaugcagggucuuacacugaaccuagaguuuacaauuuggccagcuugcuuugugggauacuaucucuacauucccagugcaaggauuacacuuggccuacauauccacccauuuuuaagggucugaaugcugguuuucauugucugcuagugcuuuaucuauuggacuagcuccccagccacacaguaaggcauacuuuaaaaggcuaucacaccugugaucuaauucugauuucacaggcuaagaagcuauuaaauccaaggaaccaugaacuaguuaaacaaaaauggccuucaccccauuaggauauggcucuaaguauuaaaaaguuauucauaaauacuguaaacaaaggcgauuucccagcuacuacaccuaggguuuccccccuuaucauaauuugcuguaaucauguaacuguauuuuaguaauuugauugucacauugaauaucucuucaugcaagcagauuugaaggggaaaaccacuacaaacuauaagccaaaauacaagacaacuuaguuuuuuaauaauagggaagcucuaggucagaagucuaucuguguggaccugccaguucagucuguggucaacauuguuuagggaccggcugaagguuagucuaacaauauuccugguagaguacagcagucaaauccagauguauuucuucagcuagacaggccaacggcagauguucuucuacccaggcauccuuucuccaaagagcuguccuuugauaguacucaagaaggaaaaacaucucagcaggccaacauccaaucuucaacuacuaacaagcacucucuuccagugugcuuuagucuuuuguuugauuuuaaaaucuuguagucugggcggcaccucugguuccagagcgcaucuucacuguaaccucaguuagaaaggaggcaccagcuucucuguuccuacaggacgggcagaaugaagacuauuaccaacguuggaggauuaguguaaugaccuaggaauuaagcuauauuaaguuucuuuucaagucuuugaauaagaaaaagugcucacucuuauauaacauacuuuauccccucaaaaagaaaucuguaagaaauauagcuuuacucaugaaucaauuucaaacacccauuauuuauuuauuuuuuuuaaaaaagagaaccagaauccauuuaaaauagacacuguuaugucuugagacaguuucaccugcuucuccaucuguauugaugggacuauaagaaagggccaucacgugguaauaagguuuauguauuugugguggauguuugaaauuuaggcucuuuccacuguauaguaugaaugaaacagucugaaguuaucaucaaugcaauaaucaccauacaaugucacuuauauuaauuuuuccuacaccauucuuauauggucuuccaguuauacaaaauuaagcuaaaugaauuuugaauuaagcugccaguauguauaaacccauauauccuaccaaaccaucaaacaacaguccuagcaacucaucuacaaacaacuaaaaccaugaaagauuaaaguauuuucuuaaucacaaacugguaauuuauguguaagagguucaaaucauucuugaauuguaccaacaguuuaguagucucaauuacugucuugucuccccagauuucauuuucuaacagguuuuuacaguaguuaagcuuaaaauaccuguuaugaaugaauccuucccaacuggcagauuguucagcaacacuguuacagucuucugacagucaccauccacacagaagcugacaugcugaagaguuaacaggcccagcaagccugggagagaucucuuggacuuucaucuucauuucuucuugggcuguguuacucuccagcuuuacuguccacaaugaaaaaggcugacaaaaaccccagaauucagcaagaagauucaguuuccuggucuucuuugaacuguguauucaagguagaucauucuuuccaaauaucucaaggucuucccuucccuguuuuggguuaaguugcugaauuaucagcuguguuccugacagcaguugaugaagccagaaaaggucaaacuacauggaacuaggaggugaaggaagcccacuguugggggaacacugauacagguagguuaaggugagggaacgacacuucaacucuuagaaggucaucacaaucuuuuauauuuguaauaaagguguuuaauacuuaugucugagacagugagcaguuaaaagacaguaggugaguagaaucccaugaggaucugucuucuaaacgaucuagcuaaauuucucucucaugcugucuguaacugaagugauuuuaaacuuucucuguauguauugugcuucugauaugagauaucaauagggagcccaggcugcccucagacuugcuauucuauuguuucagacacuucugcacuaggaaaaaaaauccaggagacauuaggaaaaaauauuguuucuuggucuugacuggcucugagaugcaguaacugaaaggucuagaaguaauuagaccgccuauuacaaaacaaguacauauuaacuaaauaagcaagauuuaaaaguagaagaaucccuguacagucucggugaauggcuagaacuuucucuaauuucuaugaaagaaacauaaaauaaauaaauaaauaaaaacaaaagcuuaaaccaaaaaacuuguccagaaaacccaaaaccaagccaaaacacccccucuacaaacucaaaagacuauaaaaaaauuaucaguaaaugucaacauugagaggaucuuugcagaagccagucucuaagauagagacuucuauuugcugaagauuuaugaaacugaauucacugacacgaaagcuuaagugagcaugcaccugagcacccggagaaggaccuucuacaugguuugucuucaagacagucuuacuacguagcccuggcuguucucaaauucagagauccaaacuccugucuccugagagcugagauuaaagauauguaccacaacccuccgccauuuuccauaauuuuugagcagagagaaauaauaugguauuaccauuauuggaagauaccacgacaucaaaagcuauaguagcagaaauagccuauaguucuauguacacccuauuaccuaaaaguuucaagccaccauuaaccuacauaaugugagaggcagaaggucuaagacuagauuucucaugcuuauuucaagccacccuuaggguagaagcauuuucuuaacuuuacccuuuggaaucaggucuuccacuguggaccuggaacucauugacugggcuuacucaggcuauccaacaaggcccauggcuuugcuuagaguacacuucaucacagccugcuggcugcuguuuugagacaggaccuugcucacaagagauggacuuucuaggauucagggcaugugcugcacacgaugcccagcccacucuggccccucccucccuuucuuccuucaguuuucuuuccccaagacaggucuucuaaguguagcuuuugccauuggagcuugcuggcuuuuaaaaugcugguucuagggauuaacucaguucccauuucuuacaagguggacacuuaacaucuuagcucgccuuuccaagaaugacauauuuuagucgcaagaguauuaugcuuaaggcaaaaacccccucucuugguaacccacugcaaacaccuacuguugagaaggaacucuugucuacugccauuaacuccuaagaucaaaugauucucuugccucugccucccagugucugagacuauaagcaauuaugucacugaaccuggccuuauaaauguaccuuuaaaagcagucaauacuaacgaauuauuuauugauaaaucucuuauuucagaacaugauaagaccauguacauguaauaaugugcacgaccacuguguccaaugauguucaacugguuuaagaguucaaguuuuuuaugaauaaguuacaauacaaaagaaggcuuaaacuuaaguuuaaucacuuuucuuuuucaaggaaacauacuaacucaguggauccaacuucucgucuuuaauaccuggauaaagcaggacaaaaauucugcuuguuuauuaagaaacacacaggaaauuggaacaauaaaauuagguaaaaaugaagauacuucuuucugaaggcugcugagugccugagaaacuguucuaggccagaugcgagugagcucacgcguagcuuuacuucuaagucccaauuuaggugcagaggcagagcagcccaaacacaccgcucugcucguuagcuuaggccucaucauccaaaccccaccuacaucuccaacucacccuccccaaauacagacucacagaaaggaaggccucaaguuuaaaguuaguaacugagcuccuggggucaggaugacaucaggucaguuuauuuuucaauguuccucagauacuagaagcuuuucuuucuuuaaaaagacaaggucuuacuuagcccuggcuauccuggaacucacucuguagaccaggccagccucgagcuaagagacuaaacauacaacacuaaauacaacacuaaaauauaggacaaauacuaauauuugaaaaccauguucagacuagagcagucuuucagaaaucaaguaauuagacccuuaccugcccaccgcuugcacaaagcaggcagguuucaguagggaagccccagagagggagucaguaacagaaggaagcaggaguugaacucuaaggcaccaggaauaaggaaugaugcugugcucugacaguucuacuccucagaagcacuacaagugccagagagagacagagauggacuagcaguggaauggcauuugccucaauuaucuucaacugauagucuaacugcaggcuucaggcuccacacugaacccuagugccagaaguuccuuagcauuuaaauaaagugcucccuuuaggaaagaucauucugaaauugggauaucauaguucauuagcagagagagaauuugauuuuggaagcuauacugagcuuugcaauuaucaaguugcucugcaacuaagaagauagacaugcuaaaggcaaugccaagacucaccucuggaaauuagaucauguucacuuuucccauuaaaugccaaagcauuaacaugcaaacaaaaaauuuagaauaucuuaacacuguuagucugaaaguaagucaaaauaccacggcuaaccagauuuuuauuaaaaaaaaaaaaaaaaaucaacaaguguuaggucuaggauuuuggauugauuggcaauaccauauucccaacaccaaauguuuauuuuggaaaaggguuaaugaaugaguaaaaaagaugcaguuguuaaaaugacccaaaaucccaagagaaaugauauaauauacacacauauauguauauacaaauacauauacauauauaugaacaaggacauuuggguuuaaaguuaguagucaaauuuuccaaggacgucuuuuuuuuuuuuuuaaauaugaagccaaauuuuauguuuuaaaaccaccuccuugaucuaacacuguuagaacugaaugaauuauccaauuugcauuuaauuucccuguaacgucacuugguucuuggcuacuaaccuuucauguuacucuugguuuugucaguuugcuugccuguggggguuugggccugcugacccugcccacuggaagaggcugccugcugggcugcuuucugcuuuaacaucguccaaucaaauguguagucauauuggugguucaggguccugaaaaagaaauguuguguuaaccuuugaauaauacuguccagcuaaauauccaacacacuuuccaagacagcugagggcacuucuucucccuauuauacagacagccccagcuggucuggaacugugcaaagaucagacuccccucaagcucagagaccugcuugcuuguuucuugacugcugagauuaaaggcaagcacucccgugcccagcaacccagggcauuucuuuacauugagagguuuuuuuuuuuaagcucgguaacuuuuaauauuuuuccuuccugcucaguaaauaacuacuucuacuaugucacaacuaagggggaaaacuuagauguauuagauuaaaaaaauauaacuuuucaaauagaagucgccuuuaaaauucucuccaaaguagcucagaauuacuaacaccuccacacuuaaggugaaucucuaggaguuugagguuggauagcccauagugagaccaaaaaagggucagcaccgugguacacacuuuuauucccagcacuuggaaggcagaggcaaguagaccugggaguuugaggcuaccuagucuacaaaccaaguuccaagucagccaggacuguuacacagagaaaccccaucucaaaagcugaacccaccccgaaacaccaucucuccaaaaggggcauguuggaaugaaaaaaccaguaaguaagcagagacagcaagaaccaagaaccugccaggggagcauauacagaacuggcagcuggcaagacaaacaggaucggggaacaucacgucuaagacuaaugaccuacuuguugguuccuugaaagaauccgaucuaaagaaucuaaaucuagucuuaauuagcucucuggugcagcggaugacccugaacacucaaugcucccucccaccuuucucucuuaagugcuggaguuucagguguaccucugucagauucuacauuuuaauaccccacccucaaccaccucaagacaagcuuccucuguguggcccuggcugucuuggaagucagagauccgcuugccucugccucccgagcagugaaugcuaccacguucagcuuuuaaugcuuuuuauuugguaccgaaugggguucuguaccauugaaacuuuaaaaaaauuuuuuuuuuuuaaaucacuuacuuuaaaauauuuacuuugaaauuaacauuauuuccuccuuuccucucuccaaccacacccacacaauccuuuucuuaaaaaaauaaaacaaaaaaccaaacaccaaccgugaucuuguuuuugaucaacuguuguuaucugccagcccuacccaggaguauguguggcauuacuuguuagacuuucacugcuaucuucucuggcacucaagauucccuaguuuaagcagucauguuggugagacuauggguguagcuuuugauaucccuaggauauaugaucuucccgucuacuccacuugguuuuacacacacacaguccacacucuggguuaucugcgcgagcagucugcccucuuuacuggugagccuuuuuuuuagccucugcagccacuuauaucuuaacaacugaccugaaaaggaugcggaauagcugccucagauacauguaauccggagcuuccucaaagcgcagcccacgacaguaauuuaaguacauggcaaauucugcaggaaaccccuaucaauucaacauuuaaaacagagugaaaagcaaaacaaucaaguuagagaaaaaaaaaaucaaguuucaaaguauaagcaaaaagaaauguaaaaauaaguuguuuccauacuuuguaggaggcuaugucucguuuuucucaccaauuuaagcuaaacuucaccaucuacucacucuagaauauucugguuagucucuuuuguuuugguuaacuuggaaacagcuagagucauuugggaaggagccugggggacauuuucuugguugauaacugaugugcgagcauccuucucccaagggcugaugccgcccuaggggagcaagcacgaaagaaagcguccuccuccacuagcucugcuucgguucuuacuccagguuccugucuuaaauuccugcugauuucccucggugauaagagcugaagcaaaccccuucuuccuugaguugcuuuuggaauaguguuucaucacagcaauagaaacuccaagacaauugcaaaugaauugcaaacaaaaucaccuuucccaagagcacugugcucccaaacaauucaagacuugagggcaauauaaagacuucugucauacuggaaaaauaacuagggugauuuccccuaccuaagaucugaugccuuucuguuagggucagauuugcuuuuuuuuuuagcaugacuacuguugcuuacuuucuguguguacugugucugugaauggaugugcaugugauauggcucuugcacaggggacagagaacaacuugugggaauugguucuuuccuuccaccacuugucccagauaucaaacccagguaaucagauuugauggcaggugucuuucaacacugugucaccuugcugcccuuucuacaaauuaguuuuauuuuuaaaagauuuauacauacguacguauguacguuuguauguaugaguggguguauauaugcacuaugcuugccucauguauacuuggugcccagaaaggccaaagacagaaaaaagugugugaagcuugacugauaacaauccaauguacacacugggaaaugaacugcauucccagaaagaguagcaacuauuauuuuugucuguuuuuuguuuguuuguuuuugguuuuuuuggagauaggaucucucuccaucaucugggcagucauacuuuaaccugacucugacuauagaaugcuggcaucaaaggcacaagugcaacaacacaccucuuaaacccaacugagccaucucaucagcccacaucauuuauuuuauuuagucuuacuacuuuagcucuggaugcauagaacuugcuauguauacagaccaagacugucucugccucuugagugcugcaauuaaagauguacagcaccacaucuggcucacauuaacuuccuuuacacauucaucaugcacacucaccuuacacaacaccucaacaggaguggacaucuucuuuucacuaaucuuuucauauuuuuguuucuuuguugcagccuauaagaaaaggaagaaugaaaagauaaauugauuuaaugcuuagaagaaguuuagcaacuaaacucagugaacagagagguauacucgagauucagugugugagaacuaaguaaagaagugcauggaaucaaguucauauuggauaaugugaugcaugaaagaacugggcauuuuacuguuuuccuuuaaagguucaaaauagcuguuaaauccuauacuacugacugacuuacacacacucaacaucaaaaccccaccugugagugcaccuugauaaggcuaguggucaccaaugacuaccagcacaagaaaauaaacaauugcuuuuaacuaauuuccuacuaaaaugauuaaauuuagguuaaaggcuuuggcuguaccucagauuuggaaaacaccuuccuguuauuuuucuuccuuuccuucucuccccuuacaaaggucucuucuucccucuaagagggaggggcuccuuauguugccuagguugcuuuuagucuacuaggccuauuccaacucccaaauucugggaucaccugccucauuauuuuuuucuucaauuaccaucaguaauuagaggcuacuauaccuucaguccuugccacggcagacugguucuauuaaaauacaucaaaacauauccuaaagauuccaugucaucucggcgacuagaaaagagaacauuauuuuauaaaccagauuaugggaaaacaugaaagccaaacacuguacacaaaagaaaugcucacaaacgaagauaaagaucuauuuggugucuuacaaaauugggcaauuagaguaauaauguucaaaauaagauuguuaacuacuuagggauaacuacugaagacugucauagaacuugaaacucuuuuuuuaaaaaagaaugccaacauagcuagacaacgcucuaaaaguuaacaaaugaaaaacaaguaaggagagaugucugaauuuugcaauuccaaaggccagagauguacagagaaauccuguauuaaaaaaaaaaaaaaaaaaaaaaaaaaaaaagcugaaugcugggcagugguggcgcacgccuuuaaucccaagcauuagggaggcagaggcaggcggauuucugaguuugaggcuagccuggucuacagagugaguuccaggacagccagggauauacagagaaacccugucuugaaacaaacaaacaaacaaaguaggcauguuaaaccucaaaagaaauugucaaaauacuuagguuuucaacuuccuuuccuuuuucaauccuucccuuuuuagauagggucucauaauguagaaccuagcuaaaucuauuccuuguccuguagcccagaaagaaggaccuugaaucauuaacaaacauccuuccucagucuccuagugcuacgacuacagguauaugccauuacacuagacauuuaacuuucuaugacaacacucgagaaaaaaaaucaaaagcccugaugaacugaacuggcuucugugcacuagcuaacagcaaggguaagacaguaagcaaugccuuagauccucagccacgaaggacccuuagacacuaagaaacguaaacacaagcucaagaaaagccaucaauagucugccuugaguuuggauuugauaagacucaccucugcucaauaccaagaugugcauugaugcuggcguaucgggcagugccagugagguuuuuaucuucucuguaugguauguguugccuuguccuguugucucuguacuuuuuggccaaaccaaaaucaauaaggaauaacuuuaaaagagaaauaaagaaacauuagguuucuaaccuuguucuuaaacaaucucuuacucauuaguauuuucaaauaucaaaauguagucuaaauagaacagauuauagauuuaacaucccaauaagccuuuacuauucuucaccaguaaguaacagccaccccuccauucaguauaccuaguaauuuauccuuaugcguguaacuucaucugcccaauucuuauacccacaguagccugucuucucacaguaagaauaucuauguuccacaggagaguugucaaggaugcucaugaaacuugacagcccauuucuaaggcuagaacaagcaugcuucaaaucuaugcgcagcuuucuagguaucuucucauccacagagagcacucuucagugcgucaauagaaagcuaauuauuucaaugacauaauccucaaagucugauacuguuaauaaaacauuuuaaaauaaaaaagcaugcauuacauuguuucacaagauaucugaaaaauauaaaauguuaauccaaaaauuaaaagcauagcauuuaaauuaagauggcuuacaaauuaucugcuuaaauaaacuaacccaaaucacauuagcauuuuagaagaaaauguuuaguuguauauaaucuacaugguaucccagaaauaaaguacuaacagcacauuuuacuaaguaauucaaauuuggcuuauaaaacugaaguuuugaaaggggaaccuacuuuuugaugaaaagguaaaacucauuucuguuuaccaauguauuugaaguuuuaacuucuauaaacgcccuacuuaccauacuaugcuauaauuauuucuacguguacauagaacacauguaaaagugucucuuuucuaauuauaucuacacuuuauucuucuuuuuguuaaaguauugggcccuuucugccaguguggaaucuguggugcuuuaggaaauguguuaacuuaaccuucuaaaacauauaagcaaauuaucuacuuggguuaauaucagccagggguaacagcacaugccuuuauucccagcauuugaguagcaaagacaggcagaucucuuccuucaaagagagccugcucuacaaggaggguuccagguuagccagugcuacauagugagacacccuccacccccaacuaaaguaaaaccuguuucugccagcuauuaugaacuaugcuuucauuuggucuaguauaauacaagacuaaugagagauauauuguaagucuaauauuaagcucucuaagcaaucaaguuauuuaggaauauggaaaagcacuuuaauacauacagcucacacuugaucugaguaugaaaaccagcaucaguauacuaauaguaaauaagcacacaguucugcagacuuacacuaaaaacagaaaacuagcaaaggauauucagcuucaugguauuuaaaacaagucuuguuauucccuucagguuuucagagaaggggaagugagcuaauguggauguaaugugucugacagcugguacucaauaagcagacacuguguaaacaaccaaagacugauucaagaaacucagcacucaaaaguuaucuccucuacaaaaaugagggaacgguauuaaaaacaaaaaauauaaaguaaacaaaaaaccccagagcaaauacuaccuccucaaaugcccaaucuuuaacaagaaacugcauaaagggagagaaccaaguaaggcaagucaguaucaguuaaguauaagaacugcgccugcaaagacacaggcaaucuucauuggugggacgaguuacuccauaagcuuauaguaauuaccugcaacuuaacuagcuuguauaguauuuacaaauauuaaagcauuuagauuaucaagcagucaugcuacaaaauguaagcaaaauauacagauggguggguuaaguaaaaaaucaggcuauuaaguuuuuacaaacguuuuccucuuauaaugaaugcauuaagucaugugcucuuaccccuaaccaagauuaagccgcagcaguaagguguuuggggguuauuuauugagaagcagucuugguuaugcaacuaacacccuaagcuaucuggaacucccuacgcaacuaguccuggcccagaacuuucggugauucucuccuccuccuggauuacaggcaugugucacaacucaguccaauagugguauuucaaguauaggaaaccuuucaucaaacaguaggaggcuagcccucaacaguacugaacacaccaaaaaucaaaaacagggggguaguucagaaaaucagugaaagguaauuuagaugacuaaaccagugcacagcucugcacauuccuucacuuuuuggugauuuaugccaauauaaucuuuucagagaauauaguaucaaaacuaaagacuuguugguuccagaagcaccaaaauucacauccuuaaaguaaacguuccuuugucucuauaaaaacucauauuggagcugggugguggugguguacaccuuuaaucccagcacuaagaagguagaugcagguagaucugaguucuccaggccagccuggucuccacacauagaagcucugucuugaaaaccaaaacaaacaaauaauucauucuggcacacuggcacagguaggcaggugggauggcucucaauuugaggccagcccauguacauauuaaauucuaggacaacugggcuacagagaccuggccucaaaacaaaaacaaaaaauaucacaugggggggggggggaaagacuacaauuucuagauaaguuaauaaaauguaaaguaaauuagcuuacuggguuguuuagccuguccaaaucuaaaucaggucauauauucaguuauuguguuacuaauggucagugaccacuuaguuucuuuacuccuuaaauugucacuauaaugaauacagugucauuuagucuagagcagagaacgcagccauuugguagaagcuauggacugacagccugauuucagaaucaaguuugagaaauacuggcugugaaaccugacccauacucacuggaggcucuuagggaaggagaggacagcacagcagagcucacuacagauucacuacagcacagugagacucaauuuguguguuaaguucuccgacuccaaacacauuuuuaaccuagucuaccuaacuuuuauuuaaguaaagguuccaacacuaaacuuuuccucauaucaacguuaguaaucuaaaacaaugacaauauccuauuuucauucaggcuugaucuaagcuuuaaaaguuuuaagcaaaagccaugaaaauaucuuagucauguuacauguuugccaaguaugucugaauaaugccaacauaagagaugcuugagcaagaucuauauuccccagaauuaaauaaaaguaauuaaaacaauaagaaagaaaagcacaugaauuugggguugagguuggaauaggagacaguuucagaccugguuuaauccugagaaagauggguccugagaaggacuaacagucaugcuucuuuuccucuuccccacuggagauucuaaacacugaacagacaauagagguggcagugcaucaaacaguauugcguacauugcaacaauggccggcgcagacaggcaacaccgaggcauuagagaaagaacaggguagccaaaugccauccuucuuccaccaagcacuguagcuucucaguuuuccaaauaaaaaucacaugcucaagaacacugaauucuagaauacuuaguuuuuaaugccacuaugauugugucacugccugaaacagggauaucaauggugacauuuggcucuuuaauuuuuaaauaaaaaauggggaauuuggaucugcaaucuuuaaaaccacaaucugcccuucccccccaaaagaauguaugggggaaaaaaucuucaguaaggaagagguagaaggcauuuagucaccuuaaaauuuauuuuuaaaaccaugcagggccgguuacuggaauagaugagcaaauucacuaagauuggagcagcuacuccaauaucaaauucagaacaauuuccaaguaagaaauuuaacuucaaaaaccaaacucggaagcugcccccaccccaucaagccuaucccuuguguauacaaaucuacugguacaagcugacugaaggagccagucuuacacaaugggcacuuccaaacuacaguaguacagaaaacaccaaaaacaacccccaacuacggaaacaagacacugaaguaaguguccaagaggaacauuucuacuugaaucauaaaugaagcacuucacuuccguccuuuggucucucucaaaacugcuacagauaagcagugcuacaaaucaucuuccuaucuguacugaggacacagauucuaaaaauagacuucccaagacaacuaucuaugugguuaaacgcacuguuccuaagaugggggaaagaaugugagguguuacuaucuaagccaccauuaaaguaaaggcaaaagccauguuuacucacugcucugucacuaugcagaacaggggucaugugggcauaucggggguuuaaggacaaggaaacaggaaggagagggcugggaaauggccaaaagaagagucaaacuaccaaaacugcaggagaaaaaaauuaagaccgacaauuuuuuuccaaccaauuaccagguuuuaugguaauaacuaagaaccuggaugcuucaaagagagaagguacaauuuggggaugcaagauaaauuauaaggcugaaaagcccuuaaauauaugaaauuaagugaaaaaucuaauuuccuaaaacuuggucagaccaacauuaaucucuagcauuaacaaguaacaccaguucuaauaauggcucccaguuggcauucauacaggcaaacaaagguaaacauuuacagcuggaccuaaaacaccacgcucccuaccugguugacaaaugggaaguuuccuuccaaaaaacaaacaaacaaacaaacaaacaaagccccccuccccccaguuuguccugaaguugagaauuucugagaucaugagaucggaacaugcuucgugcauugccaaugcugccugucugcccgagcucaacauugaaugaauaaugaaagcaauucacucaauaaaacuaagcauugcagacaaaauuucaauauaauuaguuucuaacugcaaucaugcgucauaaccuaaccacccauauguggagcaaucaucaggaaccccaauaagcacucauuuugcuacacagauguucaauucacuagucaguauuuuccuguaacagcauggaggagggguggagaacucacccaaccugaaacccaaguaauaaacuguaagcuacuuuugaagcaggcccaagaguuauucuuuuacauacaccaauccaaggacugaagaacucucaguaccaaccacccucagccauagugacagaugggucgguagcugccacacuggcacaagcgcauguauuacaaaacccacacuuuagagucuaagguuaaaaaucugacuuguuucauucaggaaggauuauauguaaguguuuucacuauuuaagugaaugaaaacuagauacaauugucuaaguuaaguauaguugauuaaaucucauuaaaaagcccuuggauuuuuauuauuuucacauaaauaaacuaaccuugguuggaucaauuguagagcaacauauuucaaguuacuaaguuaauagaguuaacugacuuaucucuagcacaaucucauaagcaaauuacagcauauucaauuuacuauggcuuuuuaaagauuuaaaaguuuaucaacgcaauucauaucaauaucuuauucuuuguuuuuucaugcaaagagcauuuaacuaaccuuauuacagugacgcccaauacccauuaggaaguuaucugguuuaaugucucuguguauaaaauucuuuguaugcacauauucaauucuacugaucaucugaaaaagaaaagggguagaagaggugauaagauaaaagcaagcagcaugaguuucucaagcacuccagcaggccagaucacugagucuguaaugacagcgcgagaacacuaaggcaaacaacaaagcccccauuuauuauuucaagccugcuggcuauucaggucuaaacuaguaauggcuuuugaccuguucugaguagaaaugauuaaauacauggguuccuggaugugguggcacucgcucuuagucccagcccucagaaggcaaaggcaggugcaugggcccuccauaccaagaaagaauaacugccaagaacuacauugcaagaaggccuuugcuucaauccuuuccuauucuuuccccguuacuagugugaacucuucuaccacagaaccuugacuaacuuguuuucguacuuuucucuucuugacuuuaggcuccuagaaagggcuguuuuaucuacuuuaguuucuccagugguaaaaccuaaggaguuugaagcuagcugggcuaccaagaggcaaacucagggauuuguuuuaaugcuauuaguacuuucagacuuuuuuuaccuuuuuuuguuuuguuuuguuuuuuugagacaggguuucucuguguagcccuggcuguccuggaacucacucuguagaccaggcuggccucaaacucagaaauccgccugccucucucuccugaaugcugggauuaaaggugcgugccaccacacccagcucagacuuuuuuaccuuaagcaucuuuuuaccuuaagcaucaacuugacuagaaucauuuaguuauuugggugccuuaucaguuauuuauuaaggggacgggggaguuccuugcuguucuuugauuaucacaaacaggaucuuuuauaaagcccaggcuggauagguaacuucucuucagucgccugaaugcugguacuuuaagagucugugccaccauguacaaaaaacaaacaaacaaaaaacuaaacaaaaccuaaaaacaacccaauucuaugaaauauugccauuuuauaaacaaccuuucuagucugucuguuuugucaaaaguucgcauaccuggucagcuaacauaaguacggucuucauagugaaccuccuugaacagaaguugaagaggucuucaaggcugggucccaggagauccaugacuaguacauuauagucuuuuucuugcccauaccaccuagcaauacaagaaaggagucaguacaaacaugugugagcacuuaacauccuaacauuuaaacuguuuuuaagguuaaggcuugaaacaauuucuuaggcaugguagcucacaccugagaaacuaaggagaauugaugaguuuuaagccauucucaguuaagaagauccugucucaaagccagaugauugauauuguuuauuuaacguaaccuuuccucuagucacaaaacaaacugaauaaucaacuauacuguuacacacacacaaacucaucagcacagcucaauuuuguagcauucugcauccuuuccccugaccugggacaaaucucuguaaugaagaaaugacuccaucagccaccgcacaacaccucagagaggcuuaucauucacucaugucucccuuuacaccaaauugcacuuaguuguuuguccuucuuugcaaagaacucacauuuuugcuuaguuuguauuauaaaaguaguauuggcacacaugauagauuuaucugcuugagaagaaccauuuaccuauccagugcuauuauuacauuaagugaacuccccaauagcucaagugcgaucacuguuaguuuuaccugucccaaggacuggaacuuaccacccuaaguuuuuucacauuuuaaugucugcaaacacagguucuucucugaaauaauauggaaccaaccuggcuauauacagcaagccuuugucuccagaaaaaaacuaaaauugguauaaaugacauaaaagccuaaccuggcuuaguuucuuugcuaauaccaauagguacuaaagccaagauuuuuugaaaaauaaaaucugugaauguugacuguaacaccagccuucaggagccugagguagagcuugaguccagccuauacuccaggguaagauaagauccugucucaaaggcccagaaaaagcauuacuuacagguaucuaggauacuacuucuuagguauuuuaaugcuaauucuuuuuuuuacaguaugcuacacuguugauaaacagcauccguauuaacacaagaauacaaagguauaauguucccaggaaggaaagcuggugguuugggaacucaggcccugcuagggaagcuuccacaguuauauuauugcugacuggagacuauaugcagaucagaaggcugguauuucugcuuuugaaguuguuuauuucaauuaauggucuuagauauucaauacuaucauugcuucaauaccauccaucagaacuguaguguauuuccaaaagugauauucaaaagauuuaggaaauacaaauaaagcucaaaucaauuggcucuaauuucagaccacugcuguauugccgacuagagacugcaugcagaucagaaagccuucuaaauagucuuauguccacaccacugcugccgucagcugcagucagaggcuuccuuuggaaguggguuaugugcuaacuguggagacucuaacugggcaaagugcugacauuaacuguugaaaaugggucuuaaauaggacuucuauaucucauucuccaaggcccagggagcauccccaaaugaugucagagcuagaguagcagggcauguuguggaacacugucuucuggcuagguacuuacucuugacuucucucaucagccuaaagccuuuaagcaccacgcaaguuacugcuuauuuaugaaucugauguuuacaguagcuaacaagacauagcugaauaauaacuucuuuaacaauuaucuuuguuugcuaugcgauauguacggucaaauaagaugugucagagaaagaauuacaggaucccaacuuuauaugaugacuuaaacacuaaguuccaaaaaauaaaaaaauaaauaaauaaauaagacugauccuuacauuguacgauaaagggaguuguugcaggauaauugaucacacugugaacaccaagauuguuauuuacugaaaagccggucucuagcuguauuguggcugagcccuuagcacacaccuuuaauuuuucuagcuggaauacagacacacccuuaguauauaccuuuaaucccaaacaaaaaagguaaaguuuguagaaugaaggacccauguuugaaaaugauguggcaggcaaaguggcacgucaauaaaaaaaaaaaaaaaaaaaaaaaaaagaaaaaaagaaagcuugacagaauaggauaugcccagcucucaagagaagagaggaaaggggagcuccuugaggggcagggaaccaggcauuuuuacugggaggacuuuacagacagcucaaaaagagcgaaaagaacaaaguacacacagauaaagacagaauaagccagagaaugagaaggaaccagaagaucagaacagauugauaguuagaggccaagcagaacaauucaggagaggacaagaaagagaagccagacggauucagucaguuuggagaucagccagccagaaaucaaucagaaagaacuaagaauggugagcuuauucagcagcaacucucagaggcugaagacauucuagggcuagaagcuuccaugacuaggccuagguuaacagagcaguaagccuucagacaacaauuuuuacuugagaguaaguuacuuauaaugagucaggugaaagcaugaauggucacaauaaacugcagguaaccaguauggguccuauacaaaaaggaaucaguuacguuaucuucuucuucacuaguuaauucacuaaaaaaaauuuuauauccauuauuuuacuuaugucuuucuugguuaaugcaauacauucuuauuagacuacuuaaaguuugacaaaaaucacaaugaauaaauuuuuuggcaguucauguugucacuacuuuaaacacugcuaacagugguaguacuauggggcaaaguguagacaacugaaggucaagagauucaaguacuaaaauacacauacccacuggaaguggaaaauacagcuaucaucugcauaucaaucacaaauuauuaauugucuugcucuuuugcuugggugcuguagaucaaacccuggggcucccagaugccaagcaagcacuuuaccacuacuguuuguccaagccccugaucuguauucuccuaauagacaacuaaccauacacauacagaaaauaaaauuguuggugucuugcagccagcaaggaaauagagaauaagugcuaauggguucaggguaccuuugaggagugcgaugaaaauaccccaaaacuggauuacaguaaugacuguacgacucuguacaugacaaaaauaagucauacacauuaaacgggccaagcuuuucauuagcaaacuaucauuuaaaguuauuucuaauauuucuucuauacucuaauuagaaguuauagaaaucuuaaggauaguugggaguauuuguggaggcuuaugaccauaauauuuuaacaguugagagaggcugugagggaacuauuucucaugucaguauugaaaguauuaaguagugggccauaccuguagucccaguauucaggaagcagaggcacgaggauugccaacuuaagaccaucaacucugcauuuauguacguguguguauggaugacugugagcugccacccuggugcuuggaauagagcuccaauuuucucaaagagcaacaaaugcucuuacccaagaagagauggugagccaucucuucacccaugucauagggcuaauuauuauacaugguuaaggucugagaaaggcucacuucacuggauucaaacagacaaccuuaaugguaucugucccuugaauuugaaugcuggcaaguuuuaugucagcuuuuacauaugacagagucauauggaagagggaaucucaaucuguaaaaugcucccacuagacuagcugugggcaagccuguggugcagguccuugaagucccaccuaggugguccuaggugcuguuguaaagcauuuugagcaaccaagcagcagcaauccuccauggcuugauuuugccuccaaguuccuaccccgacuccccucgguugugcuauggaauucuaagcuaaacucccaaaguugcuuuuggucaggaugcuuugucauaacaacagacaccucuaauuaagacacugaccaauggaagcaacugagugcuucuagagucuaguuugaagcuuauucuuucuuauauauuauccucuugaaauuaagaaaacucucaugcccuuacacauucaaucucauuuugagaguuaaacaugguuguccuaauuuucagaggaagucaaaguuacuggugccaccugcuuugacucaugacacauacucaaaaaacaaaaauugacucuucauugaagugugccuauuuuaaacuugcugauacacaguggaaacucauaggaaaaaaaagccuuuuauauacaacuuacuuagauaugcuauauaagcauguuuauaaguuuaaguauauuaacuuaaccaagacaguuucaaccacuauagacuuauuugaagcuaauauucauuucuggauuaaaauugcagaaguucaaaacugaaacacugauuccaccaaguacaauuugguguuaggaauaauuuaaacaugguaucaacagcacccccccccaagccaauuccagccaauaaauaauaaaaagcauuaagaacagacagauggagacaggugugguggcacaggcacacaccuuuaaucccaacacuagggaugcuaagguugcuggcgcuugaguucaaggccaucuuaucucacugcauaguaaaacccccaucucaaacuaaacaaaacaaaaauaaauaauaaaugaaugugaagaaaagagcaaguagagaaugauaguaauaaaagcauaaacucuagucaagaagggucuugcuacauuuuuaccaaguacuacauaugacacacuuuuaaugcaacuauuuccaagcuuuucaacuucagauaagggagggcaggacaacaauuucuuaaaguucacuuguaaauuucuccacuguacauuuaaaggcaauacaaauuaaacaugggacaauuuauacuaccuauacuucagucacuguagccauuuucuuaaaaaacaaacaagcacagaaguggaugcucacagucagcuauuggauggaucacagggcccccaacagaggagcuagagaaaguaaccaaggagcuaaaggggucugcaacccuauagguggaacaacauuaugaacuaaccaguaccccugagcucuugacucuagcugcauacguaucaaaagauggccuagucggccaucacuggaaagagaggcccauuggacuugcaaacuuuauaugccccaguacaggagaaugccagggccaaaaagugggagugggugggggugugugggggacuuuugggauagcauuggaaauguaaaugaggaaaauaccuaauaaaaaauuaaaaaaaaaaaaaaaccaaacaaacaagcauaaaaacagcacacaccacacaaauacccaacauagcagcccccuacuugguauugaccuacacauuuuaaaugguuaagauaguaauuaaacuuauaauuggcuaaaguauguguguguguguauauauauauauauauuuuuaugaaugacaaggucucacauguggcccagguugaucuagaauucugaaauuacauguauguucuaccacacauggugaugggacauuaaauuucagucacacaacaguuucuuuacaucaguauucaaggaaaaagaguguuagcccagugcauuagccagucuuagucuaauacaaguauuagaacuggagaacauuucaauuagaagcuaaggaacuuccauacucgcaucaauuacuucuagaauucaauauguaacagugcauauuccuacagcuggacugaaaaagcaaacacauaaaaugaagucacaguaagagcuucuuuauacucgaagccuagcaaugagaccgaguucaaagcauuguaggaugcacacaaaacacaauguuuuaaauucaguuuuagauaucucccucaccaaacaacaaaaaucaccacaucaguugguuguaugagguuaaccguauaacacucuaagcacaaagaauccauuauaauuuuucagagacaagaguuuuucuggguaccccuggcuggucuggaacuguagaccaguuaggccucaaacuugagacccaucuaacccagcuucccucccaagugcugggguuaaaggcaugagccaacuccaaggucaaggucuuacugauauuguauaggaacaauagggauaaauuagcugagcagauaggcaauaguuauuaaaacccuacauaguguacuaugguuguuucuguauuuuccacaccugaaucacccuguaaggccuuaaauaucuaugucauauacuauauuuuuacacgaaacuaccaaccuauaggacucuugugaugauuaaaagagguaauauauaaaacacauggacagcgugucucuuguucuucauucuauuuauuuuuucaaaauauuuacauguaucacaguggacugaucacagaagaggaguuggaguuucuggagauggaguuagucauuaucuacucauaauagguguugggaauauagcuuagaucuccuguaagugcaauacacauucuuaacuacuaagcucuuuccuguuuguuuguuugguuagcuuauuauugcuguuauuauuauuacuauuauuauuauugagagcaauguagcucaggcuguucuugaaccuccugccuuaaaaauuauagaauucuaaguucaaauacaguugacuuuugccuuuuccauuuucauuuaacauuuaaugcuucucaacuaauucuuucuguauggcacuuucaaaguccuauuaaaacagcugcacuauguuuccacucacaggucaccaagacuagggaauggcaauauucuaggucuuuagagcgggagaaucaaauugaaguuaucaacugaguauucaagcucugcaagcacauaauucuucugucggguaacuuucacagagugccaugggugagaagcaaacuagcaaccugaaggcuuuguuguuguuagucuuucaucaaauuagaaaaaaaggacacacaacuaugauauaaaauuacccuaaaaaauagucacagguuguaguuuauaaaagauaagcaaugcauauacauaauucuccuaucucuauaagggcauacauuugucaacacuaauucaaacacacauuagcaucuuugcauuucauuauauauaaauauaucuaagccuuaaaccaaaguagauauuuuuauucccgguagcuacaaaagauacucaaguaacuuaaugacccacuuuaaagagugaauuggugaaaaguaguggggagcacccuuaaucccaacacucugaaggaggaaggaauaucugggucaaccuggucuacaaggcugaguuccugguuagaaacguuacaugguggggcccugacucaaaaagaugaaacaaauucuagacgucucccuauacuuuuuuuuccccuuauuugcagaucucuaagccagauuuugugcuuuuuuuuuuuuuuaauuuaauuauguguggauggagacaggagaacuguggauagugaaugagaguguguuucucucaguaucaaauaaaggcguggaguguagagcaggcaugauaugaccuugacauggaggugacaauggcucucaggagaacaaggagccaggaacucaaaauuuaauuuguaucugguguucuuuuuuaauuugggucaguagauauucucucagguuuugucaggcucaaaaacagcaucccacaaauuaacaauacaaagcauuucuaguacacucguauuuagguacacuuugaaagaaucaauucauaacauuuucaacagcuguuuuccucuauaacauuacaacuuuauucacaacauacauacuugaaagcagaagauuaagauugcaacuguuuauagcugggcgugguggcgcgcacaccuucgaucccagcacuugggaggcagaggcaggcggauuucugaauuggaggccagccuggucuacagagcgaguuccaggacagccagggcuacacagaaaaacccugucuggaaaaaccaaaaaaacaaacaaacaaaaaagacugcaacuguuuaaacgccuuguagcagugaauauauuaacuaaugcuuccuaaaugcaaaugcaggaagaugugguuuuaaagcacaagcaaaaauuaguuucccaucuccaaaccauuuucuuagauacaguuuuccuauagaaguaauauuuuuaccacgucuuucuagagaguucaucuaaaagggaccagaagcugaugcauuuauuagucuuggagguaguuuuauaaaaaaguauuuaaugguuagacuuugacauagcaccaaaagaaaauguuugugaacuaucaccuggaagcaggucuuaaaaacgcaugaacugaaagaucugcaauuaagcaaucaaaaacacuuuaaauaggaaaucuuuauucacaccaaaacuucccaacauaaaaagcugggaagaaaugaguuucuuacccagaagaauacauuucccauuuguuccuugggaguaaaaaaaaagugucauaaugugaauauaugcgcaaaagucuggacgaccggagagcaucagauucccgagcuggaguuagaggcagcggugagcaaccccaucacgccaggaggugcugggaccucgaugcagaaccuuaaaugcucuuagcugccuccuaaacauuucuuucucuucagcacucuccccacccucaacagaacuaaaaccacauaaauuaguaauuuuaauuguauuggugaggaagcugaugagccuuaaggaguuuaagagacugacucuagaucacccuagcuucaagucuugagcagauauagagcucaaauauccaaucccuagccaguuccacuuagguaagaacucuucuuguuuauuaacacuguucuuccuuuaguaaggugaauugacuugagaacagcacauaggaaaggaauauaaaagugacaguaauucuagaggagcuuccagaugucccacaggccaaaggaauuaguuuccuguaccacacaacugaaugucacacacuugaaggcuagacuucuaagggcaaaagguacagaggaagagagaggcuaccaccuucguaggccacaacuaauucucuuuuaggauauaccagauucuuaaaaucaaucuuauaaacagauuauguguacauacacaaacuaaaguaugaaagggggauggguauaaugaaguaaaaauuuauauauuuuuaaauuauaucaacuaauggauaaaacagacugcucuauuuagcagcuuaguauuuaauauauauaugugugugugugugugugugugugugugugucuaucuaucuauuaugcacaagugacauagaaauacugaggaauauacaaaaagaaugggaaaaugcuacuucccuuuaaaaccaacgacugcuuagcuaggguggccagcacuauacaaugaaacucuugucucagaaauaauuaaaaacaaacaaaaccaaaacccaacccaccauuuguuucuauguauccauuccucccauugcugcauacuccaguccacgcucuugcccucccuaauuaccacucugcuuuaggaaccacucccagaagccagcuagacuuggauacccuccccaaccaguccaccaagguuucuuccugaaaucagucuccuuucccaggaagccuuaauuuaaaaggcuggcuaaucuauuuagccacacccacagaaaguuuacaaaggccuuaacucucccagaacucaccauuuuauauauagucggcaccuacuagucugcucccaagucaauguauucaucugcuuaguuaguauauuacccacugcccuuaaugaucgguaucugcaagguccuuaaauaagcuacuagacuaaacacauuagcauuuguuuagcauugaaaaggcaaugacugguuuuuuuuuuuuuuaaauuuacaacucucccaacuuaagaguaauaugagaaaaaucaaacacaaaugauacagguugguuguauuucuaagaaauuccaggaaaaacaauggcaaugaaagcaaaucaguggaggccgagggccuuauuuccucccaugaucgcaaauauuaguagggacaaaaaaauguucagaaaacucaaacuuggaucuccuccaauuucauauucaucucugcacauaaaucuggauuauuuucaaggagcucacuuacaaaugaccagugguguauuuaucucccaacagcuuuauuaaaacguuucuuuuuuuaaaaauguuuuuaaaaguauuagguugaagacaauucuuuuaagauugguggggugggggugggggagccagggguggcuccaugcuuuguucccagcacagaggaagcagaggcagggugaucucuaagguccaggcccagggugguuggucuacaccgcccauucuagguaaagcagagggagggacagagggagggaagagagaauacaucauguagucguccaguuaauucucaacuaccacucuguuugcaaauguuaucuuugaauacugcuaggaaacaggugagauuuaaaacuauaauuuuuaaaaagguuaauuucaaaagcaaaauuuaaaguuauucuaauaauauuuaaaaaucuuuggaagagcagcuucuauccugguuauuucuauuuaccauucccuucuaguucccuuuaaauguuaccaacaaaauaacucaacagguugaaacuauuuaucaaacuguugucaagugaggcuuucuuuuauacagcugaccacaagacuucaacaguuggugcuguucaaaacugcuuuugccauuacacauaaaguuuguaggcaaugaaacacagcaaacauuaccauucacaaaagcaaaaggcaaugaacacauugggcagggauaauaagaauuuuacaugaguacaauuucacaaguuuaugucgcaucugcugcagagaucacauacuguaaugccguccaucuccuccccagaaucucauggccuuaugaaacucaauucuuggcuuuucaggguuaacccauuuuaggcugcuaaaggaagcuuauuuugugauuccaagcugagaagaaggcaggaauauggggguugagucacgucgcuccgccauuuucuaagcggaggaggaagacauguuggaacaaaaacacaacaaaagagcagccauuucccaaaccagcuccgggagcaaccccaauagacuaaacucuguuacauccacaccuucaaaaccacuucaggggacaaauguaugaacaccaaggguauaucuccuuaaaaauaccaagaagccaacccuucuguguagggaccaaagacgaccugcagaguuaacugcaaaugaaagcccugggaaucggaaaaaugacagaagcuaaacgcagcagugcaacaaacaaaauuucaacuaaguuggagagauaaaaauuacccaacgauuacgguuaacuguggaaucuggaggacccagcaccaagaccgauucaucggguccaauuaccagccucaaccccuuucaccauuucgcaacucccucugugcccaaaggugcuuaccguaugugagggaugccaaccccaccuugaagaaucuuauacaguuugcucucguacagcaacuggggaugccuggccuucugggauucuaguuucacugccacuuccugcagaggaaaggggacggugguaucaaaaucccuacagauucaaacucacuugggaaacgagaagaaauguuaccaaugcuugcuucucuggucgccacuacaaggacgugaaaagaugggaaagcuaccuuaguaauuacaaaacacaagcagccucaaaggccuuuucuggggggagcaaaggcgagcccccccccccgcaauguccucuaaauuuaaagcgaaugaaaggagucgugcagaaaacagccaaccuuggaacguuagggcgagacuuuuuaaaggaaaguguucuaacuggaaaaagaaacccggguuaaauuuaagaaauacaaagaaaaccacggcgaucauacgacuucgcccuucucaucuuaaauaacuguucaagugagauacuuugaacaagguggaaaaccucagaguuuacccugacuuucuaucggguuuuuccuuuuuagggaaauaagugggggaggcugcuaagccaggaaaaccggcucgcuccggacuccccugugcgugcgugcgugcgugcagugggaagaggcucggaguacuuaaggggguuggggugaaaaaaaaagcccagcguuaacguccccccccccgaaccgggugauuaccucgccauuggugauguugaucgcuagauaaauguccccgaaagagccagauccgaucuuccgcaccaguuuguauuuuccaccgacgauaaauucggccuuggagccgcugcugcucgccauccugagacgcgaagauggaggcggggggccgagccccgacaccucaggaagaggauggaagccuccggggcuguuccacccgcggcagaagugagaagcgcggcgggcaaccuaaacccaaggcucugucggcgucacggggcgcacaggcggcagagagaagccggaucgccgccgccgccgcucgcugaagggccaggccgcgguucgugaaggguggucgcggcugcugaagcucggccgcuuguuguucucgggcggccgccgcugauuuuuuuucguggucgcggcgacgucgcgggcugggaaaggggcgcggugaacgagggcgggcgguaccgcugccaccacugccgccggcuccggcccggagggaagccgucacuccgccgaggccgccaucuuguuacucuagcuccagccaacacaaaaugcccccaguccccgggagccgcuucuucacggcgcggagcacucugggaaagggagcucgggcgcucucuccguagggugggcugacaaggggagggcggaaccggauucgcgacaggcgcagcccacgcucccggcguca

SEQ ID NO: 8944 - RNA, 2607 nt, Mus musculus
acugaaaagugaaauaaggaaaaugguugauaguugcaggccuaaagugaagguggcccaugccuuugaauccagcaguucaggaggagguagagcucugucuggaaguuguggcucagcuagggcuacauggaaagaacaugucuuuucuuauuuaggacuaacagaaaaagagaaggaacuuuuggaccauccuuuggugccagagagauuuuaaaaugacaaugcaucugucagaaaggggccacuugcauguuccagaauggcagggucugccaguuaccaucacugauggugguucacuaaaaagugaaugauuuaaucuuuuuacagaaaugagauaagguucuaauuuggaagucaacaaauuuaaaggggacaggaacauagcauaugccuuucucccacccaggaggcagacaggcugaagacagauccuuugauguauguaugccugaaauccuagaauucaggggacuugaguggagaggcuggaaguuccagaccgggggggggggggggguguggggcaugucgcuaaagggaaaaagacuuaucuugcaaaguauuaguguuuuuaaguauuauauuuagucuuuguaagucagcagucaaugagaugaaugagacugacuacgcaugguucuuuggacuguucaguuuuuccaaacccuaagccuuucauaaaguccugucucacaugauguuggggggaaauaugggguguuuugguuuuuuccucaauacuggcuugguuguucuggaacuuacuguaaacuaggcuggccucgaacuuccaucugucuccugggugcugggauuaaaggagugccaccaccgccuagcuucuccuaauaacuauaugauuuggauuuuccagguggguuucaccuagccuugagaauucuccccugcuauacuagacaugaacugcauuagacugacuucugucuccuauaucugguuuuuggugcaggcagggucuacuuucccaacacugaagccaccgacaucugcuuuuuauguggaugcuaaggagaugcuuugguguaaguuuugaacuaagggugguggauugugagauagugugugcuuguuuguucuugagucaugaguggacugugucuauuaaacacaaaaagccacucggaaaugaagagaggaugagacugaagcagaaggccuugaggucaaagagcugugacaguguugguguagugugaaauguuugcaaguucucugguuacauuggcuuugagguuuuucaagcaauaaucucauguagccuaggcuagccuaaaauucauccuguaguggaaggugaccuugaagaacuaacugcucuuccacuccugugcugggauaauaggacuaugucaccuguuggcaaggguucaaauuuuuuguuuuauuuguugcuugguugguuuuaugagaagguuucuuuguguggcccagguuagccuggaacucuggagaucugcccaccaaguccuaggacugaagguguguaacaccucacccaucuuucaaguugaucuuauuuaugaaaguacuaacccuugcuuguuccuuuugugauucacuaaaugaacugaaguagagaggugcucaggaucacaugucacaacuacaaaccuagccacaagcuucgagcucacagagcuccucugggauuaaagguaugcaccacuucugacccuggaacagugcugcuuaaaucaguguuuccuaguagcaccauuaauuaagccaagguaguuucguuacaguuuguaccuuguuaucagcucccuuggguguugguagugaaagaaaauaaaaggucagccugcuuugugacugggcaacuucagaugagugcuauugacaaauuaguauuggguagauuuaagauacaguucauguagucaggaauguaauacuauggauuguguuacaugaaauggaguuaucuuugcuugugaauauaaaaauuuauacaauuagaacaauucuguauucccggguauauauuaguuggucugauacaaacuaggguauaaacugaaaggauucuuuuaccuuuuacuuuagaauacaguacuuuuagagccugucauggagcagaaggucuugguuacaaaagugcaagccuuguauuagcauauauuauaugauagcagauuucauugacauuucauacaaauacauauaauuguggaaaaccuauuacccucauuuucuucccauauucccagucagucagucccuuuaauguuccucugcauguaugacccacuuaccagaaugugucuaggcagcuuacuaggaggcugcagugcuggaacaaagacucccagcagccaauaacuaccuagagcagugguucucaaccugugaauuuugacccuuggaaagggggucaccuauuuaccauagucuuaggaacugagacauaacuuucuuauucaacuccaggcagguccacccuggagacagcaucaagccuuucaggauccagcuugucacaaacucccucuggagcugucauuuccuuucucagucacaaagagagcgggucacucuuugucucucuugccugccauaaggauucugcuugugauu

SEQ ID NO: 8945 - RNA, 8766 nt, Mus musculus
acugagcuuggaaggaagaggaaagagcugcagaggcggagacucugaccccaaagcgaucgagggcccuccccuggcuuccgugucccuguggcaggcggugguggucgaaaucucugccccucagaguccuggggaggauggauggaacaggaggagcaucaugagaaggcuuccuguaaacuacggagggugaggggacggagcgugagggaacgucgugagauggucaguagcuuggcucaggggcugggaggagggagagaaugggagccuggcccagccgcagguuuuucugguuugggagccagugucgucagggaggggagcuguagccucugggggagcugccuugguaucccagaaggucugcugacucaugcuccuccuccucgucgucuuaauuacuucuuuugugcuuacaaaagcagcacauacucuuuguacagagagggcagacagcuccuccuguucaugucccugcugcugccauuuuggcauaaguucuuccaguuuuuucuuugucuuuuuuuuuuuuuuuuuuuuuuuuuuaaagacagggacucacuauguaggccuggcugucccagaacccacugugcagaccaggcuagccuugaacccaacagaaaucugccugccucugccucugccuuccaaaggcugggcugaaaggugugugccaccacaccccugcccggcuuuguguuaaugaaauugugucucuucguuaaagagagaagccgguuccuugaggacaguguaaauccuugcagaacuguagaccgcuuauucccucugacacccaguugggacuauggcuauccaaaccucuguaggaugcugcaugaaugugucugaguuuguauccacaaaugggcccaagggacugguuaggaccccagacucaaaggccaaggcuacccugguacaagucccaccuuccccaugauuggcggcuggccgacuguaggcaguuuagccucacugagcauuuuccuccuuccucgggggugggggugguggaaaucaugacagcagaucuccaagguauggcugaggcaauuaaggaugcugagcucagcacccagucuggcucaucaaggacaucaaggaugagcuguugcuagagacacacgagagaagcccccacuccauucuaggcaauuuauccuccuuggauaauaugugagagauuagucacagggauucuggaacucacccccgaagaugggaaguuugcaucuugagucacaaaaucgguugcacaagcgugggaugggacgggaggaacuaagauuucccaggcgggguggaaguuccugcagcaagccuccucugcauccccggcugcugagcuugugggcaucggaggugauggguucugagugaggcuggccagucugcccgaagcuauuccuuucucccuguccaacgauaacaggcacaggggccgggggcgggggcgggcgcgcgcagugcugggaaucaaacccagaaucuuaggcauguuaagccuggagcucucugcuguaaaaccucuccacagccuccaugugucuccuuuuaucaccucucucaaccccuuugguccuucaacuuccuuagccaaagugaaggcaucaaaaucggccauucuuugaagccgggccccugggaaggcaggaagaggccgaucuugcucaucucugguggggcuugaguucccugaaccuuagggcucucccaugcccgccuccccccucccuacaucugccaucaugccuguuacagacugcuugccgccccgcagcuagaaaaaugucuuauguuuacuuuagccauuuugaauagggaggcuuaggugggaagaagucucauuugauuuucagaaucugugacuguuuccuugguggcucuuggcagaugugacugggcucaggaucuugggauggggaggcuaccguggguuagccagacauacccuaaagccggugauagacuggccaaagagaagaugagggagcagugugccugucacuggccuggcaggagaggacccugccaucagcuugaaaaugaaaggacccccaaguuucccagaauuccaugcugugggggaggaaaagacugaagccuugugcuaggcagaagaggcacuggucucccagaaagaugugucacaccguucuaacaacuuaccagaccgcuuuacaggacagacuaucgcugagacaagggugggucagugauaggcagguaggcgggaggacgccaugauccggacuuccuaguuaugcauaguuuuugcccuuuauuuaagucuaaacuuggggcugcaggagacucuguggagucauguguaauacaugcaggaggauggcacauacuugggaacuuaggccugaauuaugagaaauuaucaaccucauucuuuaauugucaucauccuguuuacuccugcaagucuugguccauccguucaagaaucugcaauuagcuuuucauagaacgaaaguccuuuuauugcgcuuuaagcuucuguuaguauggcagucauuucugacaucauuucuucuucuucuucuucuucuucuucuucuucuucuucuucuucuucuucuucuucuucuucuucuacuucuucuucuuccuccuccuccuccuccccccuccuccucuucccccuccuccucuuccuccuccuccuucuccuccuucaagacagaguuucucuguguagcucugacugucguggaacucccucuauagaccaggcugggcucaaacucagagaucuaccugccucugcuuugcaagugcuggaaguaaaggugggggccaccaccaccugguucuaagguuuuaaauuggcuuuuaaugguagccagcuacucacuuuaauuucauuaucuguuucucacuaaugugauucccacuuuaaugucugcuuuugaauucuauuuuacuuggcuuccuugagcuuaagugcuucaauguccuuagugguuuuuuguuuuuuuuguuuguuuguuuuuuguuuuugcuguuguuaucuaucuaucuaucuaucuaucuaucuaucuauugcuuuauuucaugcuuucauacauguaggcaaaacacccauacacauaaaaauaaaaacuaaaaauuugggggcacaaaaagcccccucaccccagagccugaguucaaacggggcuggagugauggcucagugguuaauagcauuuguggcucuuguagaagacccagauucaguuuuuuguuuuuuuuuaagauuuguuuauuuauauaaguauacuguagcugucuucagacacaucagaagagggcaucagaucucauuauagauggcugugagccaccaugugguugugggauuugaacucaggaccucuggaagaacagucagggcucuuaaccgcugagccaucucucuagccccagauucaguucuuaccacccacaaggcggcucagaaagagucauugugccucgagagcaaggccauccaacaccucuccugacucuucugggcuccagaaugugaguggugcacauauacacacucaggugcucacacauacacaauaaacacgcaaacaaacaaaucuuuuuuuaaagcagcaaacucaaacucaccucagggcuaguuucuaagaggguucaguaagucauaaggaugauggguucaggacaauaauguuuaacccuucugaggcuuuguaaaaaccugaugacaacaggaaauagggccauagguggaaaacaauuuuuuuguuuugucuggauugguuagguuuuuugguuuuguuuuaaauguuuauuuauuuuauguauaugagugcacuguaacuguacagaugguuaugagccaucaugugguugcugggaauugaauuuaggaccucugcucacucugguccaaagauuuauuuauuauuauauguaaguacacuguagcugucuucagacacaccagaagagggcaucagaccucauuauggaugguugugagccaccauguggcugcugggauuugaacucagggccuucggaagagcagucagugcucuuaaccgcugagccaucuuuauggauccuuuguuucuuaagacagggucucucuaguagcccugcuuguccuggaagucauucuauagauaggacuggcuagaacacacagagaucaaccugcuucugccuccugcuguuggugaagggugugcaccaccgggccugguggaaagcacauuguaaaaugcaaaaucgucugcaaaagcaauaaacacuggccaaugaugaugacguuaugcuaagucccagagaacaaggaagccuguccucccaggaugggccacaagagggcgcccuaugccccuaaccugagucaccagcccuuuguaccacguuuccuggagcaaccgcccgcccuuccuccuuuuuguaaguaaaggcucucuaggcucuccaucugggaagagcuuggguuugggacacuguucccacuguguccuuccuucccaggacagaagccugugucauggcacuuagggaugcuugugaaagugguccagcuuuaggguucauacgaggcguggccucagguacgcuggccgaauguaggguccugaugagcgcaagcugggaucucuuuacaguaggauuuccuuggcugcuucuucccaggcacagcuugcacacagaagauucugaguggugccaaggugaauaaagaugccuaaguaaguaaggagcacaucuuuaaucccagcacuugaaaggcagaggcuggcagaucuuugugaguuugaaaccacccgggacagccaggggcuauggagagaaaccucgucuccccaccaccugcuuccgagaaaaaccuaauaaaaugggacaccucugggguccugcuuauuguucuucuugugcaccccucuaccucgagacccucucaagucacaguaugugacugugaccugcuggcauccagcuggugaucaguuccaugagacuucaaaugggagcuccagaaggaacaaugacaaagauaaugccagugguccuugagaagccugugguguuggcuacuguuucagcugagaagacuguggcguccuguuggcuacuguuucagagcugaaaagcacaacaguugcagaggcauccuagggccaucucuccugcucccuguuaggcacucaggugacuggaaugauuccagagucucagaccccucuucggggcuuguucugggggcacugaggagcaauguagaagcccuuggcaucuggggaugaccaugcaagagggcuuguuuuaucuaaauauaguaguuugggagagcauguguggcaugugacuguuuguguccaauuggguuggguuuuuacaagacaggguuucuguguguguagcccuggcuguccuagaacucacuauguagacaagguuggccuugaacucacagaaauccuccugccucugccuccagagugcugacauuaagggcauaugccaccacagacuggccaugugacuguuuuaagugucugggccccuagugugguggugcguaccuauaaccccagacccuggguuuagucauguuuuauuuaugugcauauuugugugcaggugcucguggaagccagcagaggguguagggucuccuggagccacaucucuggaguuacaugaaguuguggaccucucaacauggguucugggaacugaacccagguccucuggaaggacaucgagugcucuuaaccacugagccaucucugcagccuaaccccaucccuuggaggcugaagcaaagcaaguucaaugaccguguaagagggcuuguuuugucuacauacagucguuuggggggaucaugcagcguggguugcauggugagacccuaucucaaaagagaauauccucgugugcugguuuuguggccugagguacaacugaagcugugucguugcaaagcuuggcucagggccugagguaacucagaauugcacacgugugugauguaugaacauaugauuucagacuguguucucuggaacagauggagagggcuuaccauguguuauaucccccaaguccucuguggaccgugcuuaaacucuaaugguccccgucucccacaaaucucuacccugacgucauggccuggaagcauccugagacaccaggaaugugaagggcagcuaagauguggcuccugacugcugucccuguacuggucucuggaaguguuggccagguggaggcacuugggguuauagcagcgaauacugggaaguucuuuuuugccccuauacucccaggaagaacgaagacacaaaucaaaaguccaguacuuuauuacugucacagaacauagagaggaaggugauauccacccccuccccccacacacacuaugggaaagccacugggaugggggcagccugaggcaggcaggacuggugggcagagcauaggaggaugguggaaauuguuagcauuggccggauacugucacaguuccugaguguggccuaaggucagugucuuaagcucuuucaacccagggcugccugucugcuaacucauugggucacaagugacauggugcuggaagugccaagagccagagggcggagggugguguugcuaucaucagcaagucugccguccugagugggucagcaacagccuccaagugugagcagaaguguguguguguguguguguggggggguccucucuucagaaaugucuucuggaggcuugcuaggagcauagccccuggggacugccuggucucuggagacucgaggccacaucagaaacgagggcuauggaacuaugugacaguuaccucuuccacugacucagccaaauggacuagggacaguuuaggauaguuggaagggucaugagugugugcacgagugugugugugugugugugugugugugugugugugugugugcacauggcuagugucuucugucacugucuacccuaugaugcugagacacugucucucgguaaaccaggaguucaccaacccuggcugggcugccuggcuggcugcagaucuccagggguccucuugucuuucucccuaccagcacuaggaugcuaaaggugaccccccccacggcuggcuuucuacacaggcacuggacauccgaacucagagcuuuacagaugagcccccagcaccuaaguucuaguuucccuuucacauuuauuucuuuuuauuguaugugugugcacguacgcauguggaggucagaggacacauuucaggagucacuuuucucuucccaccacgaggguucugggaauucuacucaaguccucagauugguggccagcaucuuugcugauaagcgccgucucauccuuccaacccaaguuccauuuuauugcuggauuucuaucccugccucugccucccgaagcugagcuuaaaggcaugugguuuauuuuuuuauuuuuaaaauuuguuuguuuguuuuuagcacagugagcaaagauuuacuaaggaaaaaacaaggaagaacucccaagaguuggggggccgggagcuauaaguaguuccugccucuacuuuuucuuuugucucagacauucaauuccacgcuugaaaucaacccuggcucugccuuuugcuuucuaggcgaccuggcucuuguuugggccuaaggaaaagccgacuguaagccgggaagcaucucuggcaagaacaaggaaggauuaagcacgucugugguugugcgcagggaucacaaggugcuccugcagugggaagagccaccacuaggggcgcuccaagucuuguauuuucuaccuugaaaacucguuucccuguggcugcccuccaaauccaacggagaugaauggcuuuuaguuuaccuagcugauuuaauaaacuuuaaaaauaaauguacgaaugacuuucuuaauaguguggaugugggucuguggccccuccucaccacaaggucuacagggaaggcauguggagggucagaguggaggggagccgucucauagucugguuuucaaccacugugucuugagacgaguuucucaagagugaggcaguucugagcuucccacauccagccucccuccuggggauguuaggaaauauggacagggcggaaagaaaagcuauacaaaggucagaagagagcucccaagaccgcuuaccuccgacgaaccgccuccuccucccuacuccccggaaggaaaugccagggugggagggagacagauccagcugcuaagccaugaccucaagaacaguauuuccaggaauccccaucuuagcauccaagggauuccugggaaaacuggaccgugaggacaaggugggagagagagagaugccuucagcacgugccacgccccuagggaccagcaguucucucggcauccaccguggggcgcuguauacacccuccuucccgggaugcagcguccugcucugggaagagcaacuagagcuuugaguggcuuggaaaguaccuucccuaaggucaggaagcauuugggaccaguccucccugccucccuccccccgccaugguccacggggacucuggccagugauuauuaaaaguccguucccaggcucuagugaccuucucgcugcgguccuccagcaggucacuuggccucugauccucguacgauuguaaaguggcaucaaauaggacccacuggaugggucaggagccagcaugaaggcagcgaagccauggacgcuuagaaaua

SEQ ID NO: 8946 - RNA, 11480 nt, Mus musculus
cagggcggggcgcacagucgagcgccaaccgcuagaggccgauccggagcgugcugcccggucaccacccgccauggcccgcgcugccccgcugcucgccgugcuggccacaguccucaccaccgccgcugcaggcggagacgcaccgccggggaaaaucggugcgggaaggaugcgguggggugcucacugaggacgggcgggaagaggguucgcagcugaccggggguaggggagggcugcuccggagacgaacuggguguaggagaggcuaggggcuacugggcacagaagaagagggcauaggggagguggugauggagaggguggcuugagcaccaggagagggccaccugggaaggaggaggcccgggcaguaauagccacugacagcuugcugucugcaaagcacauggucacugcacauucgcucuggagaagcuggcgggugacaagacaggagcugggcggguggaggcguucgcaggggucugcugagggccuuguguguagcagaggcuauggcugugguuccugcagcaggagaggcccuuccuuaggacgagaaaguuccgugucugaagagcguuugccagguucugcgggcgcuaaaaaagccuuuggaagaguaacauuuaaccagaacuuccggucuguaaaagcaguuccuuccacaggacagaacaauagauggcuggggguggauuuguugagugacagaguggggaacuuuuuccucucaggcuagcuaggcacucuacugcgcagcccgauauggacaacucuuagcgacaaucuuuuuuuuuuuuuuuaauuauuauuugugugguuuuccccaacauuucaucccaaaguucuuugcauacagcaaaguugaaagaauuuuacaaucucguccaugugcccaccacccacucuggcauuuacugccaacgaacaacacuuaccauucuggugcauuucaaaauaaacugcaggcacggggccaccucacuaaauacacaauuguguagucuuugucacuagugccgccuuuguucacuuuucuuucuuccuuucuuuuguuuucucucggcaugacucagagguucucaaaucucuuuguacaugaauuccgacaaccagaaaugcugggcuucugguggugggagggcaggugggagcgccuuaggacaucugggacaucauagacuugccuggaccgguucuaaaguuuaauuguguaggaaaaacuaacucccccaacaggccacaaaagguuaaagcugaccaaagcacacuggaaaucgauuuaugacugagaguccguggaagagagaaucuuggagguuggguauuaagagacggccuaauggagguugacuuugggguagacuuggcaggauaaugaagaguuaggcaggcagggaccagggauguacaguacucauuucccuagcagcaaagacccucccagcagagccaaauggugauuccauaccuuguauccugccuccugcuagcuuguccccagacacaccucacugauguccuucucuauugaugacaagcugucccuuagcuauccugagugccuucaaccccuuggugauuuggucuggaccuagacaggaggaagggcagggugcuuccuguuugagggccuaauccuugggcuucggcaggauuuuaucucaaugcuucuggguagcccuaggacccuuuagagucccccugauggcccgcuccugauguccucucugcucucacgggcaugcagauuuuucucuaggaaucuugcuccagugcuuucucuauaugaagccuguagcugcugcuuuuuucucaggaugcccugaaagccuguaguccuacuuaguuauggauuguucuagcugacuguucaagagucucugcccauuggcugcuuaggccucugggaaccaaaacccucuuugguucaucucugggucuuugguacaucuuacaggacaaaguagugucuguuaugugugucccauaagcccguucacagugacaugacgucucacuuauagccugggagagugggaguugagagucacccccagaccuugaaaugaccauuucuuuggagaaaauggguaguuuggaacucuucaggaaagagaaagggaagagagcagagugguuaagaaaaagcuaacgguauucccggaagugacuuuuuggcuuuuuugagacagggugucuucucuguguagccuuagcuguccuggaacuugcucuguuguagaccagacuggccuuagagcucagacaucugccugccacugccuucuaagggcuuagauuagaagugugacucacucuugaguucugaggaaaaggagucgguuauuucaacaugcgauagauaugucguggacuugaccaccugccagggucuagggaacaaaaucacccuccuuccucuuuguccucaaacccuuugaagaugguguggcaaaggcagagugugcugccacuauacgugugagagaucacugccucucccuugaagguggcucuggcaagccgagcuaaagggagucuuuaucuucuggccugccuggcugggaauacugagcugucaaugagaggaaaccagaguuucagauacaggacaaacagaaucuuggggaaggcaggagcccaacccaaggguuucaugacgagcucacccuucucccucagggcugcuuguugaguacuaucugucuagacagugguucccaguagcaucaggugguagauuggacuuugaccaaagguuggcacacuuugcuucuaaagagccaagggguaaauauuuggggcuuugaaggcugucuccugacaguagguaagaguaagggugugggcucuauuggcggacgccagcagcaucagggggcugagagggaggacucaccugagccuaggaguucaaagcuagcccaagcagcauggugagacccuaccucaaaaaagacaagaccagccaggcuuggugguucaugccuuuaaacccagcacuagggagguaguggcaggcagagcucuaggaguuggaggccagccuggucuaccuagggagaccuugucacaaaaaaaggggaaaaugagggaaugaagaccuaugucuguaaaacuucuaagacaaacccguacuuggauuugggccugcgggcuguagugugcugauccuguauugacgaaugguuuccagccaccaaccgaagugcuugguuaguaacuuuucaccaguuaauccugaaauaagcaaaauggaggagauggggaauuuuauaaaaaucuaaguuuaucaucugauuuuuuuuuuuuaaacaucaaugguugaucgauugaucgguugguugguugauauauggaaagagggcacaugcaugucauggcacuugggugacgauugggggacaacuugaucaaguucauucuguccuuccacuacauagggccuggggcaugguuuuguuugucugcuuguuuuugacagggguuucuucaugacagagggcuguccuggaacucucucuguagaccaggcuggccucaaacucagagauccauuugccuccccacccacccacccacccaccacucacccccgagugcugagauuaaaggccugcaccaccacugcccagcucaauguaguguuuuagaacauucugaauuuugagauucuuuccuccucuccugcuagggccguccugugucugaugagggugauagcagguacaagaggcaagggcagcccuuucauuguugggcuuagaacguuuucaaacucagacugaaauuacccgcuuugaaaugucauaagccugcuaagugccagccaggggccugcacucugcacggggcaguaugaaaguaaccagccuuucucuugugccaucucuccuuccuugccugguuuggacuugcugacagcuguuaucggagcugggaucgggggcucugcuguggcccauuuccuucagcaacacuucggaccccgagugcaaauugucgucuaugagaaagggacuguggguggccgccuggccaccaucuccgucaacaagcagaacuacgagagcggggcggccuccuuucacucucugagccuccacaugcaggacuucgucaagcugcugggugaguguucaucacagcggggcuccagugccccgugccucaggcuccugggggcccagacuccccccagacccuuaaggucagauagucauuuagcucaaucuccucauuuuacagauggagcagcugagaccagagaggggaaagaacuugccugagguacacagugaguuaguugcagagccgggauuagaacucagguuugacucccaggccagucuuucccuuucagcuuacugccuauuaauuaugcaaguguaucaguguccgcgucccauugcccaccagauaccugguacucuacuaggugguauguggauauuacuuccaaacccugccagccuucaggaugagagacuggagcucaaacccuuaacuuacuucaguugagacagcaaugcuauauaggcaauaaagccgggacucaaagccagcaugauguaaacuccaaauacacacccuguuugcucaagacgucccagcucucagaagugguccucaggaccuuguccuguagauacacaaaguggguacaugcaaacucauucacuacauccgggucugccuuagcagaagguuggcauguccucucggcccacccucucuguacuuggggucaaacacaaugcaauggaagcacacaguagacuauccaggaugcaggaugcuguuaaagagcaggguaauguauauguuauuucaggguugggggagggagggacuaaaucauggccauauacauacauauucaugaguggaguguuccuuuagagugcugagaagcuagaaagaacuccgugaggucagggccccaucucaaagccagcccugucacaagagccuuuaaacauuccgaacacuucccucacucuuggcuaagcagaucgcuguugagagaaauacaaaaugguacauuguuuucauuuucauuuccauauucgcuaggaagagcaaacuuucucaguguaugcauuagagugcugcuuacagacaaguagcauaacaaaauagacaguuccagccauuugcaucaggaaggccccagugcaaaaaaaaaaaaaaaaaaaaaaaagcucaaagcacugcuugggccuccugggguccuugaagaggagcugaggggucugcuggucucccgcaggacugagacagcggcgcgagguggugggcagaagcgccaucuuuggcggcgaacauuucgugcuggaggaaaccgacugguaccugcugaaucucuuccgccucuggugguacuacggcaucagcuuccugaggcugcagauguggguagaggaagucauggagaaguucaugagguagggggaugcucuuaggaaggaauugauuggucggaaagugugaaaggggagggacgguaaauccaagggccggccacaguucaaugcaggcucagagcaagccccagacagcccagccggaugagugugugggacagagccccacgugucauacuaacuccauucuuuccucccaccgaaguucugaagcacuuugcaaacucaggaacuuuccaaggcugaagugugacgggcguaggugaggugcccggguggaagaggaccgggaggccgcguaccucgacgaguaagaggguggcaggcagcugcagcagaccacaaggagucgugucaugaaaauuuccaacuuuucaauguuuaucgccaguggguuuugugagccaagugaagcacuugugugcagccuggggucacccacuggaaagcuugcgguccccacuuugucgcucuagaacagugguucucaaccuuccuaaugaugcgaccauaagauuauuuuuuuuguugcuacuacaauuuuucugcuguuaugaaucuuaaugucaauauccgauagguaggguaucugauaugugaccccuguaaaaaugaucaucagucccaaaggggucgcgacccacagguugagaaccacuucccuagaacauucucuuuucucuucuuccucuugaaugccagccccucccuauuacccucuagauacagaggacaaguggucuaaacccgcucuguacucaugccaagcagccaugccucuucuguaagccccuugcuuccuggaacccugagcugaguccccaucaccuacccuucucagugucagauguccagauguggucccacagugcccuucccugccucucugcccuucuccacucccuuuucacucuaugauuagaccauccaaggugacacaucuucuugacauucuccagaugucccccggagaagcugcauuucugcucugacucucuguucuuuuuaaauuaauuuauucuuugauaauuuuauguauguaucguaaugcauuuggucacaauucuucccuccuuccucuuccuucuucccuccuuccucuuccuucccccuucuuccucuuccuucuucccuccuuccucuuccuuccuuccuccuuccucuucccuccucccuccuuccucuucccuccucccuccuuccucuucccuccuuccuccuuccuccuuccucuucccuucuucuuccuuccucuucccuccucccuccuuccucuccccuccuuccucuucccuccuuccuccuuccucuccuuccucuucccuccuuccucuucccuccucccuccuuccucuccccuccuuccucuucccucuucccuccuuccucuucccuccuuccucuccccuccuuccucuucccucuucccuccuuccucuucccuccuuccucuccccuccuuccucuucccucuucccuccuuccucuucccuccuuccucuccccuccuuccucuucccuccuuccucuucccuccuuccucuccccuccuucccccuuccucuccccuccucccuccuuccucuucccuccuucuuccucccucuuucucccuccuuccucuuccuuccucuucccuccucccuccuccucuucccuccucccuuucuuacucaccucucuuccacucccaccaagaccucaucucacucuucugucuucugccuuguuuuuguguuuguuuugccauccccuggguuuuaagcagggcugcacacaggggcauugguguggaacuguccucuagaguaugggucacucucuggugaccacaguggcuuccucuucuccagcagcucuggcuugcuuuuagcuuccuaggaugggcuggggccccgugagcuccccccaaucugugacugaaguuuuauagggcucuaucuucugcgugcucuaugcagccaaccacaguuguggugaauucuugagugccacagccauggccugcccauaagacuauuucacaacucuccuccccacccagcuuuuuucuuuucuuuucuuuuuuuuuuuuuuuuggucaccuuucugccuuggguuggcacagaaucucacugugucaucuagccuggccucaaacucacaauccuccugucucacccucccaaguccugggacugcauuucuuccgucauguacacagucaugcucggccccucuuuuccuccauaugcucuucucucucgucaguuuuaaguuacccugccaugcugacuguucccuauggcggaagcaaguucugccugucuucuucuggucccucauuccuaucuaguggcccaauugaaaaccaggcucagaaaaggcagccauucaaaggcaagcuaguccagaauuguaucagcaggugguucccaucugugcuaguucggaggccgaaaugaauggaggggggauaagacaggagcucugagccagugagauccccgacaggccaagccagagggaaggacaguagugguaucaggcuguugccaucaacccagcucguuccuugaagccagagcagaucugaagcuaggaaaaucaaauccacucguguucagagacaucaccagcaccuggggaauggcaggcccgcagggggaccuccucuggguggucacccugaaagccugucugcacaagauuccagucacucgcuucuccuaggaucuacaaguaccaggcucacggcuaugccuucucggggguagaagagcuacucuacucacugggggaagccaccuuugucaacaugacccagcgguccguggccgagucccugcuccaggugggcgucacacagcgcuuuauugaugaugucgucucugcgguccuacgggccagcuauggccagucggcaucaaugcccgccuuugcugguaaguuugcaaccuucagccugcuuguccuuccuguccauauacuuagaacaagcugggucccaugaagacccuguggcuuacuaccauggccuucuuucuuuccuucuuucuuuauguuuuuaaagauugauugauugauugauugauugauugauuuaauguaugugaguacaccauugcucucuucagacacaccagaaaaggguaucaaaccccauugcagaugguugugagccaucaugugguugcugggaauugaacucaggaccucugguagagcagucaguguucuuauccgcugagccaucucuccaggcccccccuuuuuggggugguguugguuuuuucgagacagggcuucucuguagcccuggcuguacuggaacucuguagaccaggcugaccuugaacucagaacuccgccugccucugccucccaagugcugggauuaaaggugugcaccaccacgcccagcccuuuuuuuuuuuaagagauuuauuuauuuaauguauaugagcacacugcagcuggcuucagacacaccagaagagggcaucaaaccccauuacagauaguugagucuccaugugguugcagggauuugaacucaggaccucuggaagaacagucagugcucuuaaccgcugagccaucucuccaguccccuuucuuaauguuuuuaaguuuaaaaaucacguuguauuuaauguuugaaaucaacacccauggguaggaggagucuuguccugggaugaaggcccaagaucuuucuucucucucccaggagccaugucccuagcuggggcucagggcaaccugugguccguggaagggggcaacaagcugguuuguucugguuugcugaagcucgccaaggccaccgugauccacgccacggugaccucugugacccugcacaguacagguaagugaauggugcagaagucccauuauccuuucucuucuguaccuccaccuaguggucgguguaggaaguauuuuuuucagaaaaaucagugggaggccuaccaacacuagagggcacugucgugguucacagagacuugagucuccacugcgacuccugugagcacugagaauuugagugacaucccuaccucagccagucagcagcagaaccagcggaagggcccccggccuuucuaacagccggaucagugcuugcccagcagcugcaucaaugugaccgcccagcugcuccugaccccagacucucccugcacccccagggcuaggccccacagggaaggaugguggguaucaaaaugaacgcuauguucuuuccugcuagaagggaaagcccuguaccaaguggcguacgagagugacaagggcaacagcucugacuucuacgacaucguggucaucgccacgccccugcaccuggacaacagcagcaacaacaacaucaccuuugaaggcuuuacuccgcccauugaggacauucagggcuccuuccagcccaccguggucucccugguccauggcuaccucaacucuuccuacuucgguuucccggacccuaagcuuuuccccuucgccaacauccucaccacggacuucccgagcuucuucugcacucuggacaacaucugucccgucaacaucucggccagcuuccggcggaagcaaccccaggaggccgccguguggcgagugcaguccccgaagccccucuuccgcacggagcugaagacccucuuccguuccuauuacucaguccagacggcggaguggcaggcccacccccucuacggcucccgccgcacccucccgagguucgcccugcacgaucagcucuucuaccucaaugccuuggagugggcggccagcuccguggaggugacggcuguagcugcuaagaauguggcucuguuggcuuauaaccgcugguaccaggaccuggauaagauugaccagaaggaccuaauccauaaggucaagacugaacugugagggcucccaggagagcccagggacucugcgccacacugaagauaacugagauggagcgcacuccagccgcgcaggacugacgaggccacacccaugggcucuguggcuuucucugcucucauggauugaacagggucccccaugugggcccgggcgaucugcugucugcuuaucuaaggauccucuuagaggcugccuuuuuuuuuuuuuuuuuuaaggagcgauuaagaaaagggaaggaaauucaagucaguguuuuggcuguuuuuguuuuuuguuuguuuguuuuuguuuguuuuuugugguguuggguuuugagguuuuuuguuugguugguuugguuuugggaucguguguuuauuuuauuguuuuuguuuugggggguuggucguuuguuguuuugggggguuguuuuguuuuguuuguuuguugguuacuguuuuucaagaagaaauauaaauucauccuccaagcuacuucugacuuauucuuuuuuuuuuuuuuuuuuuucacauggagccaagaugacugagaagggguauagagcagagaacuaguuuauuucuuucguuccugucuuccauucucgucuucucaaaauugcacagccuugcaaguaaaacauuuacaaccagauacuuaaaaacagaaaggcaaggucagaaaauaagcauuuggauaggcuguuuggagaggguucaagcucagaacuuccuuagagaccaucuccacacuuccgaucugagggagagauguuuacccccgccacugccuucaguagagcucugggcugcuugucaaucaugaugaauggagccacgcugggcuuucgggagaagagaugcuucugaccaccccuggagguaucggccagcgcacaggagucaugugauagaucugucuugcaacggagacaaguccucagagagugggccuaccucacccucaaaaggaggcaugggacagaguucuucagagcuuaaucuggcccuagcuuaagagagagaauuaugcuuugcuucuucuguaaccuauaaagaucaguagguuggagcuggagauacacuucaguaggagagugcuggccuagcauuugagaggccuuagcguuggcuccccgggccauuaaauaaauua

SEQ ID NO: 8947 - RNA, 2351 nt, Mus musculus
cacagguuugcaucuggagcuccgaagacacacacggaagggcuaggcacggugcaugccauucugguacucuuacacauuaagccacucaucggucacgacacauaguuuaccugugguuuccagugggagagacaaggacacuccagagucaagagguuuugaagaaacgggugcaaugaagucaugguuaaacaauuuauuuacuguaaacuuuagacuuuucucagcaaaaaaaaaaaaaaaacccaaaaaaacaaaaacaaaaacaaaaccccaaaaaacaacaacaaaccaaaaacgaaccaaacaaacaaaaaaacaaaaacaaaaacaaaaacaaaacaacugauguugucccucaaaucccugccugcaacacuccauuugaguaaauaaguggagugagagagaaagggcccauugucacagcagaaagguccaagacacaggauauuucaaguccaaggguacaggaagaaaacucucuccuuuagauauggauuuccagcagcaauauauaucauucuuaauacuugaccagugagguagauacaugaaaacaucauccagacagacagacagacagacucaguccuccagaaccaacacucuucagacagaaaccuuuaaguuccauacaaagaggaacugaacuauacaagaaaacaauaagcacucaaauacaguuucucucucuuguuugcagcuuaaaaaauaaaauaaaauuuaaaaaaaggcagaaggaugugccuccccuucugcaaaucucuauacaauuuuauucuaaaguuauuacacucaaguuaaauagucugguuaguguccugucaaggaggggucuuagagaguagaaagccuguauuacaguggcgagucauuuguacuacaguuccuuccuugggagucaacgcuaaggcuaggcacaguaccuugacaguucacaaagccuuccaugccugggggauccucacacagcaguuccuguucucucuccugccccagcugacaaguguuuggcuccccuguguaguccguucugccguugcuauugcuagaguagccguucccauagguuuucgaagaagaccugcgaaggcacagaagcucuugaaaggcaauccugaaaucuggacuccgacaguagauaagaggauugaaggcagaguugacguagcccaaccaguuaaggaggauguaaacuuccuuagggaugagguugucccugauaacgugcacgauauugacaaugaagaagggcagccagcagagggugaaugugcccaugaugaugccuaaagucuugagggcuuugugcucuuucaagcagaacuuggaggaccuucggaguccguggccgcuccgcccauccugcuccaccuggcugagguuuugggcguggaaucuuccuucagauuugucuaucuucugcagcugccuuuuggccaccuggaagacccgggaauagacaaagaccaucaccaccaggggcacguagaaagacacaaucgaggacgcgauggcguaggccugguucgugaagaagucacagcaagucuccucgguguaacaaucgauagcuuucuuguggguggcacgguaccagugcaucuggauaggcaaaaaggagguaaggccagauacaauccauaccaucaggaugaccacucgggccuuauucuuggucagcaggcucugguacuugaagggcgaugugauagcaacauagcgauccacugcaaucacgcacagggucucgaugcuggcugugacgcacaacacaucaauggaaguccagaacucgcaccagaaguugccaaaauuccacauuuucauaaggaugugacuggccccaaacggcaccaccgcuaggcccaugacuagaucagcacacgccaaggagauuaugaaguaguuggugacgguuuguagucgcucgaacuuggcaauggcugugaugaccagcacguugccaaacacgauggccaggacgauaaccgacaugaggauggccaugcccacaacccacgcuucgucccguuccugagugacgucguggucuggcgcucggcuuccguugggugccagcaagaagucgcugucguucccguguggccccauggcuggcagguuagcaggugagcgcaccggcuuucggugcccaggcgcucucagcgggugcaccuccgacggggcgcagccggccgggggcggacuccuggaagcuucauucagcggccguagguggcugugcuggggugcguccugcacacucagcucgugggugcuccgggcucgcggugccugcagccgcagccugaaugccugagaagcagccuugcagugcgccc

SEQ ID NO: 8948 - RNA, 2351 nt, Mus musculus
gggcgcacugcaaggcugcuucucaggcauucaggcugcggcugcaggcaccgcgagcccggagcacccacgagcugagugugcaggacgcaccccagcacagccaccuacggccgcugaaugaagcuuccaggaguccgcccccggccggcugcgccccgucggaggugcacccgcugagagcgccugggcaccgaaagccggugcgcucaccugcuaaccugccagccauggggccacacgggaacgacagcgacuucuugcuggcacccaacggaagccgagcgccagaccacgacgucacucaggaacgggacgaagcguggguugugggcauggccauccucaugucgguuaucguccuggccaucguguuuggcaacgugcuggucaucacagccauugccaaguucgagcgacuacaaaccgucaccaacuacuucauaaucuccuuggcgugugcugaucuagucaugggccuagcgguggugccguuuggggccagucacauccuuaugaaaauguggaauuuuggcaacuucuggugcgaguucuggacuuccauugauguguugugcgucacagccagcaucgagacccugugcgugauugcaguggaucgcuauguugcuaucacaucgcccuucaaguaccagagccugcugaccaagaauaaggcccgaguggucauccugaugguauggauuguaucuggccuuaccuccuuuuugccuauccagaugcacugguaccgugccacccacaagaaagcuaucgauuguuacaccgaggagacuugcugugacuucuucacgaaccaggccuacgccaucgcguccucgauugugucuuucuacgugccccugguggugauggucuuugucuauucccgggucuuccagguggccaaaaggcagcugcagaagauagacaaaucugaaggaagauuccacgcccaaaaccucagccagguggagcaggaugggcggagcggccacggacuccgaagguccuccaaguucugcuugaaagagcacaaagcccucaagacuuuaggcaucaucaugggcacauucacccucugcuggcugcccuucuucauugucaauaucgugcacguuaucagggacaaccucaucccuaaggaaguuuacauccuccuuaacugguugggcuacgucaacucugccuucaauccucuuaucuacugucggaguccagauuucaggauugccuuucaagagcuucugugccuucgcaggucuucuucgaaaaccuaugggaacggcuacucuagcaauagcaacggcagaacggacuacacaggggagccaaacacuugucagcuggggcaggagagagaacaggaacugcugugugaggaucccccaggcauggaaggcuuugugaacugucaagguacugugccuagccuuagcguugacucccaaggaaggaacuguaguacaaaugacucgccacuguaauacaggcuuucuacucucuaagaccccuccuugacaggacacuaaccagacuauuuaacuugaguguaauaacuuuagaauaaaauuguauagagauuugcagaaggggaggcacauccuucugccuuuuuuuaaauuuuauuuuauuuuuuaagcugcaaacaagagagagaaacuguauuugagugcuuauuguuuucuuguauaguucaguuccucuuuguauggaacuuaaagguuucugucugaagaguguugguucuggaggacugagucugucugucugucugucuggaugauguuuucauguaucuaccucacuggucaaguauuaagaaugauauauauugcugcuggaaauccauaucuaaaggagagaguuuucuuccuguacccuuggacuugaaauauccugugucuuggaccuuucugcugugacaaugggcccuuucucucucacuccacuuauuuacucaaauggaguguugcaggcagggauuugagggacaacaucaguuguuuuguuuuuguuuuuguuuuuguuuuuuuguuuguuugguucguuuuugguuuguuguuguuuuuugggguuuuguuuuuguuuuuguuuuuuuggguuuuuuuuuuuuuuuugcugagaaaagucuaaaguuuacaguaaauaaauuguuuaaccaugacuucauugcacccguuucuucaaaaccucuugacucuggaguguccuugucucucccacuggaaaccacagguaaacuaugugucgugaccgaugaguggcuuaauguguaagaguaccagaauggcaugcaccgugccuagcccuuccgugugugucuucggagcuccagaugcaaaccugug

SEQ ID NO: 8949 - RNA, 824 nt, Mus musculus
ugguuauguuaacagacuuaaaaaggguucuacccauuagucacaggaugcuacuucuggaacagaggugggcaagacauggauggauauucuggagacuaaagcuagccugauauaagguaauuagccccuggacauauagcaguucagucucuccacacacuguuguagucaguuaaucaguauuguagagacagcuccuuuccagaaaauaucguucacacauucaggaagcauuuucacagaugaacaaauaaaacaugaugugaguauucauugcaagcacagaucaagaacuuccuuuauacuuaaaccugaguggcuaaugagauaccuggaaacuugaauucuaguaaguacccucuugguuaguuauagugagagccuaggagcugaauagauuccugguagacaaacagacaggaaagaaaagcucuguguaguaucauggacuauucucuuaaacauuuaagauggccaucuuccugauuaucuuccucuuuucaaggcaaagacuuggugagucuuaucucccccugggaagaacuugguaggccuuucuuguggguagcuucugugguaagaaccaaucagcuuuccucucuuugucuaaugacccaagcucccacacacaccccaugacaacccaacaagccaguucugaggaauuagagagcccacugcaucaccagacaaauauuggcuuuuuaaaaaacacuagggcaccauuuaaggucccucucuaccugguggaauguguauuuuuaugugcuguguuguacauucauauuuaugcuuucauuaaaaucugccuaggugcugag

SEQ ID NO: 8950 - RNA, 21619 nt, Mus musculus
caggaaguuugaguccuucgcuucccguaguccccuuucccggcuuccuccgaggcguucccacgccgacgcuccggguguuuuugcugagaucuaggcggcuucacucuucgcgucagcaagcgaccgaggcgauggcagcccagaagaucaacgaggggcuggagcaucuggccaaggcagagaaguaguacguggagucgccgcccggcugguggccgugcgcgccggcugauugggagggaagcagggcugugauggugucugcgcuuggggcggugccuucccuugugggucaauccccugcagucggccgugacagcaugcaccgcggcguuugcagcagacgccccugugacauccaggucugcccggcgccggguccucaggguuugcugcugcucugcucugcucguugcgggcuuuggcguggacaccuugucuccucuucaugacagccagaagugacauuauggaaggagucucgcgguggagagccacugcaagaaaagagacccuggugccgugcggggguguagacugauucugaaaaccucucacauucagacauccuauucacuggggacaaggucuaaguuuccuuggucccguggguguucgucaccauuugguucugggcgcaguuggcacacagcuguccugggaacugcgaauucuccuuggcccucuccuccacguccgugaacuaaaacauacacauuuaacgaguaucgacuguaagaaauuucuuaguacacuguuaggugaauuagaaacuaaaaucuuaacacauagaaaggccucaguuuacaaaagaggaauugaggcggccggaaacuuccuggagaccuguccaaggcugcucaguugaaaacagcagggcgaguuuuaggcaguggaaaaucacaagcccuuucugguguaccaccuugccuccuggcaguggcuagaaagauggcugucaaugcagagggugaacccaagaauccuuuuuacuggugaaaacaaacauaagagaacagaaugggugcucuuagcuauaauaaaguugcguuuugugaacuaaaggaggauuuugaccaccagagcuaagggaacuguaggagccaggauccuuuccuaauagcuucggcaaguccucagggcagcuguguguggaguugagaacuaggcuccuagauuucucuguugagagaagauuggugaaagaggccuucugucaagacauagaugaguggacuugcuuguggcugugguggggucugaaaggugcuugaaguugcucuaaguagaagagccaaugggugacaggaacaaaugggccagaaguguaggagaggcagugggauuggucucuguuuucugauggcgguaucacucauuaucacuauucuggcugaggaaaguuuacugacucuuaggacaaaaacaguuaagguccacaacagauuggccaugaccccgacauuauuagggccuucauucuugcuaauuaguggugcucagcugccugggguugaucugcaguuuuaagaaucucuuuccggcacauuggacguuaugucuuguuuucgggagacuuccauaaucacuucaauauagggcguaaugggugcuuuggugagggggcaaagaguuaaagcuuuaguuugcugcauauuuucucaaguuuguggauuagguguuacaugcaauugaaaaaucugcuuaauauuuaagucuuguuacaaaguauauauguguauguuaaaugcagacuauaaaaugcaucaugcagggauauguaacuucagagauagacucuggguaguugaugggugugucacugaaugcagggugcacuucuaagggccucaucucucagcugaguagccccugauucagaugaaguuagcaguguuguauguaagcaggcuuacaguaauugaguuaaaaucuauaauauaagauggcauucagcaauuuuuaugccuagccaaauuuaauaccuaccaggacugugaguuugauaauuuuuuuuuuuuuaaguaaaagcaaaauaagaaagggcaagaaagauaaacaacacuggauaucuuuugcucuggcuucuaagccagcaucaauccugggagacucuaucucuuugguguccuaauacacuacuucucuuucucccuccugcucuguggugguuauuucuccucugaguguuguucccaguacucccuggagucuccucagaggaugcuaccuuugaccuuggcauaacagauacccauggcuguuaaguuguacucccccucguggcuucucggcugaaaaggauggugugcuucagguucucaagcuuguuaaagcacacuuaucuggucuguuaaaacccagacaguuucucauucuguagaucugggguggggucauuguccuuuucuagcaaguuuuuaggcaguguuguuacuucuggucuggggaccaugcauguucuuuuuggacgguauguggaagaaggaacauuggugaugggguggggauagaagaagaagcaaaagugcauuuauugugaaugcacccaaagagaguugagaaggugagggaccuguagcugaugcugucuuucuaaauaagaaacgucuuucuuucucguucuagccugaaaacugguuuuuugaaguggaagccagauuaugacagugccgcuucugaauaugggaaagcagguauuuguggcuggaguccugaugcugcuaugugugcuguuaacugaaucugauaacuuuagcauaguaauuccaucacuuccucauauacuucacgaguuaaagcagagaagcggagcagagcaacggcacaggcuuugcauggucccacacuuucccucucagauauggccagugcugagucagguccugguccgugcuccuaacugcagacgugggguagugucagcuguccagccguuagcacauucauagguauucguaaauacugcuuauuucugucuuagacuuucugcaguuuaauuuuuaaaacuagucucacugaaggagaucuaccuaucuuguuuuuccacauucacauuuaugagcuucauuuugagauaaacuauugaauguucacgaaggguuuuuagcuguaugcgcauuuuaguaaauucaccuucuauaaguauaaaauaucuuaaaauaugcagcauaggaggauuguuaaagcucagugauuuguuaaggaaugauaugauagcucugaauaucugcugucguuuuggauagaaaguaauaaagcauaauuuugaggcuggcaagauggcuuaaguugccgagccugaccaccuggguuugaucucuggaucccaugguggauggaggaucugacuucugcagcuugucucucaccucccugcgcaugcacaauaaaaaucuaaaccaccacgaauuugaaguucugcaagcauauuuucaucugugacuucguucaugaacuuggcuuagagaucgccuagagcaagcacuuuucaccaaauuuuaguuucaguuugucuccaaaggaaauaaccuggaagcuaccauuauuauacacacagaggguuauuucuuauucaaaaggaaaacaagaggcuuuggcccuguauuuaaauauuaaguaaacuuguugcuauugugcaaagugcuuguauuuuauauuuaaagauaaagauuugcuuaaaauuaagcuuuauauggauuuuggguuauacuuuacacggucgcuuaaaaccaaacauacauuucucaagugcaggaaguuuuacagcuuugcuuuaugccuccaggaccacgugcugcuuccagaaauaaauauuccgaaucaagucuccuauucaaauggccuuuguuuaucuuccuuaagagugcaugcagaauauagccacgugauggaacguucuacagacaacuaggcaggcagggacaggaauaguuguaguauucugucuguuuucacacuucaguaaagaguucuuugagagagguuuucagaaguaauaguugaggagacuuuaucuagaagcgagaccgaggcaggagcaucugcucaagucagaggucagucugugucaugugguugaguucccaggcagugggggcugcgucuaugguggagaccuugucucagaauggagaaacaaacagaagacaacacucuucucaaaugaguacggguucuacuuuuucauacuccaccuuugguggauuuuccaaauguuacuauugucucucgggccguccuggugguuugacccccaugagcccuccuuguaaaacagccugcaguguaagguuagcucuuugaacaguguggauaacuaaauagaaaagcuuuguguucaaagaugacuuggugcguagcgacugcgcagagggagauuuguuacaaggcuggugugucagucgggcugcaguuugucaggagugcacugagcuggccgggaagaagcucgggaguucggcuccuccuugggggaccccugcuauuugggaguaggugcuagaaggaguucuugguguucaguggaagcugcaccaauguguugcuaaaaaucaauuaaaacuuucacgggcuuuuaaaaauguccuuagaaagaugguaauucacuuuagguaaaaguacuauuucacgccauuaugaaacccccuaucugaaaucaguguauuuuguaaugucucacacagaaugcugccuugggugcugauucaucuuagggcuguuaaugauggaaauagaaagucuuuuuuuuuuucuuuuuuuuuuuucuuuuucuguuucagcuguugcuuuuaaaaaugccaaacaauuugagcaagcaaaggaugccugccuccgggaagcuguugcccaugaaaauaacagggcguaucuuuuuuagcuugaaaaagaaauggaacaacuaggaggcugugagaacaccuuuucccuguuagaacuuugugugugaaggaaagugcuuuucaguuaaagcaggauggacagugcgugugcuuuaaagcccagggaauagucagugagugacccugagcacacgugguacgaacagccaugcuugucuguuugcuucuggguugacagggauuugacuugagaugaagugggggaggucuccagaccugugccgaaaaagaaagagaaaguauagcuagcuguuggaaaugcauaaacuguuuuggaaaaaaaaaaauuaaauuagucuugcuuagguauuugaagauuuauaagcauucuagaaagaauuguucuugguguaucuuaaaggcucucauuuauaaauguccacuuuaucucacaugcaugucauagucuugcuagucgugcccuuuguccuguugcuggacagcaguuuaaagugcugcacagggugguucagugucucggcuguaggagccgucagcagcacugaggugucacggcccuguccuuugaaagcagaaggaccggugggugacauaguucacugucuuuagaaggugagcuccagagacuguugacgucuucuuuccuuaaugcugacaucgucauguccauucagucuuuuucaugcugccaaguaaguauauuucacccuucuuauguguuugcagaugguuuaaaaguugggguuuuacucuagccugagaauuuuugcucaagcugugcauuuuuaaauacgcauuuuaauaaauaaauuauuaaauuuauaaauguaauuaaaaugauuauuuucauuugcuuuagucgucagcugaacuuuaaaggccacaugucuccuaauuauaagaaagaguuuuagauuaaaugcugcauaguauuuugcuuguaaaaacaucgguggcuuggaagucacuuuuuucccuguacugacaguuguucugucccacagugccugugggagagaagggagcuuucuccucuuagagaguauugauuugucuuaaaacuuagacuucuguuucucucuaaccuuucugagacggacuuuauuuugcugaauaaaaucaauucacuuuuuggugcuccuaagguaucauugcuuaaacaguaaauaaauaaaauaaaaagcaugaaacuacacuguggcagugugcgcuuagagagacacaguguacuugaggucccuucuguuggucacgucccugccugccaucuucaccggaagguuucucccucuucccucacgaaggucugucucaucagggaacuuguguucucuuugcagagcuuaugagcaagcuggcaugaugcugaagguuaguagcacuguguccgacagcugcagagguacagugaauaagcugccaagguagagugcaugcugcaguuggcaggcuuccgcaucguguagagccagaggggugaggguccugggaguggacgugaggugagggugaggcaagcccaggguaccacugacuggaccacagugagcauccuguagcugcaguuaggagggaguauugaaagcuccgugugagauguagggagcugggaagagcaaggcucugggcccugcaggcagcucagaggcugcuguugaaggaagccucgcgugagguuucccgcaucugagaaccugagggcaccuggaugugguaaacauuuauaaugauaugucuguuuaaauuacuuguugguuauggaaaggaaaauucacguuaccauuuauuuugguuuuauaaauaucaggcuggagucaguagagcuacaaacgagcuauuggugcucuacuguauuccuuuucaauggaauaauggaacauuuugacugauaggccacauuuaugcuucuuaauagcagguuagggguuacugucuuguaguuguagugagauggggugugugugugugugugugugugugugugugugugcaugcgcacauucacacauccguauggcuaccguguaagccagagcucagcccaaggcugaccagaagggccauucaccuuguuuuuugagacaaagucucuggucuggugcuugcugauuaggcuagacuggcugaccaagaguuccaggucugcauccagcucuagccccccacccccaccccagccgagauugcaagcacgcaugggcugggcuuuuaguuguugacuuuagaucuagaucucagaugacaccugcucucuccugcuauaugcccuguucuuuccccucccacugucacauuaaaggugugcugucuauuuaguaaguagguaggugacuuacaaaaagggguagauuuguuagcuuuauccugucuguuuucucaaauaccuuucaguguauacuguucaagcccuuggguucuuugauuggacuuugguuuuuugcuuuaugucauuucauuuuguuauuguuuuuaauucuuuucuucuuuucugcuaagguucagggguuugucaucccaugugacuaaacauaguaucuuuaugaaguagcuuuagucugugccuaguccccauagcuaaacauuuuuuuuaaauguuuuggcauugguagaagugaggcugucaguuuauuagaaacaagcuaacacauucucagcuugaugggggacuagugaccuuuggauuugaaaggaggcccugagaggccagugagagccuuauauagaaauauaggaaguucccuguagaugagaguccuugcacccuugcagcuagcucgccaguggcuucccuuuucagggcuuucauuaaaauugcuuuaguuuuugauuuagagaaucuaggacccuaagaucuugagacuuacauaguacuagugagacacagaauugauucuguggguuguaaucaucccagaagagaucuucaaguaccuauuaagucagaacaugagggaguagccaaggugagugaaacagaccagacagacacacaggcaguggagagcuguggccagcuuucggaggugacacauccuuuauagagacagcucuggcguggcccuagcuuauuuuuguaaccugggucugaagucugcuguuaacuauagcuuaugguaauuuuuuuuaaggaagccaugacacagaacuuuugugaaagcaugugauuuagaaacauuugguuguuaaauuagccucacacugacgauauaacuaugaagucaucucaauauguuuguugccauucauuguuuuugacaguauuauaaaagugagguaagcugggucaugauggcucaugccuagaggcuaagacaggaggauugcucugagugccaggcuaguuuuucuagugagcuccaagugaucuugaacuaauguaagacccugucucaaaaauuaauguguguggguaaaaucacugaauuuccaauuuccuaaguugagccguuucugcccugugccgcaugccuuuccuguaggagaugcagaagcugccugaggcagugcagcugaucgagaaagccagcaugauguaccuggagaacggcaccccggacacagcagccauggcccuggagcgagccggaaagugagugcacacagcaguuguugguugcacuagcuuugcccggggcuccucuuugccuugauaaaguccuugagaaacagugucuuaauucucacacaggcugugcucucugucugauucaggcucauagagaauguagacccagagaaggcuguacagcuguaucagcagacugccaauguuuuugaaguaaguuagacuuugccuuguuucuuuaauuacucagaagaucuucauccauaauauauagcuuuuuaaggcuuuuuguauccacagccuaacuauccccccccccuuuuuuuagggcagugguucucaacuuguuagucaugacaccuuuaggggucuaacaacccuuucacaggagucaccugaguccauggaaaaauacagauacuuacguuacaguucauccauaacaguagcaaaauuacaauuaagaaguagcaaugaaaauaauuuugugguugggggucaccacaaccugaggaacuggauuaaagggucucagcauuaggaaggaugagaaccgcugcucuagaggguagcgaaugggcuagaagcuguggugccaccacccauggccauugcuuugugcaguuguuguugaauguaagacuuccacauuagcuguacugacgcucccuugucuuugguuccuccagaaugaggagcgccuccgacaggcaguugaacuccuaggaaaggccuccagacugcugguacgagggcggagguauggcuugggagcuguaugucuauggauccauggguguuuugagucuacauuuggaacuuguaaauaaccuuggauauagcuauuugucuacacuuggacaaccagugggaaaaaugauuuucuaaggaguaggccaugaaauucaaaccugcuuuucuacucaugaaacucaugaaagaacagugaguuaucuugaccugucauugcauaguguugugguguucucuuagaguaagugacaaaagcgcccuacauacccacaaacaacagcuugugaugcuugaguuauagcauuaaaugggauuuuuacucucuauauaauacauauauagacuaaaaauauacauacacauacauauauacauauguauguguauguauauaaauuuauauauuuguauuuuaagugauuauucaauauaucuugaucauuuuccucucuuauagcugcucccagaaccacucuaccucuuuaacuaccugucuuuauuuuucucuuauucuuccuuucauuaagaaaaaaaaaacugauauaaaaacaaaaaagucaaaaugaaacaaaacuaauucugagcccggggccugccuggaguauaguugauagacauugugacaugccggggagaaaacugauuuucccuuugccagugggugucuauuguagauagcuucuugguuagggguaggaacccuuauccgcugaccccucugagugcugggacccuguugcaagaaauaauaaaaaagaccugcacuuaugccguuuauucucugucccucuggccuggcuggccaugcacuggcaggcaauggcugaccuguuuuuaucucuuggagacucucuggcucggagcucccgaaaugucuccacccagcucacuagguucucacuggcagguugcuacuacaccagccccaugcuucaagucccccauggccuuuguggugcacaucuggcaaacccaugcugugcuguaccuuucucucuugaacccagacgagccuccaugugaaggaaaacacaacacaaacuuaguucagaaacagugguaacucaaucgcugggugcagcaacuaaaauccuaaucuuguaagccuuauuaaaucuaaauccuccaguggcgaauccugacagaucugccacugaaaccgggagacacucguaguuacaucuuuuccucacgcuaucccuuccaaaaggaccuacuccucgccugcuuccucucuuccuccgcccaacccggaaguucugccuauucgcccagugauuggcuccuuuauucauuaggggauugguucacaagaacagcaccaggccgguccacagcaggacccugucuggguugaaucuguggcaauguaugcugccacagucucugugagcuucuucugcugugucuggaagauacuguuuccuuggagucuucuacauguagccauccauguggccaggaucauuccuugaagaugcugucuuuucuagugugcaguuuugauuccuauggauaauauauauauucauacguguguggacuuaugucugggucugugauuucguuccauuaaucaucaugucuguuuuuaugccaaugccaugcuauuucgauuacaguaagucugcagcacaaugaguuuggcaauggugauaacucuaacagcacuuuuacuauucaggauuguucuuggcuacccuguguuuauuguguuuccaugcaaaguuacaaaugguuauuugaauuucucugaagaauuguguuagaauuuugauggggauuucauggaaucuguugauugcuuucuguaggacagcuauuuucauaaaauuuaucuuacugauacaugcgcaugggaggccuuucuaucuuccgguguugucuucaguuucuccuucaauaucuuaaaguuuuuauuauacaagucuuucacuugcuugguuagaguugccccaagagacuguguguguguugaaagaucuuguuucccuuacuucuugcucaguauauuuaucauuuguauauauacauuuguguguuagaaagcaguuaucuccuguugaaguuuccuaguggagucuuuggguugugcacacugucuuaucaucugcagauaaacagacuuugacuucuuuccuauuuguauccgcucuucuagcuaagauugcaaguacuauauaaaauaugcauggagaaacuggacaacuuguuuuguuccugacuauagcggaaaugcuuugaguuuuucauuuaggcugauauuagcuaaagccuuguuguaaauuaucuuuauuauauugagauaugucccuuucucuugggguugauguucuuugugugguuugaguaucuggguaaaaauggcuucauaaaaagaacuaagaaguguuccuuuaauuucuauuuugugaaauaauuugacacaugcuggcauuaauccuuugaaggucuuauagaauuuuuuguugaauccaacuggcacugggauauuuuuaguugagaaauaccuuuuuaaaaaaaauuauuuauguauuuauuuuacacuccauauuuuauccccccacuccucccucccuccauccacccuccuacugcuccacaucccacacuuccuccccaacccccugucuccacguggauguccccccaccaccaucugaccucuaaacucccugggccuccagucucuugaggguuagguucauucgucucugaaugagcacagauuccacaauccugaguccucugcugcauguguguugguggccucauaucagcugguguaugcggccuguuuggugguccaguguuugagaaaucucagggguccagauuaauugagacugcugguccuucuacagggucacccuccuccucagcuucuuucagucuuucccuaauucaacaacaggggucagcugcuucuguccauugguugggugcaacuaucucccucuaacucuuucagcuccuuguugggucuucuggaaugcgguaaugcuaagucccuuuuuguuagugcuccauagccucaguaauagugucaggccuuugggccuccccuugggcuggaucccacuuugggccugucccuggaccuucuuuuccucaggcuccucuccauuuccaucccuguaauucuuucagacaggaacaauaugggucagaguugugacugggacggcaaccccaucccucauuugaugcccugucuuccugcuagagguggcucuauagugaaauuucuuaauuacugcuucuaaagacccucugucaccucgauucaacuugggucacauguaugaugcauucaucaguuugaucuaauagagauuuuugaguuuauccucaggauucucggaguuuccugaauaguuguugugauguuguccuuuucaugccuaauuuuguucacuuggauuaucuguuucugucuugguuaauuuggcuaaugguuugucagucuuguugauuuuucucaaugaaccaacucuucauuucauugauuguuuuucuugguauuuuuguuguuuguauuucauugauuucaacccugaauuuuauuucucccugucuauuuuuuuagguauuaugucuuguuuuccuagagcuaucagaugaucauuaaguuacuaauaugucaucucuagucuuuugauguagguguuuauauuuaguaguaugaacuugccccuuagaacugucuucauucuguccauagauuuggguaugauguguuuucauuuucauucaguccuuaaaaaguguuucauuuuuucuugauuucugucuugaccaguuuuuauucaguagagaguuguucaguuuccaugagauuaugugcuuuccacuguuucuacuguuauugauauaaaacuuuaauccaugguggucagauacguaggauauuguuucaguuuucuucuaucuguugagauuuucuguguguccuaaaauguggucaguuuuuggagaacauuccaugagcuacugagaagaaaguuaacucuuuaaguguagguagaauguucuauagauaucugcucgguccauuuaaucaugccguucucuaccuacagugcaaguauaucuugucagauaauuaaaauggcuacaccugcuucauucuuugauccuuuggucccuaaggugacaucuauuuuuaauggucuguuucuuggaaacagcagaaagaugauggaaggaaaagggaugugggauggacuguuuggaaaaugcauggucaucucuuucuuuuucacucacccugccauucaguggaccaggggugaauguaagaggguggauaagauggauguugaggucaaagcuacaaaaggcugguuuagcauccuagggcccaccgagcagcaguggagccaagagggggaggguacacggcagaguggucaggcacuuggugcuucauucccguagauggaaggaagcccuggggugaugcagucuaggauucucgagccaguucugcagagccauuuguugagguuguuaggaaugccuucaugaaugguauuuuaccaaauguaccaaacguagaaacucguuugcgcuucacuuccuuuacucuaaugcaacgccuuggugagggucaggcguuugagagaagccugaugaucagagccaauggcagcacuguugugaagcaguuggcacacuccuguccucucaaguccugugacacagcgcagcgcagcgcagcgaagacuucugcugagggcuucucuccugcccugcugacauuucuuucuucugucuuuagguuugaugaagcugcacugucuauucagaaagaaaaaaauauuuacaaggaaauugagaacuacccaacuuguuauaagguauucuuugaaaaugcuuaguuuggcuuuacuuuagauaauuuuauacauuaguauaaauauuuaagcuaagauucuaugggucuucaucugcuuuuauaaaauaguaauuuaugguuuuguuucugaccaugacagaccuagcucaccuuucuuacaguaacagugcucaacaaaaaaaaaagauaauucccucaaccucugggcaguaaauuaacaugggugaccuguagagggcgcugaaugcuuggagaagccaucagcaugggcgccugcauuccugaguguuucuguuucucuugucccuugccccaagagaugccccuagucauggcaguaggcaggagagacugcaacaaauauucugaaggagaccuccucccugaaacuggagaaacagggagaaaaccucuucccccucccccucuccccuccccccuccccccucccacuuggcuuagguugaguucuggucuccagcugaaagaacuggcacgggaaccaagagaacaggaacagaucccagggaggaggagcacuugggaaaagggaauccccuauguguguggcccacacaaaucuuggccguggguaccugggacagacccaagguaggagugacuauucugagaauugaagaaagacugaaaccacuaaaucucugauccugucugaaauucugcagcagacccaaagaucacaacagaagacuggaacugaggucagaagcaccgcccaccagaagcaagccacagucuuuggcgugaaccugggaggguugagugcaguuaaaucacacugagaaugacagcagccugcgcaguguaacaaucccagaagucuagggagcagcccagaauucccaucagacaacccaggaaccaaggcagcuuagagcagcucuuagugagcuagcuucuagagucaucauucaaguuagaaggccucuaacaguuacuguaacugucggauagcauaaaagugaacacuacugaaaugaaugggaaaaaacuauuuuuaauggagagaaauacuguuauagaagcuguaaaagcaagccguuugaaaaauuuaaaacauaauaucugaaacaaauuacuaggugaaguuaacauuauagugaagacaacuguuaguagucauuugucuuguagcuucaacaaaaugcucugcaagcagcuucgggaacaauuuauuuugggucauguuuugagacuauguguauucuuuuuuuuuuguuguuuguuuguuuguuuguuguuuuuugagacaggguuucucuguguagcccuggcuguccuggaacucacuuuguagaccaggcuggccuugaacucagaaauccaccugccucugccucccaagugcugggauuaaaggcaugugccaccacugcccggccugagccugacuguguguauucuugaggcagcugaucaugcuguauccaucaggacacagaacuaugacaguuugugcugcuuuuucuuuuucuuuucaguccaggacccacgcccuuacaaugcugccucccaccaugggcaggccuucccgucucaguuagccucaucaggaugguccuucaagcgugggcagucucuggacacugcugagaagccugccuccugugugguucugaaucccucaaguagacaguaacauaacugagacauaacggagacuuaguuacuaacgaugggcugaugcauugcaugggccagugcggcaauguuugucuguaguccuaguccugcuaggacaggacugugagugugaggccagccugggcugcacaguuaggaccucucucaggaaccauauaucacugagaagaaguaauauacacaacgaaaacuucaccaacaaaauaaaccaccuucugaggcacuguguuccccguaggcucccaguaggauaaauccaugcuguccuugacccucucagcagugccgaugucucuguuguccagaguuuccucugcuguccuuuccugcucucucagcaucccaagcuggacuuacagaaucaagcucuucucugcuuuuauucccucuuaacagucauugaagguauuugaaggaaauucuguaaacuuacacugucuguauucucaggcuuugagguuuaaaagggugucauuccucaggccaguaacaccagugucagcugguucugguuagagcagacaggcucaggccugccccaccuuuaggcuccccaaaucccuguguucucugugcaccaauuguaucugacauaguauucuaggguguguccucccagguguccuuuagaaguuccuauagaacuagauauguuucucaaguaugagccagugcucugaagguuaaaugccaguuguuucaauacuccaggaaggugacuaugaaaauugguaucgguuuacauuauagccuucccucucguuucagaaaacaauugcucaggucuuaguucaucuacacagaaaugacuauguggcugcagagaggugugucagggagagcuacagguaagggucggcuguuuucacugaccaauguugacauuccugucuguugaauuagcaucacuacuuggacaaauuuugguuuuagccaugaaacuuacagaucuuccaagagguaagacuaccauugcaggguugugugauguuuuguuguugggucuuacguuugguuuccugaaugcugaggaaaaccccucuugugugugccagcuccuacucaggcucacccucagcaggcacaguaccaggguugcaaaaugucuucuguagggucucugagugauuaguuacuuugucaucuugcaguuuaacugacaacaacaaaaggggaauugcuguguggugugcugcaaaacagugaggcauuucuauggggucaugaacgaggacugguaauuuauaacucugugagugccuugggcacuauaggguuccuaguggcauccuuggucuccgcccacugguugcuaguagcaaccccuguaacaaucaugaugccugaaggucuuugcuggggacaguuggcgcgugagaacguagggcagagcugaaguguggucugugcuugccuuagcauaccaggcuuuaacggcagugaggacugugcggcgcuggagcagcuccuggagggcuacgaccagcaggaccaagaccaaguguccgaggucugcaacucgccccuuuucaaauacauggacaaugauguaagugggccuuugggguuagcuuucuuccgcuugaagugauuuuccucuggauuuguaagguuucugucucuauaccuguauuuucacaccaaaccaugcucauaaaggagucaaccauuuccauguucagguaaugugauucucucccgccuguguuccugagcgcguccuugccuccucgcugugcugugcauaaguaaaugcagccuccuuccuccccuccccucuggguuugccuuuaguugcuuuugggcgcccuaccuuuaagaggccuaucguguguagcuuuagucauuccauaggcccaugggcaucccaugucugagagcuguugagacuuguuguuaauuaucuucaggcuugccuguaaagggcaaggguuaauuucaugaagcauccuccggucuuccugggagaaaaccucucgagagugagccacgcgugugagccuugcucucccccaccccuccuuuuccuucugcguguuuagcugaucacaugagcuuauaguucuaucacacugccagaugaauuuaagaccuuaaauuuucuuauuaagauagagaaaauauauauuguucauucuagguaaauucuuacacauacuuucuuuucuuuuugagacaaggucuuaauugcuguauaggguuaccuggccuugaacuuacagucuuccugccucagccccauaaguacaaguguacaacauucuuacaggcuuuuuguaugcguguguguguguguguguguguguguguguguguguguguguguguguuucuuccucagugcugcaggccucaggcacccuccagucgcuucccccacaugcuggaaguacagucgucugucacuacgucugcauuuuaaguggggcugggauugggccagaucucuuagcuuguauaguagacaguugaccaacguagccauuuccacagccccaugcccagcuuagcaauguggauuccuccugcuuggaaagcaggccuuuacuaauuaaguucuccucccuuccagcuccaaaguuuguauauauuuuuuaauuugucccuaguuuacacucccucauucauuuauucagcacauggguuucuucauaaccccuagaagccuugcuaguugaauauguccauaguuucuccaguucccaaguuagguccauaauugacacaucuguagcugucaacaggccacaucguggugaugccagggcauuucucuccugaggaugggugguuagguuuuggucauuucaaacuuuucuguaugacucugcaugcugcaggugucacaguacauguggagauaggacagcuugugggguugcuuuuccuuccguccucccauggguucuggggauuggauucagguuggcaagcugguguggaagcacuuuuacccccugagccgucuugcuggccuagugugcacgcacaucucuuucuaugaaagcuuuaguuuguguuacgacuguuugccugaaugcaugugcaccacauggaagucagaggagaguggggucuucugggccuggaguucaggagguugugagucacucugggcuuggguacugaacucagggccucugcccucuaaccacugagccaucuuuccggccccaccccaaccccuaccauauuuauagcuaacugaugcuaagaugcggugucucaggacucuacucuuccagccuuuguaacguguuuuauuguugacaguacgcuaagcugggccuaagcuugguggucccaggaggaggaaucaagaagaaguccccugcgacaccccaggccaagccugauggugcugccggcauggcugcugaagaggaggaagacgaguacucgggaggccugugcuaguacccugccugaggagaugaggagaugaggagacgggaauccugacacgccguuuucguggaauuaggacucauuuugugggcaucugcuucacugaaauccugacguugaauguuaauauauaugaaguuucauuuccccaaaccagccauuguaucuacuaccugugaagcaguuuuuccuuuccauugcaagcagaaaacacugucauauuuuaauaaugauuuuaagaucuauaggccaaauucuagauaaauuauaucauaaguaaagcaggaaauagguauacuuagucuuuucucuuggguucuuguaauuuauuguuagauaauuuucuuugcauuuuauuuaaugucacuucuaaacgugcugggguuuugguaaaaaauaauaauuucaaacuggucugguucuuucgauguugucacuuggugcccacucauguccccacuaagagugucagcaguuccaaagagagaggcagacagcagguccucagcggacacuccuccagacucuucauuagaugucugacugaggagacggugcauggcgccaccugacccugcucaugcgaccauugauggucacagagccagugggagcgugguuguucccucacaggcuguuuacauguguguggaggaucaggcccagauuggacgugcuacucagugaccuagaaauggcacugucagcuccucccauucucucuguccacuugcauuguacccgagccuuguuggcaccauggaccaugaagaggcagaacaaaaacacgagagacucuuuuucuaggaauauaaaccauaagaauaaacaacauacuucaauggaguggggccuugucucaagguaaaaaagaaauuuauccgucagcauauuagauacauucaaauuguugagucuuuucggaaacaagcuuuggacaaaagcuuuauaauuuuuagcucaguagcccuugugugugacuauaaaauauggaagguagcauauuaaagugcuguuguaaaugucuucagcccucccaaaaaaaguauugcuuuuucuuuuuucuuaacaacaaaaaguaugacuguucaaaccuacuuggcucuugaccaaaauaggacuagguaagacuauuuauauuuaucuagaaugacaggugacguuccugccaaucuagugugcaugcauuucuuaccuccaaaguaauuuugguuuggaguuaauaauuuaacaugaguuaugcuagguacugcaaaaaauaaaaaguuagccaggagggaaaaaacugguuuuaaaagacauacuuuuggacuggguuaccagucuuucauacugcacaguucgcccauggcuauuuccuaaaaguuaguuuugaagcauuccucuuuuuacccuguauggcuaaggcccauucaugcuucgugaacugacgagguugcaagcaguagugcaugcuagagaguagugcugaauggaauaggacugucaccacacuccaccaugaauaaagcaugcuuagucaugcuagauuccugaacccuaggaaaagcauugcuacgguacugguccccuuguugugggagugcuccuacagauuggcauccucugccaggugggcuugaguggcugggugucucugaacaaucccugugcagauuacaggucugacacaaaacacuaaugcaagguuuaugcuuuccccuaaguuaccugcaccggucuuuuggucaccagcuuauucucuuuaauuacauugagauuaugaauaaaguggucuuccaaauuuguauuuaaaaagggaauugguauuuccaagaucaauauuauguuucaauccaaccagaaauacuggugcuuguugaagcaaauuagcagacuuuuaaaauauauuuggcaguacucaaaaguuacuuuagacuguguuauggcccagguuauucaauaaaaccguguggagggucgguuuuacuuguauccaccauaaacagcaauucucaacgcacucugaagcaacagugagcuugguuuuaaacagcagaguauuuaggcagugcccgccucccgccacccccaucaggagccagcgugcaggauucagguuauuuugcuuggugucucaggaacauuugucccucgugugcacuuuuuauuuuucuacuuguauuaagucuucguucuugugagcuuagucagaaauggaaaacguggucuucacagcaagcagcgcucucgcgcccucccuaggaaagccugcauggguuugcucagacucaccuaguguuuagugcccuucuguguugagugaagucagccagcagagcacauuuaauauauugaauuuguaaauaugcagaguauaguauuuguguauggaaucugugcauuaucauauuuuuucagcuuuuuuggugaauaagauauuaauaugucgucaauggaaauuagaugauugcuucugaaggaagauaauuaugaaaauaaaacccaagacucugugaaugg

SEQ ID NO: 8951 - RNA, 509 nt, Mus musculus
aguguuucaucuuuuccgaguaaccgccaagauggccgaaguggagcagaagaagaagcgcaccuuccccaaguucaccuaccguggcauagaccucgaccugucuuaugagcucgacaugucuuaugagcaacugaugcagcuguacagcgcccgccagaggaggcgccugaaucguggucuucgguggaagcagcacucacugcucaagcgcuugagaaaggccaagaaggaggcgccacccauggagaagccggagguggugaagacacaccugagggacaugaucauccugccggagaugguggguagcauggugggcguguacaacggcaagaccuucaaccagguggagaucaaaccagagaugaucggccacuaccugggcgaguucuccaucaccuacaaaccugugaagcaccgccgcccgggaucggugccacccacuccucccgauucaucccccucaaguagccgaggccauuaaagacugguuuuggucccuggag

SEQ ID NO: 8952 - RNA, 16913 nt, Mus musculus
guguuuugguuuguuuuuuaaccacugcucauuuauugguuagugggauacagcccauuagaacacacggcaugcaucuggggagagcaacugcacuucagccacugguagcccugcugagucggcaaggcagugcagauggcacccaaggaccaggcagggaugacguagcugucuacgguggcuaagauucaggugcaaagucuuugcaaacagauuuacuuuuguuacucaggaauuacaaagagggaagccccaucugccccguucuuaaacuaaaggcuaacgggguuggaaucauuugaauaacccaccauccaaucauguucauugcaaauuauaauccauuuccccuucauuaauuuccccugucaacucauaccccucagaauuauaaacacuauaugaauaaggaaaagacuaacagugaauguaaagggcuauguauuugacuccaguaucuuuuaugucaaacagccaauuucucuuuuagaugcuugaauucgagaaucccagcgacacuuaaaaggacaaaaagauggaauuuuacuggaugucagaccauaauuaaaaacuguauaaucauguaugguuuauuuaauacaaugauuguaaccuauagcacaauaaaauaucuccauacuaaagagugacaugacauauauuuccucaaaauuuuguaaugaguauauucauuaaaggagcaucaaugucacuugauguucaagugauaccuacugcuuuuucugauaaugggaaagucaagagaaagcuacuacccccaacaggaagucaagggacgauuugggcguuuguucuuuugcagaggcagucuuaacuuuucauuuccuucgugcuugagggccccaugguuauggccugcagcgcuggagaaaucgaggguacaggcacacaucucggaugugauaccuguucagaauccagcuaagaaaucguuccaagcccaagccauacccuccaugaggacaggugccauauuuucucuguuaaaugaaugagagaaagagugcuuauuuuaaaacuguaucuaaucacauuaaaauuauuacuacgaugagcuaacuuuccacacucuaacaguuagcucacuguaguaauaauucaacacaauccacacgccuucauaaaccaugcagagaggaacaguucagugaaccaucugacaggaagagauuucaccuuucaaacuaauugcuuugauuuuucagaggaaagugagaacaguauuagaugcuggucggaccuaauaauuuauuuuuuuuucaaaacugcaguaggagcuagcaagguagcucagcaguuaagagaacuggcuguuuguccagagggcuugccacaucccagcauccacaugguaguucaauacuaucuguaggagugguuccagaucuuaagcccucuucuggccucuaggggcacugcaugugaaacaaacaugcauucacaucaaacccauacccauucacaucaaaacaaaaacaaacuguaguagauacagagcuuuacaaacgaaacugacguauaacugggcuaaagacaaaaauggcaauaucccaaugcuacaugaagcacacacagcucgucugauaccugggauucuggccuccuaaaccuuaaacuauuguauugcuuuuaccugaucuguauaccaguaguaaggagcggggucaaucccuucccucuuauagccuucgagaaucuccucacugucccaggagcgcaucgagccaccuacaaucucaccaacguugggcaucaacacguccaccuugaaacaguaaguugaaaaacccacaauuaccaccacucuaccagacacaacugcgaggcuuuagggaaauuacauaucauaucaagcugcuaacuugaaaggaagcuaugugacuacgcaaaguucaaguaguacucauguucuuuaacggaacaugucaacuguuaccagggaaaggauugucgcuuuaauuacugucauucuagauucaugaauuacuugccacgagcuauaucuuaucccaaaggacaguucccagacccuuaaaaagcaaauuuucuaauacucauggaaucacaaacugacagauucaguaagucgaggauccucaggacagcgcugcauauagaaagacuugaucuccacaggaaagcgacacagcaggauugguucauuaauggugucugucaucagucucucaggcgcuucgggaauauccugagguuaaaccagauuucauuaacauuugaaacugcaaaaagaaagcagcuuuuuacccuucagucaguuccuauaauauacuagagaaugcaaaaggaccuagacccaugcacauguauauaggaaccauuuauuuaaaaaagaaauaaaaccuacuguggcuaucaaguaagcuauagcaggaucaccuuuuaacacagcccauguggggugcugagugcugcucuggacaccuaagucaugacuagauacugcucugacucuuggucaguggccagacucaagcuugcaagcaaaggcaaugaggguaugcuccagaaugugacugaucuguggaguaucaaugacauucaucuuuaaacuguuaccuaaacuccuuuccugucaaaauaagucacuuauccaaugguaggaacagucauaaaguaaagagccaacaucaaguuuguguuaucacaccugcaacaauagccaggcaauauaagaugacaaaucaagcuaaauuagucucuuucaaaccacaucccuccagaaacuguauucaaaccagaacucaaaacuccugugccagugaaagcugacugcaaacuggacaggacucacugauuguauaagggcugaaacagaacugggcagucacuggcucugcucccugaaggucuggagagaugggaugaaguggggaacagucuugauuucuuacguuguaucugucucccacacuggguucuguaugaggugaacgcacacccggaaaagccugcagacuacucacuugcucuagagcccugugcuaugggagggaggaaugcacaauucacaccaacacgcacugagagcuuccugugugcgcuaccagcccucagcugguaggagaaggugucacuucauggcagacaugaggacaguugggucacuagccuucaguuacauagcaagcucagagagaaacccaccuaaggcacggacacauuugggcucuauagcugaggaccguuucacucaaucacacugaguacuuuaaaacuucaguucagaauuaugcuacucaucauaaacugaauuuacaagacagcaagggcgauguguggagcugagacaucauuugcucucaacaucaaccacuuccgaagccaaagcaaagcucuguggagcagcaguaacucauggcucccgugggugggugggcacacgcacacacaugcgcgcgcgcgcgcgcgcgcgcgcgcacgcacacacacacacacacacacacacgcacgcacacgaacacacgugcacucucucucucucacacacacacacacgagcacacacacacacacgcgugcacacucucucucacacacaggcacacacacacacacacacacacagcggcagaggaaugauuaugaucgguaaggaaaaaagguguugugcaaaagaaggaacucaaauauucugaaaggccacaaaaagacccuguucuaaagugcacuccaucaugaauccagacaauccuaaguaguuucugcuacuauuauugacuugagggcaagcagaggcauccagcaucaggaagcagccacagccagcaacagcucacgcacacaagccacucugaagcaaugaggaagggacgcguacaucuccaaacucguagaaagucccgucuucuuucuugacaucaugcuccuucagccacucaauagcauccgaguaguucauccugcggaaaggccgcuugggggguuuaaaguucuagaguaaaaagaagagagugaaacuguguaaaaagaaauauccagccuuaaaaugccugugaagaaacgaaagggggagggggcuggagaaacggcucagugguugaguaugggcugcucguccagaggccucaggaucaguugccagccucgacacggcagcuuauagccagcuguaacucuaguuccaggggauccagcaccuucuucuggcuuucagagacacggcaugcauaugcugcacagacauacaucaggcaaaauauccauccguauauaaauauaaauauauguaauauaaaguaaaaauacaagcaggggauguagacccuggagagauggcucagcagguaaaguccuugccaugaaagccugauugguacccguggaccaagguuggaggugggaggaggcccaacuccacgaaguuguucucugccuuccaccugcaccauuacacauagaguaacaauaaacucuuuaccauagaaaacaguucugcagacagauuacuauucggaaugaguauuucagaugaagaaacacuuaucaacuagcugccucuucuauaaacuaaaauacagucacuggcaauuuaccaguauuaaauauucgaaacauuauucacuugguucaccaagccuccaagaauagagggaugcugucuuccccaaagacugggauccuuucauuuggagacgacacuacaccuaccggguugagcucauacacuaugcuugccacuggugacuucaggacucuguccaccacaucacacacuagguccucuaaacgguucaggagguccucgaaggucaggaaaggacacucagcuuccacgugagugaaccugaagaacagacacagcugagcgagcgccgcuccuacuuuacacggacgcgaagguuugacccucggggaacagagugagcuguggguaucucacaagccucacugaaaccucacaggaaaaucagauuuuagcuguggccuaacgaaccgaccgccuuuucuuucugcuuuggcagggucuuauaauagcccagccuggcccugaacaucucaucuuccugccucuacuucccaagugagauuaccagcaugugccaccaggcccacuucucugugaugcuggggacuuaaccuuuauaugcuaagcaggcacucuaccagcugaccucuccccccagcccaaggagccgcuuugguaagacaauuacauacucagccaggugccuucguguccuggacuguucggcccuguaugacugggcuauacaaaaaacaucucccagggcuggaaggcaggucuccagguacaacugugaggacugggucaaaaacgcuucuuccccgaaauagucaagcuugaagagcguggccccaccuuccaccugcgucugcaccaguguuggagugguaaccuguuaaggggagaaggagcagacaagugugcuguggccaucacuuccaaacagcaccgggaccauuugcaaaaggugaccuguagcaggcaggcaggcaggcacuuacuucacaguagccccugucgaagaaguggucccggaaacaccuggugaucauggagcgcgcuuucaggauuuuggacauguucucuccccggaucaucaugugccgguuguugagcuggacauccacaucagacuccucguugaucagguuaucagcuccuccagccggggccagccccaccaguucccagaagucacagcucagcucauggccuccuggagccuacauguggaaaaagcagaagagaauagcagagagagugagaaagacaauagaaauuaacagcacugaagauguuagagccaaguuuuuagaaagguguuaauuuaagaacauuguuaguagcuuuagucuccagaauuagagacccaauaacucaguacuauaauuuugcaguuaauacuucuuuccaugaaaaaauacacaugcauuuuguaaauuaaaaaggcugugguagucugaauaugcuuggaccaugggacguggcacuaggagauguguccuuauuugaagaaaugugucauuguaggggugggcucugagguccuaugaucagacuccuccacccagugcccguucuccuggcugccuguggaagagaguguccucuucugcuaauugcaaaccaagauguagaacucucagcuucuccagcaucaugucugccugcaugcugccacuucccaccucuaaaacuguaagccagccccaauuaaauguuguccuuuauaagaguugccuuggucauggugucucuucacaguagugaaaagccuaacuaagacaaaggcauauacaaagaauuauauaacuaauuccaugaccuagaauaacuaacuaaugacuauuagcaugaugauuuauuuuucuagcauuucucuaaagaacuaguuaacacacuucucuauauuuaaaacuuaaacauggagcuuaaaagcuaguucagcaguuaagagugcaaacuaccaagccgggcgugguggcgcaugccuuuaaucccagcacucgggaggcagaggcaggcggauuucugaguucgaggccagccuggucuacagaguaaguuccaggacagccaggacuauagagaaacccuguccgaaaaagcaaaaaaaaaaaaaaaaaaaaagaaagaaaggaaggaaagagugcauacuacccauccaaaggaccagaguccaguuuccagcacccacaggguggcucacaauuaccuuuaaaaccagcuccauggcaucugaugccucugguuucugagggcaucuguacuugugugcacauaacauauaccaacacacauauacacaaauuaaguaaaaaaaaaaaucuuacauuuaaauggaaaagguauucuaaaagcaauuaucuauuuagaaaaaaauaaucagaauuuucccuauugacucuauggaaaguaauuuauucuaaaagucucucacucauggagcauguaauuaucuuguugccagcgggacagcaaguaacaccaugacaaccacuccguuuguaaucgcaguacuucaagaaagcucagugaacacacauucaugucuauugcagggcaggcuuuuacaugaacgcugguacuagaaguauuugcucccucuugugguuaauaggcuacacuugcaggguuuuuuuccuaagcaacaguuacaaccucaguagauauuugaacuguaauuagcaacauguaaauguuauuagaauagauuaccugcucuuggccaaagcaaaaauauauuccaauguucagucccccucccucccuuucuuucuaagaaacuaccaauuccuguucaaaaaguuucaguuuagucuaguguuuucuaaaauucucggaguuuaaauagguuuggcccauagacucaugugucugaauccuuggcuccugggcaguggcacuguaaggagguguggccuugugucacugugggggugggcuuugaggucucuaugcucaagaagcucugcucaguguggaauggcugccuaugaaauucagucccuuucugcugccuguggaucaagauguagaacucucagauccuccagcaccaugucugccugcacacugccaugcuuccugccauaaugauaauggaccgaaccucugaaacuguaagccagccccaaguaaauguuuccuuuauaagaguugccuuggucauggcaucucuccacagcaacgaaauccuaaguaagacagugggcuagcugcuagugaucacgugacuggguuuguugcagaagccaguucagccccauccaauucuacugaaugcauccucucacuuggauguguuaguugugucaugguaagucacagcaagaacuacaucacuaaaaguagccucucuaucuugaaauucccaaccuccagaacuacaagaaaaaugccaugaauuuccuaguccgugagaugcuguuagagcugcaaaaggcagacuaagauaaaaauauacaguguacauauucuacuggauauaguauguugacuuuauaguauuugacacuuguguauuuauaggacaacaccaaauguaccacuacagacaccggggaacaaacuauuaaacacccaucauuuuuccgcaugaguucagcucacuuaccuguuugcccuuuggaguuagguuuaguguuccguacaccgccacacuacucucgguggacaggacuacuccauuguaacacugacacuguaaaaaggucaaaguucauauuagccuaccgagguugauuuaaaauauucuaguaaagguaaaggaauuguuuacaaacaaguuaauuuugguuugguuuucuauuggagagagauagggucucauauagcccugcuaaccuugaacuucugacguuccugccucuuagagaaagugcugggauugauuauaggcugugcuaccuugggucaccacugacuucuaaaauuagagagagagagagagagagagagcgagcgcauacacaagcuagcuauccuugaagaaggcauuaagccaguguagccaugcaccacacaguauuucuguuagcgauggagcgcgcuuguaugcccuagugaugugauagcugagcugaggacacacuaaaaugugcucagugagacagcuuaccaauguaccuguuggacuguggugucaucagucaaaacauauggcuguauaaaagcauauuuguccucuuuacaugaacacaaaacguaaaggacacuagccccacuacagauucccacaguccaucuuugacuuagacagacagagcuucuauacacuaugaugacaaguacauguugaagucauuacagccaggcgugguggcgcacgccuuuaaucccagcacuugggaggcagaggcaggcggauuucugaguucgaggccagccuggucuacaaagugaguucuaggacagccagggcuacacagagaaacccugucucaaaaaaccaaaaaccaaaaaaaaaaaaaaaaacaaaauaaagucauuacaagaagagaagagcaacuugacaauagugggauaaagcugcuuacacuuauagcugcugauuacagaaacgcaagugggcgucauguaccuccugacauaaccagaggaacagaggcucauuuguaguugugugaaggaaauaaaaaucuaauacuaucagacaugacguccauuuguaaaagcagcgcaagcagaagcacgcugagugagacaggcagggccaaccaaucucacaccgaggcacacaaaguaauguugcuggguuuuccucccacaaaaaacuggggagcagagguaagacacuguugugaauaugacauccagggacacaaaccaggauccaccauaaacuggcucucuacacugcucuaagauuuuauguuucagaaaauuuccauaaccaaaguuuccccucuagcuuuucuaagguauaaucaaaacguuuuacauuugcgauauacaaugguuuugcuacagguauccaguuagcacaguaaaaauguaaaauaaguacauagcuccuaaaacucaaaauuuacaauuaugggcccuauuaaauacaaucuuacagacauauuuaagauaaaauaccuaccaagucaucugacaagacacacugaagauaacccguaccaucucgcaacaccaaaaacaucaaauucuuuccuagaaaugagaaacaaaauucagccagucccaaggacuccagagcacuucauaacccacccuccacacgcagcuccaaggguaagcagcagcaguucaaaccucuccaugugaaggccccaagccuacuguuuauguacuguaggcucuaaucguacagucuuugccauccacaugaccguggacagucagucagcucugaacugaggcagacgcugucauauuuacucugaaucccuccaacgugaagaacagugcugagcacucagaggggcauaaagaugugaagauacgcacucacuuauaucccauuuguucuuaugaaagaugcgauaagcacguauaguaaaguaauaaaaaggggaaaagugccagggugaagguaauuauaaagaucgaaacuaaggugucagaauggggagacagcuugugguuaaagugcuugucacgcaggcaugaggagcagauuucagauccccaggacccaugcaaacagcaggccaggugggcgugguggccccuguaaucccagccuuaggagaugggagccgcccagagcaagcugguuagcuagaccagccacauaucaaggagcucuggguuccagugagagacccugccucaaccagauacaguggaagaugaauccuggauaacuucagacaucagucucuggccuccacgugcauaugccuccauauaucugaccacauacauucaaacaugcauucucacacaccauacaugggagggcagggggccaacuaggaugcuaacguaaaaaauaaaauaaaaaccgagcacacaaaaccccugugaccguacucuagaugaggaucugucccucucagacaugucccuguuucucauuacauaauuaaaacucaguuugaggaugguacacuuauuauacaccuccuggccacugugguuucuaacaggggaaguaacgucuaaguuucaaacuuucacagucauguggcacaggaacaaauauaggcuaucaauuaucacaccccuuaaaaagacaguacaccaagaacccaaaccaacgugaaggaauguuucucugucuucuucaccuaaaaccaggauuauugaagauuauaaagagggaaagaaaacccacccacucaccuugccugcgcaaccuguggacccagccaaacaccuucacucucuggccucuguauccuucuaaugcacuaaucuuuaccugucaaauuuaaaugaaaacuauuugaaacaugucauuauuacaggccaacauuuucaccaauauuccauagucaaaugucagaaacaaccacugcuggguauauggcagacauacuuaaugccaguauguguaaggcaaggccaggcaggauucgaugaauucugggccagucagggguacauuucucucaaacaacaaccaaacaaccaguaacaacaaaaacuaaaccaaacaagaaaaccccccaccaucacaauaaucaguaaaaaacaaaacaaaaaccaccaaacccaaaaaaaaaaaaaaaaaucacaaaacaaaauugggggcaguucagaaucacacaccuuacuaugcugaauuuaaaaaagagagaaaagaaaaaguccuuuaccauuagugcaaauuggcaaugagagauaccuaaaacuaucucagaaacuguuacagaaaaucaguuaauaagugaauccagguugucacaagagaugugccugucacccacacuagcaacaaucccagccucacaguuguaaacacccagacaccagaaaccuaaacagagaggacaaugcugcgaagaggaacugggugacguggggaaguagcacaagcugacaaacacuuugccagcaggaacauuacuggagcccaagccacacucacugcugagucagcagucugcuuagguuccaaaaaaacaaauaaacacaagagcaaaccuccuuucaaagaaucauaaauguuucugaaguauuugcaaaacuuugugaaaauucuaccuuuugacuuuuggguaaaaaaacagauucuagagaaggcaaaaucauuugccucaaacuacccagcacagccagacgguagccaucaucuacugcuggucaguaggagcagaaucuaccacucaucagguaaugucuaaacuucaggaccaaacugaaccucucucagcccucaggacacugucugucuccuccuccuaagaaggaagacagaacaacagaacuuguggcuugcaacccacaaguagugcagauacagccgagcccacaacaccaggaaugacagauacucacacaggccggcucuggcaggcucgggucauuuuuaauaauaauuuuuuuugcuuccuccagguucuuuucucuucguaaguuaucuucugccuaauuuuaaaaauaacagaauugguaaauacaguucuggguguuguaacucuaaaaauguguaguggcaaauucaucagucaccucuuucuucucccuagagucguucuucaucuguucucugugccacaucuuuuuaauguucuucaucugugacuuagaaauaacaucccaucucuacagagagagcacaaagaucuguguuaucuucaauaccucuaugugcucagaaaacguuauuuuucacaaaacacaaucucgagaagguucuggugcacccuaccucauuuuccuuuugugaguccacauaaauggugggaaauggcucuuuuccaacugucaucaaagccuuggggaggggaagagagaaaacauuccaauauuaugcaaucuuaguaaccaaaaucacaccuggauuauggaucugaacauuaccaagagccuagcaggaaacaucaggagccgagaggcaaagaccaugucagcaggaagacucacugagccuccugcaggaguuugcucucagaacaucgcagaucacgcuacugaaaaucccaaccaguuuagcuacaggaagcagccccuaccuccaccccugucagagaagauagucaaauggucacagggaccagcacagcuaugccaacaacaggagauaggcagcagaaagcaaaaacacuuugcaaacagucugaaaaaguuagagacuuguaaacuaucaaaggcgggaccuaagacacgcaggucugaaacuuucaacaaaguaaaagccaaguuacacagaagacuaaucuccauucaauuugaaaaauucucaugagacgauuuuuuucaucaauauugguugccauaguuugaauaugcuuugcccaaggaguggcacuauuagguguggcccugcuggaguaggugugucacuguggguguguaagaccuuaauccuagcugccuauaagucaguauucugcuagcagccuucagaugaagauguagaacucucagcucugccugccuggaugcugccaugcucucaccuugaugguaauggacugaacuucugaaccuguaagccagccccaauuaaauguccuuuauaagauuugccuugguuaugguguguguucacagcaguaaaacccuaacuaagacacauuaggcauuacuguuuuauauauauauuauauauaauuuaguaauuuauaguuugugugauuuaaguuagugaaucuaaaaaaauuuagaaaugcuaguuaugcauuuauugaauaaguguguguggucagaggacagcuaggaaaaucaacuuucucuucuuaccacaugggucugaacucagauugucaaaacugguagcaaucgccuuuacccacugagccaucucacuagccccacaaggccagucuuuaaaauagggucucgagcgcaaagcagccuugcccuugcugugcagcuugaaccccugauccuccucccugucuuuaccuuccaacugcuggaguuacaggucaaagacaaagaggaguaucuuagcgaccuucaaacacugucugaaaauuucuccaguuauuacaucaaacaggaaaagaaguaccuuauucucucuggcaauaaaaucucaaguuuauaaagcccgaccuuugagauccgaccauguagucuuugccuguuugagccccgaccagggcuacuguguuucuguucuaugagccaugcauccugaccugccugguuucauuccucagccaaaggccagaggccauaaaguuacaaaagucaguggcuaggggguuuaagcaguuaggccgaugaggaaacauuaacaacauuuauuuaagauuagguaagagccccccugcauacaaaacgaccacacacacucacauacacaugcacgcacaugagaagcagucauaaaaagaacgaagggaggaaugcccaaaucccuaaaaacucuccacccauucccggagaagacacgcacaggcccuacugaugcguuuauccuccucccugaggaggagccuuccaauccccaaggcucgagaagaugcucugcaaguuuaucuccccaccucugcuauucuugacccucuuuucuuucacuguuccaaaacccaagggaacagaagcccugaccuucuaguggagcucagccccccuucauuaucugcuguagagcaggaaugugaaucuucugacaacaccaagagaauucucaauggaaagucaucaugggagcauagucucgcaccguguaaggacgauucagucaaugaugggcugcauguccaacuccggccucaucaggcggucaguguggagggucacugugacugcccacauucuuuguacagacacaccaucucccaccaacacacagcugcaccuguagagccuuggaauccauuuccuuccucgaacuguacaccgauacucaucuuuaaugucagagacaggaagagccuaacuaccgcuccucacaacugaagggcacaccuucacacugcaacauuccucuuccgaaggucucuacugguuuuggaaagucacaggagauacaccaacugagagagacuucccuccaaggaguuaaaaaacauauuaaagcaugaccacguggccugaccuuaguagaaaacacuucaaaguuagaaggauuugaugacugauacugucaagcaucuaaaaaccaagaauauuggccaaauauggaugcacagaaaaaggagugucaaggucuugcucuuccaaggagggggcauuuaaccaucucccuuguggaguagcuauagccagaggacuccagcauuccaggucaacauagucaauaaauacuauaguggggacaccuuaaccugaugcugagucgaaggauuccugggacauguguaauagaccaccuagaaugagcuaaccucguaugaugucguaugaugucccgaagcccccaaaauaacaguacauuaaugaaguggcauuuuuuccccuuaggcauucagacucaugagucugcuuuaagaagcuaguccacugauggguugcucguaugucgaguuuuugggucccaaggucaagaugguaucuguacuaugauaaagccaucgagagacucacccgggaaccgggucagugugauucgagugggacuccuacuguuacaagaacugaaaaacacaacccaacagagaaaaaaaaguccagagaugaacugguauauauguaaguuugggcuuugaucuaccacuauuagaucuacauauguguccaccccccuuaccuucccuuuuagggguuccuuuucaaaacuucaugucugagacaaaccacuaggucagggagauggcugcauggguaaaggugacugccucaaagcaggauggccugaguuuagcuugcggcucagaauucauauggcagaacaacagaacaaaugguacgaacuguccccugacuuccauaccuguggcagaggcacacaaauacugcccccaccuccacccugccucgccccgugaacaaaugcaguauuuucuuuucaaagaaagaauuaaauaaaauucuugacaagucauucaaugccaacacucgcuacuaaaaugcagagcagcuauccugcggagauuaccuuuaggccuguuuuaaaugguuucuccuugguuccauccccgguugcgucauuuccuucucggucagauacauacagcucugcugguuuuuuuuuuuuuaaaacaaaaugaaaaguuacucgucccucaucaguaaugcucagacacuuaacaaugcaacugcuuuaucaauuuucucucuuugcaaacagaaauaucaucccauuuguaaaaacucccacaguccaaaagaagucaacauauuuucccaaucuccgaguuuaagacuaucccacccccuaacacaaugaauugcaaaucugacuuuccuauuugauuuuuuuuucauuauuuuaacccauucgcacuucucucuacuuggcugcacagcaaccaaggcagaguuuuacaguucguccuaacuuuauuagaugcuguaucuuuaaagucggagugaccuggggagaauucaucuaaucuuccugagguuacuuacuucaucuauaaaaucaggaagacacuauacaucguacagagcuguacugagaauaaaacugaacaagcccugaaccagguaucccagugacagugcacugcgagcaaaugaaaaugcuaguucccugugcuuuucgaaacaaaucacaaacucugggguuaagccgcagagggagggccucacaacugugacaucgccucggucacuuaaaucuuuuuauuuucaccgcugcagaucucacggagaaaaaaaaaaaaaaaaaaaagagguugugcggaaauuaauuaaaagccuuacaucauucccagaagaacgacuuaagaauuucacaucuggggcuucacuaggucccagacccuugcagcgcccuagccucggcggaaucacgagacuuucgcgguggggcugggcuagggaggcgguggccgagggacgcacagggcuggagcaaaaccagacccggaccaccgagucgguguccagguggcccaggucugagggucuggggcgagcgaccagggccccacgaauauuugggagugcgccuacgccgcgccaagcacuaagagaaguucuagaauucggccggaacccuuccgccgaaccucacucaccuagaaccaucucugcagucccccuaaucaccuccgaggacauagacacugcaccaccgccgccugcucaccccaacgugcacugaaggcuuccuugacugaggcguugcaucagaucaccuagagcagcggucgcggauaug

SEQ ID NO: 8953 - RNA, 16913 nt, Mus musculus
cauauccgcgaccgcugcucuaggugaucugaugcaacgccucagucaaggaagccuucagugcacguuggggugagcaggcggcgguggugcagugucuauguccucggaggugauuagggggacugcagagaugguucuaggugagugagguucggcggaaggguuccggccgaauucuagaacuucucuuagugcuuggcgcggcguaggcgcacucccaaauauucguggggcccuggucgcucgccccagacccucagaccugggccaccuggacaccgacucggugguccgggucugguuuugcuccagcccugugcgucccucggccaccgccucccuagcccagccccaccgcgaaagucucgugauuccgccgaggcuagggcgcugcaagggucugggaccuagugaagccccagaugugaaauucuuaagucguucuucugggaaugauguaaggcuuuuaauuaauuuccgcacaaccucuuuuuuuuuuuuuuuuuuuucuccgugagaucugcagcggugaaaauaaaaagauuuaagugaccgaggcgaugucacaguugugaggcccucccucugcggcuuaaccccagaguuugugauuuguuucgaaaagcacagggaacuagcauuuucauuugcucgcagugcacugucacugggauaccugguucagggcuuguucaguuuuauucucaguacagcucuguacgauguauagugucuuccugauuuuauagaugaaguaaguaaccucaggaagauuagaugaauucuccccaggucacuccgacuuuaaagauacagcaucuaauaaaguuaggacgaacuguaaaacucugccuugguugcugugcagccaaguagagagaagugcgaauggguuaaaauaaugaaaaaaaaaucaaauaggaaagucagauuugcaauucauuguguuagggggugggauagucuuaaacucggagauugggaaaauauguugacuucuuuuggacugugggaguuuuuacaaaugggaugauauuucuguuugcaaagagagaaaauugauaaagcaguugcauuguuaagugucugagcauuacugaugagggacgaguaacuuuucauuuuguuuuaaaaaaaaaaaaaccagcagagcuguauguaucugaccgagaaggaaaugacgcaaccggggauggaaccaaggagaaaccauuuaaaacaggccuaaagguaaucuccgcaggauagcugcucugcauuuuaguagcgaguguuggcauugaaugacuugucaagaauuuuauuuaauucuuucuuugaaaagaaaauacugcauuuguucacggggcgaggcaggguggaggugggggcaguauuugugugccucugccacagguauggaagucaggggacaguucguaccauuuguucuguuguucugccauaugaauucugagccgcaagcuaaacucaggccauccugcuuugaggcagucaccuuuacccaugcagccaucucccugaccuagugguuugucucagacaugaaguuuugaaaaggaaccccuaaaagggaagguaagggggguggacacauauguagaucuaauagugguagaucaaagcccaaacuuacauauauaccaguucaucucuggacuuuuuuuucucuguuggguuguguuuuucaguucuuguaacaguaggagucccacucgaaucacacugacccgguucccgggugagucucucgauggcuuuaucauaguacagauaccaucuugaccuugggacccaaaaacucgacauacgagcaacccaucaguggacuagcuucuuaaagcagacucaugagucugaaugccuaaggggaaaaaaugccacuucauuaauguacuguuauuuugggggcuucgggacaucauacgacaucauacgagguuagcucauucuagguggucuauuacacaugucccaggaauccuucgacucagcaucagguuaagguguccccacuauaguauuuauugacuauguugaccuggaaugcuggaguccucuggcuauagcuacuccacaagggagaugguuaaaugcccccuccuuggaagagcaagaccuugacacuccuuuuucugugcauccauauuuggccaauauucuugguuuuuagaugcuugacaguaucagucaucaaauccuucuaacuuugaaguguuuucuacuaaggucaggccacguggucaugcuuuaauauguuuuuuaacuccuuggagggaagucucucucaguugguguaucuccugugacuuuccaaaaccaguagagaccuucggaagaggaauguugcagugugaaggugugcccuucaguugugaggagcgguaguuaggcucuuccugucucugacauuaaagaugaguaucgguguacaguucgaggaaggaaauggauuccaaggcucuacaggugcagcuguguguuggugggagauggugugucuguacaaagaaugugggcagucacagugacccuccacacugaccgccugaugaggccggaguuggacaugcagcccaucauugacugaaucguccuuacacggugcgagacuaugcucccaugaugacuuuccauugagaauucucuugguguugucagaagauucacauuccugcucuacagcagauaaugaaggggggcugagcuccacuagaaggucagggcuucuguucccuuggguuuuggaacagugaaagaaaagagggucaagaauagcagagguggggagauaaacuugcagagcaucuucucgagccuuggggauuggaaggcuccuccucagggaggaggauaaacgcaucaguagggccugugcgugucuucuccgggaauggguggagaguuuuuagggauuugggcauuccucccuucguucuuuuuaugacugcuucucaugugcgugcauguguaugugaguguguguggucguuuuguaugcaggggggcucuuaccuaaucuuaaauaaauguuguuaauguuuccucaucggccuaacugcuuaaacccccuagccacugacuuuuguaacuuuauggccucuggccuuuggcugaggaaugaaaccaggcaggucaggaugcauggcucauagaacagaaacacaguagcccuggucggggcucaaacaggcaaagacuacauggucggaucucaaaggucgggcuuuauaaacuugagauuuuauugccagagagaauaagguacuucuuuuccuguuugauguaauaacuggagaaauuuucagacaguguuugaaggucgcuaagauacuccucuuugucuuugaccuguaacuccagcaguuggaagguaaagacagggaggaggaucagggguucaagcugcacagcaagggcaaggcugcuuugcgcucgagacccuauuuuaaagacuggccuuguggggcuagugagauggcucaguggguaaaggcgauugcuaccaguuuugacaaucugaguucagacccaugugguaagaagagaaaguugauuuuccuagcuguccucugaccacacacacuuauucaauaaaugcauaacuagcauuucuaaauuuuuuuagauucacuaacuuaaaucacacaaacuauaaauuacuaaauuauauauaauauauauauaaaacaguaaugccuaaugugucuuaguuaggguuuuacugcugugaacacacaccauaaccaaggcaaaucuuauaaaggacauuuaauuggggcuggcuuacagguucagaaguucaguccauuaccaucaaggugagagcauggcagcauccaggcaggcagagcugagaguucuacaucuucaucugaaggcugcuagcagaauacugacuuauaggcagcuaggauuaaggucuuacacacccacagugacacaccuacuccagcagggccacaccuaauagugccacuccuugggcaaagcauauucaaacuauggcaaccaauauugaugaaaaaaaucgucucaugagaauuuuucaaauugaauggagauuagucuucuguguaacuuggcuuuuacuuuguugaaaguuucagaccugcgugucuuaggucccgccuuugauaguuuacaagucucuaacuuuuucagacuguuugcaaaguguuuuugcuuucugcugccuaucuccuguuguuggcauagcugugcuggucccugugaccauuugacuaucuucucugacagggguggagguaggggcugcuuccuguagcuaaacugguugggauuuucaguagcgugaucugcgauguucugagagcaaacuccugcaggaggcucagugagucuuccugcugacauggucuuugccucucggcuccugauguuuccugcuaggcucuugguaauguucagauccauaauccaggugugauuuugguuacuaagauugcauaauauuggaauguuuucucucuuccccuccccaaggcuuugaugacaguuggaaaagagccauuucccaccauuuauguggacucacaaaaggaaaaugagguagggugcaccagaaccuucucgagauuguguuuugugaaaaauaacguuuucugagcacauagagguauugaagauaacacagaucuuugugcucucucuguagagaugggauguuauuucuaagucacagaugaagaacauuaaaaagauguggcacagagaacagaugaagaacgacucuagggagaagaaagaggugacugaugaauuugccacuacacauuuuuagaguuacaacacccagaacuguauuuaccaauucuguuauuuuuaaaauuaggcagaagauaacuuacgaagagaaaagaaccuggaggaagcaaaaaaaauuauuauuaaaaaugacccgagccugccagagccggccugugugaguaucugucauuccugguguugugggcucggcuguaucugcacuacuuguggguugcaagccacaaguucuguuguucugucuuccuucuuaggaggaggagacagacaguguccugagggcugagagagguucaguuugguccugaaguuuagacauuaccugaugagugguagauucugcuccuacugaccagcaguagaugauggcuaccgucuggcugugcuggguaguuugaggcaaaugauuuugccuucucuagaaucuguuuuuuuacccaaaagucaaaagguagaauuuucacaaaguuuugcaaauacuucagaaacauuuaugauucuuugaaaggagguuugcucuuguguuuauuuguuuuuuuggaaccuaagcagacugcugacucagcagugaguguggcuugggcuccaguaauguuccugcuggcaaaguguuugucagcuugugcuacuuccccacgucacccaguuccucuucgcagcauuguccucucuguuuagguuucuggugucuggguguuuacaacugugaggcugggauuguugcuagugugggugacaggcacaucucuugugacaaccuggauucacuuauuaacugauuuucuguaacaguuucugagauaguuuuagguaucucucauugccaauuugcacuaaugguaaaggacuuuuucuuuucucucuuuuuuaaauucagcauaguaaggugugugauucugaacugcccccaauuuuguuuugugauuuuuuuuuuuuuuuuuggguuuggugguuuuuguuuuguuuuuuacugauuauugugauggugggggguuuucuuguuugguuuaguuuuuguuguuacugguuguuugguuguuguuugagagaaauguaccccugacuggcccagaauucaucgaauccugccuggccuugccuuacacauacuggcauuaaguaugucugccauauacccagcagugguuguuucugacauuugacuauggaauauuggugaaaauguuggccuguaauaaugacauguuucaaauaguuuucauuuaaauuugacagguaaagauuagugcauuagaaggauacagaggccagagagugaagguguuuggcuggguccacagguugcgcaggcaaggugaguggguggguuuucuuucccucuuuauaaucuucaauaauccugguuuuaggugaagaagacagagaaacauuccuucacguugguuuggguucuugguguacugucuuuuuaaggggugugauaauugauagccuauauuuguuccugugccacaugacugugaaaguuugaaacuuagacguuacuuccccuguuagaaaccacaguggccaggagguguauaauaaguguaccauccucaaacugaguuuuaauuauguaaugagaaacagggacaugucugagagggacagauccucaucuagaguacggucacagggguuuugugugcucgguuuuuauuuuauuuuuuacguuagcauccuaguuggcccccugcccucccauguauggugugugagaaugcauguuugaauguauguggucagauauauggaggcauaugcacguggaggccagagacugaugucugaaguuauccaggauucaucuuccacuguaucugguugaggcagggucucucacuggaacccagagcuccuugauauguggcuggucuagcuaaccagcuugcucugggcggcucccaucuccuaaggcugggauuacaggggccaccacgcccaccuggccugcuguuugcauggguccuggggaucugaaaucugcuccucaugccugcgugacaagcacuuuaaccacaagcugucuccccauucugacaccuuaguuucgaucuuuauaauuaccuucacccuggcacuuuuccccuuuuuauuacuuuacuauacgugcuuaucgcaucuuucauaagaacaaaugggauauaagugagugcguaucuucacaucuuuaugccccucugagugcucagcacuguucuucacguuggagggauucagaguaaauaugacagcgucugccucaguucagagcugacugacuguccacggucauguggauggcaaagacuguacgauuagagccuacaguacauaaacaguaggcuuggggccuucacauggagagguuugaacugcugcugcuuacccuuggagcugcguguggaggguggguuaugaagugcucuggaguccuugggacuggcugaauuuuguuucucauuucuaggaaagaauuugauguuuuugguguugcgagaugguacggguuaucuucagugugucuugucagaugacuugguagguauuuuaucuuaaauaugucuguaagauuguauuuaauagggcccauaauuguaaauuuugaguuuuaggagcuauguacuuauuuuacauuuuuacugugcuaacuggauaccuguagcaaaaccauuguauaucgcaaauguaaaacguuuugauuauaccuuagaaaagcuagaggggaaacuuugguuauggaaauuuucugaaacauaaaaucuuagagcaguguagagagccaguuuaugguggauccugguuugugucccuggaugucauauucacaacagugucuuaccucugcuccccaguuuuuugugggaggaaaacccagcaacauuacuuugugugccucggugugagauugguuggcccugccugucucacucagcgugcuucugcuugcgcugcuuuuacaaauggacgucaugucugauaguauuagauuuuuauuuccuucacacaacuacaaaugagccucuguuccucugguuaugucaggagguacaugacgcccacuugcguuucuguaaucagcagcuauaaguguaagcagcuuuaucccacuauugucaaguugcucuucucuucuuguaaugacuuuauuuuguuuuuuuuuuuuuuuuugguuuuugguuuuuugagacaggguuucucuguguagcccuggcuguccuagaacucacuuuguagaccaggcuggccucgaacucagaaauccgccugccucugccucccaagugcugggauuaaaggcgugcgccaccacgccuggcuguaaugacuucaacauguacuugucaucauaguguauagaagcucugucugucuaagucaaagauggacugugggaaucuguaguggggcuaguguccuuuacguuuuguguucauguaaagaggacaaauaugcuuuuauacagccauauguuuugacugaugacaccacaguccaacagguacauugguaagcugucucacugagcacauuuuaguguguccucagcucagcuaucacaucacuagggcauacaagcgcgcuccaucgcuaacagaaauacuguguggugcauggcuacacuggcuuaaugccuucuucaaggauagcuagcuuguguaugcgcucgcucucucucucucucucucucucuaauuuuagaagucaguggugacccaagguagcacagccuauaaucaaucccagcacuuucucuaagaggcaggaacgucagaaguucaagguuagcagggcuauaugagacccuaucucucuccaauagaaaaccaaaccaaaauuaacuuguuuguaaacaauuccuuuaccuuuacuagaauauuuuaaaucaaccucgguaggcuaauaugaacuuugaccuuuuuacagugucaguguuacaauggaguaguccuguccaccgagaguaguguggcgguguacggaacacuaaaccuaacuccaaagggcaaacagguaagugagcugaacucaugcggaaaaaugauggguguuuaauaguuuguuccccggugucuguagugguacauuugguguuguccuauaaauacacaagugucaaauacuauaaagucaacauacuauauccaguagaauauguacacuguauauuuuuaucuuagucugccuuuugcagcucuaacagcaucucacggacuaggaaauucauggcauuuuucuuguaguucuggagguugggaauuucaagauagagaggcuacuuuuagugauguaguucuugcugugacuuaccaugacacaacuaacacauccaagugagaggaugcauucaguagaauuggauggggcugaacuggcuucugcaacaaacccagucacgugaucacuagcagcuagcccacugucuuacuuaggauuucguugcuguggagagaugccaugaccaaggcaacucuuauaaaggaaacauuuacuuggggcuggcuuacaguuucagagguucgguccauuaucauuauggcaggaagcauggcagugugcaggcagacauggugcuggaggaucugagaguucuacaucuugauccacaggcagcagaaagggacugaauuucauaggcagccauuccacacugagcagagcuucuugagcauagagaccucaaagcccacccccacagugacacaaggccacaccuccuuacagugccacugcccaggagccaaggauucagacacaugagucuaugggccaaaccuauuuaaacuccgagaauuuuagaaaacacuagacuaaacugaaacuuuuugaacaggaauugguaguuucuuagaaagaaagggagggagggggacugaacauuggaauauauuuuugcuuuggccaagagcagguaaucuauucuaauaacauuuacauguugcuaauuacaguucaaauaucuacugagguuguaacuguugcuuaggaaaaaaacccugcaaguguagccuauuaaccacaagagggagcaaauacuucuaguaccagcguucauguaaaagccugcccugcaauagacaugaauguguguucacugagcuuucuugaaguacugcgauuacaaacggagugguugucaugguguuacuugcugucccgcuggcaacaagauaauuacaugcuccaugagugagagacuuuuagaauaaauuacuuuccauagagucaauagggaaaauucugauuauuuuuuucuaaauagauaauugcuuuuagaauaccuuuuccauuuaaauguaagauuuuuuuuuuuacuuaauuuguguauauguguguugguauauguuaugugcacacaaguacagaugcccucagaaaccagaggcaucagaugccauggagcugguuuuaaagguaauugugagccacccugugggugcuggaaacuggacucugguccuuuggauggguaguaugcacucuuuccuuccuuucuuucuuuuuuuuuuuuuuuuuuuuugcuuuuucggacaggguuucucuauaguccuggcuguccuggaacuuacucuguagaccaggcuggccucgaacucagaaauccgccugccucugccucccgagugcugggauuaaaggcaugcgccaccacgcccggcuugguaguuugcacucuuaacugcugaacuagcuuuuaagcuccauguuuaaguuuuaaauauagagaaguguguuaacuaguucuuuagagaaaugcuagaaaaauaaaucaucaugcuaauagucauuaguuaguuauucuaggucauggaauuaguuauauaauucuuuguauaugccuuugucuuaguuaggcuuuucacuacugugaagagacaccaugaccaaggcaacucuuauaaaggacaacauuuaauuggggcuggcuuacaguuuuagaggugggaaguggcagcaugcaggcagacaugaugcuggagaagcugagaguucuacaucuugguuugcaauuagcagaagaggacacucucuuccacaggcagccaggagaacgggcacuggguggaggagucugaucauaggaccucagagcccaccccuacaaugacacauuucuucaaauaaggacacaucuccuagugccacgucccaugguccaagcauauucagacuaccacagccuuuuuaauuuacaaaaugcauguguauuuuuucauggaaagaaguauuaacugcaaaauuauaguacugaguuauugggucucuaauucuggagacuaaagcuacuaacaauguucuuaaauuaacaccuuucuaaaaacuuggcucuaacaucuucagugcuguuaauuucuauugucuuucucacucucucugcuauucucuucugcuuuuuccacauguaggcuccaggaggccaugagcugagcugugacuucugggaacugguggggcuggccccggcuggaggagcugauaaccugaucaacgaggagucugauguggauguccagcucaacaaccggcacaugaugauccggggagagaacauguccaaaauccugaaagcgcgcuccaugaucaccagguguuuccgggaccacuucuucgacaggggcuacugugaaguaagugccugccugccugccugcuacaggucaccuuuugcaaauggucccggugcuguuuggaagugauggccacagcacacuugucugcuccuucuccccuuaacagguuaccacuccaacacuggugcagacgcagguggaagguggggccacgcucuucaagcuugacuauuucggggaagaagcguuuuugacccaguccucacaguuguaccuggagaccugccuuccagcccugggagauguuuuuuguauagcccagucauacagggccgaacaguccaggacacgaaggcaccuggcugaguauguaauugucuuaccaaagcggcuccuugggcuggggggagaggucagcugguagagugccugcuuagcauauaaagguuaaguccccagcaucacagagaagugggccugguggcacaugcugguaaucucacuugggaaguagaggcaggaagaugagauguucagggccaggcugggcuauuauaagacccugccaaagcagaaagaaaaggcggucgguucguuaggccacagcuaaaaucugauuuuccugugagguuucagugaggcuugugagauacccacagcucacucuguuccccgagggucaaaccuucgcguccguguaaaguaggagcggcgcucgcucagcugugucuguucuucagguucacucacguggaagcugaguguccuuuccugaccuucgaggaccuccugaaccguuuagaggaccuagugugugaugugguggacagaguccugaagucaccaguggcaagcauaguguaugagcucaacccgguagguguagugucgucuccaaaugaaaggaucccagucuuuggggaagacagcaucccucuauucuuggaggcuuggugaaccaagugaauaauguuucgaauauuuaauacugguaaauugccagugacuguauuuuaguuuauagaagaggcagcuaguugauaaguguuucuucaucugaaauacucauuccgaauaguaaucugucugcagaacuguuuucuaugguaaagaguuuauuguuacucuauguguaauggugcagguggaaggcagagaacaacuucguggaguugggccuccucccaccuccaaccuugguccacggguaccaaucaggcuuucauggcaaggacuuuaccugcugagccaucucuccagggucuacauccccugcuuguauuuuuacuuuauauuacauauauuuauauuuauauacggauggauauuuugccugauguaugucugugcagcauaugcaugccgugucucugaaagccagaagaaggugcuggauccccuggaacuagaguuacagcuggcuauaagcugccgugucgaggcuggcaacugauccugaggccucuggacgagcagcccauacucaaccacugagccguuucuccagcccccucccccuuucguuucuucacaggcauuuuaaggcuggauauuucuuuuuacacaguuucacucucuucuuuuuacucuagaacuuuaaaccccccaagcggccuuuccgcaggaugaacuacucggaugcuauugaguggcugaaggagcaugaugucaagaaagaagacgggacuuucuacgaguuuggagauguacgcgucccuuccucauugcuucagaguggcuugugugcgugagcuguugcuggcuguggcugcuuccugaugcuggaugccucugcuugcccucaagucaauaauaguagcagaaacuacuuaggauugucuggauucaugauggagugcacuuuagaacagggucuuuuuguggccuuucagaauauuugaguuccuucuuuugcacaacaccuuuuuuccuuaccgaucauaaucauuccucugccgcugugugugugugugugugugugugccugugugugagagagagugugcacgcgugugugugugugugcucgugugugugugugugagagagagagagugcacguguguucgugugcgugcgugugugugugugugugugugugugcgugcgcgcgcgcgcgcgcgcgcgcgcgcaugugugugcgugugcccacccacccacgggagccaugaguuacugcugcuccacagagcuuugcuuuggcuucggaagugguugauguugagagcaaaugaugucucagcuccacacaucgcccuugcugucuuguaaauucaguuuaugaugaguagcauaauucugaacugaaguuuuaaaguacucagugugauugagugaaacgguccucagcuauagagcccaaauguguccgugccuuagguggguuucucucugagcuugcuauguaacugaaggcuagugacccaacuguccucaugucugccaugaagugacaccuucuccuaccagcugagggcugguagcgcacacaggaagcucucagugcguguuggugugaauugugcauuccucccucccauagcacagggcucuagagcaagugaguagucugcaggcuuuuccgggugugcguucaccucauacagaacccagugugggagacagauacaacguaagaaaucaagacuguuccccacuucaucccaucucuccagaccuucagggagcagagccagugacugcccaguucuguuucagcccuuauacaaucagugaguccuguccaguuugcagucagcuuucacuggcacaggaguuuugaguucugguuugaauacaguuucuggagggaugugguuugaaagagacuaauuuagcuugauuugucaucuuauauugccuggcuauuguugcaggugugauaacacaaacuugauguuggcucuuuacuuuaugacuguuccuaccauuggauaagugacuuauuuugacaggaaaggaguuuagguaacaguuuaaagaugaaugucauugauacuccacagaucagucacauucuggagcauacccucauugccuuugcuugcaagcuugagucuggccacugaccaagagucagagcaguaucuagucaugacuuagguguccagagcagcacucagcaccccacaugggcuguguuaaaaggugauccugcuauagcuuacuugauagccacaguagguuuuauuucuuuuuuaaauaaaugguuccuauauacaugugcaugggucuagguccuuuugcauucucuaguauauuauaggaacugacugaaggguaaaaagcugcuuucuuuuugcaguuucaaauguuaaugaaaucugguuuaaccucaggauauucccgaagcgccugagagacugaugacagacaccauuaaugaaccaauccugcugugucgcuuuccuguggagaucaagucuuucuauaugcagcgcuguccugaggauccucgacuuacugaaucugucaguuugugauuccaugaguauuagaaaauuugcuuuuuaagggucugggaacuguccuuugggauaagauauagcucguggcaaguaauucaugaaucuagaaugacaguaauuaaagcgacaauccuuucccugguaacaguugacauguuccguuaaagaacaugaguacuacuugaacuuugcguagucacauagcuuccuuucaaguuagcagcuugauaugauauguaauuucccuaaagccucgcaguugugucugguagaguggugguaauuguggguuuuucaacuuacuguuucaagguggacguguugaugcccaacguuggugagauuguagguggcucgaugcgcuccugggacagugaggagauucucgaaggcuauaagagggaagggauugaccccgcuccuuacuacugguauacagaucagguaaaagcaauacaauaguuuaagguuuaggaggccagaaucccagguaucagacgagcugugugugcuucauguagcauugggauauugccauuuuugucuuuagcccaguuauacgucaguuucguuuguaaagcucuguaucuacuacaguuuguuuuuguuuugaugugaauggguauggguuugaugugaaugcauguuuguuucacaugcagugccccuagaggccagaagagggcuuaagaucuggaaccacuccuacagauaguauugaacuaccauguggaugcugggauguggcaagcccucuggacaaacagccaguucucuuaacugcugagcuaccuugcuagcuccuacugcaguuuugaaaaaaaaauaaauuauuagguccgaccagcaucuaauacuguucucacuuuccucugaaaaaucaaagcaauuaguuugaaaggugaaaucucuuccugucagaugguucacugaacuguuccucucugcaugguuuaugaaggcguguggauuguguugaauuauuacuacagugagcuaacuguuagaguguggaaaguuagcucaucguaguaauaauuuuaaugugauuagauacaguuuuaaaauaagcacucuuucucucauucauuuaacagagaaaauauggcaccuguccucauggaggguauggcuugggcuuggaacgauuucuuagcuggauucugaacagguaucacauccgagaugugugccuguacccucgauuucuccagcgcugcaggccauaaccauggggcccucaagcacgaaggaaaugaaaaguuaagacugccucugcaaaagaacaaacgcccaaaucgucccuugacuuccuguuggggguaguagcuuucucuugacuuucccauuaucagaaaaagcaguagguaucacuugaacaucaagugacauugaugcuccuuuaaugaauauacucauuacaaaauuuugaggaaauauaugucaugucacucuuuaguauggagauauuuuauugugcuauagguuacaaucauuguauuaaauaaaccauacaugauuauacaguuuuuaauuauggucugacauccaguaaaauuccaucuuuuuguccuuuuaagugucgcugggauucucgaauucaagcaucuaaaagagaaauuggcuguuugacauaaaagauacuggagucaaauacauagcccuuuacauucacuguuagucuuuuccuuauucauauaguguuuauaauucugagggguaugaguugacaggggaaauuaaugaaggggaaauggauuauaauuugcaaugaacaugauuggaugguggguuauucaaaugauuccaaccccguuagccuuuaguuuaagaacggggcagauggggcuucccucuuuguaauuccugaguaacaaaaguaaaucuguuugcaaagacuuugcaccugaaucuuagccaccguagacagcuacgucaucccugccugguccuugggugccaucugcacugccuugccgacucagcagggcuaccaguggcugaagugcaguugcucuccccagaugcaugccguguguucuaaugggcuguaucccacuaaccaauaaaugagcagugguuaaaaaacaaaccaaaacac

SEQ ID NO: 8954 - RNA, 1768 nt, Mus musculus
ugagacagugucuuucuuuacagcuaugguuguccugaauuuaccaugcagaccuagcuguuccucgaacucacaaagaucuugucucugccucccccgugcuggaauuaaaggcacgggccaccacgcccagcuccaaggaaaagacuucuaggaguggcaaauuucucuuauuuaaaguagccuccugcguuccugaacaucgaaggauuaaaugaagggcuugcuagagaaacucccuaucuggaacgugggaagauuccuacgguggcuaauaagacaucuccaucguuugcauauguaaaggacaaacuuaaacuggaauuugguauuucacguugugccucacaaaaaaugagcuuuuaucaaagaacuaggcagccggguuucaaguggguggguguguacucagcgcgggcgcggaguugguuuuguucccaguagaguugacuccagcaauggcgacucacggccacaccggggcagccucuccuaggcuggccgcccagccaggaaaaucucuugggcgagcugaagcuguuagccaagucuggccugccauagcugccaagaauuuaaagggggucuagaaacaagcaucgucgcucucuuuuagagcuccuggagacucuggauaggaagagaaaaaaaagagagagauaaaaacggacauaguggcuuuguuguuguuucacggggucuucauggucccccaagguccaguucaccgggucccaaggcagagagaagccgggcaagaggagggucagcccggcaggcccagcccgccagggcgcgccccagcucagugcucugugccgggugacccaggaggcgcggggguggggugggcguggggcgaaacaccaccacccccgcggcccgccccccagcccggccugugauuggcuuggggggcgcaagugcccgccccggcgagcgggaggguccccgugggcgccgggcggcgcaggcggggcggggagagccggccgggcggagcaggcgaggggcgggcgcgcgggucccggggaucgccgagcgggcuuggggaggccgggagagccaucggcgggggcgggagcccggcgggcucagcgcagagcagggagagcuccgggccagucgccguucggcgcgcucucgggagccgccaguccgcgcguccccgcagccuuccgggaggaagcggcgccgcggccgggugcagccucaccugccggcccuuccccgccgggcggcgcagaaggacagagggucgcggcuccgcgacgcacuucagccagucgcagcguccaggacccugcgcggggcgccggcuccauggcgaccgggcuuggggagccugucuacggacuuucggaagaggaggugaguuccugcccagagcgcugugcggaggggacggggcccacuccacugugagcguccccugccagccggggcuccaagauuccgggugaccccgagcggucccgggcgguggguggcugguucucccucuucaccccggaggugcgcuucuccggccugggcucucggggugggcagaggccgcgugcgccgcugccccgcgagucucuuuccuccgcaagcugcgucucucgaggcuguugggcaacuuuucuggaccacgauccugcagcccggaguccgugacgugugucacgucuagguagccgcaggggucuuugcguagugcaggggaucugggggcugccgaggaaccuaguggugucuccucccccugggacuuuucuugcuaaug

SEQ ID NO: 8955 - RNA, 5341 nt, Mus musculus
caugaccagcaaacugagccaagccaugucagcagagcggggagcgggagagccagaagcugauaggccaggaggccaggagaccuaaaagggcccccaaaagcaaaagaucacauagccaaaauggcuggguuauauagggaagagcagcugguggaagggcaacccugcccagucccuggggcuggagaaguuuaagggagugugggauauggcagccgcaggacccuguaacagguaagggacugagagaugcugagaggagaugcugagagaaccugguggccggcaucggcuuugauauguucauggacgucuugguuaugggggugggggugguuugagaccuaaugucccggccuuuuuguuguugguaaagguugaggaaggacgaagggccauaaagggugacauaaucuuuaucuacuuucugcugaaauugcagucaucgagagcucgaaggcaggaguaucaagaucacagaauauuuaauaaacaaaaacagcuuacgugguuguugaguggggaacacagaccgcaucuuaagcauguguguuccuggaucucuugguccaaacuuucccacggcuccggaacuacuuaaucuauuggccugagaagaguuauuagguaaguggccucucuucccccagcucccugaagagagucugccuccccccaccccuccccacucccacccccgccccauccacuggccccucucugcuccugucacauagaaagguuuaaaagaccucuugauaaauaucucagggagguuaagaaaauggccuugacagcagcaaggcaaaauguucacuggagagaugcagacagcucucugucagaggaaaccuuacaaagagggguguguguguguguggggggggagcaagaauacuaauaaacacgacaauaaauguauuuuuuuuaaugagggucaugauuuagcuguaaaaucucacuggacuuaucaugaaaaaaaauaaaaagaaagaaagaaagaaaaaaaaaaacaacucugaaauaauaaaccacagucuaaauuaggggcccuggcaaauguagucauuucuaccuaagaggcuuuguguccaaacaugucauuugagaucgaaggcagacaaaggagaaggccguugguaacaaggcagccauucaacccccagcccuggggcauuggauuuccucucugggcucaaagcauuuucagccacauuaggcaccagcuucagaccuggagggaagcaaacuuaaguguuucuuugagugggaaacaaugagaaagcuguuuuuccacaaaggagaggaauucuaccgcuuuucggauuggcagacccagacuccuauccuaaggauggcauuggacgguagcuugugcuucuagcuguugauucuucaaaagauguuuugggggcuggcaaaccuuaucccaaaggaaggaaacgucccaguuuccuuaauaagcacaaguucuucaacagccugggaaaaaauguuuauccuguucuuauuuaucuuugggauccccaaggauggauaaaugaggcucugcaugaauggauccuauaauuagauaggagccugugguccugauauuuuaggauaacagacaauuuuuaagaagcgucgugacucacucaccaucgaucucauucacucaaggcugucuucaguugaacacgcuacauggcaggagauaaaccugcggagagaaauaggaacagaggcaucuggggcagggaguggacuagucguggcugcucagggggaagaaagaugcucagagcuguggaagacaggggaagggaggaaggcccgggugcuagagagaguugugauuacuggugugagagaccacagguuucaaaaggaaaguaaaaggcaguaggcaagaugguacaggaaggcccuauagucucagcagucgggaggucaaggcaaaggagugagcaguguccauccugggcuacauauaaauucaaggccagccuggaugauggagcaaaagcuguuucaaaacaagccaaccaaaaaaaaugaacaagggagcaggugguugaauuuuugccucacagucuaaaacucuaggucccaacccuucaugccacauaaaccaggcaggcacaguggugucuaucuaucaucccagcacucagaaaacagggagagaggaaugaaaauucaaggauaaccuccagugaaugguuggcuggaagcuagccugggcuuucugaguucuugcugcacaagcaaacagggcauugugagaaggcugaguuaguacaggugucuaccugucuacccugggagccugaguuugguucuugggacccacaugguggaaggagaaaaccaauucccacaaguugucuggcuuugugcacauguacacacacacacacacacacacacacacacacacauaaggaaaaaaaaagaauggggguuggaauauacucauggucauauaagaaucuaggugagaauagagacuaggagcuacagcagugguccucaaccugugugucgugacccccaaagauguuaaaugacucuuuuacuggggucacauaucagauaaccugcauagcagcuaugcauacugcaguuucuaacaguagcuaaaucacagcugugaaacagcaacaaaaaaaauuuuguggggagcuggugagaugacucagugguuaagagugccgacugcucuuccgaagguacugaguucaaaucccagcaaccacauggugacucacaaccaucuguaacaaaaaucuaaugcccucuucuggagugucugaagacagcuacaguguacuuacauauaauaaauaaauaaauaaaucuuuuaaaaaaauuuugugguugggggugugugaugguuuguauaugugcuuagcacagugaguagcacuauagaagguguggcccuguuggaguaggugugucacugucacugugggugugggcuuuaagacccucacccuagcugccuggaagccaggauccugcuagcagccuucagaugaagaugucgaacccucaacuccucuguaccaugccuaccuggaugcugccuuguuccugccuugaugauaguggacugaaccucugaaccuguaagccagccccaauugaauguuguccucauaagaguugccuuggucauggugucuguucacagcaguaaaacccuaagacagagggucgucccaguaugaggaaaggguuggggcauuaggagggcugagaagcaccuucuacacgaugaggucaugaaaggagaaaugugaucuuuuaauuuaauuguauuuauuauucgcauguguauucauuuaaguguauugggcaugugcaccuguguggaggucagagaugaacucacaggaaccaguuuccaccuccuauacaguauggccccagagacugaauucgggucuuggcagcaaguguuuuuuacccaaugggccaucucacuagcccagaaauggcuccucuuaaagccaacgaaugaugacccaccuccguuucaucucuuuuccacuguugcuguugggcugaaguauuuuccauugugacauguccaggacugagcgaugagcagauuaugggaggggaggcacccagcucugucugcuauugucuaaggugcucaauugggaucaggguuuaccuaaguggacgcugcauagcccagaauucgucuacccuggaccucaugcucuugugucuauucuuguacccuuaugucagggggaaaaaaaaaaucucaaaugcccucuacccaucagacucucuguccuaaauagacaaagccccguccauuccauuaaaucacaaaaacagcucacagaugucguuaagguuacuaaucaguuaaauuagauuuaaucaaaaggagguuaucugugugggucuaauccaaucucgaguacauuaaaagcaaaauuuuauugacaguucgcaaaagggcgagucagagggacuaauggggagaaggaaggcuggauguacccugccuagccugaagauggagggcggacgggcauacaguccccagagcagcccuggcugaccccacucugacagcugcuagguaacaggucuaguagcggcacagaacuaaacauugcuaacaaucugagagagcgcaggaagugagccugucuccaggcccuuggcuggccagcagcauuuugauggcucgcuguaagacccagaacacuggcucccguagagacuacaguagagacugcugggauuuccggacagacggauguguaggaaggacuguggccucauaucagggguuguuuaaacagccagugguggucauuuguuaugcagccguagaaaaccaaaccaaaccaaaccuccagcuucccgagagacacuucugagguagaucacacagaaacauaguugcuagcuuccagaaucuucacaauagccuauucuugaagagaaaaguaaugagugggggcagggggggggaugauaacugauaaaaaucucuucugagguguucuuagaagagagaggggcuauagguugcagagaagaggguggagucuaagcuaaauuuuguggcuucaaugacaauauuaccucuaacauuuaggcgccuccggaaucuuagcgacgcucuauggagggauggguuugcauaugagagcaauuaucuucucuuuuuuaaacacaccagaaucaaugggggaaaaaaaaauagaggacuaaaaaucuacuuaaggaauagaaauagaacuaacugcccuuuguucuuaaaaauuaauaagcuuuucucuguuuauuuuuaucacaauaauaaauugcaucuguuacuaugaaaaaggcugcuacuacccaauuaucuaaaauucuguguuuucuuuuuuuuuucuucuucuucuucuucaaacagugcuguauaaaaaucagugcauucaaauaaaaggaauguuugggaacccuggggagauggagcugucagccagcugaggcaggcccugucuagagaacggauuaauucugucucuuuuaucuuggcagacuuuuucucaggcucuuuccuaucacaggugacugaggauaucagcuagauagcacaccuacagacuccgcccuuccccagggccugagugaacagaagcugggaugauggaggacgggcuacuggcugaugggaaaggcaaagaaucacugagcuuggaccaagagauccuuggaaagcugggguggggauggcuucaaaucccccaucaauucgcucuuccaaaaacacugauauuuggauguuguacuggcugguuuugugugucaacuugacacaagcuggaguuau

SEQ ID NO: 8956 - RNA, 1044 nt, Mus musculus
agggugguuguuguuucuuuuuuuaaaaaaaaacugggggggaaugauauugaguaaacacgauguaauagcuggucuuuacguucuauaagggaagauagugaacaaauggaacaggcacacguuguacauacagcagguggucauggcuuaaagaacacaggcaaaaaagauacggacagaaacccagccaaaggccaagaagggagauaaucggaaccuaucugagagggagacacugcguuuccaugccagaugaaauaugcuguuuuccagcccuauguccuggugcccaucuugugcacaaacgagcaagccacuaaaagagguuggguuuuuugcugcugcugcugcugcuguuauuguuuuaagaacaagagaaaccuccaugucaagcuaauggugcugacuggaaguaggacaaaauggagggaccugggggggaggggggaccuuccaccauuaccuccuagaaaggcucccucccucccuccucuuugcuugcacucugaagacaauacaaccacuggaauagcagugaagaauccgggcaaaaguguuccuguggguuucauuuuagaucagacuggugaaggucugcagaguguacagagaaguuuuucuguuaaaucucagaauucucucgcauuaacuuccgugaaggaagccgccauuguccucugccuuggggcagaggugggaugugcaguggaaaaagaucuuuugcucuuuaaagacuuuuuuuuuuucaugcaaacgccuuagacugccucacacgagagaguucuuuagcuucaaccugcgcuugugccacagugcacaaaagucccagugccucgacacacaggguuaggaagaccuauucugucugcugacucugccaaccccagcaucacaguuugucaguguuacaaaaugaugaaaucgaaacucucaucugcuuggagccagagaacaaugccacccaacacacuguguguugaguuucaaccuuacuugggcuugauuucauuugaaaggaagccuuuuccuucgucugaaggu

SEQ ID NO: 8957 - RNA, 1715 nt, Mus musculus
ugaaauaggguuucucuguauaggccugacuguccugaaacuugcacuauagcccagacuggcuuugaacucacagugaucugccugccucugcuuucugagugcugggauuaaagauacacacuacaacaccuuuaauuauguguauguauguauguaugucucuguguguguguguguguuuguaugugaugcaggugacuauagaggcuagaggcagcaggcauuggauccuugggagcugaaauuacaggcaguugucaucugcccacugugggugacaguaacugaacucaggucucugcaugaguaguaugcucucaccuacugagccuuuucuccagcucccaccuuuacauuuuaacguaggcuaaauuauccguuguuuccuuauggcuuguaccuuuuagggucuuguuugugcaauccagggauauucuuccagacuuucuccauggauaaccaaggcuccgguggagauggcucugccacucagagguucucagaacucuucacagugcguuugucaggccaguaccaauuucaguaggaaagacagagauggagguuugguaaggccucaaggcauuuuugauguucuuuaacagauagaugucacaggugugggaaauguccugugcccgggaaaacucaucuuuguagccaauaaaaaugucagggugcucaggaagggagguuuguguuaagacaugaugcuaacaaucacgguguucaucugaucgggaacacucagaaaccuuaaagaaggaggacuuggcggugccugugggacuaucaacucugagacaagcacggcuggcccaucauaccuccaacccaucccgaguugaacuccacaaauaucccccagccaagcauaaccagucuaucagaagaaaccugugucugguaaacauguuaauaucugucuugcucaugacaggaggaagagaaugggcugguagggcuuuauaauuagacuccauuuccgugcuugcugauaaaccgacuaugcuauauuaugugauauuccaaaggcacacuauaauuccuggucccgaggaaauugucaauuaucuuccauguucauuaaaaaucucaugcuaucuuuacagcuagagauuaacuauaccuaugccuccuguaaaaacacggauuuucacaaugugcgggcuugcuggcuacagcugguggcugaggcaucaucaaaagagcuuuuagguaccagguucccaggagagaugucuagcaacuuguaguuggugcuaggacuuauacauccguauguauguauguauguauguauguauguaugcauguauguauguauguauguauguauguauguauguauguauguuugaacuucucaaggaauucccugagugacuguguuuccagacuacuggacucugagugaggguuccuguuugcuguaggucacaucugaauucaguacucuuauaugaauauagucauagcuccuagacaagggcugucucuggcuucucaugcccacacugacccccugauguggggagccacagccagucucugaaguugcuagccaucuuuguagcuggauauuucucuccaagugucuucaucuaggaacuuggggcacccguuuucuggaaguuucuauucguucacagacaugggcgcguguucauuccuuuacucuuucaugugucuguagauguguacugacucuc

SEQ ID NO: 8958 - RNA, 41846 nt, Mus musculus
gcggaagacgaugcaucuuguuaguuccccccccccccccccaguuucugccuuuuaauucccaucuucggccugaccucaagcagaaccggcauguuccaacucccuggucccuuccaaaacugggaugggauggaggcauggggcaagcccccugcugaccagugucuugcuucucagagagaaaguuugccccaagcccuuuggaaauggcucgccaucagcugugggaaagguucuucuccaaaugucccccauacuggaaagcaugaaguucaacaagguagggacaagagccuaggcuuaucuacaugacccuggguugggacuauucugauuugggggaucuuuguuuguuuguuuguuugaaggguggauaguauuaaaaaccuguauaacuuguagcagaaaaauaaauaauaauaauaaauguauauuugcacucaagguagcuuuaauuguuguuuguuuuguuuuaucuguaccacagaaaucacaauggaguagcaagcagaguggagccuugucuagugccuacgugggcuuccagaaacauauuucuuuauuucuuuauuuauucacuucacagccugcucacuggccccucccacaaagggcacugagccuggccuacucuguuaaaggaaagucagggaccaugaggguuagccuugaaguccaagcuucaccgaggcucccucccaccgucuguuuacugacugcugggaggauuuuauaggaguuuguggaggauuuuauaggauucacaaagcaugccuuggaguucacacuugggguucacacuuggaguucacacuugggagucuuucacacuugugguuaaacccuucuugaggguuaauuuccugacucacugugacccacuugaggccacugagccugccauuuaccuucuacccucaccuaaauguuucagucauguuuuguuuuuguuuuguuuuguuuuguuuuguuuuguuuuguuuuguuuuguuuuccaugagaccuuaauguaaaacuccuguccaguucaucagucaaacaaacgcaaagccgacgcgacacaggucggagaggagcucuguguuggauauguguagaagcucgccagauugaauuuuauccuugggaaaugugugaggaccugggaggagcucagauccaugccugagcugcaguuaggaaccagcaauucagagcugacugagaggaagagagaaagcuaaagaacagagcgccccgauaggcaaaaauaacuggggcaaaacaaaagaugaaguggauguggaaacuguagaugugaagaggagaacuagggaggagaacggagucaacacgguucgugugugaccuuuagagacucaguacaagaacacaucugucaggggcucagaacccagacuaagugauagguucaagaucuuccaggucauggaaaguagcuaagucugcaucaaacucuagaucuucuucagucaacaaguuuggcccuguuuuucuuucuuucuuuuuuaaaagauauauuuuuguugucuguguaugaguguuuugccuugauauauguacuuauacuucaugcaugccuggugcucucagagaccagaagaggaugcuggauucccccaguaacuugaguuaugaaucacuauaagucaccacaaugcuccugagaaucaaauccaaguccauuguuagagcagaaagcgcucuuagcgcuuugcagaaccaucucucuagccucaagaugcuauuuuuuuuuuaauagcacaggggcacaaguugaagaguuugccagucacuugcuuugaaguuccugaguguauuagaguagaccagggaagggcaguuuuuauauauauauauguguguguguguguguguguguguguguguguguguguguguguauguauguauguauguauguauguauauguauguauguauguguauguauguauguauauguauguauguauauauguauauguauguauguauauauauguauguguguguguauaucuauauauauauauguauguaccuacacauguuuguaaaauguacugacaccuagaccuacaugucagccucaaaucagugguguggaaggaaggaucuuuucuugacauggacaaacguauaccuaagaggagugugaauguucagcuugauguccuuggucacuccuguacuccugcauuuaguauucagcagaaacugggauguucacaauacugagauaaacacaaccucuccccagccuaccauggagccuaguguccugugcacaaguaagaccuuuacccaagacacacugauucccgaugccgugcacagugucuguguacaaugucagaguggauugucacuggcacugaagacuucaaguggcaccaaguuggaugcuuccaaaacccaaacccuguagucacagguaccagcgccucccuccucuacuggcgaggcaguuucuaaugaguuaaugaacagccugagcaccaggagcagcaggaggugaaggggggccggcugguaaucuccacacauuagcagaugcuccagcaggaggcuggggaagcuauuugccaguugguugcagccucugaaagagaggcagaagggucagccccuguggccuccaucaguucagugaccauauuuucaaugauagucauaauaaaaccuggggcacauaaucaucuaucaaugggggacuuuuuuauaaauuaauuugauaaaauaaccuacacagacauuaaauugaacguaauuauacaacuguucaauuggcauaguuagaaaaucuucacaugaggucgggcgccuaggagagccagaacugaaucgcucaguauuauagcuugagaaggaggugaagaaucucaguuuaauagagagucccacgagcaagguaggaggcuucaaauuucuccagguccucaccagcauuuguaauuuuucuguuuuauuugggggguguauuugugugugugugugugugugugugugugugugugugugugugugugauaauuuguguguguucuuaugugcagguauauaugugcacggcaaugcacaugcauguguguuugcauguuuggggagucuagagguucacuugcacuccaccuuauuuuggagacagggucucucgcugaaccuggagccugucaauucagguaggcugguuggcuagcuacugagcuccagggaucgcucuaccugucugcaucacagucucugggguuggagauguucuuacuaccacaccuaguguuucuuggguauuagugacccaaacucagacccucgaguuaccaauugaaccuucuucucaccccugcuuuccuuuucaaauauuguuuuuauuuugugugguacuggggaucagacccgggaccuuguaugugugagauaagcccucuccccggugagcuucaucccugccauguccuuauuagaaaacacuauaacucuccuguguccuucggagagcuuaugguauagaccccaacacagccagucugugugggaacagagcucaugaauuaagaggaagcucccaggagcugugggacacuugacucauguguuagaaaagagcacguauguuacuaggacugcccacuggaauagacuggaccuagcgucccuccaaugcaguugugaagguugccaucgguccuccagguccacacuccuugcacuugcucccaaauuucagucuuccucagcaucuuguguucccacuucagggccuuuacugucccuucucugagacacuugccccuuuguccucacuugucugucuaucccucaaaucaagcagcauccacagaaaggaguucucagagcugucuacuaaagggccagauccccuccugcaccaaugucccgcugcucuggccgaguuaugacccguuucucagguuuuguuuacuugcuucuauggcacuuauugcuuucauaaacaggaauuuccuuaaaguuaugaacaucuuuauuguguugggguucauguuauaacaucugaaauccaaccauaaagccugaaaagauuaggaugugucaccuaccuuugccugggagcugaauucuuuugccccccaaugggaggaaaggaugcuauaaccaagacccccaagaagggucugcgcagacgggucugcuguuuggccaugguucauuuccauuagcuccaguccuugucauucaguccuauuuuacaggacugucccugauuuagcaaauguaagccuagaaauggcuaguucacccuggccuuuggaucuucaaucucaagaguccugggauauguaaagcaaugaucaaauacaucuguaguguuuuccuccuguugaccugucuacucaugauucuuuaugauggacaggaaagagagcauucccccccuccccaaacuucucuccaaucaucugucucuccuagcuaccaaguaaaggagagagaguucucguuuacauuauucacgguuguauccccaaggcccagaacagaacuaguuguucauaaagggcacaaugaaugcugaaugaaugaaugaaugaaugaaugaaugaaugaaguaauuacaguggcagauucccuucugggaauccguguuucaaguauagccaugaguaucugagauuuaauccaggagcuacaagguauuaucagcauuucacagauggagcaccuugggacuccuaaacgguucacacagucaucagaugaaccagugcagaagagcccagccuccugaucagcucuguuuguugucuguguccuagaguaguuuacuuucuguccuaguguuuuaaaucuguuuacaaucacuuagaggaagaacaggauugagcuggucuccccucugccaguuccgguuaccugcguaaacacgcagagcccuucaaaggcagaggugggacacacgggcuuccccucucuguguaggugucuucucacucggguguuuucaauaagcaagaaagucuuuuccauuuuccacucugaaacuggcaucucguuuucucuuugaguuauuuuauuuuacauuuauuuucuuaccguuugugugugaacaugcauaccgcacugugccuguggcggucagaagccaguucuucuagucaucuuaugagccccagaaaucaaacucagguuugacaguaagcacuuucacugcugaaccaucuggccagcccugucauuuuaacuuuucaccuuuaggcaaacgaauguauguaugucuggacuuuccuugaaccucugcuccucguucaguaauccuagugggcuucgacuucccagaacgcuuugagcuuugcucuacuaggcaugcucccuuuugccuuuccuccuagccauucccucauuccucauuccucauuaguccucauuccugccuuagcccgcuuucuguugccauaacgaauacaugagguaguuaacuuaucgaaagaaaaggcaugcuuucucucauagcuguaggaguuucuggaugcuaagaguuguaccccucgcuuuggguuugcagaggcacaucaugguagaaguauguggcacaggaugcuauaaugggggagagaaaggcuaaggaaaauggcuuagcaguugagaguacuuaccguucucuucaguccagcagaggacuggagucuuacaacugccuguuacucgagcuccaggggaucuaaugucuucuggccucagcagguacacauacccaaauacacgcagauaaauacaaauaaaauaaaucuuuuuuuauuuauuuaagaggaaaucuuauuuguuuguuuguuuguuuguuauagaggaagagagagugccccuucuccuucaagcacgcacuaucauuaacuaaaagaccacccacuaggccccucccuccgaaguuuccaacacuucccaauggcaggacuaagcauuugacaccuggcaccuagugacacaaaccacaucgacccauuuaucauuaauauagucucccacauaaaacaacaggcuuagaagccacaagaccugaacacagauuaaugaacacagaaagagaacauauggguaggugugcagcaugguuuagaagugucccuauaagggguguggauaggcuccgagugaugcugagugagggguuagggugcggaagagaagccaggaauaaauauagaguuaacucugucagagguggagccagaggguuuuagggggaguagagagcacucugaggacauagaucaaguuuucuacucugagucucaggguucccuuuguauagccuuuggguuuuucucuuuacuaugguggcaucuccuugacucauucaccugaacucuucucuucuaccuuuuuuuuuuuuaaccaaccuagccuaaaagucucguaccacuuuaucuuaaaugucaggucagcuugagcuaauggagacucugauggacaauaccccuucugucuccuucuccuaagucccuugggccaccucuucucaggugguaaacaagguguuccucugaggaaaccagauugugggugaguaggucagagaauguuuugaaagaaaaacaagcaaacaaacaaacaaacaaacagauuuaacaagacacuaggcaaaauuuguaaagcuugcccugguuugagcucucuguagagcuaugucggccuggccuggcagcgcaguugauaauuaucuccauuccuuaaauguuuuuccucugcuggcuuuuggaggcauuuauucuccaacgccgaaugacucaauagccguauaauuguuguguccauuuccuuggcucugaugggugggaaagccaguuauccuucccaguucauuagccgacuggccuuugcauuagcaaccccaccauugggggguugccuuggagacaaagcuuccuguggguaauccaagauuauccagcucuuuguccugcaugugacccauaauuacuugcuaaauuagaaugguuuucuggaaaucacaggcggagguuaauauguucuuccagaacuggucaagcuaagaugacacugaauucagagggaauucaagucacaugaucccugaaggcgucucuuugaguaagaagaugaacucucccacuaggaagcacugcaccccauaaaggcccugucacucagacaaccucugccugcuuuucggguugugguuuaaucucaugacaauucccuaugucaauauugaguagacucauucugcaacaagagucugcgucuauuugucuuugauaacugcuuuacacuucaguacgcaccucuccuguaacugccauuuuuccucugcauucacacaguuguaauuaauguacccauuuaggauaagcaguauauaaaguaauagaaaaaaauagaaggagaacacauuaggccaaaaauguuuggacacuaccauguccucccuaagauuuuauagugaaagggagugugcuucuagaacacuccuaaugaggcgccucuucacuccuuuguaaauaaguuccacaccagugaaugcaaauauagaaugagaaccgucaugagcguauguguaacauucuuagauguuuauccauugaaacuguaagugaagccacagagaugucuagaaggaagcagaauaaaacacuaucuuaaaacuuuaaaugaguaguuuacuccgcuagaaucucaaaccugggcuagcacagugccugaaaucucauagucacccaucuaaaaggcauuuaagaaacccaacugaauccuauucaaauaaaugucauuggugauuugaccaugcagauuucugcuugauggauuccacaccaaguucugugcuguugugacuguauuucucagcucgaugucacuucgacaauauuuauguaucuagugugucgggagcauccugagaccucauuuugucgagcuguaauaauaaucuacagagacauuggcugaugaaucaccuggucacguuagcucacaucuugagcauguguguuaaacauugggaaacuggcuuugacugugguauacugaggucagccaucacacugaguuuuagagggcaguuuaguaaguggcgggaugguuagccaggaaaagggaaauugucuuugacaguguucuuucucacuaguuagccaugguacuggggaucaaauuuagggcaggcaguaauauuguuaugaagauggcuuuuugaucaaauaaucuuaggaaauauuguguuaagggcauuuuaaaaagcugugagcauguguauuuguaucaccugcagggaggaguguguguguguccagucaaauuuuggugucuuccucaaucacucuccaccuuauuuauuuauaaugugucuuucauuggcuggagcuuuuuaauuggcugggaaaccccaaggauucugucuccacuuccuuaguguugggauucuaggcaugugucugaccuuuccauggaugcuggggaccugaguucaggucgucaugccaacacggcaagcacuuaacugaaguggauuuguagaaguuuuaacuggaauucaguauuaaugagcuuccgcauauauuuaacacuuaagcacacacuaugaagcacacaaauauccuaaaauuauuugcuuaaaggaagucuuuucucccaguaucuguaccacuugcaaccagugggcuuuaacuggacuaauugggaaacauaguuagacuccccacaccuugcuuuaauuagcagauacaaccaaauuccuccagcaagauaucgucuccucacaaccuccccgaaacagcaccaucagugaggagccauguauucaacugucugagccuauggggacauuucugauucaaaccaacacaaucacuggaaagcaccaucggggauacacacacacaccaauggugccagguagagauagaaaagaaaauucauccuaagugagguaacucagacuccaaaagacaaauguauguauucauuuacauguugauauuagcuguuaaguguuucauaagcaggcuacagugcauauaaucacauuugucuguuaaugggcuucuaggguauuuccaguuucuggugacuaugaauaaagcagcaguggacauaguugaguaagugccgcuguaacaagaugagaguccuuugagcauaugcccaugagugcuauagcuggaucuugagguguaccuauuugcaucuuccgggggaaacugccacacugauuuccagggugacuguacaaguuugcacucccacaagcaauggaugaguguucuccuuacuccacaucccugucagcaugagcugucccuuguuuuauugaccuuggccauuuggacugguguaagaugaaaccacacagucguuuucauuugcagucccgggaugagaaggaugcuggacauuucuuucccagccauuuaaguucccucuucugaaaacucucucuuuagcucuguacucauucuuuuuuuuuuuuuuuuaauuuuuguuuuuauauuuuucaaacuguuuuucuuuuauugaaaauagauuugggggugguacaagauauucugauuaugguuuccccuccccuuacugcacccaguuccccccaccuuccuccccuuccuccccuuccauccaaggccauacacuuuuugucucucauuaaaaagcaagcaggcaucaaggaauaauaauaaaauaaguuaagauaaauuaaaaacaaacaaaucagaauacaacaaagcaaccaaccaagaaaaagagccaaaagaauaacauaagaaacuuauacagaagaugcagagagacagcccuuuauacauucaggaauuccccgcccauuaacaaaaagaaguggaagccauaauauauacagaaagaaccacuaagguagaaaaauaauaauaauauucacccugacuuaacaacaugaaucaaagaaccuccaaagaugccacugaguuuguuuuggguugaccuacucugggcaugguguauacccuuauaaguguuuuuuuuucccccacugaggcuuucuuggaggaaacuaauuuuuucuuuucaaguggccaucaguuggagauagcuucuggguuaggaaugggggcauguguacaccucuucuuucagcucuaggaccccagaccccugugucccugcacaugcuaccuccgccucugagaagucauaugugcauugauacuauuaugucuagaagaccuugauuucuugguuuccuccaucccuucuggcucuuauaauuuuuucaccucguucugagccccaaggagaggauuuugaugaagccacuccuuagagcugaguguucuaaggucucuuacucucugcacauugucugguuguggaucucauacuuguucccaucuucuggaggaagcuucccuaagauggcugagcaaggcagugaucaaugaauauagcagaaugucauuaggagucauuuuauugcuacaguccuuuagcagaacaaauaguacuugguuuugccuuagcuccauggcuuauuaacucucagguucuuggucacacacagcauuggauauggguuccaccucauuggaugggucuaaaaucagauauugguugguuacuccaacaagccauuauagcaucaguguauccuccagucagaucacucuuguagauaggguuauugcuggguuggugucuaccuuucuccucugguggcaugcaacauaccuagcaguaccaugaauacugccuuauaggagugaaggcucuagguagacaccagcuuggccucuucauauacagaaggauaaauagauguugccuuuggcaguagggccuuccggaaacuucauuuguugaacagagaugcccuguuggaucuaucucccuuugucacccacuuuuagugauuucauuuaaauacccuucacauaaguauauauuauaggaagccucaacucuuuuugguuuccuuacaacuccucaaaaggcccuuucagcugucccucaucauauucccucucucauccaccuccuuuuuugacccucccaaucuguugauugcuuucgguagccuauccauuuucaucauauuaauucuacuaauccaugagcaugggagaucuuuccaucuucugguaucuccuucaaauccuuucuucaaugucuuaauguuuguaucacacaagucuuugacuugcuugguuagaguuauaccaagauuucuuuuuuuugagucuauugugaaagauacuguuucccugaugucuuucucagucccuuugucacuugucuauuugaaggcuacuagguuuugugaguuaaucuuguacccugcuacuuuguugaaaguauuuaucagcuguagaagcuuacugguggaguuuuggggaauacuuauauauacacucacaugaucuacaaauaaagauacuuugucuucuuuccuuccuauuugaaucuucuucuucuucuccuucuucuucuucuucuucuucuucuucuucuucuucuucuucuucuucuucuucuucuucuucuucuucuucuucuucuucuccuccuccuccuccuccuccuccuccuccuuuuucuucuucuucuuuuuuuuuuuuuaauuuuuugaggcaggguuucucuguauagcccuggcuguccuggaacucacucuguagaccaggcuggccucgaacucagaaauuugccugccucugccccccaagugcuggaauuaaaggcacuugaaucuucuugauacccuuuaguugcccuauugcuccagcucagacuauugugccauauaauuacuauauugaauaguuacagagagaagagacaaguuuguuuugugccugauuuuaguggaaaugccuuaaguuucccuccguuuauguugauguuguuugagguuugcuguaaaucacauuuauuaugcugaguuagaucucuuauauuccuagacacuccaauacuuuaaucaugaaggaguguuagauuuuugucaaaggacuuuucugcaucucaugagauaaucauguaguuuuggucuuucagaauguuuacaugguagaucccaucuaucaauuuacaugucaugaaauguccuugcaucucuagaugucuugcaucucuagacacuugauuguaguggaugaucuuuuugacauguuguuggauucaguuugcaauuguuuuaucguguauuuuugaaacuauguucauuagagaaauuggucuguaauucucuuucuucauugagucuuuaaguggcuguuguaucacaugauuauggccuaguaaaaagaauuaagcuauguuccuucuacuuuguggaauaguuugagaaguauugguacuacuucuucuuugaaagucugagagaauuguaacuuuaagcuuuucuuccuguucacuuaguucccuucaaucaugacucugaaacuaauuauuuauuaauaaauucauaggucauaggcuucagcuugcucucauuuauuaauccuuuuauucuaaccagagaccagcuacauggcugguuuccucucuuugucuucuauuucccagaauucccucucuucaugccaaaugucccaccuccuauuuccugccucggcucacuggccauaggcuauuuuauugacaagugaugcuuauaagagauucucucuacagauaauucugcauugaauucaucuggaccuggacuuguuuugguugguagacuuuuaauuacuucuucuguuucucuagggguuagaggccuauucaauucgcuuaucugauuuugacuuaaccuugguagcucuuuuauguuaagaaaauauuccacuucuuuuagacucuccaacuugauagaguagauuuuuuucaaguauauuauaaugauucucuagauuuccuuagugucuguuacuaugucccccuuugucucuaauuuuauuaauuugaaucuucucuuucugccuuuuaguucauuuggcuaagaguuuauccauauuauugauuuucucaaagaacuaacucuuuguuuuauuuauucuuuauuuuuuguuguuggugguggguuuugguuugguugccuugagguuucgguggagggggggugguaguggugguggagguuugguuugguuuuuuuuuuuuuuauugguuuuuguuuuggggguuuguuuuuauuaauuucaguccugauuucaagccaucuauucauuuuggguaugauaccuuccuuuuguucuagaucauucagauaugcuguuaaguuacuagcaugagauuccucuaauuuuuagugaaagaacuuaggcuaaaaacuugccucuuagagcgaccuucauugugucuuaaaaguuugggcagguuguguuuucauuuucauucaauucuagaaagauuuuuuuucucucucuuaauuucugucccgaaucauuuucauuuauuugugagguuuuuuuuuucaguuuccaugaguucuuaaauuucaugucuuuuuuucuguugucauugauauucaacuuuaaucuguauuguucagauaggaugcagagugcuauuuuaauuuucuuguuucuauugagacuugauuuguauuccaguaugugauaaauuuuggagaaaguucuauaagcaacugagaagaugguauauucuuuuguauuugaauaaaauauuuuaaauauguuaguugcauuuguuuuaugacauccuuuagcuccaguauuucucuguuuaguuuuuguuggaaugacuuaccggagagaguuagguauuaaaaucacccacuuaucaguagugcaugaaggucaauaugugauuuaagcuauaguaguguuucuuuuaugaauuuggggucuuuguguuugguacauagaugcuuagaauugaaauaaccccuugguggauuuuuuccuuugaugaguauguaauguccuuccuuaucucuucugauuaguuuuugcuuuaagucuauuuugucagauauuauaaugagcacacugucuugcauccuagguccauuugcuuggaauagauuuucccauccuuuuacccucggguaaugucuauccuugauguugaggugugauucuuagaugcagaagacggauggaucacauuuucacuccauucuuuuagucuaccucuuguuuuauuggggaauugagaccauugauguggagaguauccaugagcaauguuuguagcuuuuaguuacuuuguuguuauuguguggggguucccugccucuucugauuugcuggucuggaauuauuuauucuuuaggugugugugugguuaaccucuucaguuucaaguuuuccuucuaucacuuucuacagggcuggauguguagacugauaacacuuaaauuugguuuuuuaucaugaaaugcuuuucuccaucuguugugauugaaaguuuugcuguguaaaguagucuggcugccaccuggggucucuuagaguuuauagcccaggcucuucuggcuuuuagaguuuccacugaaaggucaauuguuauucuaauagaucagccuuuauaaguuacuuggucuuuuccccuugcagcuuuuaguauucuuucuuuguucuguauguuuaguguuuugauuauuaugugccaagaggaauuuuuuucugguccagucuauuugguguucuauacacuuguuguacuucaauaggcaccuccuucuugagauuagggaauuuuucuuuuauuacuuauugaagauauuuucugugccuuugauuguaggcuuggucuuuucauaaugucccagagcugcuggguguuuugugccuggguguuuguagauuuagcauuuucuucagucaagguauccauuucuuugaucaugauuucaaugucugagauucuuucuuccaucucuuguauucuguuguugagacuugccucugagguuccuguucuaguuccuaaauuguucauuucaauuuuuacaucaaguuggguuuucuuucuuuauuccauuucuacuuucauaucuucaucaauuuucuucauuucauuccacuguuuauuuaugauuuuauagauuucuuuuauugauuuauucauuuccucuuaaaggaacucuaacauauucauacaggcgauuuugaaguccuuaucuggugcuucaacuauguugccuuucucaaagccuccuguaguaggguuguugggcuaucauggagacauauuguccuugccguuaguuaguauguuuuuauacuguuuucuuggcauguaggcauucuagucugggaugacuauaguuuuaggugcucacaucugaucuugucuuugcuggcuggguaguccaucucuugguuucuguuaccuuuucuguuucuucggagagguuguuggcugugaguuuccagguagggaaugcuucugcaauccugccagauguggccacugggguuugagguagguuuuuccaauuauuggauguggacaauuaguaaugaggaugacuagaaguggaggguuggggguuccagaggacaaggaaaguaagguaugccaccagguuaugcuuagucccuugguaaugggggcagagaaggagaaaaggccacgcuacagagcuggggacgagacagggagacuggguuuggaggagacaacgaagaucugaugaucaccuaacugcuucacuggaaagcuuacuuggucaauggguuucuggggaaugcccacuggaauugguggcuaagacaaagggaugguguggugaggaaguauauaggaaaagaucugaguaauucacuggagauggggacagacgggaagggaggccacagcaaggaaucugcugcagagcuggggacgagacuggagaacuggauuuggaggaggacagugaaggucugaagauagccugccaaacucccuccaauaggagggaacuuaugcccgguagugucaaccuauguguggcucaugugguuauaagcacuuuagcaaaacauaucuaugacaguuuccuaagacaguuuaccuccuaacuagauucuaaaugguuauucucuuuuuccaaauacuuauucauauacacagagauaagugugguucucaccccucaucaaaguuggagacuaugaccauagaaauucauaaugucaaauaguccaucuggauaugucaucaaauccauaauggucaaaacgcaaauaaaaccagacugcgggguacccaaucccaagugauacaucuacaaugcaaccauugcacccaaggcucaggugauacugcagaagagguguuacaaagacacagaggaguaggaugucugcugugagauuacaaagugguugccuaaaccagaccugcauaaugacacccucaggucacauuccaaugcagguggggaaaccucacauggccccaacuuuagaugaagagcuauggcucccuucugagaaagggagagucauucuucuucagcauugaccccugugauaagucaucccauccuaaacaaucagcucuaaauaaguaugcacaugggcaacacuugguggacucaccaggguacacacacacacacauacaacacacacacacacacacacaccacacacauacacacacaccacacacacacacacacacacacacaccacacacaccacacacacacacaccacauacacacacacaccacacacacacacacaccacacacacaccacacacacaccacacacacacacacacaccacacacacacacaacacacacacacacacaacacacacacaacacacacauacacacacacacaacacacacagauacacacacacaccacacacacacacaacacacacauacacacacacacacacacaccacacaccacacaccacacacacacacacacacaccacacaccacacaccacacacacacacacacacacacacaguggucagugguuuaagggaaaaacacaaguaguguuagagaguugaaggauguaaauacaguacucauguauaaaacguauuuuucaaaaggagcuuaaauaaaagugccaagaauagucuaugcagcugggcgugguggugcacgccuuuaauccccagcagaggcagguggauuucugaguuugaggccagucuggucuacagagugaguuucagaggguauacagagaaacccugucuugaaaaaaaaaaauagccuaugcaaugcugaagacuccacuggaguaguuacaugacuagacgccacaaucuugugaaacacucugcacuuaggauguaaucauuggugcagcaauaagcaaacugaccguggaaccagaguccaaaauacacucauaugugccugucaccuggaguugacagcaaccacacugaagaccagugaggaaaggaagguacauuuuuuauaaauguuacugagucaacugaauaugcauguagaaaaaugcacaucuucaugggaaaucaauuuauaaagcaugaaugcagguuagagccguaauacucgcaggagaaaaucugugaucucagaauaagcaaagauuuccagacagagcauagagaacccugacuauaaggagggugugugugugcgccaaagucauguagauuaaauuauaaauguuuacuggauaaaaggacaagaguuaagaaaaugaccuggagucaacauguagccaaagagugacauccaaaauaaagaacuuguggaggugagucagacaaagccagaagcuugggugcuaggaggcuuuagguaggaauuucaguuaaguaugaauaauuagcaaaaccaguuaaugguggcuuuccuguccucagcaacucugcuucugcagaugugaaaaacggaaauguguuccuuugcuuuccccuucuaaaacugaauacugauuacagaagaugcguuugcuuugggcaagucaacagguagaguucuuaggaccuagauucguucuguaaacaugacaguuaaggacauuaaaaauaaaacagccuuauagcacguaacuugugcuuccauucuugaaaggcguaaauugugacuugcauuucucuuuuguuuuuagacuuauuuauucucuuuuguacguaggagcauuuugucugcauguaucuaggauguaugugccuggcuuccacagaggccagaagagaucauaggaucuccuggaacugaacucaccaaugguugugaguugccuugucgggguuggggcucugcagaagcaacaagugcucuaaaccucugagcuaucgcuucagcccaacuugcauuucuuguacuuggaauuuaggucucucagagguugaagccauuaacaauacauuugaaauauucauuguauuuauugccuuagauggagucuucauagugaggacuuuaguaacagaauucuugaacuuaaaacccaucacuuuuuuucuguguggcacugggcaaauauuugacugcuuugcacguucauuucuucauucuaaaaugacagugcuaacagcauguuagcuaucaaaggcuuggugagcuucugucacaccauaaggacucagucuuugucagcucuuauuaacuuucuguuugcguaauagucgaaggcuacugugcaaaucugagcuaugguuucuagagauuagaagagggagaggauguggaauuaaggucccagagcacccagggcgaugacccccacaaguccagggaugcacagcuauggauguuuguuacuuucaugccucagagaggaccaaagagcauauuucuccaguagaugagaacuguacuuccgcugaaaucaggaggaagccuuauauguggcuacguucagugugaugguuuuucuugugcucuagaaagagauuuacuaguaauggcuagggaaucuggagaggagaaacugggagguggaaaaaaaaauacaagcaaucacacagcccuauggacagugugcagcugacagcccagacaaacuagaauugugugaaaaaugaaacaaaucauuuugugguuuuuuuucaaguuuauuuuagucaucguuaaacaaaacugggugaccaugaauaugcuaacaauacagguguuaugaaaauuugaggaccuggguuuaaccccaagaacagaauacacauaauuauggaaggagagaaccuaccccauaaaguuguccucugaccuccacauguguucgguagcaagugaugaguacacacacacaaaauaauaaaaauaaaauaaaacgcaacccauucaucgacucuguccauagcauaaaagcuugcaacaaaacuaccgaguuuuauuugugugcacugugccaugguuucaaguacagccuugccuucgaaauuccuuuuugagaaguaaaguugauuuggcacaaaccucuuaauucgaccaccuaaaagguccuagggcucuuuugagaugcucuccgugggcugagacucuuggugggguaaucauuucuggaaaguucacaaaacaaaagccagccacugaauaguagaugccuuuauuuauuaguuuauuaugggcugguuccacaagucuuagggcuuccaagguuuucuaagucacagaagauagucugcuacucuggaacuugaaauacuugguaguaggaaaaaaugguaaucaccuucccccaaaggcacuacagagcuggacacaccgcaccucuacuauaccgaguauccguccuugaccccguccacgccccuguccccgccucugucuccagucccugccccggaccccagacugcuggaguugugagcucuuaggccagcuccgccucccagucuugcuccaccccuccuguagccccgcccacagaugcucacaguccuaguggcccccaguagcgaggaggccaggggcggggcucaucccuggcccgcgggucucucgggcuccaccaaucagugagcgcccuguuggccauccgcggcuccagagccccucccucucccgccggccucugcgucccagaauccaagauggcgguguccaggcggaggguuccccaggcuggagcgcggucguucuucugcgcccugcugcugucuuucagccaauucaccgggagcgacggcacgggaggcgacgcugcggcucccggcgccgcgggcacccaggccgaguugccacaccgccguuucgaguacaaauacagcuuuaaggggccgcaucuggugcagagcgaugggaccgugcccuuuugggcccacgcggggaguaagccggggcuggggcgaggggcggguucccuccuugccuuucgucuccucggucugucuccccagugcccugcagugcagaggaucagcuccagcccugcaugccacaugcacuggggcaggacuccccaggcagccccaagucccggucccccuaaccggcagguuccccgcguguucccgagucuucccacgcagcuuguccacccacuuccagucuucccuucuuuaaucucaucaguacuuucugucugguuccgagguguucuguuacuuucugcaaguccuugcacucaaaccaccuucugcgugucguguuaccuuacacccuaaugccacgucucauggguacacuuuccguggccauagcaaucugagaccaguuccaacagccuccugcuugcuuguuuuagggaguuagcaaugaucagguuuguaccuaacuucccgaaugcuccaagcuagcauagaauguuaagagugauuuuuaaggucuuuggacguuguucuuuaaauguugggauuaccccauagaauuugccucucgguggcagcgugugucgucuuugaucuuuacacuguaaacuuuauauuagugucucuauauagcuaguacacgagauacaucuuuuguauugauuguuucugaaugucggcugaggauagacucauauccucucuuuuaagacuuagauuuaaaaaaaaugagaucauuucggcuucaaguuuuauuuacucugacauagaugacagaacgauggcugagcccugcccugcccuggugagaagaagauguaucagcacuuuuuagugcugaugugucacugcuaaccaaagauuaucaguaacacuugauaaucuucaggggccaucagauacauccauuauagcaaauaguaaauaccgucuauuuuuguguguaacugaggguguguuuauagaaggcuucccuuuaucauuugacauugcccugugacugaaacaaaaugcuucaugucuagaaaguaauggcuaaagcacacuuccaggaagggccauuuuccucaaauuaaugagcaauuaucagguguaaauuucauaaugauggagucauuauguaguugaagcagaaugcaauuacacaguuaacgcgguugguuuauuauaagccuucuggguuuaggaugcugucaagauaguguggcucugcuuacacaaagaugaugaacacgauaccaaacaggagcuuucagaccuccccuuuguauuuuucuuuuggaaacgauggugcacauguuggcagcucuucccucgugcaccuguccaccgccugucugcucuucucucuuucccacucacacaucagcaauuucagaauguuaaucagcuaccgagaucaguuaucuucagucucuuuuuacagagccacaagcaacgaaucuagaccacugugacagaggucaaaauaaaaggcuagcguugcagcucgguugguagggggcuuacccagcaugcaccaagcccugaguucaaucccuagcacuggguguagugguucacauuuguaaucacagcugauuucacugggaaguggaggcaagaguguucaaggucauucuuggcugaauuuaacuucagucugggcuaaagaugagcauagggguuugugucuaauguacccgaguguggguguaugguuagacuccucacugguauguauggcaugggaaucccuugcuuucaugguugcuguaaucuuuaaucuuacuguucuguuaaugcucuuguucuuuuuucucccuuuucauuuauucuugcgacccaucauuugaaacaacaacaacaaaaaaaaaaaacaaaaccagagacacuuaggauuuaguuuaaacacagcccauuacacucagcccuaauugggaucacauagaucucuuuuauaaaucuuauguccuuuuaaacugucagcacauagccuuggguucagaggggcaaaggaauggauucuguagcuguucauagcuguauagauggaacaagugacuguacagagagaugaagguucuuggacaguggacucuagucuuccaauucuuuucccacagugcucucccuacaacucuugaauguuugaaccugugagcacacugaaaguaucucagcuuuccuucugccuauaaaguguuuccuagcauaaaugucaguauggcuacacucugagagaguauguucgaauuguuaaacuuuaggccucuuaguuaccuuaauaacuacucagugugggaccaucgaaggauuuauguguguacuuuguuugauugugucgcaguuuaucaaauugugcagggaauauguuugagguguuuuuaacagacugaaaguuuguacagaagucuguccguacugcuuguccagauaaucuuuagcaguuucagucagugguauugcugguuuuggguuuugucuccgaggucugggagucaaacacagggccugugagugauaagacaagagagugcucuacuguugauccgugcgccgauuccugaauauauuuugaaauuaaagccuguucauuguucuuucagauaugauaauguuauacacucaguauguaauauaguauaaauguaacuuuuagauacacuggaaaaccggggggggggggggggggugugugucuugcuuuacugugacaguuugaaacggaaccagcauuauccccaugcuaugccuauacaaagagugacacucagugacuaagguccaacagucauacguggcucaacugggacucgagccagcuacucuugaguuucacuuguuuucucugaaaguccacaguaguuaaagaacugcuuaugaaauuaaagcgugguuggccuuauucuggaaaaauguugaugugcaggacauuuugcacgugauuuuggaguguuuaaagaagucaucaggccuggcccuuucauuucacacaugaacguuuggugaacccguggaguaaggacaugaauugcucaaagccacagcagaaccaggagcagcugaacuugaccccuagugacggguucuugucagaaugcugcuucuaacauuuguaacugguacgaugcacuacagacucuuacuaugggacuuuuaauauugagggguaauuuuauuaaaaagagauuaugaaaaucaaaugaaguuugccuuuuuuuuaucgaagaugcauacaauauauucugaauaucacuuccccucucagucuccuuccagguccucccaccuccucauccauccaacucuaugcuuuuucucucuuuaccaaacaaacuucugucccuucagaaaacaaacaggcaaaacaaacaaauaaguuuucuaaaaacacagaaaaaaauagcacacagaaacaaaacccaugagaacacaaaaucagaaaccacaauacagaagaaaaaguuuugucuuaaccucuguccuugacauuuaauuuguggguguaggcuuccagauguauuucucuuuucaaaagauaaaauuucagagucauagcugucagcaugaaguuauuucugacacaaugaauguaaaaucugucucaguagcuguguguagccauucaaagguaaucuguugaguucugcguacuuccagcuuaaagcuuuucuuuucugauuccuaccacagaugcuauuccaagugcagaucagauucgaauagcgccgucauuaaaaagccaaagagguuccguguggaccaaagcaaaagcagccuucgagaacugggaaguggaagugacauuccgagugaccggaagaggucgaauuggagccgauggcuuaguaugaucauuucugucacucaaacgagcauagcugccaggcaccacuggcuccuaacuguugucccucuuacguuuucucaggcaauuugguauacagaaaaucaaggcuuggacggcccuguguuuggaucagcugauacguggaaugguguuggaauauuuuuugauucuuuugacaaugauggaaagguauacuuauugcuaaaacuguuagccauuuuccauguuaauguuuuucuaguacaguuaggcuguaagaagguggcuuucuugacaccuucaauuuaauaguaaagaacuuggcugguagucugagcaugguaauuagucuugguggcagagacuuaacuacuagaagcuuuguaggcaugacucugcacacugauuuacagccaugguggagaccuagcucuucagaacaugccagugauucacacccugcauauguuugguaacuaugaagagucagcgugagucuuuagaugugggcaagaaaaccagugguguucaggaagccauggcagcacucacaggcuuggcggcagcuagcucucggacuuggauccguuccuauguuaacuacuuucugcucagggcaguuuuccugaugaugucuuaaaagcaguuaaaaacaaacauauuuacgugcugaaaauacuaacucguggcuuggaagcuucaagcuugauggucuucccuucacuugguuguuuauugauuuccagagcuuacucuuacuuagcacguuaaaaacuuuuaacaacuccuugaaagccuaggccguauuauuuuaaaaauuuaagagcccuagaauuuuaacauuaugagaucucauagaaaauaaagaaugaugacguuuucaaugaaagauacuaaaauaagucuauuuucuuuauuucuagaaaaauaauccugcuauaguaguuauaggcaacaauggacaaaucaauuaugaccaucaaaaguaagugauuucugcauugguuuuguuuucagcuuguuuuugcaauccuugagaaauacauugcuucaaaucucaacacucuucaaacgaaaucagcguguucccuuccacuagcugcuguauugucaguaggcaaaaaggcaugcguucucuucuuguuuugaaguucuuucugugagccacacuuuccagguuaauugaaagguaucuuucaaaaauaaauuuagcuuucaccaaauuaacgaguagccagucugagccaccauuuuucaaugucagugucacuuuaaggcagucagugaguugcagagucucuaggugguaaguguaagcuccuugcuucuccgcgccuggcucugcucuuccuaccguggagacuacaaugcugccgguucuguauaaaccccauggagugguuuaaaauagaaaugccuaggucagcccuucagagucugcuucagcuggcuuggaaggaguuuauauagacuuguaucuuuaaacccuccucaaggggcugagaauguagcugaguaaaaugauagcauuuacaguuugaauacuugccgagcauguauacgacaguacguucaguuccuaacagcacaaaauauaaaaacuguaaagccccccggaaugauguggaugccauccuggucccauacguagcauauccuauagcauguuaccccucccuucagcgugugugauguuggccuuccuuuccaguguugccagaguucugacaggaaagccuuugucuucuaacugacaaggacugucauaagccucguuguaacuugguguuuuugaaucuacagugauggugccacucaagcuuuagcgaguugucagagggacuuucguaauaaacccuauccuguccgggcaaagauuacguauuaccagaagacacugacaguaagugacaguaaucaaauacucggggaucuaauacugcuuuuuuuuuuuuuuuuuuaauucuugacagaagauaauguaauuaaauguggauuuccacacauuuguaugcauugcccuaaggcaguaguucugaaccuuccuaauguuucaacccuuuaauacaguucuucauguuguggugaccccaacacauaaaauuauuucauugcuacuucauaacuguaauuuugcuacuguuauggaucuuagugugaauaccugauaugcaggauaucuggcaugugacccuguuaaagggucauuugacacacaccgccccagggggucacgacccacagguugagaaccgcuucucuaagcgagcagaaguaagaguagcuggcauauguggucaucugugugcuacuuggccagugcguuucugauugguuagaggaagcuuaagcacccagccugaagauagcuaagugcgcauccaagccuucaggauacaaacauggauaagacacgggccgcuguuccugaauagcuuguacaccauagagggagcacauagcaucaccauaccaagugacaaggcacagcaggaaggaauugucagcuggaaccuggacccuagaaaugacccugggggaggucuggaagggguucuuaauugaggugcaucucaaagcaggagaggaaaagcgugcaugcuccagccgcagaaagcagacagggccuugaagaagcugaacguuggugaaagcaaguuguuggcuauagugugaagauagagggcauuucugaagugggguggaaaggccggcaggagccaguccugugaguaacuuguaagagaguuagcacucucauccagaagugaaaugauagcauuuacaguuugaacaagugacuuguucagucucacaauagugugaugggaacagaagcugagaggauuaggcccuucgugcuuuaaaugcagcuuucagacagcucugagagagauagcucuccauuugcaacacggagaaauugaaugugggagauuuugaguaacuuggacaaagccgugguuugaauccugaugucugcagggauccauucacugcugaccugaggugauagaugccagagguagaggagcggggagcuacacugucacauuugcucaccuuggaucaucuagagcaguuguauuucugcugggugauggauucggaguggucauggcuccuaaggcuuugcaagaugagaacuuauuuacuguagaaagauugucucuuuuugagccuuuaacacauaauggaguuaaaaggaaaaaaaagugaacuaucuuacugcauaaugagggcuagugagugaguuuauuuuaaauuacccauuagggggcugaagagguggcucagcagauaaaaagaacucgccaugccggcuuaagagccagagcucagaaucccagaaccuaugaaaaagcugagaaaauguggccaccuggaaucccagcacucaagagacagggcaagauggcuggcuggucuagagaaucacugagcgacccugccucaguaaauaagaugugaagugauugagaaagauacccaguguggacuucagggcuccauacacucacacacaugcaagcucgcauacacacacacaguguccauagacagagagaaucacaacagcagaaggaggcaagaguggauuuacuaaucacagaacacugaaauguacuuuuacaugucuguuguaagaauaugcaacuucaguaugucuuccuaggucaugaucaauaauggcuuuacaccagauaaaaaugauuaugaauucugugccaaaguggaaaacaugguuauccccacacaaggucauuuugggauaucagcggcaacagggggacuugcagguaaaucuugccaucuuuucguauugaaagcuugugaaugaaccguacugguagugauauguuuagggaacguagacgcaaucccauuucacucuuaaaacgucuuuggggccuucccauugcccguucuacagccuaggcaguuggagcggcaaugaagaaugcuaaucacgccaguuaggugcauuguguagugacauauuuaaaguugaggauagaagaaguuaauucccaaauguuuuaggauacuugaaaguugcuguaucauguagaaaugaauuugggaacccaaggaaauauuauuuggggccaaacuuuaaaugaaaauaauuacaauuuuccacauauguugauaaaugaaguuccuccacaccaauacugcuuuguacucauacggcacauuaccguuuuaaguacuuccaaaacuguagauuguucuguacaacccaagcaaggaggaaaaagauguauagccauuuuuuuuuuucagcuguuugccaaguccagacaaaggcuguuucucggggucacacagucaaccccagaaagucccggucuggauuugugguccugacuguugagcacacggccucuccagaggucacucagucuguagugcaccgaguucugcuucccuggacgccucuccggcucuccccaggacaagcagcauagagcagcgcaucacacuugaaauaauucacuccgcacaguggauggggccagccaggauggucacagcugcucacugcugugagacccagucuccuuaguuccugccauuagcugcaacaacuuaguaccgaucugacuuaaacgguuuagggaaaauagaaguauuauugcuguccaguugagaaaagcaagugugagagaccagagcuggugcguuuggaaauaggugggcaggguuuugagugauuugaacacggcaucaucaugcaggagacugggaacgcaugggaagagccuuagacacuuccuguuaucuccagcugaacaugucugcugcgcugacuuagggagaaagguuugggguaguucugcuaucagucuuccauaaguaauaaauacaaauacccgacaagucaguccucaacugugaaacaagucacagcaccuccuaaaaccguuuuucaauuuguagaugaccacgacguucuuucuuuccugacuuuccaacugaccgagccuggaaaagagccagugaguauacacguuucuccaguucauuuucaguucucagggguguugcuccagcuguagacucugagaagaccgaccucagccugggucuuguuucaguucacugccauuuggucuuacuguguccuuggcaaaaccgacgucuguuuaguggccaucucuugguguauagugcuaaaugagacagaugcuuagaguaaaugcucauuaaaugguaacuaugauuuuggguaguaauaaaacuaagagugaacugucuguaguuaacuaagagacuaucuugaagcuagugucggacuagugagugugaggacaggcgacaagcugucucagcagucucuuacuuuugaccuguuguuucucugaaaaagccuacagcagaaaaagacauuucagaaaaagaaaaggaaaaguaucaagaggaguuugagcacuuccagcaagaauuagacaagaagaaggaggaauuccagaagggccacccugaccuccaggggcagccagguaagggguccgggauugucgcucucuggaggacccuggggucugcacugccugccucaccucugcucucagaccagcacacaguaauggaugggaacaguggaaggcaaagcuuggguccuucagggucugggaguguggcuugugaacacggcaguggaauaggugcacacgagccaccguguuggaguuugguaagaacagcauugccggauucacugcuguguucuuuaaacuaaacaagugaaaagccacagacagcucugcccucaugggugaaugcuacauaaaagccuccaagaccguggucuccuuucaguguuacauaccugcuuuuauuacagaguucugauagauuuauggauauguuggaaucaucuuaccccaucacccuguguuaucuuccuuucccucugaacccccucucucuuacuaguccaauggcagccacaccauugaagaaaauggcacccuucccuggcacggcgucagacuucucagaaaugaguagggccacgugagacucuguccaugaugagaugcugaaggcccaguauuggacagcucuuauuagucaugauugcagcagcuguccugggccuggguggcaguaguucaugacacuccuucccauauuacugcuccuacagucuuucuguccccucuacguguccuuggaccuuggggucagggacguagauauccugucuaggacuaucaaaacuauugugagcuuaaagugaagugguaccugcuucuuuuccccugcuacugagaaucauggaauuuaaugguggaaaaaauuaaaaugcuaguuucagcccaagaaauugagaccuuauccguuguuaaguugucagugcuuaguaucugcugguuuuaugucugguuuauuccccauccgcucgaaugauagagacuguacuugacgaagccugugucuagcauuugaacauuguaaagugcaguucucacaguggagggugguaugguaaacggcaucauuugugcccauagcuugcagcugccuguggaagguggauagagagcacacuuggcaaucguggacaguugugugugcccuuuuaagcaucuccacaucagaauauguuuuucuaccccagaaaguucucuggcacuauaagcacacucuccccauagccuaucccuguuuugauuucuguuacuucauauuuguucucccuaguaaaauuauauagugcguauaaaacaaaaaaaaugauuuuaagugaaaaaguucaagucgguuuauagcccuguguuggucauguucugguuuggguauuugucaacacuuggcauguuaaccguauuucagagucacagauguguagagaauugcaguuaacuugugcuuacuuuuuagcggaugacaucuucgagagcauaggcgaucgggagcugagacagguguuugaaggacagaaucguauucaucuggagaucaagcagcugaaccggcagcuggauaugauucuugaugaacagaggagguacgucucgucccugacagaggagaucuccaggagaggagcaggaaccccgggacagccugggcagguaagcucagacacggaggagagugggaacagcgcugugcucuggguggccaguggaugcuaagcugccugcucaccguguuucccuccaggucucucagcaggaacuggacaccguugugaagagccagcaggagauucugagacaagugaaugaggugaaguaaguacccagcuguccugcuucaggggucuguacccguguccuaaugaaaugugugugcccgcugucccggguuaggugcccugcagcagggugagcugcacauccgagggucagguuaggaggaaacagauaauauaugcaaauugcaaacaucuaaauuuuaaaaauuaucguaagcugaaaaaagaagaaaaaaugcuuuagccaagaaguuuucuguaguaaugagaccaggugugccucucuggaaaguauggaaagaauguggagugacauguccuaacucccugagaaacccuggggacagaaagauguuuguuguggcaggacuggauaacaggcacgcuugcucaggacugucuuugauuccaucuccugccuuaagucagaucagccagaggguuggagugggaaggagaugccagucuuuggauaguuuaaugguaacuuucuaaugaggguggcugacauccagccaccauucccagugucugcuaagacacuaagccgucucucaaggcccuuacuuucauguuuuuaaacuucagaagcuauuaaaaugcuauauuuuguaugucuuucacccaucuuuuaauguugauauuuuuacauaaccacaagagaauugugaaaaccagcaaauuaacauacauacuguauaaucaacuaaacaaaugaccugggugggccuuccauucccggggagcuguaacucacacacacacacacacacacacacacacacacacacacgugcaugccucgugcacaugcagacacauauuaacccucuuuuagacuugcuaccucaaucuuuucccaccuccccaucuguuuaguguuagggcauuaaaaccagggaucugguggggcuugggcucuuucuagccucucccuugauuucugacccuucucuaucucacugaaagcaggcauaggcagcugcuccauuuuuauuggguugguugguuuguuucuuucuuugcaaggguauuuucuuacacugucuuucuucuggaaggaccauauccuggguauguccuuggccucuuucacuucccagccguacuagcuaaguaagguucaggugguugcuggaaauucaggauuugggcugcauuauggacgaaggcacuucccucagauacguagccaccccugcacacuucccuucuagcagugguagauaccugauaugcauguggcaaguuagucaaaacugagcccaaguuuaaacuuuagaaaaauaugacgaggaauuaccugccgguccugggaauggcaguugucuuuauggguuuuuccaaauucucuggaaauccuggaagauuucuagcagcauacaguuacaguucagcugucugcuguagcguuuccuagcccucccgccacugucagcccacgagccuuugcugucaaggcuugaacacacacaccucucucauacuugguuuccguuuccguccuuguugcuuuucuguccacugucccuuaacagauguuuuugccaagggcuccucuugugucaucugcuccuuaaaccaaagacaauucugccauuucagauccuccccagauacuaggcacccggccugcugagcucagugccucuuccuuuguaggccugguugugccuccagggcacugcccucccgccagaccuuugaacaucggggcagagcugauucugcuuucacagguuuuccuagaaacugcccaacucaucccauguacccuguaacuguaggcaagugagugagugccuaggaaucuauuaagaggccaguccuuguauacuaaaaauguauuucauaagcaggucuguacuuccaagacguaauaauguuaaaugugugcuuaugagaaaguuguacauguuuuauauaaauuaaauuguaauccuuaauugauguuuucaggggacaauuuagaugcccgugguguuaagauaaauugcaauugguuucugacugagaaagccccagguauuuugugguuaguguuaaguuugugcugcucauucaagucagauggaacucuuaaauuuaacuuagucucucucucucucucacucacacacacacacacacucacacucacacucacccagcaugacauaacucugacacuuucuuuucuuuuguuucauagcuccugccuuuuacacuaaaauucacacggaggaagugaaaguuaaaacuugauggauucaucuaaaaagagccaguauugcugauagaaagucaagaugggaacccuucucacagagcgucaauacgagugggaaagucugcuguuaggggagguuugagcaggaaaggauugcaggagagucagauauugaggaggggugucauuggacuuggccuuugcucuaguccgaagauagggagacuaaaggcucuuaucuguggcaagggucacaucuagaaagggcauuaugcagacaggcuuacaguugaaggauauuuucagggaaaggaaaggaccaagagagauggaggaaaaggaggcaguaaaguuagaaagaugguaaagacucaguguuuuaucuaccuugggaaauuaccaggcuugaggcacuucauguugucggugauaaucacacgaugacuugccaggcaagcuuuggaacuaccccuagcuaaagccccuucguuauugucagguguguucguccuuucccacaaacaagucugugacaguuccuccguaguuggagcugcuucuugcuaugcggucacucauccacugggcucgguggcugcuccgcuuuaaaucugaacaguggagucauauguucuacagagugugcguccuaaagucaguguguaaaggugucgcagaguucgcauagagacucacacauuccuucagacauuagugcugcuucguugguuggcuuccuguuucugugcugggcuggcugguaccugagggccgucugauggagcacagggaagcagaggcacaguucacuugugucaggaaucccugagaccagcagauuaucugauugucaaagaacuuagaaagcugcggggcuccugguccugguuuguuacaacaaagagaaacagucauaaagaaagcuggccagugagccgagugcaggacccaggggcucccucugucccucccagcagccuccuggcacacagagcuuggauuuccaguuuuuauuuuacuaugauuugaagugauaagaauguauuaagaacuguacugcagauucugaauuugaccuuuccugggcugagguguggucaugggcauaauauggcaggugguggcgccuaacagcacagaacuuugguuuuaaugaucugauguguugaacuuagaaaaauguaaccauuugaaauguauaacuggaaacaaaaaaccaaacccuugugacuugaaagggauuuuguguuguaggaacuccaugagugaaacugugcggcuggugaguggcauccagcacccgggcucagcaggcgucuacgagacaacucagcacuucauggacaucaaggaacaccugcacguggugaagagagauaucgacagccucgcacagcgcagcaugguaacugguucugcgcagcauggucucauuccuaacugccuuaucguucuguaagccuuggcucuggguuucuagguagaagguagaagucugucugccucauuauugccugcaaaagcuagcagugagggcucguaugcgugaguauuugcauuaucagaaaaugaaaauauuuguauucucauuuuaauauccucuauaauccauguuuuuuuaaaacuugcuuggcaguuuauaugugaauauaaaguguggguuuuuccuuucuuuuuauugaaaauagauauuguuuucagugcaauauauacugauuaugguuucccugcugcaaccccuccaagacgcucacuugguaacaagaacuguccagcuggggcuccaucuccccaguuguuuggugacccuauuuagaucacuuuuguauuggugacuauuuuaggaagugucuacuguauuggguuuccaugcagccuuuucauguggccuuuagcuguggcugucccucauuuuuccucucucaacucuuuuccuucccccucuccaucuaauccuacuguuccagugccuccccuuacccauccguagcugucuauuuccucuucauaaugugguccagccccuuccccuuccuuccuuacucuauaaccucugugauccuauggaucguagccucuuaacaggaacuuggcgggcaacaugcacauagaacuggauucacaccauguuugucuuuugggucuggguugucucacucaagaugaaauuuuuuuuauagcucuauauccauuuaccucugaauuuugugauuucauuauuuuagauagcugaaugguaacuguaucuugugccucauuuuaguggaaaugcuuugaguuucucuuaauuuaaguugacauuggcugugggcuugcuagaaacugcuuuuauuauguuuagauaugucucuugugugucuagacacuugaggacuuuuaccaugaagggguguucauuuuguuaaaggccuuucaugcgucuuugcgaugaucguguucuuggcagucaugucauuucauuccccaguuuguguuuuacagacuucacuaguggauuuacucauacccucuuuaagaaccgcacacaaauucacaguagccauuuugaaguccuuucuugugcuucagcuauauugaaugucucagggucuacuguagcaggguugcaugucucagggccuacuguagcaggguugccugucucagggccuacuguagcaggguugccugucucagggccuacuguagcaggguugccugucucagggccuacuguagcaggguugccugucucagggccuacuguagcaggguugccugucucagggccuacugcagcaggguugccugucucaaggccuacuguagcaggguugccugucucagggccuacuguagcaggguugccugucucagggccuacuguagcaggguugccugucucagggccuacuguagcaggguugccugucucagggcccacuguagcaggguugccugucucagggccuacuguagcaggguugccaggcucuaguggagacauacuguccuagcuguuacuguuuuuaugcuggugucuaggcaucuggacuagggaugauugugauucuggguguuuucuuuguugggugaguuuucuggucuuuggcuucuguugcccccucuggcucugaggaguguauggguggcugugcauuggccgguaaggcgugcuucuggguccuuggcaggugccaggugcagccacuguguguccuggguagacuuguuucuagguguuucgaguugacauguaggaauggguugggcuagaagagcuggggcugagaggaugacccaagggagaaaagcugaggcucucuggaggaagagcggaagacuagccucugcgagugaucugcuuccguguugggaauggaggacagggccgagagggaagauugauugccuucucagucaccugagcaaggugggggugcucaguggguuuccagggagagagaagcuaaguugauggcugauggccugaggaaggaaggcccaaggaggaggagagcugaauggaagguguuuggauuggaccucuucccagcuucccccuuccuguugcuccuaccuuugcccuccucauuucaggaacuugguaaacccaccgagcccaccuacuacugccuguaugugcgugagggccacccaccagaguauuggcagcccaucaggggccacagccccgaggagaaaugacucccucucccaguaggcacucagccgggguaggauuucauuaacccucccccacugguacugggauuuuaucugacuugauccccuguauucuugugagucuguuuuuuaaaaguauauuucuuugguauauuuucucccaacauucugaucugaaauuuucuggcuguuuuguuacuguuuugcuucgguuagguuuuaugaaauuagauagaguuaauuaagauuguguugagugcucuucucccucaguggccuugugcacauaccuaugguugguccuagucaagcuuagaagaagcagaagaccaaccccuuaaaauauguuaucuuuauaucagcaauaaauggcauuaacaugacuuucucaaggucauuaguaagggaaaaacaccuuagucuucaacuuccaaucuuguuucuacuauauuuugacacugccuuaacuauguacaugccuugaaaucuuuugcaaaacaugcuuaauaguuuuauuauuggcccugguuuuucauccaaaucauuauauuuuaguucuguuugaagauauuuuucccucuuuguugcaauggccagcuugguguugcgggugagcacuuccccaaaacccugccucauagaugcaacuagauugagaacaacuaucucaagucaucuuugucccugcuauguaauuagcuccuuaaaguauaguuuucugaagucagucagauuuagugucgugagauugcaaagugugugccaggaaacaaaauucuguuuaaauaguuuguugguaaguaccauguaauggauugugugaacuggaccauuauugggcgugcagucuauacuguuaauuauuaugccaguagagaaauugugaacugaagcauccggggcggugggagccugugggagcucaggucucuagaaccguggagggcccugaagucaucacuguagugaaguuggaagcaagcggcgccuccgugcugaugacuugacggugacaaagaagagcagccuuaugccaguuguucugugaaagcggaagaauuuuuaaaagauugcagaaguuaaauagguagaaauauguaggggaaugaguaaaaaaaaauacuuguuuauuuaacagacugugaguucuauaaaauugaaauuuacaucuuuccagaccauuauugacuaauuauaauacagguccuuugccuuacagccaucuaaugaaaaaccaaaaugcccagaccuaccaccauucccgucgugucuauccacgauccacuuugugauauuuguaguggugcagacaguguuguucguuggcuauaucauguacagguaaggcucuugauaacacuugacccaacaugguauuuuguggaguuaauaggaccuuaauguagcucucacuaauguagacaguucacuacaaggcaaacuagucuacugggugugcauuuuuagcguguguuugccacgaacuaucguuuucuacuucagggggguugcuaguuuuaaugaucccauuucuuucccaaguuaaguguuguacagagcaucugucaguuuuuuuuuuuggauuuucuuucuuuuucuuuuuuaggacucagcaagaagcagcugccaaaaaauucuuuugaccuucauuuuccuauauguacaucauguauguaugugcaaauguugucuuuuugagggaauuuaguauuuaaauugcuucauagucuaaguuauuaaauuuuguaugaaauaacucuugaaaacauucacuuuucaguaaaaaauaaauguuaaagacaaccacauuuuguucauaguacuacaugucuuuaaaugucagugagucugugguaggcagagugcagccucugaacagaguaauggcaagucaagacuuaaagacagucggggcagccacuggcugugggugauacccucugugucuauuauuggaggguucuuuauuuauguaaauaaacuuaucuuuuucccccagaauaugaggucuaaacaagagcacccuauucauguaaccaaaggcauuuuuagaagugagaauucccuaauacgagacuggauuuagccauccuuuggcccuaacauagcuccuucugggaucagugacuugucugagagcuuuaaucuaaaugccaggagucagcgcauuuaaugaaaugcuuuucuccuguguucagugugcauuucauuuuuaaaggagauuuugguggaaaaaccaacuaguuucuugccuccaucauuuuggugagaacaguccuauggugagaacuuuucggggguauuucccgguaguguauucacuccggauggggggcacuguccugaaaauguuccgguaaugucaaugauaguauggaaauaauuuuuauacuuuuaauuugugaaauucauuucucccauuuugucgaacauguaguuuagcuccaauugcauguucugcggcuauuuuaauuuacaggccuuaccaguacacucugguuuacauucaaucucuguaacccaaguuuaugacuugcaaacucuuaaacagaggggacuguaguggaagcagcuuugagcuaauugaaagcaaauuuguaaaguaaauacuuaacuguuuguccuuuaaacacuaaaaauaaggauguugugaaacauccauuagugaauuaaccaggaaacacugggcuggaaagaguugcugucagcccagaguuagucguagggauuugcgaaaccaucuguggcauuuuaaagugcagauuucacuuuucuuuucacagcugggcuagacuuucgcuggcuucaagacaauuuaccucuuacuaaaguaaugggcucguuugcuaugggauccagaacaacacuguuuaguauguccuuccaaaauuguuguaagccuuuguaaguuuccucucaagugucauuugcauuuuugucugacaaccugaaaucuauagaagacuuuaugagaacacuuacauuguggcacuaccuagcuugcaccgugugugcagucuugcauuuucugcuggcauuuauccuagaagugucacagcacacucacagugacuccacaaaacucacugcagcacacagugcuccugcuuccuccucuguggagcuagcauuugacacucgugcucuaacggagugucaucuuccagaacucacuuacauuuuuaaaaacuuccagacaagugucagauuguagacugugagucuugggaaaucuuccugagauaaaggcuacgaaagccacuguuacaaaguccgcagucaugugugccugaaugcuaaaggaaucccaaaucugggcaguguacacuuucaggcucaaguccaaggggaaguacacuggucauuccuaaugcgauugcagacagucaguauaguggagcaggagcagggguccuuuuacuucuaaauuucuuuuaaaaaaucacucagcaagguaguucacauagucugucuguauuuguuucuaucaaaaucauuaaaucuaaauagcucacuucugagcaaaacccugcucugugggaaauuaucacugccagaacuccuucaugucuguagugucuugugugauuggaauaauucaacuucucacaccagcaaguauuuuacaggugccuuggauugagacaaaauuuauuuuaaaacuuuaaaucuuuauuuaugaugccacuuuuaaaagaaaucucaauuauguaaaauugucgaugggcuuguuuaauaugccgcuugugauagaauuauuuaaaugcuuuuuucaguuaaaacuucaccgugaagucacagacaauaaccaguauuuuaucauguauugaaggcacauaaguguuuuucagaguauggcccaugggccaaccauucaguuccuggaaugcuuauuaagaauacagauuccaaggccaauucgaguccauccaugucacaacucaggugggcuucagaguguccauuccccagacaccacagacauggcacacugacaggugacaagcacuagaauggggguaggggaaagguuugcuggguguuuauuaugggcucagagccgagccaugcacauuuucacugucacugagaccggcgucugcugguucuucuguacucuugaguguucgcucaccaacucuccacucacuaacaacuacaaaccaaguccggguugucggcugaccucucggcucccgggugaugacucugaaaccuguacaaucaucuuuggcucauggcagagcauaaccgcgcccauggugaagcuugccugccaaagcccuugccuuccugacggucaccacugcucaucucagaugccgcgcacgucacuagcgugaggaaaaugggaaagacuugaauaaggguugcucaccugcugcucucggagaaucagucuuguaaaggacagcccgcugugguuacccaugcugacucugcagcgcccacaugcugguuggaggaaggcagugaacgcuuuagucaucaggaacuuugugagaucagggugggaucagcucuuacaacuucuuaaaucuguaugcugcccguuuuaauauauuucucuucugauguucaaguuuaaaaggguuuucuauccacugucaauuuuaauuauauaacauuuugucaagguuuuguuugguuuuguuuucccuuucugauuguuacuugaugcuagcuggaauucaagaaaugucaaugacuuuauucaaauaaaagaaauauuuuaguaaauugguuuuuuccuccauu

SEQ ID NO: 8959 - RNA, 2442 nt, Mus musculus
aaggauaacaugaguuuauuuauggaaagugcugagcaaugccuagcaguuacgcauuuaauaaguagugguagucauuagcuccaccugucagaguuugccaugauuguauuccaaaccaucccaccuaauuagaauuuauuaugaagaaagcuauuggcuaggacguagcucaguguagaguguuugucuaguagucacgaagcccuaggcuccaucaccauaaccauggaaaaaaauaaagaaaaggaaagaguauaagaggaggagccaaagauccuggacaaggaacuuguaaauuucaagaaaggccagggaccuaaagggggggagcuagcaggcugggggugagcggagaagcucaguacacccucuauucucacuuugauacauuuauauaugacauuuauaggaaagcuucccuuggaggaagagcuuugcuagagaugggaggugagugcuaagcuuaugguguaggaugaugucccaacuccucagccacacuccccguaacacuuucuuagacacacugccugcacccacuugcaucgugggacagcagaguaauccucccaaggaucggguaguuaaugucauaacagaugugaaccaggcuucuguccugugcuauggcaaccuuacagaauucagcugcaccacaggagggggacuuggaaggcucaaggggggggaccucaguaggugcaaucaugaggaaggagucccuugcccgucccccccagcucuacuuugaucaagugacaggagucuugaacaauuuccauuaugcagucugguuugaugggcacaggaacaaaaucugcccuauagaggauagccugcuguacccugucucaaacaacaaugauacaaauaagcuuuguucuaaggaaaugccuguagcacgggggcacuuuaacugauuaacaagcuaucccuugaguaaugcagggcccuggacuaaaauaaccucuaaacagaauucgcucacuuagucucuucugcuaacucaugagggcagugggccuucugcucucuuguuagugccgcgugggaagaauguuuguaaaggaaagcuacagugcauauugcugccauggaaagccuacauuucuuuuuaaagcaccuaacaggcagugacaggcuugaugggugccagcgugugggucucugcaccucgccauucgcuccugcaucaucuaaaauggcagcuaaccugucagaauucagcgugagcgaggauauuuauaaaacacuagaaagauaaauccguaccagcaaaagaugggucuuucuuuucgucgcucagaaacaggaggguuugggaaggcaaaugccagccagcucuccuauaaacugagcaaccagccagggcaaggaguuagaucaggaaggaggcaucugaacugcacagauugcaagcaaagaccgagacguuugggaauggacuugaguuaccuaagaaagcagagguuacccuuaugcauaaagaaagcuaggaugggggaagggguacuaacuacuuugcagcauuuggcgcagcucccaaacaccccuaacuagccaagucuggagccuggauauuuuuuacaugcaagucuagacacauuccgucuucuucgguagcuacacucgcaaacaaaaagugccugugggcgcugguuuuguggauucgcuccuagcuuagcagcuuuagaaacuaagcgggagagcucaaaagccaguggcagguuguagagacgccggcgcuuaggugggcggggcccggcgcuguccgucaugcgggcaccgcccuccggcaccgcccucccaucaauucgccccggcgcagaguuugacgucaccgucugcgccgcacgccguaauacaggaagugagaccaaaacaaaggagcgccggccgggugcggaccuucuugcaccggugucccugcugccucgcccgcgcccaccccaccgaagccgcacgacgauguccaacauggagaagcaucuguucaaccugaaauucgcggccaaagaacugaaccggaguuccaaaaaaugcgacaaggaagaaaaggccgaaaaggccaaaauuaaaaaggccauucagaagggcaacauggaaguugcgaggauucacgccgaaaaugccauccgccagaagaaucaaggggugaacuucuugagaaugagugcacgaguggaugcgguggcggcccguguccagacugcagugacgaugggcaaagugaccaaguccauggcgggugugguuaagucgauggacgcgacguugaaaaguaugaaucuggagaagaucuccgcuuugauggacaaauucgaacaccaguucgagacucuggacguccagacgcagcaaauggaagacacaaugagcagcacgacgacgcugaccacuccccagaaccagguggauaugcugcuccaggaaauggca

SEQ ID NO: 8960 - RNA, 2770 nt, Mus musculus
ugagacagugucuagcucuggcugcucaaaaacucacuguauagauauuuuaacuuagcuuaauggcuuaaaacuucaauugacaggggauauucccacguuagucucugggauauuggaauuacaacaggccuaugccugacauuggaaauucuucaggaugagaaauacauaaacuagcucguguuuauuuuaccucauuuuaaaacguagucuuugagccuuguugcaaaugacauccuuuguacagugugacuucaaaaauaauaaagccauagcugucaagccucuuacacauccucuccccaaucucuuaaaucuauaaugcagacccuugcuaaaccuagcgcuggggagagauggcucagugguuaagagcauuggcugcucuuccagagguccugaguucaauucccagcaaccacauggcagcucacaaccaaauauaaugaaaucugguacccucuucuggccugcaggcacacauguagguagaacaauguauauauaauaaauaaaucaaucuaaaaacuuaaaaaaauuaaaccuaacucugccuccuaugauucuucuugacauucuuuucugugccuuaagucaccauccugccuuccgugaguguggagucccuaaguggaaaauucuucagcguguuguggcaaacucuacuguauuuaccacagcugcuaauuggauguguuggaaaaaagaauuuugucuugggagaugggagcagguuugccuucuccagucaagacagaauucuuuuucuggcagagggaagagggucugagguucucagaugcggcuccuguucucucccucaggccugggcagacgaugugcagagauuucagaggauguucagacaugacagccaugugcagcugaagguggucauuggcaaucaugacguuggcuuccacuaucaguaaguagcgugcggaaaaagcaugccucggguuguaugcgccaugagaauuaacuuaaaaugcuuuaauuaauuaauaaauuaauuuuuuugaagacagggucucauuguauauuucagacugacugcaacucacuaugcagaccuggcugaccccaaacucugccugccucuguucccaagugaugggauuaaaagugucacuacaucuggcuauuuugagacucagucuuaacuauauaguuuugacuggccucaaacuugcaaccuccccccaacccccgugccccaccuucaacucuggauuaaaauguacguuuagugucaggcuauuuuagaagucagacaacaaguccacguacccuuugcuagcucacacuguagugugcuagcccaugugccaccuuaagugcucucucucuguaccuuaauuucucuuuuuuuccugugccguuacuuauugcuccacuggggucccagguguugugucuggccaaacuacaccagggagcuaaguaauuugcccccucucacgauagacggcagacuugaccuuugagccucagucgccuggguccgguuaauaaugccagauuguggaaguuacuuuucguggucauaguaacucgucuugaccugagaaacaucucuuuuuuauaauuggauacaggaugaguaaauacagaauaaagcgauuugagaaaguguucggcucugaaagacugcucucucugaaaggaguuaagugaguauuaucuacgaauucagaugagacuuuuuuuuuuuuuuuuuuuuuugguagugaggugcugaggggugaagcucagagccuacggcccuuccacugaacuguguccccugauuaaauccacugccauucaaaggugguugucuuucggucagacccgcguuuuguauuagcuuguaccuugcuuggugauugauggucacugugggaacugaccagaugggaacaccuauaaccaccuacaaugaaccagucagccuaugacuccgcccucucguuguaggcguggcaugacuccgcccacuuggugugggcguggcauucuagcugcacugucccacaugucauacauucagcagcccacucuguacaggugcauuuguggcuuguuuuguuuucagacaggaucuuucuauguugcccuugcagcggcaaacuccugaguugggacuguacccacaccugcacaggugacacaagcucacgagcuugcccaagguuacgcuucuaacuggguugagagcuaguuagaucgcauggcuucucuccuguaggauuuccuacaaguuacaagcucgucucgucuuucauucggagcaacagaaacgagcacagcuucauuguaucuuggauauaaugcuauuuuuguuucaccagugugaacucacaguuuagcugggguuaagcugcucuuggguuuguuucauuaugcuaugggugcaugauguuuccauggggacaagggcacacacacacacacauguccaguggccugaccuucucugccugcucuugucggccucaguuuugucauggucaacagcguugcaauggaaggggaugguuguaucauaugcucugaagaggaagcugaacucagagagaucucucguaaacugaauugcucccaagagguaggagaccucugcgcucaugucucccaaaggcuccacagucagaugcccuggcuguuagucacccggcuccucuucccucucuuagugguaaccacugggauugaugggcuaacaaggugacuccugaccagcaggugccgggauccagucagugugaccgugagcccgagccga

SEQ ID NO: 8961 - RNA, 25714 nt, Mus musculus
ugggcaccuguggccuuuuucgggaggaaccucuggcugcugggcucguggguaggaacaggcccggcacgggggacuauggcccagggagcagagacccgggguaggugauggggugugagagggagagggauucacgggaacgcgcggggaguuggugacuuggggcucaggaggaacuggggagcagaggagaaauggagacgagcagaguauucugaaagaagggugacccgggcgcagggguacguggucggcacucgccugaugagggcucccgcguagucccuggcggucuccauuggugcggguccuccugucccaaagccgcgucucuuaaaucacugcccuaucagccacgccccgcgacgacuugacccgaccuuggcgacaggcugcgcuccugcgagcagcgaauaguucuggcucccuggccugggucccggggccacgccccuucgugcgcaaacgguaccgagggcccaaaaccccaggauuuggugauguugguggcucuugucaguuuguuuuucucuucuggagacuggggugacuggugacaucaucaaugucagcgauauggcuuggcaguagagaagcaggugugcguggggcgagcggaguguccuaacaggcugucugcaugcuggagucuccaaagcccgacccagggcugggcggcuggccagcgaguucccgggggacaggaggaaguugcuggggacacgcguaaccgcagcacuucggguucucagaggugccagggcuucccuguggguagguaaguagagagucgcgucgagggaguggaggaagcauaaugcugccacccauuaauaacuggacuuguagguuaggcaguuucugagacacagaaggaaagcacaagauuuagagaagguuuucgugaacagcagcugcccuacaccgaguuggcgagcauucaccacagcucgcuacaaaauuggaugacuuucuucgcaagcuacaaggucuggaauuaggaguugcuaguuuucugcucacuaucacuguccaagaacuuguuacuguguuccaggcucggucaccagcccucuucucugguacaucucacaggagcaaaagacugcuccuucuucggggucaucgguguccacacaccucaccugaccuucagggaaguagaagcuaaaagcaguuucccagugaacgcccugcaagaggcucacaaagcugccuuuccugcccacagcuauggggcuggacaaagucaccugggcucauuagcggacccuccuacugacaccucucagaggaggugagaaaaugggaccaauccauucaaaccaccuguuagaaaaugucucacuguagagaaacuuuuuuuuuuuccgagacaggguuucccuguauagcccuggcuguccuggaacucacauguccagaugcacaggguaucggagugaccaucugcauagccaggcucagagcccccagcgcucugauggauucgcuuguuuauuuaaacaccuuugauuuaaauccuuagucuccccaccccucuagcccagucuggccuccaagcucacagauagagaacugcuaaucucuuccucuugagugacguccuuaaacguuugugucucuccucccagcaaauuugcauuucuaaaaaaaaaaaagugucucagggcuggaauaauguuaaguuuggaucccguauaaagcugggggaaaggcuaagcauaauggcucauaccuuuaaucccagcacuuaugagacagaggcaggaagaucucuaugaguucuagguuagccaggucuacauaguaaguuccaggacagccagggcuaccuagagagauccuaucucaaaaccaaaacagaacaaaacaaaacagaagcuaggaagccuuggaaccuguaacuucaguguggugggaacccagcuguaaagucaagagggcuugcuggccaucaaccuagcucuagaaaaggauagugcaggauacuccccuucugcucccuagucacacacauucacuauacauacauaacacacuuauuugcauaucagacacggauggaggaggguccuaucuuuagugcugaacaauuuaauuugcuacugaugacaucaccuucaguacucacugacggacaguuccaaucugauugucauacagauggcccugcuuacaauaagugggucacagaacaaaaccaagacaggaaucuggaaaaagagcugaugagggguuggguugugguuggcagauguaagaggaagacaggagaggguggggaauagagaguaaccagaauguauuauagaaaguuuggaggucucaaaaaaccgauagccaguauucuaugcccuaaccauucagguuaguugauuugaauacuuaaggcacuagccacauacuggggugagagucuggagaguacaggucaaggucaaggucaugggaauucucaucucuaagacaaagggagccccuugacucagaagucaugcagacuugaaagcaaaugaauggaugagauacaauguaacaucugaaugcacauuguaaaagaacaaagcaagaauucaguccccggggcagagaagcggugaagugaugcugaggcugaaggacuggaagaggagggagaaaguggggaggaggaggaguugaagaugggggaggcugcaaggccuuucuauguugcuuuuaggaacagcaaaugccccaugggacaucaguugccuagaaggcuguccaggggcagguagguauagauccugggagagcaauguaaagccugcagacaugggguuuaaccuguucagaucugaaaccaauggaguggaagcaaggagacuggccuagguaggggaaggaacuucagugagccaaauaaagaugccaagugucauccagugggcaugggcaagaggggaggcuggggcauuuuaaggucaugaugauaacaaaggggaccagcuggagaguucccugguauuuuucguuggguugcuggagagacagaaccacacccugacagaagagagacaguaggaaggucaguuuggggcuggaguagcgauuaagcugaaucuacuucuguaggaggugucccuccaaccccccuacccccacuguguggccuguggcuuaggggagguaaacaaaguggcagauaaauaaaagccagcgguuucucagugggaauuacggggagcauaggugcuugcgaaucagagaaagcuuaguaggugucuucucaaaucugugugugugcuuuggaaaccaaccgaauaaaacaaugaauucugagucugacuccugccuugcuaccuugaaucccauggcuaaaugcauugguuaauuagguuuuguuguggcgguuguuuugggggagggcucaauuugacauuggggucaucugggaagagagaaucuagacugagaaaagucuccguuagauuggccugugggcacaucuugauuaauguucuugauuaaugauuggugugggcagcacaucccuagacaggugguccuggguuguauaagaacacaaacgauauuuguaguuuuagggcuggagagauggcucagugauuaagagcacucaucggcugcucuaacuugagguccugaauucaauucccagcaaccacaugguggcucacaaccaucuguacugggaucuggugccuucuucucgccugcaggcauacaugcagauagagcagucauacauaaauaauaacucuauaagaagaaagcaagcaaaccagcaugguucuccuccauagcuuugccuucagcuccugccccgacuucccuucauguuggaacaugaacugaaauaagcccuuuccuccccaugcugcuuuuggucaugauauuucucacagcaauugaaaguaaguugagauacaaggagaacgcuuucuauuuuucaguguacuuucacuuauuccuucacuccuucaccuauucauucauucuuuucuucucuuucuuuuuaauuuuuuuuuuuuugaacacgguaucucuguguaguccugguuguccugaaacucauucuguagaccuggcuggccuugaacucagagaucugcuugccucugccuccagagugcagggauugcacccccccccacccccaaccccagcuucguucuuuauuucuaaccuucugugaugagggugaacauaaucaaaauauauuacacacaugugugaaaguaucaccgugaaaaccauucuuucguauaucguuagcguaagguaauaaaaaugacuacuaaccccugaugguaugggcuccuuacuaguucucagugggucucaguguggucugggugagauauggucugaaguacaaugaagauaguuuagcaccagcacaacuuagaucaugguauagcgugucagaagccaagcucuagaaaagauaaauuuaaacauagcugggcacauaaccaaggcugcccuaucagcauugucaaaaagauaguuucaaucuauccuauuauuugucaucuccccagcccuccuaaaauuuugaaaaaaagagagaaagaaagaaagaaagaaagagagagagagagagagagaaagaaagaaagaaagaaagaaagaaagaaagaaagaaagaaagaaagaaagaaagaaauggggccagagagauggcucggugguuaagagcaaggacugcucuuccagagguucuaagugcaauucccaguaaccacagaguggcucauaaccaucuggaaugggauccaaugcccucuucuagugugucugaagacagcaguaguguacucauauacauaaaauaaaaaauaauuugaaaagagauuuaucuuacauguauguacauuuuggcuuacauauguguauguaugccacacuugugccuggugccaguggaggccagaggagcugggguuagagucuuauucaguuguucagguugcccucaaaccuaugauucuccugccucagccucuccaaagcugggauugccgauguguaauaggauacucucuucuguggcugacugcuuguuccccaucuagagacucauucacauugauacacuguuacuauuauuguuauuuuucuugccaaguaaaauuccauugugggggcuggagagauggcucagagguugagaguagugacuguucuuccagagguccugaguucaaaucccagcaaccgcaugguggcucacaaccaucuguaaugaguucugauguccucuucuggugugucugaagacagcuacaguguacuuacauauaauaaauaaauaaaucuuuaaaaaaaauuuccauugugggacacaccaaauauaucuauacauucuacuguuauggccucguugggauggcuaaggcacacuugcaaaaaccauguguguguguguguguguguguguguguguguguguguguguuuguguguguauacgcuauuuccucuuuuacagaguguucugggaauguggacacauguucuauucaauucuguuauguaaggacucccugcuagguacugugacacugaccaaagaggcagacagaucaauguaguguggggggagggggagcuuaugcaucacagaagcaugggccugaccagcagcaagaucauguggacuccuggauuuuggaucagaaagugucuuagccacuauucuauuacuaugaagagacaucaagacugaagcaacuuauaaaagaaagcauuuuaaugggggcuugcuuacagcuucagaggugaguccauggccaucacaguggggcacauggcugcaggcaggcauggggauggagcaguagccaagagcuuacacccugauucgcaagguagaggcagaaagagugagacuuggccuguugugggcuuuagaaaccucauaguucacccccacugacacgccuucuccaccaaagccacuacacuuaauccuuccuaaaacaguuccaucaacuaggguccuagcauucacaucuaugggcuuaugaggccauugucacucagaccaccacaggaagaaagguguaauuaugacuuagguaagugaccguccugguuucaguguaucuaacuuaccuuaagauaccacugaagaguugggugcaucugugagccugggaugagguagaaaacuccagauaugaugcuaaaggguuuuuuucuauguacaguucucugggaucgugugggagaaagcagccagggugacuccaggcugucuugaaggucacaccucaagauggcuacaguuguguccaggcaacugcccccucacaucugaguggcacaagacugagaaucucaggaauacagcuuggguggagaagucucgucccuugggagcaaguaugggaggaagaguugggggcuggccacuugcagcuugaggaggcuugguuuggguucgggugccucugagaccaagucacggccuacacacgaugccuugguucugagcaagugacggccaaaccuugaagaagugcaucucugagagauggaggagagaaaucuggggguacugggguuuugcugauacccaaugcagguguuuauagccagaaaggucagagcuguggcuagaguacugaccaauuacacuuuaggucccaagguagaugagcccuucacaccuuucuuuggaauuauauccuauaauaggcuuucucugggucacaaauagcagcucucaguuccacuacggaauggacaauacuggaagugggggcaccgucaggucuagaguuacuagagcugaguggcuuucuauuugcuaagcucaaguccucuacucuuccccaggccagcuucacacugaagaaugugaagagagccgucuccacuguccuaucugaaugagagcccuguguguguguguguguguguguguguguguuuguguggguaaaugugggugagugagacugggggaggcuuggugggaaggugggggauggucagacacuugugcaaggggugcuugcucuaugcagcuauuucuuuaacuagauuagaagcaaauaugccauggauucuggaauggggguuaauaucuucccaauuuuguguaucuguugcuuuaaaacuucaucuaugggaagccagguaugguagcguaugcuuuuaauuccagcauucaggaggcagaggcagguggaucucugugaguucgaggucagccuggucuacacaguaaguuccaggacagccagggcuacacagugagacccugugucaaaagcaaacaaauacaaacgcaacagcaacaaaaaccuucauauugggacugggaauacagcucagugguagagagaggacuugccgaguggcuaugaggcaagaaacauaaacuauaagccaaaccaaaaccauaaauaaaguaaacccgaaacccaguauuaaacuguuacaggcccugaauguuuguaugaccugaaacuuuuuggguuucaaggucauauacauccaacagaggccauggccucucuugccuaaagggcucacaugacccuucccccaccccucagcagugugccaacacccagaagucccuggagcuccggcugaaagccugcucugcuggaagaagggugauccaggcagcuggcagacccucagccagcucuauuaauaacccugagugcuggcgucucguugccuggcgccucucugcuugucucuguugcuggguuuggguuuuuguuuuccuuccaaguauaggaacaaccaugauguucuuugcugcugaguucaguguaagguguuuuuguuuuguucuguuucugacauguccagagaagucucugugucagcguuauggauggggauuccaagucuuccuuaacugaguagaaggcaaagugcgccggcaccuagcucugguuuucucgugauugguuuuuugaagagauuccuccuccuccuccuccuccuccuccuccuccuccuccuccuccuccuccuccuccuccuccuccucugucaucauugcugcugcugcugcugcugcugcugcugcugcugcugcugcugcugcugcugcugcugcugcugcuacuacuacuacuacuacuacuacuacuacuacuacuacuacuacuacauauaugcaugaucuaucuguauguaugcugcauaccagaagagggcaucagauuccauuacagaugguuucgagccaccaugugguugcugcgaauugaacucagggccucuggaacagcagacagugcucugaaugguaagccauuucuccagcccuaagagauuucuucuuggaggcaggaucuauuauggcccaggcugcccugaacuuccuaccuccaccucccaagugcuggaauuacaagcaugagucaccaagccuggcuggaggagauuuuauucaguucgugcagcagaagcacugugcucuugagugucaccuucgugaagacaucauggauaaagcaagaauccucuggaccguguucagcaguggcucugggcucuuuccugcucacucacgcaguucaguuguucuccuucuugguggaugacacauauacacagugcagguucguuuguuuguuuauacaacuggcagugcgaagcacauucugcgauguacuuugcaacaauguaacaacauguagcucuuucucgaggacguaggaacuuaacuccgccucuuaaauuacuaaauacuauuuucguaguauauguacaacauagggcacucaacaacucuuguugaacauuggagauuucccuuugguccauagucuaaguagugcuguguauugaacauugugugcuuguguguuucuguaugugugcugugugauguugguuuggaauguuuuuuggaaccuuuaggggguggagccucacuggaggaagucaccggggucagaccugagccuugauagucuggcccugcuuccuuucugcucucuguucucugacuugaggcaguaugaccagcuaccccugcuucuggcacuaugucuuccucccacaacacucuauuccucagccaaaggccacacucucuuaaguugcaucuuguuagauguuuggucgcagcagagagcaaagcaauuaauacaauauuuagcuacaacccaaguuaucgaggaaacaaaagucaaaaccacagcaagguacaauuccacucacugggacugcacuucuuuuauuuuuuaauuuuuuaagccagaaaguacaaaugcugguggauaugugaagaaacuggaaccccaaaucacacugcugaugagaagggaggugacauaguucccuggagcagggugugucuguucuucaaaauagguguggcugagaugggguggagcucagugguagccugucaugugugaggcucuggguucaagccccacaucucuaaaaacauuucagcagccgggugugguggcacacgccuuuaaucccagcacucgggaggcagagacagguggauuucugaguucaaggccagccuggucuacaaagugaguuccaggaccgccagggcuguacagagaaacccugucucgaaaaaaccaaaaaaaaaaaaaaaaaaaagcauuucagcagacacucagacaaauacauguguacucauguucauuguuuaauguuuacauauucacaacagccaagaggcagaagcaacucacauguccaccaagagaauacaugagcaaaaugugcuguguaaacacaguaguuaacccuuaaaaggcaacagcaggggcuggaagggugacucagugguuauguguacacuguuccuguaaaggauuagguucaggauuuagaccucuuacugggugacucacaaccaccugcaacuccaguuccaggggagcugauagucucugggcucugaaggcacccacacuuaugaguguguauguguguaugugugugugugagagagagagagauugagagagagagguauauguaugagaugugugugcacacauguguacaugcacauguacacauauguguacacaugugaguguauaugaauguguacaugugcauguggguguaagaggguugugugugcauguguguauauauguauauaugagagagagauauguuugcuuguguguuucuguaugugugugcauguuugagagagauguauaugugcauguuuauguauauauauauaugagggagagauguguguguguguuugugugugcaugcauguauauguguaugugagagagauguacaugugugcauauacguguauguacuuauaugugagggagagauauguguguguuugugugugugagagauguguguguaugugcaugaguguguauguauguguacaugugugcauauauguguguguguguguaugugugugcacaguuuuaaagaagcaaaccaacaaacggaucuaaacuuucuauagaaaagaaccaagccaggcaguuuugaaaaaggucagaguguaaggacucacuccaccuuauuucaggcucuagcaguagagccugugugguacuggugagaugaacagaugugggucaaaagaaagcggugaguucagagguagggccacacauugacuuuccguaaagacagggagggcagggaucaggcuuuguagcaaggggcucuggaacaaagccuccugucugaaaaugaacuuugacccauccauaccuuguauaaaaugaauuuuuguauuuuacauuuuuaauuuugaauuuuauuuuuuuggggggaggccuggagguaggacucacacacgugccacaguguggaggucagaggacaacuuguaguuccuggugguggaacucaggucaucagaccuuguggcaaguuaccugcugagccgucuugcaugcugccgauaugcaacuugauuugcauugacuugugaauuuaaacgcacgcuuaagugagugaccccuucgguuugcuucuguauuugagacuaagucuaugugcauguggcuggccucaagcuugauaucuacccuugaacauacagcagaguuguuuguuuaugacaaagccuuacuauguagccuuacuauguagcugagacaagaggacuggcuucacucaguccucuugccucagccuccugaagggugugggcuuacaggcucacacccacacagcugccugcucuuucaucuacugcuucagugccagcaccggaagucaggucucgcauguuagccaagcgcuaacuccugagacuccucaaagaauccugaucugccauauacggcauuagaucuaagacggcuccaucagugagacagcaaaaaggaaccgaagccagcuuccccgucauuauggaaguccucacgugugaggaugcgccguccaucaggcagggcuuucauuggagcgcagugaugguguggcgagauacgauuggccgaggauucaugggcuugggauuggcucaaauacuguauguaggcuuaugugcugugcauuaaacucagaucugcacccugaugcuggucuccagagucugauuucccgggauuugucacgugacucuguugcuucucagcacuccacccccaauccucuguccuguucccacaggaaugcaaauuggaccaaaguuucuccguuucuuacaaaguuaagcacucauucaaccauaacucagcaaucccgcuuucugguauuuaaguaaaacauaaacucagcuuuccucaaaauccucuaagugaggaugcauucaugauggcuccaaacuggaagagauagacagcuuagcauaucuagaaaacagaacacuuggcaguaaacaggaguuguugaccugugggacuccacagauuacccucggauguauuaccgcacaugcaggaagccaggacucaaacgacuacgugcuguguaauuccacuuaugugagguucuggaacaucuagggacagaucaguggcccuggggcuggagggagguuaacucccaggggcauacgagggaucugggaacgaggagcuuguuguauauuucauuuguaaguaguaguuguacaaugguguugucgagaucugaagggauaugaguuaaaaggggugaacaugauguaaauacaacuuuacaacuguauuuauuugugugugugugugugugugugugugucugucugucugucugucugucugugcuugccaccguauguaugcugaggucagaggacuaguuuuuuccggaguuucuucuauccuccugccuuuacacgguucugggaauucaauucaggucgcaggcgugugaggcaggcacuguuacccgcugagucuacuugcuggccccagccauaguuucuuuguuugggaagaucuuagugcagaaugauagaaccaguuagggacacucuuggcagacuaaaaccaauagaauuaaacaugcaguuauccaguugcccagggacuccaacacucacagguauuuagccaaaagaaugcaacaucugaucacaaaaagccagguucauagagaacagacaccaaacacugaugacuuaagcaaaugcuggugaguuuacacauucaaucccauacuaaagcggggcaaguggcugaucuaugcugcaauauagccgggucucaaacacugggcagagcaacagucagccacagagcacagagacugugaagggucagggcgcaguaggcgaccugggaggagagcauuugccugaggaggagccugggaagugacagggcacggaggacuacaguauaguuccccaaacuccugagcaaaagcgugugccaccgacaucuggaugacggccaagccuggguggggggaacugaggggaccgugacacaggacaccuucuaggauaacggaaugguuuguacuuaguuuggagcaaucaaaacucugaagauaaacaauacaaaacucucgcaagccucugagucaaacacauaacaguguagauagcuuuugguucagauaaucuccauccuaacaugacagaguguaaaauauaaaacauacagcugcaaaaggcacagaggcagguggauuucuaugaguucgaggccaguuggugugcagagugaguuccaagacaguuagggcuacacagaaaaacccugucuccaaaaaacaaccaaccaaccaaccaaccaaccaaccaaccaaccaaaaccuuuuaguuggguaggagagauggcucagugguuagaguacuggcugcugguccagaggaccuggguuugauucccagcacucaccuggcagcucacagcaucuguaacuccaaucccagaugacccaaugaccucuucuggccucugugagcccuaggugcacauguagugcuuuuacauacauguaggcaaaacacccaugcauauaaauuaaaaggaaacaaaucuuuuuuuuuuuaaaaaagagucuuuuacugugacaaaaagaaaauuccuaacauaaagccaacuauccuaacuuuuucuuuuccuacaguccuaggggucaggggcagggccuccucagacuaggcaggugcucagcugccugagcuacacccagccccccaaccaucuuugguauucagccucaauguacagucacauugugcacuguggcccaaauccuuuauguucccaaauggaauugucgaauccacgagacagcagcugccacuuccauucccagccucuggcuaccaccccucccuccacuuucuguuucuuuggaucugacugcucugaauaucacaggcuggcucguuucccucaacacgauuccauccauucucaacugugaaucuguccuucauuuucagggcugaaccguauguggauuuguucuugggcacacggaggugacugugccaauaagaaauaagggaaguucagaugucuuucgucaccuuuucccacucuucugggcacuggccuuguagcugaaugggaucacucugagagcacccgguuugacagugaccuuggccaugcaaagccucauuuugucuaaaggacaaagugaagcgguggcucuaaagccuugugggauccuuacacaacagucacuccuggccugguuggcuccucaaguggcccucugcccuguggggcgauggggcagcgggggcagaaagcccuagggagagggugcugacuagaccugugacaagcccccaggggcaaguaggugcaacacuugccugcagccaacacccuaacccuuucuggguguagguugacaguguuaaacacagggagggacacuuaaguagcuugcggaacuuucucuggccugcuaucugcccuacugaggccaucuacccccucgcaaucugugcuucacccccccccccccagcagccauaagugacaguuagugacagggaaaccugaggacuuacaaacaccuucgaugggcugcaagcuuguguucucuguuccacucuaaagcagaaguaguuauaaccaguguagccccguagguaaggcuuuucagggugguugguaacaaugagucauuuucucaggcccuggacacaggccccagugcaguaccccccauccccaccugagcaaggcugugggaaccagcuggaaaaaaacgaagcucaaccccgaaugcaucugcuccaguuggcucaggaagcuucaagcuccaauuucagucuucauucccguaccuucaggaccagguggagaccacacaccuccccaaggcacacuccccucugucacacccgcugguuaaucuucucccccacucucccaggaacaggaaacaacacucagagagguccuacacucacuuggacaccuggcuuucugcaggugggaucccuuccaaagacaccuggcuuucugcagcacuucuggauuuucagguuuucugaaauaagccacaagucuuucauucaaaaaaaaaauaaaauuauuuucuguguguggguggguguuuuggcugcauacaugucugugcacugcacugugugugaaauacccaaggagaccaagagcagauguugggucuccugggacugaagucacagaugguugugagcugcuguguggguguugggaagagcagccagggcucugaacugcuaagccuucucuccagaccaagccacaagucuugaacuucuuacuguggcuacuuacccacugccuuuggccugcuuaacgacugugaugucugcuucacacccugccacaguuacauggcacuugcccccagacgugcucugccagcacccaggacaauuuaccucacugugugcuugccccaaagccuggcguggcacuucccuucccaagcaaggcaucgucugccauuacccugaacagcuuuucacuguccgugauaaggcagacacugcaguaggggucaugagguaccaugaguucacagugcugugccuggcacuguagcuuucucucaggcuggucgcagcaaauccucuggucacucugccacccuacaaccaucauaucagcgauucacugauuuaaguuuacugcacauguucuagaugauucugacacacacacacacacacacacacacacacacacacacacacguauauagugcauugguguuuugucugcaucaaugucugugugaggaugucaggucuccuggaacuggaauuacaguugguugugagcugccuugugggugcugggguaucgaacccaaguugucuggaagagcagccagugcucuccaccacugagccaucuuuccaguccaugguucuguguuauuuauacuuuuuccuucuuagaacugaauuucauccugucuaaaugucaucuacccuuggugaucuagugcaaaggugaucuuuuauguaacgcgcugagccucggaguggaggcucuccucagcagcccaucucuccucccuccaacacugugauuucuuucuacaccgaugcuaguugauaacuucugugguauggcugugcuuugugcucccaaaguuuccugucuugagaaccucagcccucaagguggugauacugggugaguggcccuuuaagagguggagcauagagggagcuggugaggucaguugggaaaaugcucaaggaaaagaagcaaagcucacaucucucuggguuccagucuugucaagugaccucuugguccccuaugucuucccagugcaugagguaaugaaaccaaggggucccauugccaauaugugcgccaugcuguuuggacuuucaaccucccaaacuguaagcuaaaugaaacucguuuuuuaaaccaggagccugccucucuuuuaaguauagcaacaagaaaucugauacaauaaccuuugugcaucuguuuguaugcacgcugucuaccuuugcauagcacuguaagcucugcgaagagaggagugauguguguuaaaggugacgcuggcacuuaggucagaaucuaauuauagcuguaggcagauaugggagaaacgucaagucuuucccagcggugaacgcucugagcagcaaugacaaccuaccaaacaagacugugcuacaauagugacgcgacuauaagcuggggugacuaaauauuuucuaauugaaugugaggcccaccaugguagacaaauugugucugguacuguaagaccauucaagaacucagagcuagggagguuaugggcccuaguguugauuugcuaaaugguuacgguaucugcuuuacgguauugcugugaauuggggagaaaggggguuuauuugguuuauacuuccauauuguaguucaucaguccaggacaggaacuccaacagggcaggaaccuggaggcaggagccgaugcagagcccauggaggggugcugcuuacuggcucgcuucccuauggcuugcucagccugcuuucuuauagaccccaggaccaccagcccagggauggcaccacuuacaaugacuugggcccucccccacaaucacuaauuaagaaaaugcccuacagcuggaucucagaguugcacuaaucuagguguccacugaacaaaauaguaguaguagguucaacuguggcaccuauggguuccacagcuggguugucagagcuauacuaggugugcaguuuuccuauggaguacaccuuagauccgaucacaaagcagucagucaccacuguaucguuuaugacacuauuguauaucuauggacacaucuugcugggauguuuauuauuguggcucacaggguucacaagcuggauagauaagacuguugauaacgucucccccugcagccuacauagcgugccuuacuguuaugaaaauuagccgccagggaggaauuauccuggucaacaccagguugauguuucuaaguccugagaccaaaguguauggugccuucaagucauaggguuucacccucaaguucuggcaagcacccaggcgcaguggcaguagccuguauuguucuggagagcuucgggacaucugugaccagcaacuggaaggagaugucccacggcuggcacugggcuuuuuauuugucaaccuguggcuuuuugcccacuucuuuucuaagaacaggacagauacuucccuuugcaaagugacaaaaacuucucuugugauaguguccccuuccuccauccuaggaggaaagugacuuguuacaggagagucaggcccaaguuguguauguguagacaaagcuucauggaaacaaacucucucuagcuccuaguuacacuccaugauacuuugaagcucagcuuuguuaaacuguauacaucaccuaaucuaacuauuugaguuuacuuuucugugaauucccacacacauaaacauggcuaaaaugccacaucuuuccuccuguuaaugcuuaguguaugauuuguaggcuugaauucguugagcccaggagggcugagacaaucuuuuucuugucuaucaauuugcaucucaucugauuccugcccugcagggggcccuauuauuacguugucuuuaucucacugaugacaaaacaggcauaggcaguauaagaauaacuaguucuaaagccgggcgugguggcgcacgccuuuaaucccagcacuugggaggcagaggcaggcggccuggucuacagagugaguuccaggacggccagggcuacacagagaaacccugucucgaaaaaccaaaccaaaacaaaaagaauacuagaauacuaguucaaguuucacacugaccaagacacagugacaaucacauaguagccaucacuccguggccaucacauuguggucauuacaagaugaccaucauacagugaccaccacacagcagccaucacacaguggucaucgcauauaaucagugaccaucaaacaguuaccacccauggaggccaucaccuaguggucaucugcaggggccguuccacauuacccauagcacauggucacuauauggccaccguuacucaaggaucauuacaauguggcuauauaaauacuaauaagcaauaucacuggaauaugguaaguguuaguauguuuaagucagaugaauuaagauuuuuuuucaguacuccggagagauuuugggaaaaaaaaauuaaaccugggauuccuaugcccagaccacacagcucugucuccaucuuaugucuaacagagacugaagaaguagcucucacaagucauuacugcagccaugagcaaauaauaauaaaaccgaaacacauguccaaaaucuaucagagcuaggugcgggaaggcaugccuuuaaucccagcacucugugaguuaggagcuaguguggugugcagagcaaguuccgguccagccagggcuaucugagagauucuguuucagaaaggaacaaccaaaaaaaaaaaaaaaaaaaaaaaaaaaaccccaaaaaacagcaaaaacaaacaagacaaaacucuuuuuuuuuuuuugucuuuuucuuaauagcccuggcuguccuggaacucacuuuguagaccaggcuggccuccaacucaaaaauccgccugccucugccuccccagugcugggauuaaaggcaugcaccaccaugccaggcaaacaacaaaacucuuaagugagcuauaaacaaucaaucaaguucccccuuuccccuucccccuccaagacagggguuggggguggggugagggugaggaguuuucuccagccaauagccuuggcuguccuggaacucacucuguagaccaggcuggccucaaacucaagagauuugucugccucugccucccaagagcugggauuaaaggcgugcgccacucacagccuggcaaguuuucuuuuucuuauuagacuuaugauuucacacauuuuuugcaugauuucuauugauacuuuuugguuuuucagggacgauccaacucaggacacaaaacggcauauaauccaucaaaaccccgccaccuugugccuauacaaucauagauacagaggaguacugccacuaagauuucccuacuuccgggaacauagaaucucacaaaugcucuuuguccaggacagcucgggaaccacguggucuaagcccguggugcaguucacuaucacggacaacagagggcgcuuuacccuuaggaaggugaguucucaacuaggccaucgcauggccaaggccaaggaagauagauugcagaguuggcauguauagaacuuucuggcaauggcuugaccuggcuagcuaggacccagcaauguggaacggugcaaucacacugcagcuugaagguccgugaguacugaggacaaagacaagcugcuucccaacucuccgucccagcacagaagcuuuggguguggccccauguagggacacgagagccucacccugggggccuuggaagcuaccugcuauuaucuaucuaucuaucuaucuaucuaucuaucuaucuaucuaucuaucuaucuaucuaucuaucuaucuauuuuagcauuacaguugauaggauccugagacugaauuggccucccugcuucuuucugggaagcugaccucaaaggccagcaguccccuuuggcuuaggagacuaugaagggccugaaaaaccugccugccucuccgcucuuaccugccuaccuuugugcugaggagaaacgggaucuaagaaggaagcugacaagagaugaagccgagacaaaaucaaaagccccagauaaguccuucucucuguuucucccaccccauaucuucaggcagagccaguuccuguaccccaguagcccuuacagagaccgcacaggaggccuggauggagucuuccauugggaacugcaggggucaguauguucuagcauagucccuaggugcuccuaaugugaccuugaccccuucagacuagucuacuuaccaucugaucccuccugaaucagaccuggcccaccacccaggagguauuuucucaguacaguccagacacaccucuaccuccaggggaacccgugugcagacaugaauccaaagcacacagaaagagagcuguccagcagcccuucaccuuuagagggacagcaguggguguggcaccucaauggcaucucucggggagauauggacacuccugcagucaucagcuguuggagugaacccacaggugggcggagggcuucucaacacccugacuuuuuuuuuuuuuuuuuuuuuuuguuaugguuccaggaaaccaugcccuggcugcggaaggcuccggcugaugcuggacagagagaaggaguaucuuugcugagacaagccaugcuccuuccugcugaugauccagucaccgggggugguuggaagaugcuguccuuggccugagcagcccacaaccucaucuguucccccagacauucagggauccacuuaccaauaugacuuucccaauguagaacaugcuuacaugccagcagcauucaggcuaacggcaccuggagaaugggguuauccugaaggggggcccaucuuaauucccuguucagucugagacauugugauucuccagcuuucuguauguaucuguaugcaaggcccuucugccagaagacacaccuaucauauaacugacagcauucucuccccaauggcauuguauuugcuaccuggagcuccugcuucuauaagcauuucccuacccacgccacaccuuuccucccucaccaucugauggccugcucugguccucacccagccccaccggaccguuccaaggucauucacaaggucacuuugaagccugggggggugggggcuccccaugcugugcccuugcccagcuuccccaugcccaaugccucacugggugccaugagacugcagacucagugucuggcuccuggggcaugggcccauaagaaguuaguacucaucaagagccacaagcagaacuuccaacaacaaaagguuccaguucaggccaucugucgggggcagcugcuggcaugcauagguugagugguggcaaguguuagcccaggcaaacagcuggacacaccauggcccagucucuccccaugcuggcuacauuguagccucaacagguagcuuuucuuuuccaagugacugcauaucaccacugucucaaguuacuuuuuccacugcugugauaagauguggcgaccaaggcaucuuguagaagaguuuauuuggggcuuacaguuucagaggguuagacuccaugaccauuaugggguaaagcauggcaguaggcauggugcuggagcaguaaccgagagcucauaucuugauccacgaaacaguuaacugggaauggcaugggcuuucaaaaccccaaacccaccccucagugacacaccccuuaaaaacaguuccacugagaaccaggcauagaacuauccugaccccuucauggauaaucggauaauugggaaagugauuaguggggcuggcugaauugggaagccugggagagaaagggcugaagcagccaggacaagaagccccgaucugggaggugguuuucacagugccuguccuuccuggaagucuguguugcugcacacacuucuccagguaccuacuggagcaccguuuaaucugccuauugaacuuccacucccaagcauccaacaguguaagcucagggguuaaacugcauccucucacacagcucugcccaucuuauugauucacuggcucugaaggauucgggcuacagacguugaucuuuugacuacccuguguguguacaugggggucagaggauggcacugggagucucccucagucacucuccaccuuauuuucugagucagucucucccugaaucugaaggucaccaguuggguagaguagcuugccagcgagccccagagauccucccgaugcccaucuccaguguggcaucgcaaagcagguccucacgccugcaggcggaaacuuaccaaccgagccagccaccucccuggacccugcuuacacuuuuaaacauuugcucuaauuacacuuugccuccauaggaaaaacagagauaaauguuguuuccaucugaggagaggcacaggcaccaaauucugagcuauaccaagaacccggagugcagaaugcaaaugguuuuucaaucugucuaagcuguggagcagcccaacaagacauuucugguuuccuuuaauauuaaggugaggcaaucuauugagccaugggagauguuacaaucuuugaacuuuuaaauaauaauuaauugugcacaguaaagugccugucuauaaugauuaguaccauauacuuuaaaaugcuagaacaaaucgcuugaauguuuucucauaaaagaaauggcaaaucaccagguaggcuuuacugacuuaaacauuaauuacauagugcacauugaaauaucacauguaucucauaaauauauaacuuuuacaucuuuauguaucggauuauuuuuaagagaacagacaagacagcaacaggccauggcuuugauaaaaugugacagacugaugucacuguucuuugccaccaaacgcaacagccacuucaccgaagcaggagcuggucacugacacagcacaccccagugacaacggaacuacaggggagaauuuguacaggacaccgcacuguagcuguuuggagaauguuggagauaaauucacuaaacacaaagcaagacagcaaaucccccugacgcuaugcauuugguggcuuuccugugaugcccagggaugucccucgagaguucugauauaagggcaggccauaagcaagaggcuaguggcuucccugaggauacaaaccagagcacaaacccauaccuggcugacccccugcuauggauggcagggcguuuauuauuugguuaauugagaaaggcagguaggucuccauggcagugguucucaaccuucccaaugcugugacccuuuaauaccauuccucauguugacuauaaaauuauuuuuuguugccauuuuauagcuguaacuuggcuacuguggcaaaucauaauauaaauguuuuccgauggucucagguaacuccucuaaaaggguuguucgaccccuaaaggagcggcaacccacaggguugagaaucacagcucuauaggaugcuaccgcaaagcuguugugauagagagggaaguuagaggacaguguguggaaguucaccagaauucggaagggauggacucgccgaccaccugacaagauggaggcuguuuggaacagaaauaaaaauguccugagugggaggggggugcgugccuuggagcagcacagaaaaaaccgaccagcucuguuccuggcaggucuuucggggaaugagugaaugggcaaacaagcaagggucccugccuggcccaaccuuggggcuuccccguuccccagcgcucucuacuucucuuggaguagugcagacauagcuuguuuaagugcucugagggcccaaggguagcuuguuccgggggaguuuuuauuugaaaauaacucucauaauuauucacuccaggagaucuucauaaucauugcagagucucugaguaauuucuuguguagcuacguauaugugaggugcuguuuugaguguguucugagaaaaaaaaaagaaaagaaaaaagaaaaggguucaaaugcaggccuacugggguaaaucagagaacgucauagugccaggcauggcagcacauguccgucaucccugcggcgggagguggaggcuggaggaccaggaggucaaggcccuucuuggcuacacagaaaguuccaggccagccugggauucaagaaaucccuucucaaagaaacaaaacccucacguauggaaaacugcuaccagaaugacucgcaggcauggauaaacagucacgcagauagauacagcagcuucaggagaugagccuaacagccaucucagaauggcuuagcugcuuuccgaaguauucaguagcuugaaaaguccuggacauuugaucccacgaagauaauggaugagagcuuugugguuugccagggccgccacagagaaaggguauucgacaaagcacagagcuuauauuuucucaaaacaagggaaacacacaaagcucucacuaauuaagagaaacguauuuucuggcacagaagggaagugcugucucuuuccccuccgacagcaaccguggugugccagguguagaacugaccagguucaagagauggaaaaagcccugaggccuuguuaguacagauauuucagaaccaccugggccuugucugcagucaccuggcacaacagucuaggcccccagcuuaacuuggaaccaaaauucuggucccuagugcugggauauagcucagugguacaaaguccaucuacucugcaugagagccugaguucuaccccagcgucccccuacccccccaaaauuccacuguuuaaaaaguugcaacuccugaaagacuuuauguuuacaaaaauguuugucacaaaauauuuuagcacuguuuuucaguuucucauuuuuuuuccacuuucaguacacgugggcuucgauaaaggguucuguauacagcauuuuaauuuauacgauacacguacucccugaaggucaacugaaggcaguauaaaaaaauggcuaaagauuaucuauguguaguuaaauacaaccuguagaucaggagacugauauuuagggaaaguuuucaccgucgccauggucgggugccagacauccaagcugagcauagacgaccagugggguaauagcaguaacagccuugccugagaaccagaggcuggaggaagacccaaagcagaccacuauaauucugauuuauugcauuccgucuuaccacggucaggggagggccugagagcccguucuaaagcuguaucaccugagauuugcauucuggaaaaacaaucaggauggaugacuaacacaccccucacaagaucuggguuuggcucugaugaaaagaacacguaccgaccugaaaaggggcuacacgagauuagagagaaucagcuaagcaccgaggcaaggcccagggagagcuaugguagacuguccuggaacuuaagccaccgggacagcucuuucccagguugcugcugcguuuuuagccuucgagcuguguguggcucacuucucaucgucucggccguaguuaauaguuuguagggccugagcuaugagcacugccaucucucuggugccagcagcuacgacucugcacgacaugaggucaagggguccaccugu

SEQ ID NO: 8962 - RNA, 15735 nt, Mus musculus
cgggcgccccgcccccacggcgccgcgcagcaucccgcagagcgcggagcccgcgcccugggccugcggcugcggcgaugaagaucuggagcucggagcacguguucgggugagccagcggagggcugcgcugggaaacgcguggaugcggucagagccgugcggccucggggaggggcgggaauccgggaccagcaagcgcuccggagccuggaucacggccggguggggagcggggcggcaggugcguggcgaggccuccccauccucagccgguuugugucggcggcaagcugcgucgugggggcgucgcgaucccaucgguaauagggcagcggccuguggccagccucccuuguagcgguugucacccacuguacccaaggggcuugggcucgggaaaaaucuagacgcgaggaaggcguuugggguguuugguccugaaucccugugcacccggacacuuccaagccaccagggacaccgugaacugccacgagugcuccccugacccgaggggcgccuuccuucuccccaucgaguguuuugauuagcuuuucaaaggauuuuugagacuuucugaucccgauuggagaagcguuucguuccgagcggggguggacguggagagacugcaugaaacagaauugucguccauugucuuuuaaaguguaaauuuuuuaaaauaaaaauugaucaccuggcuucaggacgucuggcuuccuuauuuuuauuuuucgauggugcugggcccggacccagcguuucgagccugcuagaaaagcguuccaucacugagcuauagccuccuccucuagaaaaaaaaaaaaaaaaaacccuuuaaaaauuuuggaacuuuagacgggugguauguaaauuuuugguaaacuuggcaggccuucugaaggucuccccaauauuccgacguaauuuguaccgccuagauggagagacggguagaaagucauaaaguacagagaugccagagacuuggacucgcagggguccugaaauguugacugccacuggaaagucacuguugacaauuuugaccauuuuugcagcuuucauuuuuuuguuguuuugguuuuuuuuuaaucauuauuauuuacauuuuguaaucuguaauauguuaccacucauuuuaauguauguguguuugggggagauucuuuuucuuuuuuuuuuuugagauaggauuucacuauguggccuuagcuggccuggauguucuugcuguguagaccaggauggucccgagcucacauagaucugcuugccucugcuuccccagugcugggguuaaagccaugugucaccaagguuggcucuuuuuaaaauaucuuuaaaauuacauuuaaguaauuugugugugugguauguguacgagcacaagccacauugugcaagcugcagucaagauaacaugggcagucgguucucagcuccuuguggaucaggagauccaacucagagucgaaguuugacagcaggcaucuuuagcagcugagccaucuugcuggccccaagucauccauuuaacaauguguucugugauucugggcuggggacuuagcacacugguuaaagaccuugccgugugagugugggggcuaaaguucagaucuccagugauuggaguggcuggccugugauucuagcuugguaagguagagauggagaugccuggagcaaguuggcuggcaggacuacccugccucagucacaggagcucugcaucggucuugggccugcacaagcaugcacacacaagcacgcacaccuucaugcaccugcgcacagcacucacccucaugcacaccacaugugaaaagagaacaugagaaaaacuuuaaauguauuauacaaaugaguaauuuuuaguauaauuacagaaauugcuuuuuuaaagauuuauguaucuauuuuauguauaugaguacacuguagcuguacagaugguugugagccaugguugcugggaauugaacucaugaccuuuguucgcuccagccccugcucuccugccaaauauuuauuuauuuaguauaucuaaguacacugcagcugucuucagagacaccagaagaaggcaucaucccauuacagaugguugugaaccaccacgugauugcugggaauugaacucaggaccccuggaagagcagucagugcucuuaaccacugagccaucucuccagccccccagaaauugguuuuuguuauuguuuuauuuucuuugcaaauugugcagccaucacugugguggucuggcuuuagaucaucucuguuaucgucuagagagauccugaacuuuaugugggagaugaacucccucuccauuccugaccccagaaaccacuggucuguuucuguagauuuuuuuuuucuccuggauacuuuauauaaauagucaacaucauaugugguauccugugucugguuucuuuuggaaaucaucaccaucaucaccaucaccaccaucauaauuuuugaggcucauccgugugguagcauguguugcuucuuuguuuugugucccagguacccugccagugccugacccuggcacuguucauagggagggaguucacagggaggccagaugcccuuccagaauaagggcagccauagacuuccggcaggcugucagcacccacucagggcaguagaacuuugagcagguggaccuauagcuagcuugcuuucuaguaaggagccggggggcugggggggggggggaagaaauuaaccuucuggagaggcagagcauguccacuugcccuucucuucaguuuugccucuuccuuuucuuuucagccaagacagcugagaugguaaauaugguagacaugcugacacgugauaagcgugccagaauccacgccaucacauguaugucuguuuauguagaaauccgcauaaugugauuugguuuccccaaauagggaucaccgaccucaucucauaaggaucuuuuccucccaguaguguguuuuuugagcucuaacuaagcugauaacauaucuauggauauaggcugauguauauauauauagcuugaucuacuagcuguauaaucaccuaccuuaugaauguuauaauuuguccuaucuuaucgaaaggacacuugugcuuguucuaugcuuauggccugugauggccaauacuggccguuaucuuagguugagagacaugugggaauuaguaaggcaugccucuggguguguuugcuuuuccauucaguggcucccaaccuuccuagugcugcaacccuuuaauaugguuccucauguuguggugacccccagccauaaaguuauuuucauugccacuccauaacuaauuuugccacuguuauggauuguaauguaaauauuugauaugcaggauaccugauaugugaccccaaagaggucgugacccacagguugagaaccacugccauaggcaaugcguucacgaggucucugaccuaacauugauuuaauacaaugaaagugggaaaugguggacccauauaaguugggaccuuguuggagggagucaccuggggugugccguugaaggggugugucuuggcucucauccuuucucuccuuucugcucucucugucuugaggugggugagcuguuccuuuguacuccgugaucuuugucauuguguucugccuuguccaggcacagagacaagggacccugggcugaaucuugagaugucaaggcccucaguuuuguuuauguugauuauagcuuauauuaguuacuauaucagagagccagguagacuggcacagccuauaaccccagcacuuagcagggaggguauugaggcauacaaagacccuaucuuaaaaaacaacuaaccaacuguauauuaccauuagacauuuuaauugaaaauuuaaaauauuaauucauuacaauaaacaauaguaaccccuucccccuuuuguuuuuggacacaggguuucauguagcccaggcuggccucacuguggagcuaagggugacuuugaauuucaauccuucugugcccauuuucugagugcucagaugacagggcaugcaccaccauaccuaguuuuaaacuuguacuacuauacaaacuggaauggagauauuagauauuugccuugagugcaugaauccuggguucaguuuccagccccuuaaacuugacauagugguauaugccugaagucccagcaacugggagggagaggcaggaaagucaggaguccaaggucagcugagcauauaugaggcccucugucaacaauuuaaaaaaaucaaaaauuuaacugcguuuugcagaaauugggagacucugguacuuuaaaaauaauauccaugauuccuguauuucuguaguuugauucucuuaucuacuucugcaucugcuguuuuguaauuuuuagccuugguugagguguaccgguagaguccagcaucacacagauaaggagcucuaagacauaaaugucugucuuuaguuaggguuucuguugcugugacgagaacagcauggcccaaaagcugugcaucccuccugcggaaggcggauggucucagguuuguagugugggccaguuaggcucaugguaauagacacaaguuuccugaacuuucagcuuucauucaaaggcucagguuuuaucuuugggcaacaaacacuaaagugacggcucacucccucaacuuuccagaaacacccaccaaguccccaagucugagagaacaguuugugcauuguucuuuccagggcaagcaggggguguugagaggcagcuucugugugcucucaacacaacggcugauaaaccagggcagccugagauccucucguccugcagaaauguaucuggcgcgcguccuguucucuugcagacugucaaagggaagaguccucgggggucaagcgaugaucagauuaaccacuuuaccauuucaucacauaguccuuagagaauccugaguuguuuuccuaagugugugugugagcagcagcgugaccaggcugugguuuggagcccggccugcguugcugggaagaguccagcacuuugcccuauugcuuuaaggagucaucagugucaauguuaauguggugagagcuaguaaugucccagucacauuguggcaaccagguccagagcccucaggguguggcccacguucuguagaaccugauggagguaagauacagcugagcugagcuuugguccugugacugccucuucaccuccaaaccuacaacuuuuagaaauaagcaaaagugggaagagcagacuccuggauccauggugagguuccugggcugaguguuccucuuagaacauucauggugguuacccaugcauucccaccuuggccuuuuuacuaaaugguuuaggcaaaucuuuuuuuuuuuuaaagauuuauuucuuuauuauaugaaaguacacuguagcugucuucagacacuccagaagagggagucagaucucguuacagaugguugugagccaccaugugguugcugggauuugaacucuggaccuucggagggugcucuuacccacugagccaucucaccagcccaaaucuuuuuuuuuuuuuuuuuuuuuuuuuuuuuaauguuuuguuugguuuggcuuuuguuuuauuuuucaagacaggccuucucuuuuguagucuuggcuguaauggaacuugcucuguagacuagacuggccuugaacucacagaggucugccucccaggugcugggaucaaaggccuacgccaccaccgccugaccgauuuagggcacaucuuggacccugguuucuaugacccugccauugacugggguucucccuuagacacucucgcaucuuagcaugugugaugagucuucauugcugacuuuacuguaucugggaucaacugaaguguaagcugcuggacacucuugcgagggacuugcggaaagacacacuguuaagugugagaagcgucuucugauggccacauagagcaauagacauggaagaggggcgcguugcauucugucugcuugcucucacucuugccggcaaguccauccuuccuguugcuauggcaucccucgacggacauuagacaucaggaccaguucuucgggauucaauagcuucaagaccagcagcucucuaguaguucucuaggccuucagcacagauugggacugcugggaucagccccaugggcugagcagguacuggauucucagccucuccaaugugagacagccacugugggggcuaccuagacgguaucauguaaggcaaucuagcagauccccuuuccuauauacaaucaaauaauucauacacauucuccacgaccccccccccccucuucuuuagagaacuccaauauagcauagaagccagaauucguccuccuaucugccuuuuguugguccacauagcccuugccacggaugcuggggaccauucuggaauugguguggcagaggccucccuuccuuuaggauaggaccuagucacaccaugucucuguguagcuggggucucuugagagugguguccauucaacuccucaucugccagagagagagcuuugugcccuugcagcuuguuccugcaggcaaaggagccagcaggcgcuccagugaacagcucaguggccuucagccagcccugccauuguccauaccuaauccuaaugccacaagguuugcaugcuggcuguauauuagugguuucuucagccagcgggugcgauauugacuuugugccuagacuuugccacuuaauuuuaucuuuugauuuucgagacacaguuucucuguguagcccuggcuguuuggaacuugcucuauagaccagguuagccuguguucugucugccucugccucccugcuaggauuaaaggcauuugucaauauagccggcuggguuuugucacuuuuagaaauagcuuuagagacaacucucaacagauaacuccaguuccaggggaucugauacucucuuagccuccaugggcaccaaacaacgugggugcacauauaaacaugcagauaaaacauauuacagccaggcggugguggugcacgccuuaaauuccagcacucaggaggcagaggcuggcagaucucugaguucaaggccagccuggucuacagaggaaguuccaggacuacacagagaaacccugaauugaaaaccaaaaccaaacaaacaaacgaagccaacaaaaccaaacccacacauaccuacaauaacuucugugguuauuuuguguaaguauauuuaaacaaguuguauaucauucgagucugaaucagaaaugauggcaucguggcgauacacuugagggagacuuuccaggaaagcguaucaggaagggaaggagggcuagcugaccugacaguaguucucagcagugggguaaggcccauguuggacaucuggaagggagguuccuuuaaccuggcuccgucacagccgucugagguuugagguuaggucauggcucuggacaguaguaguaggcugcagucugaggcuuugccaucucugagagcaagagauaaauuagcuuagcuccgggcucugacuuagacagugugacucugcacaggaagccuugggugguucuugggucauccuuaagauuccuugggauucuaccggauagccaggcagucugguaggaccaugagcccuacuggaagucaggguccucuuacauuaaggaccgcagccagcguuuuuccagcgaggcgcagguagggaaauggucucacugcagagaagugcccacaaaagguuucugccuccugugggcuggaggaggaccaagacaggaaaagccagagaucaacuaagcuugauggcccuguguagucucagcacagaccuggggccccgcaggaggcauggauuuagacaacacccagggcagccugaccagaauaaacacaggagccuuagcuccugggccacuuccuaugcugauuguauucucuugccagccaucccugggacacggugaucaaggcggccaugcggaaguacccuaacccgaugaaccccugcgucgugggcguggaugugcuggagcgcagcguggauggcugugggcgccugcacagucugcgccugcucaguaccgaaugggggcugccuggccucgugcgagcggugagagucccuguguggccgcgggcgcuuacugcugagggaugccacaaauggccaggcagaguaggucccugcagucccuugcccccuucucagacuguucaugguucucagucuguugucugggaaggacucuagucacucuggguuaggugaccugggugaccuuucuucagggacaaacgugaaggagcagauucccaccuuuugcagucauacuuuuuacaugugaacuuuagguauacacagcucagccuguacgcgcuuuuagagccaaaaauggggucgggauggggucggguggagaagcaugagaauguuaaccuaaggcagcacccuaaccuuccuccaacuccgagugcagguccuugcguagccccagggucuccuuguggcuccuuugcuacuccuggauucuauguaggaugugaaaacuaucucuguaggcagauucuugccuuccaaacucugucagcagaggagccucuuuaucaggaucccuggcuucccugcuuuaaguuuugucgcaacguucauuacugucaugcauuaagcauuuagcuccacuuccuaauaucugccccgaggggggggaggucggggggggauugcucucucugcccuuuacugaaucugcagguauagagcauuuguuguaaggaaaugcguaacuggacguuagaaugucgcuuuacucuuuuauuuugucuuuuagauuuugggagccaacaggaccuugacguacaucaaagagcgcuccgucguggauccggcugccaggaaaauggagcugugcuccaccaauguaagcaguggucuaagaugagaaggugcuuaguguugcuccccgacggugcgugaugaugccuccccuaaacucuacuuccagcugccguuugccugcucggagagcgcuuaggaggacuacauuaguuagugguauuuuaucuuuguuuuguuuugaggugggguucucacuguacccccuuucagccuggaacucgacggauagcccaagcuggucuuaaauuuucuuuaauccuccugccucagccugaggaguucugaggcuacaggcuugagacauuuucucaccuuuuuauucuaauauaaucaacauaaggaaaaaggcaauaggucaggugugguggugugugcuucaggcagaccucugugaguuugaggccagcuugaucuacauagugaguucuaggacagacagagauacaugguaaaacccugccucuaaauaaauaaaauagaaagagagagagaagaaaaagaaagaaaggcaauaacuaguuagauaagaaaacugcuagccgggcaugguggcgcacgccuuuaauugaggccagccuggucuacagagugaguuccaggauagccagggcuauacagagaaacccugucuugaaaaaccaaaccaaaccaaaccaaaccaaaccaaaccaaaccaaaccaaaccaaacaaacaaaaaaaaccaaacugcugaaucuggguguacuauugcacaguuggguggcuauagauaacaauguguguauuuauuauuauuagugaugauaauaauaauacagggucucacuauguagcgccaacuggucuagaacuugcuuuguagacuagacuggcuuggaacuuacagauauccuucagauauguguuacuaugccccagcuaacuauuauauuaauauacauguagaagaaaauacuuagaaugucucuaccacaaagauauaaauauuugaggaaacagaaaugcuugcccuuuuuuuuuuuuuuuuuuuuuuuuuugauuuuucgagacaggguuucucuggguagccuuggcuguccuggaacucacucuguagaccaggcuggccucgaacucagaaauccucccgccucugccucccgcgugcugggauuaaaggcaggugccaccacugcccggcugcccuaauauuuuuuuuuaaauauuuauuuauuaucauauagaaguacacuguaguugucuucagacaccccagaagaggguauuagaucucauuacagaugguugugagccaccaugugguugcugggauuugaacucaggaccacuggaagagcagucagugcucuuaagcacugagccaucucuccagccccaaguuuauuuuuuugauacaggguuuaauuauguagaccaagcuggccuggaacuccuagagcucuuccuaauggugggauuaggcacuacuuacccugauuucaauguuauacaauguauauaugcauugaaacauuaugauaccauauauguguucaauuuucauauauuaauacaaauaguaaugagacagaagugcauacaauccucacaaagcauaaacagauaaagcaacagacaugaucagacccagagucugucccgagucacagcaguggagugugggguaucuggccagcaggacucaguagcugguauugguucaaacuuugagagucugaucuuagguauuuuaucugaggcauauuuagcauagcacaaauugggggaaaguuuccuggugaucaugaacucaauuccuugugcacaacaaaguuuaagacaugacuacaucagaucucuuuguaaaguacaagcggcaucguccauaaagguagguucuggcagauugacggagaagagcaagcucaagaugagaaggaagauccugugugcucucugccacauggacagcacaaaagucaccagauuauuaacuauguccacucccagccuuccaggcagaaaacagguuaugcaucucucucugaagggacaaccuguguauuaacauuccugguucccugguucagucugcauccuggguguucauuagccauguguguuuguagcugacauacaaauguaacgucguagugccauagagaacucugcucaccaugauauucuagaggcauuuuuuagaugguuguuuuuuuuguuuguuuguuuuguuuacuuuuaauuuuuauuacuguguguuagcaugccacugaaugcauuggaggucagaagacagcuauauggagucaguucucucccuccuuuauauggguuccgugaaucgaacucauguugcuaggccucugugguaagcaccuuuauccgcugagcuaucucacuggcucuagguagguuuuaauagaaaauacaaacaguaaguuaguuugcugacaggaaguaggacuggagaccgggcugcugaagcuucuguguggaucccagaguccagcacguccagccauuccgagauuccacaagggcuggaaagcuggcuacuguugccauggacagcgacagugggcucuuuguccuacaguugcugacaggcuuggcaauguguggaugcccugaaggcagauccugccucagacguggguagagguccaugaucaucaucaaggagcugcccagcugggcagugguggcgcacaccuuuaaucccagcacuugggaggcagaggcaggcggauuucugaguucgaggccagccuggucuacagagugaguuccaggacagccaagggcuacccagagaaauccugucuugaaaaaccauaaaaaaaccaaaacaaaacagaaggagcuaccuaguagugucccugacacacacugaauguugucuuucucuggcuuucccaaguguuaauucugggcuggaaggguagaugguuugagaagaaauacaagaaaauuagaaccuaaagcagugguguuuuauucuuuuauguguguguuuguuuuuuaaagaucacgcucacgaaucuggugucagugaaugagagguugguguacacaccucauccagagaacccugaaaagugagucaccucguccugggauggacacauugagcagcagggguggacggagccucccucccgggguuggucagccccuuacuucugcucuucugcaggacugugcucacucaagaagccaucaucacugugaagggaauuagcuuggggagcuaccuggaaagucugauggccaccacgauauccuccaaugcuaagaaggugaacgccucaggacagggcccuggugcagucugugguaaugugcccgaagagguggggacauguuugguccuugcguccuccugaggacgggcaucuuugcaguugagcuucuaaggcaauagacuucccacaguuguuucaaauagagauacagaagggcuggccagguucuugaggcaaaagacauuuguccuaguaaggguuacuauugcuuugagguucaucccagucuaucuggucuccacauggcagcuuuggcucugggacuuugggauaucuuuuaagucucagauaugaauuggcuguguuauucucagaggguguugaccuugagauagcucaagcuggugcauucuuuaauucauuagagaaaguaaggcauugaaaacaucccaucauguuuccgagcuuggauggcuuguuucuguggacugucuuuaguuaggguuucuauugcugugaagagauaccauggccaucucaagccuuauacaggaaaacauuuaaugggggcuggcuuacaguucagggguuuaguccauugucaucaugacaggaagcuuggcauugugcaggcagacaugguacuggagaguagcggagaguucuaucuacacuugcaggcagcuggaagacacaggaagcccaccuggccuggcuugaacuucugagaccucuaugcccaccccuaacaacccacuucuuccaacaaggucauacuccaacaggguuacaccucccaguaguagcacucccuauggggcccuguuuauucagaccaccucauaguccauggcucagggagauuauugcuaccucuuugccacagcaguucccuccugcauguggcaagaacugaaguccuucuguguuguugcaggggugggcugccauugaguggauaauugaacauuccgagagcgccauaagcuaacaggucugccacccaugccuggugacacaaggggcagucacaguaacuucuuaacccgguacagaguuuuagcuuuuuauuacugugugcaugggaugcaugagagauugcuuggccgccaguuccgugcugcauacugucugucacagaggacgauuccguccuccuucauuucccuaguuugugucaaagaaguuuccaggguacaccugagcuuuuucuugucaacuggauggagucuacggaaggcaggguagcaauugauauccugaggucucaguaccuggcugccagaacagucugcaggauugucacagcuggugaagagccuccacgaauaggcccacagugucauagggaaauuuaaucuggaguuuuuccaucuuggguaaaauuugcgcuucuugaaaaaaaaauucguuauccuuuuauuaugcugggguguggacugaggcucgcacaccuucugggcuuggguaagcgcucuaccucugagcuccacugccagucuguacacguuucuaugaaaagugcugcaugccuguuuacuuacuugguccaagccaguguucagccucuggccugucccgguaguggcaaaagcaccucuucacagaugguccuuggucuccucugccuccagauauuugacacuugauugguuggcauuugucauguccucacagagagcaucccacuucccuuaggcggggccuccucacuuccugccugaaugucccuguuaagcugcugacagugguggcuugcuucccuguugccuccagucauuaccauuuccucauuucccucagcaggcaagcugugggguuugagguaucuuuaagauauucuugcuccuuuuuccuaagucaaugaagcuugccagagaaguuucccuugaauccaaggucaagaccugcucuggggucucuuagccucaaucugagcucagcuuguggaagcugugugcaggucuguguguggagagagagaguccuggugugaagucuaagcucuucagguuguuucuucaucaacuagagcuaaaccaucccucucucuagucagaugucucaccaaaaagagucaaagaagaaaggaaaggaaguguggacgaauaaagaagacgagaggcaaguguggcuggggcucccgccaagucuggaagaggugucugcuggaaucuuuccucccagugcagcaucaggcccaggcgccagcucugugaggcuguuugugugaggccguuucuugggagugguguggagcccuggucugcugggcucugcuguaggugcugugggcacugugcugggcaguacugggcugcacugccccuguguugguuuuaagcuuuuauuugcuucuggaaggaguguuacuucugugugcuggcucuagucacuccaccaaaagagagcuccccuuuccucaugcccugccagcuaagcugggguaggucccccaaaccuuucccggggggccuggcugcuguccucuguuccugguagucccauguccuuauagugucccacuugccucugaaggagaauagaaguugcucucuggcccucaggguccccaucaugcccugcauccagagacaguuugggagcucucugcacaggccacuauggauuccagcagcaacugggauguccauacucaagaccggccuugaacucugugugugacugaagaugcccuugaacucuuccuucugcuuccccauucccaaguccugagaauacagacuuggacugcuauacuugacucuuuuugguuguuauucuugagacagauuuugcuauguagccuuggcuguucugaaacucauggcaacucuccugccucagcaucucaagcguuggaaucacagguguggaccaccauacccguuaugggaugcuugucaagucccaacuguccuuucaacaggaucucuugacaagccugggugucccuugaagacggugggaaccucuugcuaucuacaaagagcuguccagcgaauucccucucuccauauccugggguuuugaggucuggcuggggugugaguggugguuuugugcucuugaacuagauugaaccccuuccccacacguacacugccuuccugccucagaguuucugcuccucauuuucuuuguagucuuuagucugucgguguuucagucagggacaugagcaugcggugcugccaucuuuuguuuagagacaaagucucguguaacucagguugaccuucaacucacuguacaugaggcuguccuccaucuucuuccaccucuuacgaauuacaagugagcacugucaugccuggcuuucuaccaucuuuaaaucaagguuguuuaacacacacacacacacacacacacacacacacacacacacacacacacacacacacacacacacacgggauucauguuuguacuuuuaaaaaggaauuaaaucuguugaauaguagagaccucugcucuuccucuguugguccacucacuauuucuagaacuuuccuaugccuaugaaaguugaugucuuuugcuuucauuaaacccgguucacacuguaac

SEQ ID NO: 8963 - RNA, 6323 nt, Mus musculus
uguucaauuuucauauauuaauacaaauaguaaugagacagaagugcauacaauccucacaaagcauaaacagauaaagcaacagacaugaucagacccagagucugucccgagucacagcaguggagugugggguaucuggccagcaggacucaguagcugguauugguucaaacuuugagagucugaucuuagguauuuuaucugaggcauauuuagcauagcacaaauugggggaaaguuuccuggugaucaugaacucaauuccuugugcacaacaaaguuuaagacaugacuacaucagaucucuuuguaaaguacaagcggcaucguccauaaagguagguucuggcagauugacggagaagagcaagcucaagaugagaaggaagauccugugugcucucugccacauggacagcacaaaagucaccagauuauuaacuauguccacucccagccuuccaggcagaaaacagguuaugcaucucucucugaagggacaaccuguguauuaacauuccugguucccugguucagucugcauccuggguguucauuagccauguguguuuguagcugacauacaaauguaacgucguagugccauagagaacucugcucaccaugauauucuagaggcauuuuuuagaugguuguuuuuuuuguuuguuuguuuuguuuacuuuuaauuuuuauuacuguguguuagcaugccacugaaugcauuggaggucagaagacagcuauauggagucaguucucucccuccuuuauauggguuccgugaaucgaacucauguugcuaggccucugugguaagcaccuuuauccgcugagcuaucucacuggcucuagguagguuuuaauagaaaauacaaacaguaaguuaguuugcugacaggaaguaggacuggagaccgggcugcugaagcuucuguguggaucccagaguccagcacguccagccauuccgagauuccacaagggcuggaaagcuggcuacuguugccauggacagcgacagugggcucuuuguccuacaguugcugacaggcuuggcaauguguggaugcccugaaggcagauccugccucagacguggguagagguccaugaucaucaucaaggagcugcccagcugggcagugguggcgcacaccuuuaaucccagcacuugggaggcagaggcaggcggauuucugaguucgaggccagccuggucuacagagugaguuccaggacagccaagggcuacccagagaaauccugucuugaaaaaccauaaaaaaaccaaaacaaaacagaaggagcuaccuaguagugucccugacacacacugaauguugucuuucucuggcuuucccaaguguuaauucugggcuggaaggguagaugguuugagaagaaauacaagaaaauuagaaccuaaagcagugguguuuuauucuuuuauguguguguuuguuuuuuaaagaucacgcucacgaaucuggugucagugaaugagagguugguguacacaccucauccagagaacccugaaaagugagucaccucguccugggauggacacauugagcagcagggguggacggagccucccucccgggguuggucagccccuuacuucugcucuucugcaggacugugcucacucaagaagccaucaucacugugaagggaauuagcuuggggagcuaccuggaaagucugauggccaccacgauauccuccaaugcuaagaaggugaacgccucaggacagggcccuggugcagucugugguaaugugcccgaagagguggggacauguuugguccuugcguccuccugaggacgggcaucuuugcaguugagcuucuaaggcaauagacuucccacaguuguuucaaauagagauacagaagggcuggccagguucuugaggcaaaagacauuuguccuaguaaggguuacuauugcuuugagguucaucccagucuaucuggucuccacauggcagcuuuggcucugggacuuugggauaucuuuuaagucucagauaugaauuggcuguguuauucucagaggguguugaccuugagauagcucaagcuggugcauucuuuaauucauuagagaaaguaaggcauugaaaacaucccaucauguuuccgagcuuggauggcuuguuucuguggacugucuuuaguuaggguuucuauugcugugaagagauaccauggccaucucaagccuuauacaggaaaacauuuaaugggggcuggcuuacaguucagggguuuaguccauugucaucaugacaggaagcuuggcauugugcaggcagacaugguacuggagaguagcggagaguucuaucuacacuugcaggcagcuggaagacacaggaagcccaccuggccuggcuugaacuucugagaccucuaugcccaccccuaacaacccacuucuuccaacaaggucauacuccaacaggguuacaccucccaguaguagcacucccuauggggcccuguuuauucagaccaccucauaguccauggcucagggagauuauugcuaccucuuugccacagcaguucccuccugcauguggcaagaacugaaguccuucuguguuguugcaggggugggcugccauugaguggauaauugaacauuccgagagcgccauaagcuaacaggucugccacccaugccuggugacacaaggggcagucacaguaacuucuuaacccgguacagaguuuuagcuuuuuauuacugugugcaugggaugcaugagagauugcuuggccgccaguuccgugcugcauacugucugucacagaggacgauuccguccuccuucauuucccuaguuugugucaaagaaguuuccaggguacaccugagcuuuuucuugucaacuggauggagucuacggaaggcaggguagcaauugauauccugaggucucaguaccuggcugccagaacagucugcaggauugucacagcuggugaagagccuccacgaauaggcccacagugucauagggaaauuuaaucuggaguuuuuccaucuuggguaaaauuugcgcuucuugaaaaaaaaauucguuauccuuuuauuaugcugggguguggacugaggcucgcacaccuucugggcuuggguaagcgcucuaccucugagcuccacugccagucuguacacguuucuaugaaaagugcugcaugccuguuuacuuacuugguccaagccaguguucagccucuggccugucccgguaguggcaaaagcaccucuucacagaugguccuuggucuccucugccuccagauauuugacacuugauugguuggcauuugucauguccucacagagagcaucccacuucccuuaggcggggccuccucacuuccugccugaaugucccuguuaagcugcugacagugguggcuugcuucccuguugccuccagucauuaccauuuccucauuucccucagcaggcaagcugugggguuugagguaucuuuaagauauucuugcuccuuuuuccuaagucaaugaagcuugccagagaaguuucccuugaauccaaggucaagaccugcucuggggucucuuagccucaaucugagcucagcuuguggaagcugugugcaggucuguguguggagagagagaguccuggugugaagucuaagcucuucagguuguuucuucaucaacuagagcuaaaccaucccucucucuagucagaugucucaccaaaaagagucaaagaagaaaggaaaggaaguguggacgaauaaagaagacgagaggcaaguguggcuggggcucccgccaagucuggaagaggugucugcuggaaucuuuccucccagugcagcaucaggcccaggcgccagcucugugaggcuguuugugugaggccguuucuugggagugguguggagcccuggucugcugggcucugcuguaggugcugugggcacugugcugggcaguacugggcugcacugccccuguguugguuuuaagcuuuuauuugcuucuggaaggaguguuacuucugugugcuggcucuagucacuccaccaaaagagagcuccccuuuccucaugcccugccagcuaagcugggguaggucccccaaaccuuucccggggggccuggcugcuguccucuguuccugguagucccauguccuuauagugucccacuugccucugaaggagaauagaaguugcucucuggcccucaggguccccaucaugcccugcauccagagacaguuugggagcucucugcacaggccacuauggauuccagcagcaacugggauguccauacucaagaccggccuugaacucugugugugacugaagaugcccuugaacucuuccuucugcuuccccauucccaaguccugagaauacagacuuggacugcuauacuugacucuuuuugguuguuauucuugagacagauuuugcuauguagccuuggcuguucugaaacucauggcaacucuccugccucagcaucucaagcguuggaaucacagguguggaccaccauacccguuaugggaugcuugucaagucccaacuguccuuucaacaggaucucuugacaagccugggugucccuugaagacggugggaaccucuugcuaucuacaaagagcuguccagcgaauucccucucuccauauccugggguuuugaggucuggcuggggugugaguggugguuuugugcucuugaacuagauugaaccccuuccccacacguacacugccuuccugccucagaguuucugcuccucauuuucuuuguagucuuuagucugucgguguuucagucagggacaugagcaugcggugcugccaucuuuuguuuagagacaaagucucguguaacucagguugaccuucaacucacuguacaugaggcuguccuccaucuucuuccaccucuuacgaauuacaagugagcacugucaugccuggcuuucuaccaucuuuaaaucaagguuguuuaacacacacacacacacacacacacacacacacacacacacacacacacacacacacacacacacacgggauucauguuuguacuuuuaaaaaggaauuaaaucuguugaauaguagagaccucugcucuuccucuguugguccacucacuauuucuagaacuuuccuaugccuaugaaaguugaugucuuuugcuuucauuaaacccgguucacacuguaacuauuuuugugacugucucuuuucuacuuuuaaacaacaguguccugaaaaguccccuuugaggacucacugcugagagccacugaagagagcuccugaggccacugaaggcuugccacuaucgcuggccagccaccauagaaagguggucgccugagagggacacugcagcucccucuuuaugugguagcagcucuuagauacuuuuccacuuugagaugguuauagacuauugacuaacagcuugacuggaguagggagcaccuagggcauugaggaagagcacucuugggugugucugagaggacauuccuagagagguuuggcugaaaggacaccuccucucacugugggcagcaccagucaccccaugggcaaggggcagggggaggcaaaagccacuggaguucgggguuugcguuuuuuugcuuggcaccucagaccauaccacgucugcagccacaauggacuggaccacucugaacucugucaaacccuccuuuccugaagcugccuccugucacagccgugagaaaaacagguaauacuauuucaaguucaaccaauuaagggaguguagucauugucuucaguauucauucuguguaaagccguuggcuuuguaaccucugcuuugguuggaaguggauuccacaacccuuccuuuuuagaaauucauuagcauaaaaguaaauguuuuaugaucuaguguuauaaguaguuagaccuuaauuuuaagcugagaaaacugacacagggcagcucaaaaaauacaggacggcaucagccucacauauccuacgccagucagugccugaguaccuagaaggaacaucucaaaggacagccucauauuccaagaugcuccacugaagggucccauaaauccccaaagcaacaaaacucacaggaaaaacacaaacuagaagccuaacaggggccaaacccagaauacaguguguccaggaagcuccacuacucucuaagaagugccauagugcugacauagucuuggcaggcuugagagcacguggaguugggcccugacccuuuuaugca

SEQ ID NO: 8964 - RNA, 24097 nt, Mus musculus
ggggcguaggucgaggacuggcgacggaggacguggggaccgcgcgcgcgggauccgcgaggacgaggaggcggagcgguggacggcgucgaucaggcggcucacaggccagccccggcgucugucagucccgcaccguuugaagacaguuaaguuaguuggggcgccgcggcugccggauucccgcccugccaggucugacgcggccgcggcgcuuugugcuccgcccgccgcugaugcugcgcgcccgggacgacgggcuccgccgcugcaccgugugaggugggcgacuagcggccgcgaggcgccagcgccggcaugucgcugccuccggagaaagccucggagcugaagcagcucauccaccagcagcugagcaaggugaggaccucgggcggaccgguccccgcaaccggagcugcggagcgggcgcgggcgggcgggcgggccggcaagcuucggucgggugugagagccgagggagccgcugugaaccggaggcggucccggcgcuuuccagauguccacguacaaguuagcccgaggccagauguuuagggucccuuuacaccaggaaggccgauggcaguaagaaguuaugggagacggggcgcucaaaugacugacaaggaacgcguuuaccccacucggggcuuccaggagucuucccuucuguccucgacugccggcuguaagcugaaguaauaaagccucuuuaugguggugguggugcgccagggcuuguggccagagucucuagcuucuuuggucgaaaccucaaaacggucucguuuuuccuucgcacgggcaaggaaauagacggacaaauuagaguuccaaguugaauaagcgagaaagcugaaauaacucgcucuuuguucugccuccuuccaggucugcguucuuuugauuauccuccauucccucccaaaagaauugcuuccauugacuuauuugcgggcaaccagcaauaacgguugauaaccaaccaguucagauugcuucuuauguugcucaaaaguuucaccucuuaaaaggcucaauuuuuauuggcacuggguauuugccauuaguuuuagaagccuaaaacucuacaagugguauuuaucuacuuuauaauguuauaaguugcuuuccuguuuuuguuuuguuuuguuuuuuggggggguuguuuguuuguuuuugagacagugucucuuuguuuaguuugucuggcuggccuggaacucaagagauccucaggucucugacuccugggugcuaggaauaaaauuacaccaccaccaccaggcguaauuuuguaaaucuuaaugugugguuucuccauagauggauguccauggcagaauaagagaaauucuugcagagacuauacgagaagaauuagcaccggaucaacaacauuuaucaacagaagaucugaucaaagcucuaagacgucgaggaaucauugaugauguaaugaaagaacuuaauuuugugacugugaguagcaguuuacaacauaagguccacacucguggcuucucuuagaacuaccauaaguucacucugucuaguaauagccauuuuuccuaguuuuuaagaagaauuuauauguauggcuguuuugccuacauguaggucuggugcucacaguguucggggacagcugugauccucuggaacuggaaugagccaccagcacgaugcugguggggggaauugaucucagguccucuggaagagcaagugcuccaaacugcugagucaucacugcugccccuguaauguucuucccucugucgcugcuuguguuuccagacuggguuucuaugaguagcucugguuggccugaaacucauuuuauagaccaaggucuuaaauucacagagauugccuguugucugccuccugagugcugggacuaagggcauuuguguucauugucaccgccuggcuccuuuucugagagguucuaaguuggccccaccgugaguuggcaaauagagaguucaugagauaggaguuguuggacacuguauuucuuucgcugacgugacagaaacuuacgcuaugcuauagcucucuaauucauuuagguuagguuuguuuuaaaacaaauacacucacaagauuccaucagaaaagcucuggcugcauaaagcccucauuucucuguacaaauaggucaguaaugggauauaucccggugcauuuuguaaguaggccuuauuuugaaaaugaggcaauaaugaaaaacuguggccucaauacaagagucauauucuacuaaaaauaggauggacuucauaauacgcuagagaaucggguauguuaauacacuagccucuuuuggguuuugagguuugcaaaccuauuuguuauaaaaacugacccauuaacagccucugcuucauaaauguuacuuuuuaaaacucaguucguggugggcuagagagagagaguucagagguuaggaacacugacugcucucccagagguccugaguucaauucccagcaacccauaugguggcucacaaccaucuguaaugggauccgaugcccucuucuggugugucugaagggagcgacagcaguacugcauaacacuggcugucuuagaacugugugccaaggcuggccuuaaacucacagaccgccugccucugccucccaagggcuggaagcaaaggagugcgccacucugauuaaccaacuacuguacagggcuuaaagcaaguguagcuuauuuaagguaucaguuuguuuuuuaaagccaggcuuggcagcucaugccauuucuuccagcauucaggaggcagagagaggcagagcucucugaguucaaggccagccuggucuacauguguuuagcauuuaguggauggcaaggcuuaaagacaguuuaaucccuucauauuagacuuuucccaguuagaucucuuuggcuaagaaaauaaaggcuuugguuugguuuugucuuuuuuuuuuuuuuuuuuuuuuuuuuuuuuuuuuuacuuuggaggcagugugaccuagucccuucuuaggguagaaggcuuucugaaggagccuaauccuauaguguuuucuucugucucugcaauuuucuuagcuagaacuuuuuuuuaaaacuuucuaacuugcauuuuucccuacuuuuccaggauaguguugaucaagaacucccuucuucuccaaagcaaaccguugguuuugauaagcagucaacauuaaaaaaaaguauguauauaccuaauauauuuucaucguaaacuugguuguucuuggaaauggaccuaugguaguguuuggcauuugauaaauauuucaaguuuuucuuuucaaaguaaaguacuuaaaauuuguuuuuguuuuuuuuuuuuuuuguuuuuugaggcaggguuucucuguguagcccuggcuauccuggaacucacucuguagaccagguuggccucgaacucagaaauccgccugccucugccucccgagugcugggauuaaaggcaugcgccaccacgcccggcucuuguuuuuuuuuuuaaacauaaaacuuugaugcugcuuugcaugaaauauaugagauugacugucugccucaguugguccaaaaccaggagcacugguuuuucggguuuuaaugauauauuuuauaaaagcugcaagggcagauuuggugguucaucccuuuaauccuagcaccccagagguaggugaaucucugggcauucaagaugaaccuggucuacauaguaaaguucuaggacagccaagaauucacagagaaacccugucucaaaaacauaaaauaaauccgaaucuuugcuuuuuaaaaaugguaaaacaauuaucugacaaaugcaguuacuaaguugguacuuacuggcuaaguuggcuugaagagauaauuauaugcuuuacgaacagcuaagaagcaaagguacacccggccuugacuuuaauucccucagaaaaaguacguuauuaaguauuuuuccuucgcuuacacaagugguucugcucugucgugaacuugauuauuuuuuuacccguauccuugucucugucaaguugucugugauaucuugaugacauugguucaguuucucggcagucuccucauauguugcuacacuuugcagcuaauguugauccaacacggagguaucuuuaccuucagguucuggguggaaaagcuuucuuggaacaucugcaagaaccugagccuuugccuggacagauuugcucgacuuucacuuuauguuugcacuaucggaaccaacgauuucgcuccaaaccuguacccugcgcuugugagccagauuuccaugacggcuuuuugcuugaaguucacagagaaaguuuagguaagagacaguagugguaucuaauuaaauguguuugcuuuucauuguggaccaacuucuacaaaagggauuguaaccccccagccugguagcucaguuuauaauaaucccagccucagggcacaaucccuuugccuuugaguuccaggccaaccuggucucuggagagaguccuuguggugggguguggagagguugagaaugguaggugcgaaucucugguuuuuguuauguuuuccccccaguacuauuguuuauuuaaacgagcucuuuuuugcuucuuccuuuauuucugaauuuucucucauuucuuuuugcuauacuaauugaugaucuuuuugguuagcugcuucugccucucauguacauaggcuuguguaccuuuaaggacuagaauugcaagugugugccaccgcaccuagcuuuguaauguaaaagucaaaguuugaaucugguuguggugguucaugcuuauaaucuuaucacuuggggagccugggcaggagagaggaguucaggcaggaggauugcaaauuagaggccagccuaaacuacagagggagaccaugucucaaaaacacaaaacaaaaaaagucaguuuauauaauuuacucaucaaucuaaagccauaaagcaagcaaaauugcagaaguggccuaaauaauuuaaauaccuuuaaaugaugccucaauuuuuuucucuuacccuuuuccuuuauguucaugagacagagucucaugcagcagaggcugccaguaagucagucuagagcugaggaugaccuuaaagcuacggccuacacugaagcaucuagugcuggaauuuuagcugugugccagcacacuuggucugugugaugaugaggucaaacccaaggccuuguccauaauaaacaaagcacucuauacgcugagcuacauccccaguccuucugagaaaaaaaaagauauucccucccuauaaaaauguuagugggguccuggcaagauggcucagcagguaaagcuauugcuuugugaguuuggcccugaaaucugugugguggaaggagagagucaacuccugcaaguuguccuuugaccuccauacaagugcuggggcauucgaaucuccccuccgcauacuccucuauacacgaaggcucagcugccagcucggggguguuagaucuuucaggguuuacguuuuguuuugucugcgugugggagugugucugcugugcacauguguacgcaucugaggcuggaauaauaggcaggcugccacaauccccuagcauuugugugaguucuguagaucugaacucugguccucuuaacugugcgacacaugcuuuaacugccaagccaucuccugagacuuguuuuguuuuguuagguuuuauguuauggguauggguacugugucugcaaguguguuuguggacuacaugugcaguacccacagaggucagaagagggcgucagauucccuagaacuggaguuacagaagggugugagcugccauguggcugcugggaauugaaugcaaguccucuguaaggacacaugcucauggcuacuaagccgccucuccgggcccaaggauuuuuagggaucuuuagguuucuucuguguguguauauuccuuuuuuuaggccugccucccccagccccccucugagauaggucuuaguauauagcucugacuggucuugaacucacaggucuacucacuuccaccuccugaaugcugggauugccccacacccagagaaagaaagagcugauggcucgcucuucuguaguagcgcgugcuauaguaaagucuuuucaagaauagacuuuucaugaaucagaagggucugacugcuguaaguaacauagcuagauaacuuccaaguaacuccucauauuccccuagaccuggcaggucagucauagaaacaggauacgucuucccagagucuggcaugcugucagggacaucaccagauaauuucacuguaugucagcuuacuauuuagugacauuuuucagaaaaagugugugugugugucuguguguacacccucccacuuguaguucuggauauggaauccaaagccuugggcauguuagguaauuacuaccacuuaacuacauccuuagcuuauaaaguuauuuucuguuucuaaguaauucauaauacaguuuuuuucuuugguuuguauugcuaggugauggaacuagaauggcugauucaacaacaauguuaucaauaagugauccaauucacaugguacuaaucaaaacagacauauuuggugagaccacuuuaguugcguccuauuuccuggaauggagaucaguuuugggcucagaaaauggagugaccaaucugacuguggagcucauggguguagguaugaugauuagagucacucuuggcuuuuauaaauacuuauguguguaaauacauuuacuuugucagaauagcuuuacagggggaaagcuguaaaacacgguuucacugaauuguccuaggggugucuggaagacgccacuguaggcuuucaaaggcagucugaucuagccuagggauuuuuuuuuccugaaaaaugaauagaaauuuuggaggugcaagguuucuuuuuuguuaaauaaguauaagguuaugaagaaaaacagaguccuucaaacacauggauccacgugugcgucugcgucuuucuggucgacccuagagaugugcugcaacacagcauuguaacugcaguaguaguucuugggaggggaccaucugcauuauuuuguuuuuuauuacggcugacauuucacagccuauccaggucuguccuugaguucccguguaaaccaguuggccugccucugcuaggauuauagauguaugccacaggaaccaucucaccagccccuuuuuuucuauuuuaauuguaaacugauaacuuauauuuaccuguauugaugggguacgaagugagauuaugacucauggaaucuaucugugaaugaauaacucaagccaauuauguauccaucauuucaacuauuucucucuuuuucuuuuuucuuuucuuuuuuucuuuuuuucuuuuuuucuuuuuuuuugguuuuucgagacaggguuucucuguguagcccuggcuguccuggaacucacuuuguagaccaggcuggccucgaacucagaaauccgccugccucugccuuccaagugcugggauuaaaggcgugcgccaccacgcccagcuuauaaaaaccauuuugauuugcuucauuuuaacauuuugauucauuuauaguaugugcauuaggugcaguguuguauguuaucacucuaccuagaugauaagggagcucgcuccuaaguuauuuuggguagacuuugacuaaauaccacagacugaaaguuucaugguuuuuuguuuuuuauuuuguuuuuucuuuucucuuauuuuauuuuuuagauauuuucuuuauuuacauuucaacuguuauccccuuuccuaauuuccccuccaaaaauccccuauccccuccuccucccccaaguuucauguuuuaaauagacuuuaaguagaguuguaaauauuuauuuuuauuuauaggcacagaaucaaaaguuuccgugggaauuuuaaauauaaaacuugaaauguacccaccgcucagccaaacgcugucucaggagguagugaacacacagguaaaucuuacuuccucuuucacaugugcuccaauugcagucaguauuuaccuagaugcucagauuuguacuaaaauaauuaacauaagggaugggaaaagaauuacaaagcuggagcuggugguguggcuuagugguaagugcuugcuuagcauuuacaaggcccuguauuugaccaaacucaaggccugggaaugugucgggaagagucacaguguuggagggcauauggaaaaaaguuuuaucagguuaguauguauuugugugugcaggggaggugggugauaagugugugcugugcuaaugggccacuuucugcagugguccugacauuccccugcaugggaccccgggacggagcucagggcauccggcucuggggacagacaucuccugagagcuggcgccuuauguauuaucauaauaaguguauauguguuauuuauaaagcuauaugguagguaagcaaagaacuauuugauuuuuuuuuuuuauuuuuguuuggucugguuugguuugguuugcuuuuucucagacaggguuugucuguguagcacuggcuguccuugauucuguagaccaugcuggccuugaacucagagaucugccugcuucugccuccugagugcuggaauuaaagagauacgccaucaacaccugguucagauaacuauuuuaauuacaguuuauuuuguuggagguuuugguauacaagaucacuuuguauaacccagcaugaccuugaacuuuugauccuccugccucagccuccaaauuugugcccagcacuacaucaucugauaaauucuguugauacuuauagugauaaagcguuuuuguugguggcuagagggauggcuugguuuuuaauauuacugaaugcucuuccagauggccuggguuuaaaguuuaugaauuuaugaguugggaauuuaauaucgggcuucaugaauuguggacaucuuuaucacagagugacauccccagccccauggguucucuguuuggguuuuuuuuuuaaagacauuucucaccugccugagccucauuagagacuuaccuccuucaaccucccauguguuaaaggccugugccaccacaccuggcaggucuucuuuuaaaaccuaacauuguuuuacuuauuuauuaguguuuaaauaucuaucuuuauuuaauguaugagucuguguggguguaugugcauguguguugugugguuguccaaagaaucuagacuaggagauuguugccccugaaguugguugugagccacccagugugggugcugggaaugaaacuaaggucucuaaaagagcagccagugcucuuaaccagagacaucucgacagacuccauuguuuuauaagcauuuugucauuuuucugugauguuagucaguuuucaugagucaugugugaauguguauguguguguguaugcauaugcauauauaugaaauugcuaguuucuagacuuuuuaaaacauuucauucuuuguaaaaugugagaaguuuuauacauuccugugugugcacuuaguggggguggggcgugugucacaguguuuguguguggaucagagggcagcuuugugggaugauucucucuggccuaccugagagguaccuugagcacacugagcaccucacuggccuuguucuuacauuuaggcagcaaugcuuacuugucucaaacaguugggcugaagagacaggacuggaaggacuuccugugccccccccagcucugaaaaaagacgugggggcuuuuuuuuuuuuuuuuuuuuuuaaacgaaugcucuguuuggccuuaucuuacccuuguuccucacuagcucuuauaacuuaaauuucccauucauacuaaucuguguucuaccacgaggcucauuaguuaugucuccuucaguccuggccugcuuuuccucugcaucuggcugggaaguucuuuagucccugacucuuucccagaguucccaucucugcuggaagucccgcuuauucucuacuccuuuguuuacuauagaccauuaucuguuuauuaaaccaauccguccgggggugagagagggagggcuuacaaaauaugauguagcuauacgaauaauaauacugaaguccucucuuuggcacagaaaucagcauuugauaaauacaaagaccaucuuucuuuuugguuuuucgagacaggguuucucuguguagcccuggcuguccuggaacucacucuguagaccaggcuggccuggaacucagaaaucuaccugccucugccucccaagugcugggauuaaaggcgugugccaccaugcccggcuaaagaccaucuuuauacacugcacacaaagaucaucccagcagagauugcucagugaguaagagcacuggauucucuuccagaggacccaaguucaauucccagcacccccaaggcagcucacaacuaucuguaacuacaguuccagggcacauggcuccucacacaaccauacaugaaagcaaaaacaguaaugaacauaaaauaaacaaaucucuaaaacaaagcaccauguacuugaggcagcuaccugcaacucucaacugcaaggaguccagucacucacauggccuccuugggcaucugcaucccacacauauucacauucauaugagguuuuuuuagggucuuuuguugauauaguucugguugaccuggaacuuccuagaccaggcuggccuugaacucacagagauccacgccucugccuccugagugcugggauuaaaagcaugugcucccaugcuccauuuauagcagcuuauucguaggagucuggagacagugaggaaacaaaaugcuggcuguaaacuggguaugguggugcaugacuuuaaucccaguacuugcagagacaggcggaucucugaguucaaggcccgccugcucuaaaagugaauuccaggacagccaggcuucacagagaagcccugucucauaaaaccaaaacaaaacuccaguuacagguuuuaaauugaaaaguuuccgcaggguggugugugauggaugguuacugggaggccaaccuaggucacaucuuuaggguacaaacguaucugaauugcaacaaauguuaguauuuaauuccaagauugggccuguguuuuuuggguagugggugcaacauccuugaguaaaaggcuuguguggaugggagagagaaaaugagccgggggccggagugauaauaagcuuagacagguaguuuucaugaugguaggaagugacugaaguguuuccuuacuuaaaaaauuccacgugugcaggaaaaagucguuuggaugaugggauggagacuagggauauugaaguaauuauacaauccgggaaauguugaguuguuugcagaagaguauguaguucagguuaaguuagaaacagcaauggagaacaguagauuguucugguaauugaggacauuuuauagacauuuaauuguuaauuaauuuauuuuuuuuaauuucaagcuugccuuggaacgucagaaaacugcagagaaagagcgauuauuucucgucuaugcuaagcagugguggagggaguauuugcaaauucgaccuucucacaacucaaggcuggucaagauuuuugcccagguuuguaaauuaucuuagacaaguuucaucccuauauuugaaauguagugcuauaaauguuuaauuuacauuuguaaaaauauauucauugcacaaaugaaaguuuauuucuaaaauaguuaucauuuauuggguagguugguggcauaacaguuuuuguuaacuuggaauauaccuuuucauaauacuugauuaaacauuuggauauuuauguuaguuuuuugcuauuguuuuuuuuuaagauuuacuuacuuauaugagcccacugucacugucuucagacaagaaaagggcauccgaucccauuacagaugacugugagccaccauguggaugccaucucuccaacucccuagggauagcucaaugguuaagagcacugacugcuuuuccagaggucugaguucaauucccagcauccacauggugguucacagccaccuguaauuggaucugauacucucuucuggugugucugaagauaacagcuacagcuuacucagauaaacaaacaaacaaacaaauaaauaaacgaguuguuguggucaugguaucuuuucacagcaauagaaacccuaagacaucaucuaugacacuuaaugucaaaaaacaucuagcacuguagguguuauauauaugaugaggugaauauaaacuauuugaucuauuccucagaagugauaccuauauauauuccauagaaacuauacuauaaauuuugauuucuagacuaguaauguguggcauguacaauuuuuugaugcuaggcagccacagcuucagugugucaccagaucaaagguaaacaacagauauuccuuaguguauuguguuucuaagcuacaacagagggcaggacagcuguacuaaaggcacuuucaagcuaauacguucaucggcaugaaacugcaccgaagucaagguuucauuuguaguucaaauucugcaaacauuucuggucacuggcucagacauagugauuauacacuuugcaauacaauuauugcacuuacuauaauuguuuaaaaauauuucauguauauuuguacuaauguguguaaaugauauaugaccacgcacaugccccgugcacgugugaaggucaaaggcuaguuugaagaugguucuuuuccuuccuccuuuguaugagcuccaggguuguucagcucucauagcaagcggagucauagaagugguacuuaaugcugguuuuuuuguuuucuuuuuuuaaagauuaauuuauuuauguaugugaggucaucagaaccuauuacagaugguuugugguugcugggaauugaacucaggaccucuggaagaacugucagugaucuuaaccauuaagcuaucucuccaacccuauucuaucuuuuuuaagauuuauuauuuauuuuauguaugugaguauacugucacucucuucagccacaccagaagagggcaucagaucccauaacagauggcugugagccaccauguggaugcugggaauugaacucaggaccucuagaagagcagucagugcucuuaucuguugagccaucucuccagccccccauaguaacucuuauaaagaaaacauuuauuguuguuguauuucgagacaggguuucucuguguagcccugguuguccuggaacuuacuagaccaagcuggccuuuaauucagaaauccaccugccucugccucccaagagcuggaauuaaaggcauaugccaccacugcccggcuaaagaacccauuaaauuggagcuggcuuacaguuuuagaaguuuauuauugucaugaugggaaacaugaaggaagcaugcgggcuggagaggagcugagggcgcuaccuuggcaggcagcaggaagagaaugccacacugggccuggcuugagccccugagucucagagccacacuuccuccaccaaugucacaccauccaacaaggccauaccuucuuagagugcuaccccucugagcccaugggcccauuuucuuucaaacaaccacagauguguacauucaugcacauauccuguacucccuaaucacugggacagacuacaaauggccuuauuucuagacagggaucuugggacucagagucccaaaugaacuguuagugggaaggagaaaauuacuucuaacuuuccauacugcuguucuugucaaggacugggauuacauuggagaaauagaucagugguucuaaaacuugaacuguaguguuucuguugccuaagcuaggguuuauuucaucagaacagguuugcucaucuccagaguuugaaauguaagggcuccuucaacuuugagacccugucuccgaaagaaagaaagaaagaaagaaagaaagaaagaaagaaagaaagaaagaaagaaagaaagaaagaaagaaagaaagaaggcaagcaagcaagcauccauccauccauucuguauuuaggauauuccuaaaauguuuuucaaauucuacuuucaauugaucuggauauggaauucugugugacaguacaaaagaagacuucagcuuagcuuuagguccccuucccuucccuuauccaucagcugacucuuuuuuucagagcaguucuuaacuacuacaggcuuuggacucaaacagcucaaguuuuaaaaauccuggcucuagugcaugccuguaaucccagcacuuggaagaagaggcucucugaguuugaggcuagccuauucgauagagugaguuuuaagacaagcagggcuacacuaauauaaacgcugucuuggaaaaaccaaaccaaaccaaaccaaacucugacuccauuguauaacagcuauaguuuauuucauuuaugaaaggagaauauaauagacuugauaaagaauguaagugccaagcaguaguagugcacacuuuuaaucccaguacuugggaggcagaggcagguggaucuuugugaguuugaggccagccuggucuauagagcaaguuccaggacagcuagggcuacacagagaaacuuaaaagaugcaguagccuagugcuagauaaauggcauccagaauuaucuacagaauaauagauaugguacuugcagugauuagcuuguugguauaaucuuuuccccuucuuccuccaggaugagaaugggauaaauagaccagucuguuccuacguuaagccacuucgagcuggacgacuucuggauacuccgaggcaagcggcucgauuuguuaauguccuugguuaugaacgagccccuguuauuggaggagguggcaagcaggaacaguggugcacucugcuggcuuuucucuguagaaacaagguaucaaaaacauguaacagauaguaauguuuacucucaauuauuuuuaauuuauagcauauuuauaagagaauuuccuugaaaauguacauauuaucaacucgaacaagacaaauuacacaucagcacuuaaaauuaacaucuuuauuuuuguuggaauuuccuguugaguagaauguucuuccauggagauagagacucaaagucauagagcugaauguguuggcuaaugcguguaaucccagaacgugggaggcuggcgcaagaugacggguucacagucagucuggauaacagaaagcuccuggguggccugugcuauagugggugcuugucucaagaacagagcaggcuggauguggugcugcuggaggcagaggcaggugguguaagggaggcuagcguaguuaguguacagaccaagcuccaggucagccaaggucaaagagaucagaagucuauaaacacaaugauuggaagaaaaguucuuggacguuaugguauguuauguuacuguuaacagaauuauauuuaacuuauauaauacacaaguuauaauauaauauaauaauauaacucgccauagagugagagccuauguggaacaguauaacaguauaacagugaaacaguauaacaguauaacaguauaacaguauaacaguauaacagugaaacaguauaacaguauaacagugaaacagugaaacaguauaacaguaugacaguauaacagugaaacaguauaacaguauaacaguauaacaguauaaaacagugaaacagugaaacaguauaacaguauaacagugaaacaguauaacaguauaacaaugaaacagugugacaucagaacaucuggaacauggagggagcaucauacaaucaccgaaauaaacauuucacuguuuuauuucuuguaaucauuuuaccuaucuuaaaaguauauauagauauguugaacuuguuugcuuaauuugagcacuuuucauuuauuuacauuuccuacugaaauauuuuucagcuugcuuguccaugcucuuuaucuuguaaaucucccuuguaaauuagagucuuacauuaguauauucucuccuuguuucagauuaacauuggauugaugauuaaaguugaagguuauauuguuuuucuuucuuuuuuuuuuuuuuuaaagauuuauuuuauuaauauauguaaguacacuguagcugucuucagacacuccagaagagggagucagaucuuguugcggaugguugugagccaccaugugguugcugggauuugaacucuggaccuucggaagagcagucgggugcucuuacccacugagccaucucaccagcccuauauuguuuuucuugauuuagguauuuagcagagcuaugaguauauacugauuuuacuuggcuucccuuuguagggugauugugaggaccacgcuaaccugcugugcagccuucuucuuggcuauggacuggaggccuuugucuguguggggacuaaggccaagggggcgccgcaugccugggugaugaccugugggacugauggcaccaucauguuuugggagaguuuaacagggcacaggucagugagcucaguuuccaaggggaguauaaugcaggacucgggccagugagauggccagcggguagacacagcagagggcuggguccacacaguuguccucugacuuccacgugcaugcuacagcauacaaaaacuuaaauaaaacacagguauaauugugguauuguggaucaaaccaaaggcccugaagucauuuacucauucauucagucagucauucauucacucugugugugaggaagucaggacaacgggcagaauugauuucuuccugcauguggguucuggagcucacacgcaggucagcaggcuggagagcuauuaucuuucacacugagccuucuugaaauuguagaagcuuuuuuguuuggauggaacucauaaguacauguuuauaaucuuaguuauuagaggcuuuuggacauaugguagcuaaguaaaugacuucuaagagaauacuauguacuucuaaaauauuuacuaucaugacauuaguaauauauauauauauauauauauauauauauauauacacacauauacauacauauauacauauaugcauauacuuuuaguuuuguauaauuggcauacuuauuuucuggugauuauuccuaagacuaaaaauaaguucaaguugaaaaucaugguuuaguuugaaaaucugaaguaggcaccaauucuguuguuucuuccuggauagccuuucuuguuuuuccuucaucuuguguuaagcauucaguguuguaaagaggacugggcugccuccuuauuuucccaaguucuguuucucccugucugauaaucauuuugaauagucaugccuaauauuauacaagugaauuauuuuaauuaugauacucucugggauaaacuuuuuuuuauuauuauuauacauaaguacacuguagcugucuucagauguaccagaagagggcgucagaucucauuauggaugguugugagucaccaugugguugcugggauuugaacucaggaccuucggaagagcagucagugcucuuaccacauagaauauucccucccucccucccuccgucccuccuucuuuccuuccuuccuucuuucuggaaguugauuuuuaaaggugcacuauguagauaagguagaauaaugcaguugggagcuggcucaguagagcacuugcugugcaagcgugaguuccaucuucagacauuauguaaaagcccaguguggacaugugccuguauucccuggagcuguggagacaggaggcuccuggggauucagugaccaucugucuuacccagaacugugagcuccggguucagggacagaaaaggaaaaaaguggauagugcuggagacagagucagccuccagccggcacacacacaggagugagcaagugagagaaagauaacugccuuuacaguuuaagaauucucauuguauaaaacugucauuucuuuuagguacauccacaagccuaccaauccugacggaccuccacuugcugagcagcccaaaccacuguacccauaucgaacaauugguuguguuuucaaucaucagauguuccugggaaacugucagcccucagaugcaguagagaccugcauauuugauuugaaugaugaguccaaguggaaacccaugagcgaagaagcaauuaagucugugugugcuccaggugcuacuaccucccucccucccuucccaccucugugugcguccacgauugacgccucggucaccagcaaugaaaucgaaaugcagcugaggcuucuggugucggagcacagaaagguaacugacacggaagcaguuguggccucaugcucccuuuuguuguguauuuucuaacucuuccuugagauuauuuuauguguaugauuauuuugcuuguggguagauauguaugccacuugauugccugaugcccuugaaggucagaagaaggcucuggcuccccuuggacuagaguugcaguuacaaacugccauguggaugcugggaacugaaccuggguccucugcaagagcaguaaguacgcuucaccagaaagccaacgauccaucccaacuuuuuuuuucccuuuaaguguguucacuuaagcaaacacaauugcuaccuucaugaagauuauaguggcagaagccaugagacaguugugagacuuacaaauggcuaacucugggcuggggagauggcucagcaguuaagagcacuggcugcuugcuguuccagagguccugaguucaauucccagcaaccacaugguggcucgcaaccaucuauaauggaauccgaugcccucuucuggugugucugaagacagcuacaguguacucauauaaaugaaauaaauaaaucuuuaaaaaaaaaaaaaggcuaaaucugggcuggagagauagguuaguggcugagaacacuuugccuuuacugaggacuugagcucagauccuagcacccauaucgaguggugcacagccuguaacuccagcucuagggacucugacacuuuccuggcuuacucagagacccauaaucacaaacacaugcacauacacauaaguaaaaauaaauguuucuuaagaauuccuaagucuacuaaacccucuaaaguuacuauuuccuccuagaauuggagaauguugggcuuguucauucgcuuuagcccaguccugccacgcggccauacccaaaugcccacccugccacccaucgcugccccgcucccuuggcuaguuucuggacauuuuuuaaagauuuacuuuaugugaaaguuagugugccagaugugugcuucaugccugaggugguuaaaaaaaaaaggcauuggauuccuuggaacuggaauuaacaguuauaaacugccaugugacuacuaggaauugaaacuaggucugcugcaagcaucacaaguacucuuagacacugaguggucucuccagcccucuuccuguuccuuuuauuccuccugggugcagguaaagugacauccucggucuagcuuuaauuugcauuccuuuaauaauagugauggggagcccagagaauauaaggaaucaguuugccguugauggugucaggaaaacaagaaaaguuuauccaaggaggggauuuuaagaggaagcaucagccaggcagugguggugcaugccuuuaaucuugggaggcagaggcuggcagauuucugaauucgaggccagccuggucuacagagugaguuccaggacagcuccaggaaagcuccaugcucucuuuccccaaacugccugguaacuuucuuaucuauuaaaaugaagauaguacuuuacuguacuaucagguuguuuuuaacacaguccugcaguuugaccauggcuuucuuauauuauuaugaacauuuacauagcuaguaagccccugucaaugauaaggguuagugauuaagucagaauguggauacuuagucauacagcggagaucugugucaguacugaucgcucugaucuuuaguuaagcggguaagccugcaaaccugcaagagaggcgcgagugauagggaaaguggugagaaagauggcucagacugcguuuuaguaucuuacgagcauuugccugcgugugugugugugugugugugugugugugugugcgcaacuugcaugccucgcauccacagaguucagaggaggacucugauccuuggaacuggaauuacagaugcuugugaaccuucaugugugugcuaggaauugaacccugauccucuucaggagcaagugcucuuaacuguugagccaacuuuucauccuguuuuuaccuuucaaucucuuauaguguuaaacacagugccuuuuuagaguaacuguuuuggaaauucuugacauucauuuacucaauugacuuauugacuuugcccgcuccugugguugaguuuaugcagauugucuuacuaaaguucuugaggggaagcuggucuuguauauccuaggcuggccucgaacuuugugucacugagguuggacuucugauccuccugucuccaccucugugugcugggauuacaggaugcaccuuaacaccuacuuuuauguagagcuguggacugaacccaggguuccaugccuuaccaaccaauccaaacaaauauaaccuaaaaauugauugacauuauaucuuccauauuaggaugauuuuguauucuagcuagugaguaguuauuuuauacuucugagccuuaauuaaguacucuucuuacuagcaccuugcagaaaauacugaaugcuuuuugcacugucaaagaguauguuacagcaaguuauuauauucuauuucuuaaaaguaacuucuuuuuuuuaauuauuucuguuuaucccuagaauaauuaagagaaaauugggaaauuaggacagcuuuaaaaaagugucuucaggugggcaugguggcacacagcuuuaauccuagcucuugggagguggaggcagaaagaucucuagaggacauacugaguuccaagacagcuugggcuacaugggcucugucuuuuuuuuaaaaaaaaaaaaaaaaaaaaaaaaggaaaaaaaaaggaaggaagaaagaaagaaggaaagaagaaggggaagaaaaaucuugaaagcgugggaagcagaaccaggcacaucugugaguucaggccguccagggcuacguggugagaaccggucuaaaaaggaacacaaagcucuucuugccaggugugcugacacaugucugcaguccuagcacugacgcggggguaagacaacaaccauuucaagauggagaccauccuugauggugagauaggacugugcaguuauacaccacaugucuugaguugggugugguggcaccugucuguaauccuggcauuuggaacguggagacagaaaaugaaggacauacucagcaucacaucugguuuauaucagccuagacuaugugaaacugucaggaagcaacaaaaauaauuaagccauuucuaggcauacauucuagugagcuguuagcuagguauaguggugcauuccuauaauccuagcacucaacggcuaaggcaggaggauugcaaagucuaugcccaucuaggccauguucagagacccuggccaaaagcaaaaagcacauuuuuauggaacuggucuuuaaaauauuaauauaucucacauuuuuaauugcuacaggaccuuggccucaccacugucugggaagaccagcucuccuaucuuuugucaccagcucuggccucguaugaguuugagcgaacaacaagcauaucugcaggcaaugaagaauuucaggaugccaucaggagggcuguaccugacgggcacacauuuaaaggcuuccccauacauuuuguguauagaaaugcaaggcgugcauuugccacuugucuucgguaaggauuuuauuaauucacaauuuaaaaauuaguuaauuauagauauuuuguauuaagaaucuagaaagcaauuaaucugauaauugcuaggugugacaaccuauauacaugggagcuucuacagugacuuucuccuuaacuacuuuuucuuuuuauauaggucuccuuuuugugaagaaauaaucuguugucguggagaccaggugcgacuggcaguucgcguucgaguguuuaccuacccugagucugcaugugcuguuuggaucauguuugcuuguaaauaucgcucaguauuauaggacuaacauuuccuaagaauuauuccuguguuuuauuagaauuguauaugagcagcuguguguagguuucuuaauuuaaaaucagccuuuuggaugucauuguuuuacauagaucugacugguaauauuuuaaaauaucauguaugugcuuaaaaauuaaggauaaaaauuuguauugaauuuaguaugaauuaaguguauaauaauaaaugacacuguguucugagggacucgguguuuaaaugugaauguaagaucuguuacuuuacaucaguaaguaaagagauuugucuacuggcuuaagccauaguuaauucaaaaugaucccuauuuuucauaaaggaaagauuauuuuacacaaauuaggaaaaauuagccucauaauaguuuauuuauuacauagaugaaaauauauuuugcuaaauuauaauuuuugugugauacuagggguauaugaggcuuuccagaagucugugugaagacuuugauguaagaauagaaaaaagcuggugugguggcacacacuuuuaauuccacaacaggucuacauagcaaacuccaggccagucagggccacacagugagaaccugacuccaaaacacaaacaacaacaacaaaaggaauguaauaaccaaaaagcauaaguguuaauaaugaaucucacaugaauaugcagaaugugaguaauuuauggauauuauuaaaauuaauugagcacuuuagaaaauacuuauuauacuuccuuguuacaaugcugguuguucuuuauuuuuuuguugugauaaaaucaccagccuacuggcaggccaugguggugcacacuuuuaauuccagcacuagggaggcagaaacacgcggaucucaacuucgagagcagccuggucuacagagcuaguuccaggauagccaggguuauacggagaaacucugccucaaaaaacccaauaaagaaacggaucagccuauaagugacuaaugucauugacaaaaaucauaagaggccauugagaaagcaugugaguuuauauauuuaucuuaaauugagcaaauuuaaauguuuuaagagagcaaagauaagcauuaaaaaguaauucaacuuacucuaaguaacgaaugaugaauauuuugacugcccauucuguguuucugugcagaggguuuuauugucuuauuuuggugauacuaggaauuagaucaagggcuuccuacaugcuaggcaaacauuaccacugagcuauacccacagugucucaguuauguagcccuggcuggccuagaacucccagaagguugcuugccucuguguacaguuucuuaguuuagcugcuuuauccacuggucuucuuaagaaauaaguguaugccagcccacuauccaaauuauuuauucuuuucaucacuugcuguugcaaauaaaaugauuuuauuuauuuauuuaguuuuggaugucuugacuuuuuuuauaguguguguaugugugugugugcuuguacauaugagcgaguauaagccuuagaguuuguagcaaucaggccaacuuugaggagcaggcucugucugucacacugugggcucuggagauugaccucaggucagcagucuugccagcaaggaaguaaggaagugccuuuacccccugagccagcucgcuggccuaaaaaugguuuuuugaaauuaaaaucuaaagauaccaugccuaguuaugguugcacaggccuuuaaucccaguaguugggaggcagaggcaggcauaucucugaguuugaggccagccuggacuauagaaggggaguuccaggacagcuagagcuacacagagaaaacauugucuaccauua

SEQ ID NO: 8965 - RNA, 59127 nt, Mus musculus
gggcggggcggggcgcggagcgcgcaugcgccacagugccagcgcucuccccggauagagcggggcccgagccuguccgcugugguaguuccgcucgcgcugccccgccgccaugucggcaaccaucgagcgggaguucgaggaacuggaugcucagugucgcuggcagccguuauacuuggugagucuuaggcccgcgcggcgucccggggcuuccgagggucggagcucgcgccugccggcuccgugucaccucccccgucucccgcucgggcggaaguggcgagcgcgggccgcgucaggggcgcgccugcgcggacaguccucaccgcugugaggcuuagaccugaagcaccgaggugccggucgccuguugguucugaaggcggcgccacagcggcgccugcuggcggcccggccggccucggcguguggugcgccgggcggagggucgaggggcacccggcgcggggugggacgggcuccggcuuccucgcugaccguguucuugucggccgaauguucgguggccgagcgcgcugguagcgggagcagcgagaagggcgagagagcccucuaggaucggggccagcgaaggcaaagcggggucccacggagucucggucauuugcgggugucccgggggccuguggccggagcucuauaccagagccggagcugaagcggcggccuaagcuccugagggaucggggaucgccagucuuuucauuggccacuuucucugggagagcgggucaucuucugcuuagagcuccccggaacaacaggggcuuugguuguauuaccauugauuaaaguagcguccucuuuagaauuuccuuugcuuaggcauacuuuauagauguauauauaguacaccacaggaauuuauaugagccuugcaguugguugcauuucccaaaugagugcacuggucgucguagcacucaaaaguaacccaacaaucuuucgguccaaaagaggccacaugucuauaggccgccgcugugcucugucaccagagaauaaccuuaccuauucagcucauucuaaaguauucuuuccuaugaacgcuugugacuaccuuuuuacagcgugugggcuaccuuuuaauccaggcaaaacuuuucuccccuuaaaaaugauucauugcuaaucauuaacgucuaucccagaucagauuuagugauuggugucuccuuauguuuuggcuuguuacuacaguacagaaagaagcuagaaagcuuucuuuuagcucuggaugacucuggguuuucaccauuucauuuaauuagauggcaguaaaaauucgcuuuguuuaggacuuauuucucccauccuccuuugagauaaggucucacagucuauaacuuuugcuggcucagaacuugcuuuguagaccugccugaccuugaacuccuaggcuggcuuugaaguccuagucuucuaacuaccagugucaaaguucuggaaagaaguuguagaaaaucuuaaaugcaaauucuaguggauuugugugugugaacuugcaggucuguggguacauuagauuuagcagagugccgccucaaaaaugccaaugacaaaagggguacuaaaucaaggaagauugcugggugguacaugccuauaaccccaaaguuuaagaggcagagggaggucugugaagugauuuuauuuuauuuauguagccuuggcugaccuugaacucagauuguccugccuccccagugcugggacuaaagccgugcaccuccauguccagcacagcucugaguuuaggcuagccuggucugcauaguuccagaccagccagggcuacauaguaagaucaaguaugcaugaucuuauauacauacauacauacauacauacauacauacauacauagaggugggagggggacuagagagauggcuuucauuuaagagaacuuguucuuccagguugauuccuagcacccacaagcagcucacaacuguuucuagcuccuguuauugggaauccgaagcacuccucuggccuucagggaugccaguuaugcacauggugccuaggcagacaaaaugccauacacucagaaucaagggggaaaaguaaaauaauaauaauaauuacuauuguuacuacuacuauuauuuuaaaaacaaggguucauacuagcaacuuaauuuagccuaauuuauuuucugagaccaggucuugcuuaguaucacaaacuggccuauaauuuaccacuagguuuggauuugugacaguccuuuugccuuagucccccaauugcuaggauuauagggaagagccaccacauguggcuuaauuggguacauacauguaagucauuaaugucugagaaguaagugaaaguugugaucccacuuaacagggaaaaaaagcacuuaugcuggaugguggcucagccuguaaccugucaauuaggcugaagcaggaggauuguugugaguuuaagacuagccugcagcugggcuuugguggccaagccuuuaaucccagcagagucagguugaucuucaguguucagccagccuaggcugcauggugaguucuaugcuacccaggacuaaggaauacauucuuguguuggaauaaaaaauuucuaaacaaaagccagucauaguggcaugguuuuuuugggaggggggcauguuucgagacaggguuuuucuguguagcccuggcuguccuagaacucacucuguagaccaggcuggccuugaacucagaaauuaaaggugugugccacuacagccugggguggcauguuuuuuaauccuagcaccgaggaaguggcuccagaaaguaucuggaguuuuaaaggucaucuccagcuauccguggaguuaugggucagccugggauaaucgagacucgguuuaaaaguaaaaaucuugcuggcaagguugcucuguggguuaacaguugcccagccugaaaacuugaguucaguccugugauucacaaggagggagagaaccaccuuucuuucacagaucuucguauauaccugccuuuuugugugcagccacaauagcgaaguuaaaauguaauuguaaacaauuggauguucagggagauggcuuauuuguuuaguguuugcugugaaagcaugaagaccuguauuuagaucuuccccauuuccauaaaaagccagguguagcucuaaucuuuugugcuggggaggugaagaccugcaaaucucuggagcucacuggucagcgggccucccugaagcagugagcuccagguuuaaugagagacccaguuucaaaagauaaggguuugggggcugcagagauggcucagggguuaggagcccuugcuacucuugcagaggacacuaguucaguucccaguguccacaucagguaucucagaacugccuguaaguucagugccagaggaucugacaucuucuguccucuauggggagugcaauccugugcacaaacacauguuuacacauaacuaagaguaaagauaaaaacuuuuuuuaaaaaaagguauagaacugucaauggcaagaagauucagagcauaugugucaccucccaagccugacaguuuguuugauccuugguacccacaugauggaagaagauaacugauuccuacaaguuguuuccugaucuccacaugcaugcauagccuuuauaaguaaaugucagaaaaaauaaauacaggcaaauacacuuaacuuguguucacugaaaauuucuuuuucagaaacccuccauagacaagugcacaagaucuuuaagcaaaauaguaguucugugcuggcacuuuuuuuuucaagcccaagagcauuaaaaccaugcuauguacauugguguuacaguaaaagcaagccaggagccacugaagcuaauaaugacaagcaaguccggaagaguuuggacuuaaugcuuucuuaguauccuggagcauccaucucacauuccacagagauggcugcuaccaacaucugugcugucaaggcucuaauucugugagucuugaggaccucuuuggaaggucauacuuugcuuucuuucuuuuuuuuuuugagacaggguuucucuguauagcccuggcuguccuggaacucacuuugaagaccaggcuggccuagaacucagaaauccaccugccucugccucccgaguacugggauuaaaggcaugcgccaccacacccggcuaauugaguuacuuuuaagauauuagaauaacuggccaggcggagaaguagcucaagcgaagcaguuauuucucuccuucagcucuguacucacuguuuucccagugcccacauguaaaauucagcucuucugccucaauaccacuggggcugccucuguguggcuuuauuuccuaugucauuuuucucccccuccugcacuauuguggucuguucuuggaaauguguguauccacuuauccccgugagccucuagaaugaaauuuccuuugcacaacugcucuccuguugcuucuuuccccuguugcuuaacaccuuugcucaugucugacgcuggacuaauuugggaagcuuccuaaccuaccaguccaugcuggauaugugcaaaucuuugacaguaggguugaagaaaugcagagguucuguguguguucccagcacccacauggcagcucacaaauguuuguaacuccuguuuaagugagcauucuuccuuauuacaaguaagugacgcuaguaauaauguuuuaugaguucugcuuuuucugaaaugcuaaaggagcuaggagaagaaaggauugcucucaaggguaaaucaagauccucagcuuuuagcugcuugauggacaugagaauguuuacuucguauuuuauuucaguuuuuguacuuacgaauaaauugaguauuuuugguugagguucuggccuccucgucuuuuuuauucccuauagacaguugcuuuagagcaucacuuuuggaaauaggugucguagcucauacugauacuagcacuugagauacuucaggguggaggaucuuagaggucagucugagcagcguaucuaauuucaaguuaauucauguaauuuagcaucauccuauuuuuaaauaaaagaaaacaaaccuaaaaagccaugauuuaguaauaggaagaguuucuugguugguugguugguugguagguuuuuuuuuuuuugagacaaaaaacucacucuagccuugucugacuuagaauucacaauguaacccgguugggcuccaacuagcaauccaucuucuucugcuucuucagugcuaggauaaagucaagcaccaccaugcccuacuuuuguuuuuuuguuguuuuuuguuuuuuguuuuuuugagauagaguuucaaucuauauagcucuguuacuuuggaacucacuguuuagccuugaaccaaugcugauccuccugcaucaguuucugaguacugggauuagagacaugggucaucacgccuggugaauguugcuggauuuguguuuuuguuuucugggggauaccagucaucaagucugugguuucacaaugccagucagaugcucuaccacugagccagagccacaguuaccucucuucucuccccacacaauuucugagcuaggucucuguaauuugcuagccuugaacaugauaucuuucuccuuuagccuacaaguuguuggguacaggccugggccaccaggaugggcaaggcgaaaguucucgauuuauagaaagaaagaaaaacaaaaugcugcaguugcuaaaaucuauauuaaggccaaaucuucagucugaggaauuggaaggauaaagaaauuugcugguuuugcugcugugguguguguaagugugcuaauauggaaaaggacuuaaauugcagagcugaguauuauuaucugguguucuacauucacugggagcuaggaaugaacucccacagauaagucucuuggacuauuuuacauauuuauacacaucuguagauuuuuuuucuuuuuuuuuucuuagauauuuucuucauuuagauuucaaaugcuauccccaaaaccuccuauccccccccccccccccccccccguuccccaacacacccaacucccgcuuccuggcccuggcauuccccuguacuggggcauaugaucuucaaaauaccaagggccucuccucuaauugauggccgacuaggcuguccuuugcuaugcaugcaacuagagacacagcuacacagcucuggggguggggggugggguacuaguuaguucauaucguuguuccuucaauaggguugcagaccccuuuagcuccuuggguacuuucucuagcuccuucauuaggggcccaucccaauagaugacugugagcauccacuucuguauuugccaggcauuggcauagacucacaagagagcuaugucaggguccugucagcaaaaucuuccuggcauaugcaauagugucuggguuuggugguuauauaugggauggauuccuggguggggcagucucuggaugaucuuuccuuccaucuuagcucagaacuuugucucuguaacucuuucuuuucuuuuuuuuuuuuuuuuaaaccuuuaacuuauuucuuuuuuuuuuuuaaauuagguauuuuccucgauuacauuuccaaugcuaucccaaaagucccccauacccccccccauccccuacccauccacucccccuuuuuggcccugguguuucccuguacuggggcauauaaaguuugcaaguccaaagggccucucuuuccagcgauggcugacuaggccaucuuuugauacauauguagcuagagacaagagcucugggguacugguuaguucauauuguuguuccacauauaggguugcaguucccuuuagcuccuuggguacuuucuugggggccgugugaucuguaacucuuuccauggguauuuugucccccauuguagaguuauuuuuaaaauuaucuuugugauguauagugugaugacauacuauuaauuuuuacuuuugcugauguauagaguccuaaauucuuguaaugaauauguauuaauuuauuaaaggugcaaauuucuuuuucucuccaauaaaaucacagauaaaaacccaaaguaaggcuagguauaguguggugcaugccucuaaucccagcccuuaggaggcagaggcuauuagauuucucaguuucauaggaggcagagcaacauaaaugagacccuaucucaaaaaacaagaguaagauucuuuggccacuugguagccugguucuccugagauuacugguacacccucauauuggaacagggucucaaguagcccaaacugacuucuaacuacuuaacugagacuggcuuugaauauauaauccuguugccucuacuccaaaguguugcaaccacaaacuuauuaccaccaugcucagaauauuuuguauuuuaaagguaagcauugguuauuaaaacaaaacacuaguaagcuagguaugguguguaugcauguaaucccagaauuuagaagacugagauuagguuugccaugaauuugaggccagcaagggcuacaaaguaagacccuauuuaaaaacaaacaaacaaacaaaaaaaaaacaaaauccaaacaaaguaaaacccugcaggagaucuuagaauuuauuuuucuacauuguaucaacacaguaagguuuuuuguuauguguguaguaaguacagccuguucaugccauacguguauagagggucaccuaaaacuucugggaguaguuuucuccuccucagcaagcuccugcgaucaaacugaggucaucaauuuguguggugcuagcccuuuuaucugcugagccaucucaacagccugagacuuaagauuuuuuuauacauacauacuuuuaaaauuaaaagguuguuucaauauguaacccaacagaaagauuuuaacuaaaaacauuugcuuaucucaauuccaauaacugcacugaaauaaauuccuuccucccucaaauuuguauuuagaccagguaucacuuacuucaaguuaauuauaaaagcuaucuccagaauauauguacagguacacacacacaccacuuacuucaaaguaauuuugaauuauccccaaaacauacauguacacaccauuaacaucugucugucuaucuauccauucauccauccauccauccccccacccauccauccacacacguaaaaauagugcuuggucuuguauucagaucucaccuaccaccaccaucuaguuuuuuuuuuuuuuuuuugagauaagcucuuuuuuguuuguuuguuuguuuuuuguuuuucgagacaggguuuauuuguauagcccuggcuauccuggaacucacuuuguagaccaggcuagccucgaacucagaaauccaccugccucugucucccuagugcugggauuaaaggugugucccagcacgccuggcuuguggcuguuucuuuaaugaucgucuuauaacaaauuguuuuaaggauuuuauaaauaucuacuuaggaggaucuucucaauucugugaucuguguaaaagaauuauuuuauggucugguuuguugcaguuaaaaaaacccugaaaauaugguagugacuguaauguagacuucagugauuucuucagcauaagugugccaucggguaccauucuucaccuaguaauguagaagcauaguuauggcuucuuucugcugcagacggggaaacuuuuagcaccagaaugcacaucaguuguuuuugcaacauggccuuggugguagcucagcuguuggccuuccuugucucuuuuugagaaacacuuuguauuucauuaacuauacuaaaagaucggauacaugcagggaagugggguaucugggggccugccaggcugugccguuaaaaauuacgccauguaacagguuuauugggagaguagggagacugaaaugccucccuagacugggacauuagagagagauagacagacagacagacacacacacacacacacacacacacacaaagauagauaaugaaggagagagaggaguaauugaagagagaaacaagagagugaucuggggugggguggaguuaggaggggguuacacacugugugcaccugccacaccugucccccuguuggcugggguggaaggugacauaagccaccuuuauauuccugagggcuaacacuaaaugcucauaaaaguuacaucuuggguauugcucccccccccccccaaaaaaaaaaagaaaagaaaagaaagcuguacagugucagaugguaguuugugaugaguuuugguuauacacugucuuaggguuuuuguuacugugaugaaacaccaugaccaaaaccaaguuagggaggaaagaguuuauuugccuuacacuuccuguuugaaggaagucaaaccggucaggaaacuggaggcaggagcugauguagaggccauggaggggugcuacuuauuggcuugcuccuuaaggcugcucaggaccaccaauccaggggcaacaccacccaccaugagcuggacccucuccuauugaucacucauuaagaaaauguuuacaguugaaucuuauggaacacuugggguuccuuccuaucagcuaacuguagcuugugucaaguugucauaaaacuagccagcacauucucauuauuuagacaucugauuuagcugcauaggaaggaaaauaaagcaguaauugacaauagguuugugguuuuuguuuggugagaguucugaagcuagggcugcuguugugacucccuagugccacugaugguagccuuuaauuucuguguagcuuuuuuuuuuuuuuuuuuuuuuuaagccuagugaucacaggagguuccugccuacucccaucccuuacuccugguggucaaaacagaagagagggcaagaguuugcugaggcaguuuuucuuuauuauugagguuucauuuuugaggcaggaucucgucuuaaguguugcccuuggccaagcaugguggcacacgccuuuaaucccaguacucgggaggcagaggcaggaggauuucugaguucgaggccagccuggucuacaaagugaguuccaggacagccagggcuauacagaggaacccugucucaaaaaacaaaaaaacaaaacaaaacaaaacaaaaaaaaaaaaguguugcucuugaucacuauucuuggguucagguggucuucccaccucagccgaggagcugcuacugcccagcagcuuauccagugugugcaggccacucagcuggcacagauagcaggauaaaccuuucucuacaaccaagcccagugcugcugcuuauuccauuggccaccuuuugucacaagccuuuuaaaauuugagacagggucuuauucccuauguaggugaggcugcuuucauagagauccaccuggcugugccucccuagugcugggauugaagacugugcaccacccaugccuggcucauagacaucaagcucuuguaaacuagaaaaucaaauuagaaaccuucaguuaggaagaagggaaagugggauuggcuguuggugugugugucucuggaacuggucuuuauaaagcauugggauuucuuaucuuacacuggccagaguuaaaaacagaaaacaaguggaagauugaaggucugaaagaauaaauucacuaaggguuuuuuuguauucuuagcuaacaaaagaaaguaaguauggcucuauuuuuuuagggcugaauauuuggauugggguguauauauggcauuguuuuguaacucuuaaguccuuauugcuguacuagcuccugccaucuuuuauuuaucuaauaaugcaucuuaauuaauucuuugagaacuuguaucuugaucauauuaauaugccccuccccugcuuuuucccugaaacucuugccagguccauccacuucuuaucuccccaucacauuaugccuuuuuuauuuaaccuuuuuauggauuuauuacuuuuaauuuuauguguguuuugccuucauguauauuugugucaugugaguuuagugccuacagcgguaagaagagggggucagauccccuggaacugaaauuauacauguuagccaccaugugggugcugggaauugaaucuguguacucugaaagaacaaucaguguucuugacugcugagccaucucucuggccccuauguuuaguauuuuaagagaugccuggagagauggcuuagcucuuaagagcacuggcugcggagcuggagagauggcucagugguuaagagcaccaacugcucuuccgaagguccugaguucaaaucccagcaaccacaugguggcucacaaccaucuauaguguggucugaugcccucuucugggaugcagaugcacaugcaaauagagcacuuguauacauaaaauaaauaaaucuuggggggaaauccuuaagaagagaccgucuagcuggguggugguggugcagguggugcauuaauucaaugagaggcagagacaggugagucucugaguucgaaguuagccuggucugcagauuguugcaguauccugucuucugacucaaucuuuguucuuucuucguagauuuuucccuaaaccccuagguauguaggaaguauguuguggauuuaguggcuggcuaaccccugguuagcucccugcauuuugacaaguugugaaugguuucuguguuacaugaaguuucuuuaauaagcagccuguccuacacuuaucuauggauauaagaugaauaguaggagugggauugagagcuauacuuuguugguuuuuguuuguuuuguuucucuguauaacagaggccuagcugucuuguagaccauacuggccuugaauucaaagaaauacaccugccucugacucccaagcacugggguuaaaggugugugccaccaggccuagcccuuuuuucccaccaacaucaguaauuauuauaguguauacauagaauuuugucuagacugaaaaauaagaacuagcaacuaauagacaaucacugaggaagauaggauuauacaacagaacaguugaagauucuuguacagguuucauggagggaaccucugcugaccaguaaauuuccuuuccuugucugucuguccgccuguucguucgucuguucauccauccagcuauccauccauccaucuauugagucuggccuagaacucuaccucuagcucuugaguguugagauuaaagacaugugccaccacacccagccaccaguaguuuuuuaaaaaucucauuuauaauugcauuagaguuaauaagauuacucagaugaaacuguuagcauauuauuuuugaagaaaaauaaauuaaaauaugagcuguaacacaaaagaggugaauaaauagaaacaaagcaacuuuuauuuccauauauuuagacuuuacuauuuagcauuaguaacuaaaauuuaauuaucuugaugauaaaugaaauuuugaaauagaauuacacuuugaaagaacaaguguaacuggugaauguaaaaauuaauaaauggcauggaucauuucuguuagcauugugagguuugauaugauauaaacauuucuuuguagaguacuuaaaguaagugcuuaauguuguccuauauugccugggagaauauauguugcuguauaaaauuuaagagggauauuaaauauauauuuuuguuauuuuaaggaaauucgaaaugaaucccaugacuauccucauagaguggccaaguuuccagaaaacagaaaccgaaacagauacagagauguaagcccauguaaguacuguaagauacagagauguaagcccauguaaguacugugagauacagagauguaagcccauguaaguacuguggguuuaugugcauguguguguucuucagcuuguuucaggagacccgaugcagugacagucuuuggguaaagauugauuaguauagcaauuuuuaaacuuuuauauacuuuuguuuugagacaggcuuucacucuguagucccacuguucuggaaauuaccauguagcacaggcugaccucaaauuugcagcagucgucuugucucagccuccagaauauugggauuauuaagugucagccaccacacgagguuuaauguauacauuuucucauguguuuguacacacgcauguggaagguugagguugauggucagaugucuuccugaauugcucuuuacccuagagaucuguuccagcuagucuggcuggccaucuuguucuguuagaacuuguccugggauuacagucaggcugccacacccaccuggccuuccaugcggguucuagggauccagucuccaccccuuacauuuacuuagucaucuccccaucccucugguuugaggaacaucugauuagcucuucuaagcucugguagaauucagcacuuaauugucuguugcacucagguggaggauguuccuauaacagcucagcauuuccuauccucauccaggguucugcagucugccagugaacugacccucacaaaggcucuccuucccuguuguacagcuuuuuucuccaggugucagagccacuuacugugugucgugucaucccccucuucagcacauucauccugguguccugauaucugaguaaacacuaugaaacaccagccuuagaguaccuaggccuuuucagcacucuuugaucuugugcccacaaagaaagcagggagggauuuuuuaaaauuuuguggcagggcucccugcaucugcuauacugucuuccaacugugacuuccugaucagucuccuaagugcuggaauuacaggccugugcaccacacccagcuuucacccugcaccuugaaggucacuuucugugugucacuacugcuuuuguuguuuauuuuuuuguuuugcuuuguuuuauuuuuguuuguuuuugaauauuucacuuagaauguauaugguuuuuccuggcauuggguucuuuaauacuuugaguuuuagauuacucaaguguugcuauauccuucaguuuguuuguucguugagacaggguuuuucuauauagcccugguuguccuggaacucacucuguagaccaggcuggccucacacucagaaauccaccuuccucugccuccaagugcugggauuaaaagcgugcaccaccacugcccagcugcuauauccuuccuuaaccagucuguuucucauaucuauuuagcuguuuuauuuuaaaauaucuuugaccuuaauucuccaauuuaugaagccccauuuuggaagacuuuauucuuuauucccuuagagaguuuaaaaacucaagaacuuagagucaagaaacaacacuuaagcuguaaugugacaccggggaagugccucagcuuaugcacaucccugaagucccagggcuucuguuucucuauuccuuuguacauacaucccuuccuucuuuccuccuccuggucugccuugcuaucuucagccucuuugucccugcuuuuccuucuuauuacauaaauaggauguagaaugcuuuucccuuucccucccacccccaaguuauuuccuagguagaucuaugcaucuacacaacagggguuuuuguuuuuguuuuuguuuuuguuuuuugagacaggauuucuuuguguagccuugacuauccuggaacucacucuguagacuagacuggccucaagcucacagauauccaccugccucugccuccaagugcugggauuaaaggcauauaccaccaucgcugcuaucaucacugcccugcugaacauaacaguuuaaaaagaauauauucugggacuggagaaauggcuuagagguuaggagcacuggcuacucuuuuagaggacacggguuuaauuccuagcacccaaaugcaucuguaacuauaguucuagggaaucugauguccucuccuagcuagccucuguaggcacugggcacacaaguguagguacauagguauacauguaggcaaaacacccauauacauaaaauuuaaaaaaaaaaacaaacccaaaacaaacaaaaaggccagguggugguggcauacacacaaucuugacugggggugggggggggugggaagaaagaaacaaaaagaucaguuaguucuccuuucugucuguccugaucaccugugcucucuucaugaacccccaugcagcuaccacacccuccucacuggaacuuaguuaccuugcuagcuuucagaugcaaucaaugacuuucccuugguuucccuucuuauccuucugugucuugugagauugccgacucugucuuccuucucaaggacuuauuuacuuuuucugucugcucucccauuuuuagagccguccauccucaauuuaucuuuauuuuuuucaagggucuuuuccucuccucacuauuuuuucuuaaucuaugagugaucucauuuucuugggggccaauugccaugcuuauuuucaugacuucacauuugaucugcagucuuggucuuaacuccaaacagauguuugcaaguugucaugugccaaccugacaugaaguuagucaaagaaccauagaaccauagaaagcuuauagaaccaaugguuggguauucccuacauugcuuuauuccuucuauuuguaacugguaccaccauuuacauauugacuaauacuggaaacagacuccuuauucaucugccacaucuaauuaguaacuaaauaguuuacugugagugugaucuauuuaaaauguuuucuuauguacauacuagcuuuuuugugauuuauuauaguaacuucuaaacuuuugggacuauauagauggcucaggaguuaagggccaaauacugcuuuuguagaggacuuggguucguuucuuaguauccaucugguggcucacaaaacaccuguaacuucaacacauccaacaggcaugcagccccccuucucucucucucucucucucucucucucucucuuucucucucucucucucucucucacacacacacacacacacacacacacacuaaaauaaccucuauagcuccauucuauuacugcuuucuuccuuucucuuacuauccaaguuguuuucccgccccauuaaggcagaaauuuaaguuugucaucauuaucauucuagacuuuuuauauaccuuuaugacccuuuauacacaucuagauuuuacuuauagcuauuuuccuacaaauuauucauuugaguaagaguggauuacuuagcauucucccauuaugacuaguuucuaacauacuguguucucaaauauggugcucacucauuucuuucuucucuuuaaugacagugacggucuucucccugcagugccaaaucagccgcgccuuccgccggcuggucuuuucaccauggagaggauauuauggaagcaggguuuugugugugagcaugcauuuuaauguuuuuugagacagggucuucugucuauuauguagcucuggcuguccuggaacuuacucuuuauaccuggcuggccucuaacucacagagaucugccuguaucugcugucaggagauagagacaguggagucacugugagugugaggccaaccugaucuacauagugaguuccaaaccugcuaagaccauauacaaagacccugcuucauaaaaacaaauaaauaaaagcugcacagauuuaugauucuauuaguauggcuuaccuauaaucauaguccauuguagcuacagaacaagaauauucucaguaaauauguguauaaaugaguugauacauggagagaaaauaacaaaaaguuagagacuuaucuuccuccuccagugaaaugacauugugcucuuuuggagagagggucucaguauguagccuuggcuggccugaaguuuuacauacaucaggcuggcuuugaauucauagacaucaaccuucccggccuccccuuugcuaggauuaaagguauauauuaccacaucuggggacaagucugugcucauaggcuuuuaaaauuuauuuauuuuuguauuuuauguauaugaagguuucuucugcauguaauucuguaccacauguguaugugguaacugaggaggcuaggagaauguggaucccugggacuuguuauccaaguaacagauggcugugagcugccauguggguucuggaaauuaaaacuagucuuccggaagaucaggaaauaauucuuuuuuguuuuguuuuguuuuguuuuguuuuguuuuguuuuuuucaagacaggguuucucuauguagucuuggcugccauggaacucacuuuguagaccaggcuggccucaaaacucagaaauccaccugccucugccuccaagugcugggauuaaaggugugcgccaccaccgcccaucagcagauaauucuuaacugcauaagcaugaugucuccagcaauggaccuuuuuuuuucuuuuccuccaauuuuuuauuagauauuuucuucauuuauauuucaaaugcuaucuggaaaguaucccauacccccucccccacuccccuacccacccacucccacuucuuggcgcuggaauuccccuguacugaggcacauaaaguuugcaggaccaaggggccucucuucccaaugauggccgacuaggccaucuucugauacauaugcagcuagagacacgagcucugggguacugguuaguucauaauguuguuccaccuacaggguugcagaccccuucagcuccuuggguacuuucucuaacuccuccauugggggcucuguguuccauccaauaguugacugugagcauccacuucuguauuugccaggcauuggcauagccucacacgagacagcuaugucaggguccugucaacaaaggacuuuuuuugugauaaauuucauacuguacccuaagcugaccucaguuguggcaacucuuccugccucagcuucccaaaugcugggguuacaguuguaagccaccacagcuagccuuauuuuuggcuuuuugagaaaagggucuccccaaguuggccuugauccuccuccuucugccuccaaagugcuaagacccugugugcucaugguggacacaguauuauaaagaaguugauuuaucucuugccuaucacugaaucucaugaggagcagaagugugaauuuauucaagauaaggcuucuuacuuaacccuccuaugaagguauugcugcuggaaguguacuaaacauuaauucugcauugccagaggugcugaagauugcccuuauccuagcaaaauggauugacacaguaguagcaugccuauccuuaugugugacucauccaccugugaugugugucagguuugcugagcacagaaugagccucauuaggggugaugauuagaagcuagggaagugaguaagccucugcaggaccaaccaaaagggaaaaacuuggcuaagugcuaacuuguacucgugucaugauuaaggaugauaccaaagaauucucagauuagcgaugucauugaugaacacuucaaaugcaagaaaugaaaaauagaagcuuuugggggagagauggcucaguguguaagagugugugcucuugcagaggaccugggcucaauucccagcauuuacagguugcucauaaacugucucuuaacucuaguuccaggggaucugaugcccucuucugauauccauugguaccagacacacacauggcauacauaacauacaugcagucaaaauagucauacaccuaaaaauaagauccauauguuuauaaaaaguuuuuuauuuuccuuaucaaaaugaaacuuuaaaaauacugaugaaauuuuaguuuaguguuuuaaguucucaagucauuguuuguuuuguuuuguuuuaaagacaggguuucucuguauaguccuggcugucuuagaacuaucucuguagacuaggcuggccucgaacucagaaauccgccugccucugccucccgagugcugggauuaaaggugugugccaccacgcccagcuuggauucuaguuuuauagacagugaacuguucccacuacguucuuuacuguguuuauucaugcagagugcagauuccuugcagguacuuucuagagaacauuucuaaguacauggaaagcuucaacagagaccuggaaacagcugguuuaugcuuuuuuguuuugggggauugaagcaaagacuaggugcauguuagacaaaugcuaaccaugcucuuacaccucuaucccucuguacuauuucucuuuugagacagcguacugcucaguugcauaggcuggcucuugagccagcauguaggccuaggcaagaaacaggucuuaaccuuuagauaaucuugccucaaccuccuaagugacugggaaguacaggucuaccucauuguaucucaccguuauuugccuccauuuguuucaaaaaccccucucccgugcccccuuuaucucuugauucuuuaucaagugcagccuuccuccucacccuucccagacugaaguuuccauuccccaguaaggagcuguuuggguucuguuuuguuuguuugggugccaggugucaaauacugggcugaugacuucuaaguugguuucauuuccuagcuguugugaauaguucauaguaguauacauggaugugcaacugucuguggcauguuggcauagauuucuuugcccacgcuuuuggaaaguugugggaaucuuuucuuguucuuuugguauuuguuaacuauuucauuaaaaauuuauacauuagcuuccauuuuuuuucauucauagcuaggguauuccaauuuucuuuugcuauuuauggauaguagaauaaaaaagggaguaauugccgggcgcaguggcgcacaccuuuaauaccaucacucgggaggcagaggcaggcggauuucugaguuuguggccagccuggucuacaaagugaguuccaggacagccagggcuccacagagaaacccugucucgaaaaaccaaaaaaaaaaaaaaaggggggggggaguaauugaaaacacuauuacacugccaugauauuaugccuuuaaucccaguacucaggaggaagaggcagguagaucuuuugaguucagggcucugugaguucaaagcuagccuggucuacagcagguuccaggacagccagagauagacacaaagagaccuugucucaaaaaccaaccaagcaaaaaaacccuuacuauacuuacacuucucacucacugaauaauucaaucugacagcccuuggggugggggugauggucuuaaaagucauguaaaggugauaauguccuaaaaggaaagaccuuguguggcaauugagcuaagagugagcccuguauuguuagauuaggauugcuguguucuuguauguuaggaccugguuuucagugaguacugauauguagaaaaggcugggaauguauaguucagagguugagugcuuucccaguuauaaagacauguuugaauuuuggcagccauauucauauguuuauuagccuuuuuuauugagacuuuuauuuuuuaacauuuuuacuuuuauauauaugugcaugcauuuguguugggauggccgggcauguguacauauggguaagcaucuuuggagccagaggguugaugcaucugaggcuagaguuauaggcugugguaagcugcccaauguggauacugggaaucaaauucauguucccugcaagaggacauguucuuaaccacugagccaugucuccaacauaauugagaagucuuaagagcaauuauguucucuugucaccgggcauacuuagcuuuaguuguucaaguucauucuuuacaacaaggaaacaugguuccuuggaugaguggcugaucucugggaauggaacaauauguaaucccuuagguagauguagugacaaaagcuuguguucccagcacucaggagucaaaagcagaauugugagcugaacagcagcuugaacaacacugccagauucuggcucauagaaaaggggcuggauaugauggcacaugccuuuaaucacagcucuaaggagacagacgggcagaugucaaaggcuagccagagcuacagaguaagacccugucuccaaaacaaaacaaauaaaaggaagaaagaagggggaguuuagaaugucucaaauuucuagaaaguacagauuuuauuaccgauugaauaaauaaauacuuaaauacaaaggggagauaguaauuguccagaagaaaugaacaggaaaaaauuuaguauugaaggcuguugaagaugucuugggaagacaccaaaagcauaaguuauauacaguuucuaaaauuagugaauuguaauagauguuugugugugucuccuacuuauaauucuaguacuugggagaccagggcaggagaaggcugugaguccuagauucaucugggcuucagagagaaagacuuuguucagaaaaauaaagcugaguuacugaaugguaaugugugcuuucaauucaacucuugggcagcuagggcaggggaaugcuaugaguucgcagccagccugauuacacagggaguuccagacaagcugcaaauacauagugagaccuccucuuaaaauaaaaggcauaaaugaacauuuuaaaguuuuggagaauaagaucaacagauugacuagggaauauauauuugaaauaggcagacuagaaaauggacagaagguaugaauacaaaaggcagauaaaugugaacgugaaaaacaucauuagcuauuagaaauauuaguauguacuuacuaaacagagggcauacuaccucagggcugcagaggagcuugauagaggcuaaucaagcugauagcaaugguguagcuguauccccaaaaucucccaagucagggguucucuuuguaggcuaagcuggccuugaacucagagguuugccugccucugccucccaauagcugggauuaaaagcauauggcaccauacggugauacgacuauuuuucacaaaccugaauuuacacuucugugaccuagcaaaauagauuuuuuagcaucuuagagaaaugaaaauccuauucuuacacagcuguguaagugaauguucauaacagcuuuauuuggaauuuaagcucaagugaucuuaaauugggaacaacccaaaugccuuucaguaauaggugauuaguaaauuuauauuguuggauauugcuaaacaaaccauugaugcacacacacacaaacacacacacuuggguagaucucaaagaauuuagauugagaguaucaggagauuacauaacuauauuuuuauauauaauuuaaaagcuuuuauuauugccuguggauuuauauaugucauggcacaacaauggaagucaaaggacaaauuuugggacuugguucuguaaacucaggcugucaggcuuccauggugaacacuuuaaauaguagcuauuuaccagccucuauuuaacuuuuuuuuuuuuuuuuuuuuuuuuuuuuuuuuuuaaagauuuauuuauuuauuauauguaaguacacuguagcuguccucagacacuccagaagagggcgucagaucuuguuacagaugguugugagccaccaugugguugcugggauuugaacucuggaccuucggaagagcagucgggugcucuuacccacugagccaucucaccagcccaacuuuuuuuucaaggcaggguuucucuguguagcccuaaaacucacucuguagaccugacuggcaucaaacucggagauccaccugucugugccucugcagugcugggauuaaaggccuguguccagcugacuuuuuuuuuucuucuucuagaugguugguuguccuagaacuugcugugugaucaccagccuggcucauagagauugaccugacucuguccuucaagugcuaggacuauaggugugugcuacugcgcccagccuaugccauuccugaaguaauacagugucaguaguggagacuguguuuagugaugcaguuagagguaggggugagaggaaugggacucagugugaaauagcacacaguaccuuuggugauguaauaguucuauacuacaccauaguuacauacauauauaaagaauacacagaaaugaaugccuguaaaaaugggagaauuccaguaaggugugaauuggaccaauaucuuuccaugguuuuuuaauuuaauagcccguugaaguugguccuggguagcauaauccaggcgaggugggagucagugaggaacauaaugguucugauuaccaagagcuucaucuuaaaaggcaaaucauaaugaguucagggccugagggaauguuccuuccuugcuaagugacugagaaucuuguccuacgguagcauuuugagcaggcccguguagaagccgcaguucauugucuggaagcucugcuggagaacguguacuggauggugcagccacagugcacguggagagaacucugaguggggaugcauggggugcccuccagaacuaccuguauuuagaacuugggggaagaugaaugaagcagaaguuucaaacuacuaaaaucuuuuagauaaaauaggaaugucagagaauuuguaguugucauuggaauguuuaaggcugagucuuucugaguagucaagccgcuccaucugucguuuccuucauaugcuguuuucuuuugcaacacucugcuuaacauggggugugauugcaaguauguggccucuaagagaggaaccuaguauuacauugaaccuaguauuaaauuaauuggacaugauuuuguuuaauacaaacacauagacugcaacaauuguggguuuaagacagagucucacauugguuaggaguugcugaggcugggaugauuuugaacuugugguauuuuugcugggaugacaggccuaucuguuaccauccugguuaggagggacuaggaaguuaaagcucugguguucuaggccagcacucuaucuuuugagcuacauccuaagcacuaggacucuagcucagaauaauggaauugccuuauuuauaggcccuagugaggucaaaguccuccuuagucaauacauggaauuagggugcuaaugauugaacaugaccuuauggaaacucuuaucuagaacuuccuuauuccucuucuaagucugaucacacagugugauugggguuguucaguagucuguagcugugaacuguucugugugauugaaauccuucaguuuaagucccucuagucugaaaagaaugaugacuuucuaccugauggcagcaaaaagggcaugauaguuuaccaucugcuuuauaagguuaugaggauugaggcggugaccgccuaguaagaugcgucuggcauaucauaaucacuaaacagugcuuucugcuaguucaaguugauuguauggucagugagaagcuauuuauagguuuguuuguuuuuuuuuuaaauuguaaguaagcaggugaaguguucagacuuccauaugugcuaagauuuauauuucuucauuaaaaugauagugguuaugggacuuagauuuaguucugucuuuguguaggacuccuugcucaguuuaugaaaaaaauuauauuuauuuuaucaguuuuuggaguugaacaguguugacauaguuauaagaugugcugaguucuuaucaggaaaguaccccaaguagagauuaggaaaauguaaggaggaaaaauaaccaguaaugcuaucuuaauagaauuguccuguauuugcucaacuugugaguucauaauuggcuucugccaugaugaacaugaaccuugcccucuguuugacaugugacacucugcaguagcagaggcguuuacgacagugaucaaugggggaauauccucugcucuuguucuuuucaguuuauugugaauguugaaagaggaagcuucugugugcguuagccacaggcugagcaagucauuucuugagagcugagacaauuucccagaagacacugagagugggaggcagagagacuucgucagaagugggugggcauaauuuuuaauccaauguuuuaguuacaguauuguuagauauuaaauuucauaauucacuaauucacucaaugauaacaauuaagaacaaauaauauccuacagaauaauaaacuguguuccuuacagugcugcugcugcugguacuguuagaaguggagaagugugauuccugugaaaaagugguuucuuaccuuccccuuccuuuaccuuuuaaaagaugggugggcaggggcucaggaaggugcgggagaauaugaaugagccacagaaggcugagcaaguacugugagcucaggugccuuuggugaucucacuuuagagaggcuggagggaaaagguggaagagcacaaagcaugugauuuucugaccuuuuuaaauuguaacuguggagucaaauguuuccuuguuagaaauaaacaagucagggcuccaaagagcaggaagggaaaggacucaaguuccuggcaucuacaucugucagcuuacagggaagcccuuuuuggccuuuaaaagcacccacacacucauggcucacacacccacauacauauauguagugaaaaaaauaaaucuuuaaaagaaaauucaagccgggcgugguggcgcacgccuuuaaucccagcacucgggaggcagaggcaggaggauuucugaguucgaggccagccuggucuacaaagugaguuccaggacagccagggcuacacagagaaacccugucucgaaaaaccaaaaaaaaaaauaauaauucaaacaguucacagauuugggaucagcuaacacuacuggaccagggaaaggaagcaguuaacucccggguugggagggaaccugcauguuuauucagacugagcauguguaagugauuccugccugcuuagugaaugccaggguccuuuguuuuuguugagaauuggaaguugugaagucacaguuucgcaagguuuuggugggaauuucacuuccugaaauguauauaugugugcucuuuguuagauauuucagggugguguauauuaauuaacaccaaaaacugucuaugguuuucuuuuuagaaucucuuuugaauaaaaguuuguguguguguguugauacagggucuuauguaucaaaggccuggaauucacuauuuagaccaggcuggccuagacauagacacugacaguguuaacagugugugcaccaugcucuguucucacagucuuuuucauagaacuaaauaaugacauugcuguguaucugagaguuugauuuccugauaagaacauauaaauuggggcuggugagauggcucaguggguaagagcacccgacugcucuuccgaaggucaggaguucaaaucccagcaaccacaugguggcucacaaccauccguaacaagaucugacucccucuucuggagugucugaagacagcuacaguguacuuacauauaaucaauaaauaaaucuuuuaaaaaaaaaaaaagaacauauaaauuuagucaccagcugugcuuaauucuaaaaaccuauuauguuuuccuaaagauuacuuacuguuuucuauuuucgucugccaacaaaacuuuaaaacuuguuuucuaaaccccauagaaugcaguuuuccuuugcugacuugauaacuuguuaggaagugaugcaaagcccuguaguugcacaggaccuugggugacuuucacguaguagccagugcacugcacugugcuuuuagucauuggguaugauuacugcaaaguuuuggguuaaagacugaaagaacauaucugaauuccaggaacagagaccacugcuuaagcugcuagcuuuuuucuagucuuagcgucuaaacccugccuuggucugggaaggcauuauguaggcaaacugaauuccuagcacccuguguggggccuuaacaucuugagguguguuggucaaaagacuguaugauuuguguguguuuugguuuguauucuuccugugauugcaacaugagggaaugcaucccuuugcaggauacuguuguggaauuuacauuuuugugguuguauugcuuucucuaagagcuuacauucuucuguuggugugcuauccaggaaacauaauggucuuuauucuguuaaguaggaagcuguccaguaucuuguacagugugucaauuauaagaugacuaagcuguuaagaaaacaacaauuaaaaaaaaacuuuuuaaaaagugcuugcugacaucaucuuuccccaaagacuaauuaauauauguguuuacuauagcaagaucauaguuguucuguugucaagugacauguaguauuuacagaggccuucuguucaguccaacaggagcagcugagauagauucauacggaaacuaaagauauuuaacauuuuuauucauaugaagaauagugucuuugggucuuauugcuguggagacacaucaugaccauggcaaggcaacucuuauaauggaaaauguugaauuggggcagccuuacaguuucagaggcuuagucuguuaucaucauggugggaaagaaacaugguggcaugcaggcagacuuggugcuggugaagaagcugagaguucuacaucuugauccauagcagcagaaggugacuguaugccauacugauugucaccuuccuccaacaaggccacaccuacugcagccuucuaauagggccaaucccugugggccuagggggaccaguuaccuucagacuaucauaaauaguuuagacaguuugggguuuuguuuuguuauaguugucuggauuuugguuuaaaagugguugcucaaaagcuaguuaaaauagcacacaccuuuaaucccagcauuccaggaggcagagucaggcagaccuaugaguuugaggccagcuuggucuaccacaaaaagguguggggaagagggagaaagaaaaaaaaaagggagugaguggugagguuaggaguagccuaaacuggggagagguagugguaagaagauuaggauuuuaagaucauucuuugcugcauauucaguugugggccagccugggcuacaugaggcccuagcuuaaaaaagaaaaagccaagagacaguggaaagagagugacuauuuaguauagauuucuuugaaaggaguaguuuaucacaaacuauauucucugaaguugaacauuauacauucuguuaguaacuuaguuuaugcuugugucuuuuuuuuuuuauguuuacgauucuuaauuaaaguucaucuuggggauaagugcuuacaugcuccucaucuuuuuuuuuuucucaucuaaaugauacaagauguuguauuuuagauguugaaauuagcauaaauucuaaauccgaaaauuuuauuuuuaaaauguagaaaugugucuaaccuguuaacauaaucguaaguaaugaaguguuuccaguacucuuguaaagaauacaguuugggugauccaguuauuuuagcuuuuccguguuaagaauuauuuaaauauacuuguaugcaugcuaccgggaaaugauaagucuguucucaguuugagcccaguuaugguuuugcaguuaugguuuuccucagucccugggcacugagacuugagauggcguuucacuucugggaagguaagugucuucuucacuuuacugcacuuuacugcugggcagugucucagguuacuguagauagagugcaaacagaagcacuuuuuuuccaacacccaguaacaggauuauagucucacuuccuuauucuaaaaauagaaauagguaauuuaggacaugucucaacucuccuuugguauuaauuuauguuuucuuuauuucuccuaucaucuauaacuaccuuaaaauauuaaaaucaaauaaaaaguaugaaaaguugaaaugacaguuaugauuuaucauucucuacuuucagaugaucacagucguguuaaacugcaaaguacugaaaaugauuauauuaaugccagcuuaguugacauagaagaggcacaaagaaguuacaucuuaacacaggcaagugguauggugcugagcagagguggaggggcugcuguguuucagacacggcuaaacaugggucuggacaucugcaaaugacaugcuaucuuuuaguuuucugauucugaaaucaguuuugcaaaugccauaguuuucagauuucgaauauauugauaaaaaguaaaauuguuccuaauguuacuauuuucaauggagggaaguuuuuugaaaugucuuggugcaguucucuucagguaaauugacuguaucuaacauggcuuggaguucuuguccccuaacuugugaugaagaacuagagaggcccuggaagcccuuuucuauccuucucuccccuaugaauauacuuucagagaguauagucauggaugcugaggauagggucugaccaucugcagagccuagacauuuguacacugcugcucugcugccuuuucuccuccccaguggcuccucacagcaaccuccacagugcaggaacuaggaacuucugagaucauagcuuacucuuuauccaguaagaggcuaaacagcaaccagcacugucacauuucccagucaaagauguucagaaauguaacuuaaaauauuugagaguuuuaaauuguauuugauuauuaugugucucuguguguauauuuauauauacaugugcacaggguguccacagaggacaaaaagaaguggcccuuagcacugaaauuacaggcuguugugagcuguacaacaugggugcuaggaaucgaacucuggaccucuggaagagaagaaauuguccuuaacucuaucuauaguaccauguuugagguuuuuaaaaagccaagagguuaaugcaaccugcuauuugaaggacugagaaaagugugaaguaauuguuuuuuuaaguucagccuaauguaccugugagccauuagaauuuucucugcuacagaaacauuguuucacuugaaguuuccuaugacuaaaaggaaggagaaacagucagguguaaaccuuguuaaggauauuaauucacaauucauaggacaaaagaaagcuagagaauagggcuggagagauggcucaagguuuaagagcacugauugcucuuccagagguccugaguucaauucccaggaaccacauggugacucauaaccaucuguaaugagaucuggugcccucuucuggugugucugaagacagcuauaguguacucauauaaauaaaaauaaauaaaaaauuuuuaaaagaaagcuagagaauauacauuugcaaagaugcuauguuuguacauagcauaaagugggcccagucacugagccuccaccaaggacucagcugcuuuccccucaggccgccucucuuuccucuccucagaucuuguccugcccuugcccccuaaccuuccuucuauagucacuuucugaagguaguuuacaccuaggagaaggaguguuugugaguccuuugagaacuuuuacucuguugacuccuuugcucauccaaauaagagugaugaguugcuuccugcuaggcacacacuugagaucaacagaauuagcaggaauaucccaaccgccacucugggauugcuaguguccaugcagcuagguguagcauuaugaaauagauuugccugcagugguaauucagcuauacugagacuaauuccugaagagacaauaguaguucauugcagggagaguauauaauacucaguggucacaaugugcuugagaaacugaccugagaaauucuacauguguuuauuccaaccucaguuucacaagagggcuggcauggguugaaugaugaaucauacacauaccuuuuaguagccgucuuuaaugcgaauggggagcauaaacuuuaauuugcuguuuuauagugagugaaauuuaucuuauguauagucauaaucauuuaggauuucaaaaaaauucaagaaaucuauauucagaacugaaaauggacuuuguacugagaaugagugugggcauguggaaaggcaugugugaaguuaggcucucguugcuaugacaaauacggaaaggaaaacugaaaaggaaaaaucauuuauuuggccucaaauuuccagagauaugacucaaggucagcuuuaaggcuaaggugaggcagaauauuguggcaguguggacgaagagagaaagagcuacaugacaagggcauuccugugaccugcuucccccucuuagguaccaccuccuaguccugguacacuaaucuaccaacagauuaaccuuugauuaggccagagcccucccaagcauccaugagaugacaucaggccugcagcacucgagccccagguggagccuuucccaccuaaaccguaauacagcuauuccuucuccugcccuuucccuccagaucauuguucuucuuuuuccuuuuacucaguuccuacagacaggucugucugucuuuuuuuuucuuuuuuuuuuuuccucuuuuuugguucuccaagacaggguuucucuguguaacucuagcugucuuggaacuuguucuguagaucagaccggccuccaacucagagaucugccugccucuguuucucugaguccagagauuaaagucauaggccgccaccugggcuaaugauuguuuuauaagcaucuauaucucauaugaaaaaauuccugaugaacaauuccaugguuuuuaacucaguuaucccuguuggacuguucucaugaauccugauagacaggacucuacacacuaggagugugagaauauagcagcuugucucuagauuuuuuuguuuauuuguuuguuuguuuuuuuguuguuguugcuuugguuuuuguuuuuuuccugauuuccuuucuguauucugguguacuuuucccaguuuucuacccuggccuuaugaguugcucaguuccacacacaucagugcagcauucuaagauguuuccuugcaaccagcucuucagacaugguucgcuacugugauacucccacaucuaccaugugcccugguucuuugugugccucaccuucugcuuaggacaugcagagugaccauaacuacccauguccugccuaucaccucucugccagacuugccuuccuuuggcuagacuguaaauccucagguuuucuuacaacauaaggccugaggauugagcauuuggugguagugaugcuccucugugcaccuuguagggcugagacuacaucucaguuguacuugugcauagcauguuacuuggucacagagaaaaccugcaacauuuaguguuuguuaacuacagugguaguccuuguugcuuauuaauuagauuagcuuucuuuccccugaguuuuaggauuucuuuuccuaaccaaccccuugguauaucauguccauuguacaguuuaaaaaauugguagcauugcuaguuuuugaaagaacugauacacgaaaaaauucuugucuucuuaaaauccuuuauucuuuauacuguaacagcuguugcauguuuauugguuagucuuuaaaagcaguauuagaaaugauguauucaugugcacacagaggacuucacuccugaguugcuucaugauuuuuuuuaaaguuuuauuuauuuauuuuaauacagaugguugugagccuucaugugguuguugggaauuguuuuuaggaccucugcucgcuccggucaacucugcucaacucugcuugcucagucccugcucacucuggcccaaagauuuacuacacuguguacacaguacacuguagcugucuucagaugcacaagaagagggcaucagaucccauuacggaugguugugagccaccaugugguugcugggauuugaacucaggaccuuuggaagaggagucagugcucuuuuccacugagccaucucgucagcccucaugauuuuuuuuuaaaguguacuuuauuuucauaucuguauauaaauucccaaugaggccagaagagagagaucuggagcuagagauaugaguaacugugagccacaccgugguguccuuugaaagagcagcaagugccccuaacaaccaagccaucuuucuaguccugcuucaugauuguuguuuuugagacaagaucucacuguguagcccuaaguggccuagaacucacugaguagacaggcuggccuugagcuacagagauccucacucuucugggauuaaaagagcucaacugggcccaugcgccaggcgugguggugcacgccuuuaauuccagcacucgggaggcagaggcaggcagauuucugaguucaagaccagccuggucuacaaagugaguuccaggacagccagggcuacacagagaaacccugucucgggaaaaaaacaaaaaaacaaaacaaaacaaaaaagccuaaaaaacccaacugggcccaugauuuuuuuuuuaauuuuuuuucuuaaaaagaacuaauuauuuuauucaauacgaguacacuguagcugucuucagacacaccggaagagggcaucagaucucauuacagaugguugugauccaccaugugguugcugggauuugaacucaggaucucuggaagagcagucagugcucuuaaccacagagccaucucuccagccuccccauaauuuuuuuuuaagaugaaagaaaaaggcauuuauguuacuggggguuuucucaguguucuuuuugguagagaagaugauguugguucaccucacuguaugcuuuauauuguaaguagauaguguacauuggauggagagaauaguauccuuuaauguaagggggucguuucucagauuacuagcuuuuuacaggucaacccgagaguuuauccaucuaagugauuggcuagacaccaagaaauaaucugcccuaaagaugauuuaccuucuaauuggggugggguguagcucugguauuguauucucugccacaugacacugguaguugguuacauguuacaguuacuuuaggcacaguggaacuuaguucuauuucagccuucacucagaauuauuaaggauucugucuuagucaggguuucuauuccugcacagacaucaugaccaagaagcaaguuggggaggaaaggguuuauucagcuuacacuuccacauugcuguucaucaccaaaggaaaucaggacuggaacucacacaggcaggaaccugggggcaggagcugaugcagaggccauggaagugagcugcuuacugccuugcucagcuugcuuucuuagaaacccaggaccaccagcucagggaugacaccacccacaaugggcccucccaaccuugaucacuaauugagaaaaugccuuacagcuggaucucauggaggcuccuuucucugugauaacuucagcugugucaaguuaacaaacaaaaccagccagugcagaugaaggucgguuguuagaguaucuaccuagcuugugugaggcccuccguuacaucuccagccccacauaaaggaggaaaggaagugacgguuggacauucuuuuucaucucauggcuugguuuuuuuguuuuuguuuuuguuuuuuuuuuggggggggugguggagguuguuuuuguuuuuggagacaggguuucucuguguagcccuggcugcccuggaacucacucuguaguccaggcuggccucgaacucagaaauccaccugccccugcuucccaagugcuggggauuaaaggcgugcgccaccaugcccgguucaucucauguuuuuuauuuuuuguuuuuuauuuuuuuuuguuuuuucgagacaggguuuuucuguagcccuggcuguccuggaacucacucuguagaccaggcuggccucgaacucagaaauccgccugccucugccucccaagugcugggauuaaaggcgugcgccaccacgcccggcucucucauguuuuuuaaaaaaccccuaugcuaucauuaaucgaaauguaaaaguaauuggaaguaauauauuugauuuuuccuccuccauugcauuuuguaauaugaacuauuauucacuuuuaauucugccagaugauacuaggcauaacaaaccaauaugcagguacuuucaugguuauuuuuuuuuuuccugcaaauucuuuuguauugacuugggguuguugguugguuaguaaugaaauaaacuucccuauuuuccacaguucccugauguuugugugagauaucaccugccuguuacagaaacugaaagagacagauuuccuuuucuaacagccuuuuuagcuagaauacgaacagccaggugguguuauacuguaggcaccuuugguaauaacagcaaagccauauguaauaagacagugaacuguguaauaauaacuauauaauaagacuaaugaacaaggcuggcucuguuucggacagaaaucuuagcuguauuuuauaguuguuauuugaaccuaguuauccagcucuucccauaagcccuauaugguucuuuuccugccaagguaaagaaaaugucuuuacauggagguaaaguuuuauugaaugcacacuauauuuuggauuuaagugcauuugaagucuuaauuuacucaucaggccccaaugcacugguuauaacaguguguuccaguagcauccuugcagccuuguccuuccccagccccucucucauguggucuucugucguuacagggcccacuuccgaacacaugcugccauuucuggcucaugguguggcagcaaaagaccaaagcaguugucaugcuaaaccgaacuguagaaaaagaaucggugaguauucuucucuucucuucucuucucuucucuccucuccucuccucuccucuccucuccucuccucuccucuccucuucucuucuucuaucuuguuuguguguuuguuuuguuuuguuuuuuuggagacaggguuucucaguauaaccagcccuggcugucuucacucacuguguagaccaggcuggccucaaagucacagagcucugcuugucucugccuccuuagugcuaggauccaaggcgugcuccaccaugccuggcuggugagucauauucaacauuagugguugaauaugccgcgugugugaugugugaucguuaucuuacacauuucuuuuauuuuggugaaugcuugugguggcuaacagcuaguggccagguuauuucuuucuuuuuuuuuuuuugguuuuucgagacaggguuucucuuuuauagcccuggcuguccuggaacucacuuuguagaccaggcuggccucgaacucagaaauccaccugccucugccucccgagugcugggauuaaaggcgugcaccaccaccgcccggcagccagguuauuucugaccaggacuaauggauacuuugcuuuccuuucauuucuuuacaguuuuuuaaaaaugcauuuuauagauuuauaguaauacauaucuuauucugcuacauaagcacauuuuuuauaaguauaggugauauguugggaguauucccuacuuucagcccuccuuucucccacucuccuauuaucuuuuuuguacuccccgacaguucuacuacugcuuuugugucugucuccuagauuuuguauagguagguaccuuaaagcacacacacacacacacacacacacacacacaccacuucucuuugugagauugccauauuucauuugguacauuuaucuuaguugcaucuauaguucugcaaaugacauaacuuugcuguuuuugguuaaaaguuuucauucuguaaauauaccacauuuucuucauuuuucugcuguuaggcaaguguauuggauucucaauuuagguuuugugaguagugccuugguaaaugucaauaaaguauaaaucucucugugauagaccuaccuuggacuuggaguccugugguuagauacucagaagugauauagcugggucauauuguaggucuauuucacuuuuguguagaaccucuguacagauuuccauagcugcuggaccaguuuacauuuugaauagcaguguguagcggcucccuuuuggucacaucuuugccaguguuuuggguuugguuuugguuuguuuagugguaguggugucacuguugagguuuuccuuuauuuuguguagcccuggcuguccuggaacucccuguguaggccagacuggcaucacagaaaccuaccuccuucugccuccugagugcccgaauuaaagguguggauugcuguguccaacaguucuuucuuuucuacagucauccugacuagagggagauggaaaugucugugcgguuucaauuugcauuucucugauagccagcuagacugaaaacuuuuuauguauguaaugacauuugugucucauuuugucuguucauuagcccauuuacugauuggguuguuugucuuuuuguuuaauuuuuucaguucuuuauauauucuagcuauuaacugucugucagauaaauuagguagcaaagauuuuucuccuauuugguagauucuguucauuuaacuacuugcuuuucuaugcagaaacuucuuaauuucaugagguuucuuuugucaucuguuugcauauuuuucuuaagugaguagaguccuguuaaaagucauugccugggcuggggagauggcucagcaguuaugagcacugacugcucuccagaagguccugaguucaauucccagcaaccacaugguggcucacaaccaucuguaaugagaucagacgcccucuucucgugugucugaagacaucuacaguguacuuagauauauaauaaacaaaucuuaaaaaaaaaagaaaaagucauugccuagggugucugucuguaugcgugugcccacgcuagggggagcagaguuuauucuucagugcuuucugcuuuauauuuugagaccuucuuggguccuguuuugacuggacugguugugagcccucaggaucugcuuuuaugaacccacccacuccuccccagugacaucugcaucagaaaccacauggaugaagcugccuuggcuucucucuggguucucuuucucuuggguugguuuguggaccugcugcuuuuguuacuaugacugugugguaugccuugaaaucaugucugauuagaccucuagucuuuauguuuguuuucuuuucucaggcuugcauugcccuuccccccaggccuuuagagcuuuuguaagagcagugcugggaucaaagguguguaccaccacugccaggcuaagcgcuuuaagauuuuucugagauguacuuucaaauagcauuggaauuuugauggggauugcacugaaucuguagauugcuuuggauaguauagccgguuuuacaauauuaaccagucuacauacuuuucuuccuuucuucuuucuguuugucaauauuggggacuggaccucagccuuuaugccugcuaagcaagaauuuucccagcuaagccauaguuccugugggcagagaaagucuucaggguuuugucucccccccccccuauuguuguagcuuuuguagagauuuuucuuuaccuagguuuauuacaugguauuccuuaaugcaguuagaaugagcuucuauccuucaugcguugugagcauguuuguuauugagauaauagaaagacuucugauuuuauauauuauauauuaauuucuaucuugaugcaaagacuucucauuaauccugaauuuucuuuugcagucuuuaggaucuuuuaaaauggaaugauuuuaucuguaaagaaggauacauaggcgucuuccuuuccuguuuguaccucacucauuuucuucucuugcuuuacuuaugauugagacuucaagugucauguugaauaaggguagagaaagaugagaacuuuugucuuucuccugauuuagccaacauguuucagauuuuucuuuggugugaugcuggcuuuuggguugucauuuauagccuuuauuguguugaaauauguucuuccuauuccuagccuccuuaggacuuuuauuaugaagggauguuguuuuaaauaucacguaugcaauuucuccuugagucauuuuacguagugaauuaugauuggugauuugcauauguugaaccacccuuguaucucugggaugaagccaacuugaucaugaugaaugaucucuuaugucuugaauuccauuacugauacuuauuauagugagaacuuugcaguuuuguuauuuguguguuggucuuuguccgacauuauuauuagagugaugcuggcuucauaaagugaauuugcuagcauuuguuuugcugauucuuaguauuguuucuuuaguuuccauuucauucacuucugcgcagguguuaauucuuaccauccccuacuuugggaugugcgcgcauguccaguuuccauagcuagccuaucugagaucucucugauuuauuuacuuacuugacacuuagagcuauaaacauucuuuugagaacugcuuuguauccagagaguuuggaauguugugcaauucuauauauuuuucuguuuccagcggcucauauuucuuucagugguguguuuucuuuuuuguuuccuuuuugcuugguguguuguuuucagucuguaaaucugcaugguuucuguaguuucuccuguuguuuuguaguuuuguuccuuugauuuucuauaagauugugugugaauguuuccugaggcacacaucugcuagcuccagguagggcaucagugauagaaacaaaguguaguuuggcaagcuaaugaauggauaggugugagauuauuuuuagaaacauugggaauuaaguggcucuacuacuaccaaagaaaaacaacucucugugagacuaguaauuuuuggaggcauuguacggccuuggcuuuuuauauuuccuuuguuucucuuuuguauauauguaucugagguuaggcuguuuuuuguuuuuuuuguuuguuuguuugcuuguuuucgaaauaaguuuguaguguucaguaagaucuggguuguaguaguguugaaguguuuuuaucuguugggcucuuuuucagaacaccagacucaauauccaguaacucuugacagaaguauuacaccuuuauaaacaaucacuaauuaagaguaaacccauuauaaauauauagaaauaaucaaguagcacucagucgccacuuacaccccaagcauuucagaaaguaaaggaagccuuauagaaucaagccuuguuuacugagcugcuaguuacugugagugugacuacaagaaaaauaccagagugccucacaguugguauuagguuaauagagaaaaucucgaggaugagauuagaugagagucagcaaggccaaguagaagggugagucaguuuugccuaaagguaggauggaaagggagagcuaaagaaaugguuucagggguuaagagcaaacacugcucuugcaggagccccuaguucaguucccacaccuaugugguagcucacaaccauguuauuucagcuucagggggacucaguguccuuucugaguucaccagacacuguauucacaugcacacccccugcaccacacacacaaacacacacacacacacacacacacacacacacacacacacacacgcuuuaaaguauguuuuuaaaaagaaaaagggccaggugcaguggugcauguuuuuuaucucuucauucaggaaacagaagcaggaagaucccugugaguuccaggccagauaaguaagaccaugucuuaaaagaaaggaggagggcuggagagauggcucagugguuaagaguuccgacagcucuuccagaggaccugaguucaaaucccagacaaccacaugguggcucacaaccauuaaaucagacgcccucuucuggggugucugaagauagcuacaguguacuuacauauauuaaauuaauaaaaagaaagaaagaaggaagaggaguggaggauguuaucagaaaacccaauaucuauaauauuuugccaguucaaauuauaacuaagauuuaugugucuuuagacucuuuuucugucaaaauuagaaagucuugacucuuaagauuauuuccaguuuaaauauaccacacacacacacacucacaugcuuuaaaguauguuuuuaaaucuguucuaugacagauuucugguucuuaauucuuccuaaauuaauaguuacuggguuuugaugauaauguguaucaugacauuggccuaacagaauuuccaauaauugccaucuguaguuguuuuccguccucucccacuaaucuagagauucagggguggggcauaguuuuguuuguuugaauguguugcaaacuagaugauuuguaaauuucaucccucucacgucaaaguagauucacuuuuuuuaagauucauuucuuuuauguguauuauuuugccugaauguauauaugugcaccacauaaguaccugguacucccagaggcuaaaggaagacaucagauccucuggaacuggguuaaggcauaguguaagacaccauguagguucugagaccuguguaggaggaacaaguacucuuaacugcugagccauuccuuuagucccuugugggcauuuuaaucucugguuccuuuuuuuuuuuuuuuuuuuuuuuuuguuguuguuguuggugggggugguuuuuugagacaggguuucucuguauacuccuggcuguucuagaacucacucuguagaccaggcuggccuugaacucagaaauccgccugccucugccucccgagugcugggauuaaaggugugcgccaccaugccuggcccuuaaucucugguuucuuaagugucagugaaagugcaucugcucuuuuaguacuuaaacgucauuuuggcaggguauaaaaaacuuagcucuugcuuuuacuugaauuuaaauacauucuuuucauuuuaguguuuuagauuacuguccaagucaaauggaugucauuuuuuuuucuuguaccuauauuacgcugggguuuucucccuuuuuauuuauuuuuuuaaauuuuauguuuaugaaugguuugauugcauauauauaugcuaccaugugugugccuguuggauccccuagaacaagguuuaugggugguuuugucccaucauaugggugcugggacucaaacccaggucuuuugcaagaacaagaaguacucuuaacaacuaagccgucucccuaccuagccaggcucucuuucucuuuaacauuaacuuuugaaacuguaucuuaccacuugauuggcuuuuugcaaguaaauaguuuuguccuuuaaauaguugcaaaugcuuuuuuuugugugugaaaaauaaaaagauuauuaaauuauauuugggauuuguucuguuccuguuugucauugcugguguuuuugagggguguguguguguauuuucuuuguauuuguccugcucuuguuaauccuguuucuauuucucucuauuuacuguaaaauguccuucuuguccucuuaagcuuuauccauuacacuuauccugcacuacaguucuaggugucaaaacaaaccaaaaggcuuauucuucugauuggcuguccuggaacucgcucuguagaccaggcuagcuuugaaccuagaggaaagccgccugccucugccaaacaagugcugggauuaaaggugugcgccaccaccguucagggugacagaaagccucuuuagugcucucugaaauaacauucuugcaagagcuugauacuucuagaaacucaaacugaauauguuaaaguguaauuaugcuuuaagaacagcacacuuuuggguugggcaugguaacacaugccuuuaaauccagcaugugggggcugaagccagcuugauguucauacugaauuccaggacagccaaggcuauauaaagagauucugucucaaaauaaagaagagcauauuuuaaugaauauuuuauguuuauggcuuuuuaaauggaaaggaaacauuuuauggagcuacuuuacagaauauucucauuaaaauacuuaagauauucuuagguuucaguacuuggagaaguauaguauguaugugugagauuuguuuuuaugguuuuauaauaugucuaaacuauucuuaaauuuagguuaaaugugcacaguacuggccaacggaugacagagaaaugguguuuaaggaaacgggauucagugugaagcucuuaucugaagauguaaaaucauauuauacaguacaucuacuacaguuagaaaauaucaauguaaggcuuuucuuguuucaaaguuucaguuuuaucugauggucuuaagaauucuuggggguugauacuauacuuacuugccuuuggauauuuguaauaauaucuagguauaagcauguuuuuagaguauuucuauauaaaguaacucuuuaugcauucugaagaauucuaaaaacaacaaagaauuacaauguucagguuaauauuaauauuuaagaauugaaaauuaacuauuggagcuggaaggcuggcuguaguguucuuguagaaggcccagguucaguucccaguacccaugucacgaggcuuaccacugccuguaacuccugcucugggaaauccuuguauaagaaaaaugcuagaacuaacuucuccuugauuuuuacauuucagacuggugaaaccagaaccauaucucacuuccauuauaccaccuggccagauuuugggguuccagagucaccagcuucauuucuaaacuucuuguuuaaaguuagagaaucugguuguuugaccccugaccauggaccugcagugauccauugcagugcgggcaucgggcgcucuggcaccuucucucuuguagauaccugucuuguucugguaagugucaugcgaucucauugguguuuugugcuucucuguuuuguuuuaucauuuuauaauguugaugauaaaaagauaaauaauuuugcaugacuggugccugaggagguuagaagaaagcauugagucccugaaacuggaguugcagauaguaagacccuauaacucgugggugggaaccaaacccugauccccuuuaagagcagccagugcucuuaaccacucugccuguuaauuuguuuuuaacuguuucuauaggcagcaguaaauuuugaaguaauaucccaaaacucuaggguuuuuuuuuuuuaaacacuuuacuucuauaguuuaaauugacucuagcuccugcagguacauguguguccaugacaauuauaaagauucccuagaaagucucaaccaggcuuggcucguaccuuucaucccaacacuaaguaaguuggggcagaaaauuugcuccaaguuugagguuagccugggcuacggaguuagacccuauccaaaauaaaaaaggaagaaaugaagaauacaguaaagucucccuccuaaaagggagaaaugacaaaggaaagcaauccugaaagagugacucaugccuguugucugcacgucugagccagccgggguuaccuagugagauucaccucaaaaaagaagagaaugccaacgaacuggggccauggcaagcaugagcacugacuccuagugcauggguaaaagaugagcagaguagcacaugucugugaccccagaacguggugaagggcaguuagguggguuuaauauaguuuacugaccaccagcuuauccaagucauuagcuccagguccaguaaaaaacacugucucaaaaauggcuugaauucuacccuagacccuacuggguaggagaaaacuaccuccaauaaguuguugacuuuaaagauuuuuaagccacugugcugguaccugucuguaaccccuugcuugauagaggcaagagaagcaaguccauagagaguuugagcaagucugagcaacaugagaauuuguuucaauacccccuuucuuucugguacuuuguauacagaauuaaaagcuucuaccuucagcaauaaauuuuuaaauuuaaaaaugugauuuuuuuuccuucuuggauaaguacaucaucucuuauuuauaaaccaaggcuaaaaaguacuucccaggguuacugugauaauucuguauauuaaugauauuuucuguccugguuaacgucagcuaacaacuugacacagcccagagucaucugagaggagugccucaauuaaagaaagacuuuuuaagaucagauugguguuauuuguagggaacuaauugauacaggacagcccagcccacugugagauuaucuguagagagaaugucuuguauauuuuauggauacaccacccaucaauuaaaaagccuauggcuuaggcaggaaguaggaggugggacaucggggaggcagaaagaguucugggauagagccaggcacgggaggauuugcccaggaagaugugaagagauggaugugggguaccugaacacagguaaccagccgcgugucagaauguaaauuaaaauaaauggguuaugggcuggagagguggcucagcggguaagagcacugacugcucuuucgaagguccugaguuuaaaucccagaaaccacaugguggcucacaaccagccauaaugagaucugaugcccucuucugguguaucugaagacagcuacuuuauuguuauuauuauuguuguuguuguuguuauuagauauaauaaaaaauaaaucuuugggacggagcgagcagagguucugaauucaauucccagcaaccacaugauguuucauaaccaucuguacagcuacagugugcucacauacauuaaauaaauaauuuuuuuuuuuuuuuuuuuuuuuuuuuugguuuuucgagacagaguuucucuguguagcccuggcuauccuggaacucacuuuguagaccaggcuggccuugaacucagaaaucugccugccucugcccccuaagugcugggauuaaaggcaugugccaccaugccuggcaauaaauaaaucuuuaaaaaaauaaauaaauuauuaugcuuaaacaaacccuaaugggcuacuuuaacauuuugccuagacaaguuauaguuucaaucaaaacuugaauuguuagagcugagagguggcucagugaugaaggacaguugcugcucuuuagaaaacuaauguucgguucuagcacccacagugggugacucacagcccucuccagcuccagggaucacaugcugucuucuggccgcugugugcaucucuacacacuuggcaugcacacauacacaugcacucacaaaucuuuaaaaaacaaaaaacucauuuacuaauaaaauuaaccuuuugcuuaaaggcaguagauucuguuaaugaucaauauuaaaacuggguuaugagaaccggcggucuuuggcagaguguuugccuagcauuuaaggguucaugaguuucaaacugcauuggauguucauaccugcucucuaccaacugugccuugcucauccuuccuucucuucaguuuaugguuuguuucuaaaaccagaucaguaguccagagcucagagguaauuuuguaggucaaggcuuuccuauuuccugccaucuuuuaagugucugcuguacauccacaaagcaugucuuuguccagauuugagauggggaagggcacugagcagcaaacuuuaucucugacaaaaccauuuuuuaaaacuauauaaauaauccuaaucauaucugggugucugugugcauauuucucacccccccccccauguguguguguuaaauuauccuucuuuuaagaaggaaccuguucacagcuaaggucugagcagugaguggccuuauauugcuuuuuuuuuuuuucaacucaaacaacuugguuuuaccuuucuugcagauggaaaaaggagaggauguuaaugugaaacaauuauuacugaauaugagaaaguaucgaaugggacuuauucagacaccggaccaacucagauucuccuacauggccauaauagaaggagcaaaguacacaaaaggagauucaaauauacagguaaacucaguaucauuagugucaaauaaccauguuccaucuaaauccucagccuuccccuacuucauuugguagauccagcugacugucuagaauucauaaaacuuuccacaguucaagaggcaaagaugaaagcuagucaccaagaguucaagaccagccuggucuauacagugagauccugacuuaauuuuuuuuuuucuucaagauuuauuuauuauuauaucuaaguacacuguaguugucuucagaugcaccagaagagggcgucagaucucauuacuaaugguugugagccaccaugugguugcugggauuugaacucaggaccuuuggaagagcagucggugcucuuaaccacugagccaucucuccagcccccaauuuuuuuuuuuauauguauauaagacacauauauacauauauacuuguuuccucaguggaaacaagauucaauuaaaauaauuuuuuucauaugagaagauuucagcauuuaauuauugaaagaaaaaaaaacccagaaaacauaaguacuuuuaucuuaguaaaaacuuacuguagaggccugaggagauggcuaaguggucacagguuacaagcacuuacugcucuuccagagcacccaaguguguuuuuaagaacucaugucgggcagcuccaggggauccagcaucucuggccucucauggcacuuacagucauaugcacauaccuaaaugcacacacacagaacuaaaaaugaaggaaauagccgggugugguggugcacgccuuuaaucccagcacuugggaggcagaggcaggcggauuucugaguucgaggccagccuggucuacaaagugaguuccaggacaaccaaggcuauacagagaaacccugucucgggggggaaaaaaaagguggaaauaaaaauuuuaaacccuucaugugggaguaaagacuauuucuauauagguacuuuauagcugaauaacuucaguucuuacuacagacauaaagugcuaggaguaaacuuuacaaacuuuacaugucugauggugacauucucagguggugucuuuuuuuuuuuuuugguuuuuugagacaggguuucucuguguagcccuggcugaccuggaacucacucuguagaccaggcuggccugaacucagaaauucaccugccucugccuccccagugcugggauuaaaggcgugcgccaccacacccagcucucaggugguuuuuauuguauauuuauagaccguaagcucaaagaguaucagaacuuaguuucaugugauaaggaaaaguguaagguagaaagagaaauaacaguauauccuucccugcaucgucugcauaauaaagacauaccuagaucgaaaccaacaaucuuaauccacuacucuuugacuaucuauuuauaaauaucugcuuuaaaauagaauauaucuuuuagggggcuagagagauggcucagcaguuaagagcauugacugcucuuccuaaggucuugaguucaaaucacaguaaucacauuguggcucacaaccauccguaaugagaucugauggccucuucugaugugucugaggacagcuacaguguacuuaaauauaauaaauaaauuuaaauaaauagaauacaucuuuuaaaucaauucuaugugauuauuuuaaaugucuaugaauguguuuguguuugugggcaagugcugggauaaaaguuaaugucaaguuuaccugucuguucccugccucauauugaguaauugcaauuuguagauugugauuuaaagaaaacaaauuuuauuguuuuuuauuucuguucuauaccuagaaacgguggaaagaacuuucuaaagaagauuuaucuccuauuugugaucauucacagaacagagugaugguugagaaguacaaugggaagagaauagguucagaagaugaaaaguuaacagggcuuccuucuaaggugcaggauacuguggaggagagcagugagagguaugugccauauaugugcuagccuaccgagauaugcggguagucacuacacucagggagucugcgacaggaccacccuguguucagacaguuaaugcuccuuuuacuugugucagaguguuuaggugguaugugaugacauaaauaucuucagagaguuuuccgucaucauaagaaagccgguacagggcggggcagugguggugcaugccuuuaaucccaguugguggcuuacuaccaacuuaacuccagcuuuuuugggauccaagguccuuauggugguuugagugugcuuaguccaugggaaguggcacuauuauuggccuugaaguggcuuuuuuuuuuuuuuuaaguuuauuuauuguauguaugugaguacacuguagcugcacagauaguuguugggaauugaacaagggcucacucuggucagcccugcucccucuggucaacucugcacgcuugcucagucccugcuugcaccucuaauggcacauaccuaaauggacacacauagaacuaaaaauguuggaaauaaaauguuaaaacccuucacgugggaguaaagacuauuuacaguguacauaaguacacuguagcugacuucagacacgccagaaaaggucaucagaucucauuacaggugguugugagccaccauguuguugcugggauuugaacucagggccuucugaagagcagucagugcucuucccgcugagccaucucgccagcccuggaguggcuuuguuggaggaaaucaaucauuguggggaugggcuuuuugcggucuugugcucgagccccacccaugguugaagagauuaggcuccaggcugccuggagaagacagucuucugguggccuuugguucaagauguagagcucucagcuccuccagcaccaugucugccugcccacugccaugcuucccaucaugaggagaauggacugaaccucugaaacugugagccagccccaguuacauguuuuguuuuuauaagaguugccaugaucauggugucuccucacaacaauagaaacccuaagacaagccuccuuaggcuuuugguuuuuuauuuuuauuuagauuuauuuaauuuacauguaugaguuuuuggcugcauguacaccacaugugugccugauacacacagaggccagaagagggugucagguccuuuaaacugaucauucagacagugaacuaucaagugaauacugggaauuuucccuggcucauuugcaagaacaaguguucuuaaccacugauccauuucuccagcccaagaaaucaaaauuugaaaacauaguaaugauaaauuuaaaagcuauuguuuagagacaacaaaaacuccaauacugcucauauacagaaguuaguguaauuaggugauaaaaauaaauaguauaauacagaagaugaguuguauaaaaauaccuaauuggccgggcagugguggugcaugccuuuaaucccagcacaugggaggcagagacagguggauaucugaguuugaggccagccugguuuacagagugaguuccaggacagccagggccacacagaaaaacccugucucaaaaaaacaaaacaaaacaaaaaugccggccagcaaauagaagccuaaugaccuaaguuuguucacugagucccacuguagaaggaagauacccaacuucucacaguguccucugaccucuacagguuuauaccucucuuucuccuccucccucucccucccuccccaccucucaugcacucaagcagaguaauuaaauaaaaagagaaauucagagcuguaugccuauccccaugcacuuaggaggcagaagcaggagaaucucaaguucaaggauagcuuacauacugcgauccugucucaaagcaaaucauuaauccuaucuauaucuagucaaggcucaugcuuggaucugaaugagaccugaugccuugguguucuuagucagaacagaucccccacuuuuuucuccucuguuugaaagaugaucuuuuagcaugccuuauaguuuggauuucucuaauaauuguucuucuugguuagaaucaaguuaaauguuuugacuagaaaaggucuugugaucuaguagacauugaagagccagucaagauuuuuuuuuuaaaucaagcugcauguucaaagcugugacuuaaaaaaugacugccaagccgggcauaguggcgcacgccuuuaaucccagcacuugggaggcagaggcagguggauuucugaguuugaggcuagccuggucuacagagugaguuccaggacagcuagggcuacacagagaaacccugucuggaaaaaccaaaaaaaaaaaaaaaaaaaaagccaagacugaagcacucacagugagugaaaagagauggguuuugugagauuuuuuuuuuucuagaggaagagaguaaauggcugacauguugacauuggccauuuuucaauggaugucagagaacuuucauugaaacaaaauucuauguuggacaggaaaaugggugcuagauguacggauggucaaauagaagacuggguaaccuccaaacacagcauucauagaaauugucaacaguauuugucaaaggacauugaauuuucauaugcugucacgcaacaggaccagaugcugagaaucuccagucugucuccuucgugguagagaggaaagcagagugugcagaaaacaugucugucuuagcuucagguccuguaaaagcguuacuuacuguaggcacagcagacgugacccugaacuguggagcacaccacuggccuguggagccgcuuguccuucccuuuguuacugcaguacacugaaugagauggaaagcauacaaaugaguguccaugguuugaugguggccugggccccacugucagugugaugaaggccugcagugcagacacucacuuguuucugucuauucacagcauucuacggaaacguauucgagaggauagaaaggcuacgacggcucagaaggugcagcagaugaaacagaggcuaaaugaaacugaacgaaaaagaaaaaggugguuauauuggcaaccuauucucacuaagaugggguuugugucagucauuuugguuggcgcuuugguuggcuggacacugcuuuuucacuaaauguucuauaaauuaauaguuuuacccagcaccuuucugcacuaguagcugaccguggugcauuaaucucaaggguuuguuagcaaugccucauacccagaaacacugcgcuagaguagacaucagccagauaagggauauuacagucacaagcccagcaucucaggacucaucacugcagguuccucugagacccagacugucaauggcucacaauaaagacaagcaugcuuguuggauacuguuacuucuuacagcugcguucacaccaguguauugagaaauccuuuaucccaaggauuggcuuuuggaggccuucuggauuuuaaccugcacuugauauaagcaauaaacauugugguuuuuuucuacauuauuaauggaaagaaaauauccuuuaaacaauguauguaauauguaauguacuguugaaaugggcauuacaacuuuauauaaccauuuuaggguaaauauauuuuauaaguaccuauuuaaucuuacuuuuguaguuaaauguacuuuuuaaagguucaaucugaaagucuguuaucauagaaaaauaaauuguauguugacucaguuguauacugaauacauuuucccuuuccuaagcagacguuugauagaggcaguugaaacuauaagcaagcuaagacuacuacacauucuuauuuccuuucuauuuaugcuuuaucuuauuuuaaaaagaaaaacaaaaauuuucuaaacaugucauugaaggaaauuguuuuuuucugcgauaguuaagaagugacaguuggucaaaauauaguugaaaacaaacaaaaacuugguuucugcaggaugugguagcacacacagugcucaggaagcuaaaacaagaggcucaaugguuugaagccagccaaaacuacauagcaagguccuaucuuuaaagauaagagaaaaauagaggugguggaggagagaucagacaacaccaagaauaagaaaucgauucuuagccauauuuaauggacaaaccugucaucucagcuuuugggagauagaggcagaaggcucacaaguucaaggccagcuucaacuacauagcuagccccagaguuuggggccagucaggacugcaagaaacacugucucagaaacugaagugguuuaaaaacauuuugauuucuguaaaguaaagcccaugcaugacuacacuguuaauuuuuugugaaaauguaaauguaauuacccagacgggauaaauuaugguuaguaaguuaaaggaaccaguguuuuauacuuuugauuucaguucacuagacugaaauuuugaaguaaaaaaaaauuuaauuucuuuacaaguucaauaaauaguacaaugguguacaaacuuacauugucccuuaccuuuguaaugaguauuuuuaaagcauaaccacuaauuggguuuuggugguuucaaacccugcuugguggaaagguuccaaaccauuaggacagcauugcugcuucaucucuuuuauauaucacguaaaagugcgugguaaaucuuaauuaguuuaaaugagacaguuaauuucuuaaugcaguuugaaccccauagguguaguuagaaauugugaauggccuugaaaagcaucucacaaagcguaugauguauguguguguccugacucagcauagcuguccuaaggcuuugaaauggagagcagguaagaaggauguuuccucuugucuguuuaaucucuguuuaagcggaggccuuagaauuagauggcuauggguuuugagcuuucuaacacuuacugguuuguuuuuccaaaauguaguauguuauccuacuagaccuuauuaaaacuuacaguccaagccaauaagguggcguacaccuuuaaucucaacacuaagaacaccaagacagacagaucccugugaguucaaggcuagucugguccacauaauaaguucccaggcagccagaaauagacauugagauccugucuugaaagaaagcaaaccaacugaagauagccugagcuuaaacaacuucccacaagaaaaacugauaaggcugagaccaguccuuccuuggacgauaugcuuucuagagauagcauugagcaccacucuuucugccucuugguguguauuuuauguuugugaggauuccuuuggcauacggaacccucagugcuccuccccggagcccgucuuucuccccugaacacaucuuuaaggaugaguuuuaacaggagaaccuuuaagucacacugucauguugcuuacuaaagguacauggccuguggugacagugucacuggcaucauccugagccuguaugagaugugcugugcugaugagagaagggugcugggcagagaagggauacuagcaguuucugauggguucacggcuuuaaacacagugugcgucagucucgguagcagcuuauuuuaacuaauuuaggaauaauaguuugucuuggaucaaauucuguuuuuuguuuguuuguuuguuuuuuguuuuugguguuugguuuuuuuuuaauuuggggaaaaaauaggcuuuuuaaaggggauuauuguuuacuggaaagaauccucacuuccuguuuccucccaccuugcuguaaugucaguggucacaagauucaccagguacuguguuaucucagccuccugauuucuauccaugcucaaaccuaaaguguaaaaguacacauuccuuuuuaaaaauacgcauaugcaucauuucuacguucagcagaaucuacacauuugucaaguuuuccacaguucucaguucuuuuuauccauuccguuaugugucaccucauguaucaaacagugaacauaaaaagauaugaagaccuguauuaauuaguuuuuguccaaacagcugugcucugaagcugcgucagaggaaagguccuaauuucugagcucagcuuccaugcacucggcucggcccuuugucuuaaaguaaagcuagugcugugaguuuagaacuguggcccacguuucaaguuaugacacagaacagcccucucugguugucauuucauuuccuuguuugcuuuuagcaccagucccagggugcuggcucccauuuucugccaggcacagaaaggcuacagcugacugcuuuaaaaauagcucugcguagauucugcagagaagcuggaaccuaaugguaguaaaaguacuuuuuuuuggccauuguauacaaucuacuuaacaaguuuacauuucugucaagacauugcagacugaagaucuacauugccuuaauuuguuacuuacugauacaaaucuuuauuuguaguuguuguuuuggauagguuuguauauucuuuuuuuuuuuuuuuuuuuuuuuuguauguguguugagauaguaccuugccauugcccaagccuggccuuaaacucagcucaaacgacuuuccuaccucagccuguugaguaacuaacaccacagguacacacugugcacacagcuuucaaguauaaaucuuaaagagauuauuuuaaaacuguagauaagauuucaggcccuuagucaagcguggugcauaccuucucugaguagggccaucucuggguccuggugaguagugucuaugucugugggaaggaagggcugcucggggccuucaucuggcugagcucgauucaucuguucauagcaugggacaaaauaccaacagaaauguccauucuauuuacaugccaacaccuaacaaagucucuuauuuuuaaaacuccuuuauauggcuuugccauagaaucuuguauauacuuuuuuuuuuuuuucaaaauagaaaugauuuuuuuucucauuaaauuugucaucuuauuacuugaaacgugggccuuuguuauuggcaguggcuugcucccgaggaggccuguucuguccacccugucccagaacgcacucauuugagucagaugccacaguucuuccucacacuggucuuugguuuauaccaugcagcaccauaccuagagucacagcugucucuaauuguccccugaauauggaaugagagacucaggcugugcccucauucacugcugcucugcacuggagccuguccccaaucagagaacuugccucguggccagcagucuuccuuccuggguccugagcagcuucaagccuucugcauuagugcuuucucuuagccguggcuguugggaagaagacccacuguucuccacagguuggguuguuuuuuuuuuuuuuccuggcuguccuugucccagcacagugccaucagccauugugagcagugcuuaaaguggaaagcuacaccagccuaagaggcuuuguguaagcugacguuuaggauuuaaagagccuggaccaucugaguucugacucugaagcucugcuugguuguaaaguuccaguugauucugagcagugaggugugaggccacugucaccgguagggucugcuuggaugccgccugcuuuacuuggaucuguuuuguuggggacugcugcaaggagaauugcaugggaauuuucuucuuuuucuuuacagagacuuauaagcaucgaguuauucuuuguagucacucauuaggcauaguuuuuuuuuuuuaagacccaugaugcuguugcuauuccccccccccuuuuuuuuuugguuuuuugagacaggguuucucuguauaacucuggcuguccuggaacucacuuuguagaccucaaacucagaaaucccccugccuuugccuccugagugcugggauuaaaggcaugcgccaccacggcccggcugcuguugauauuuuaaaugacuauuuuaaaaagucguucaguguggaaaguugaggagaggaagccuagguaaguuccuuuaaagcaugcuuggcucaccucgguuaguccugaucaaucucagucggaugcuaauguaaaugucguguggcaaaacaacuuuuaaugcagucugacuuucccucuaacacgggcaaggaagaagacaccagcauuugccucugcagcacagaggcagcccccaggauacccacguagcucauugcuugguuugcucgcccauuuuacuuuugccuuauuaaaaauaaaauggugaagauccauucaagugaauauaauagaauuaucucaaaagccauuuaucuuaauagucuuacaaauaaagucauuucuuagaagcuauuccauugauuuccucuuauuuugcuaccccuaaacacuauuugaaaagaaguaaugaguuucaaaaaccacagcgugucuguuaaauggcaaauuuauuauucuugguaaauguguauuuaacaaacacuaggaaaggauaucucguguguaugugagagagaaagagagagugcuucacaacacuuuaaauaaugccagccauauuuucagauaagaaacccaguggaggugugacucacgccuuauuuuccagccugugcagauagagcugagaugcagacuccaggcugugguuucagucccuccaaggcucaggcucauugugcuacuccacuguguauuuacuuaaaccagauguuuaagcggggaaauaguagacaccccacuaguggagggguggaaucccuuuuacaaugcuucacugacuauggcggaccagaacguuucugugccaaagccccacuucauuccuuucuguucuguuccacauucugccagagucagaaccagccguuuggucccagguccugcgacccauugcuaucuaaagaguaugguucccuaaugagaacacugcagagaaucacuguugggaaaucaaacaagacuuuguagaccaccacaggggcuugguagaucugccugccuauggagaaagaagccaguagacaggaagaagcuucauucucaugguuggggaggagccuaagugguggagaucuaguguauugccuguuuauacagugauaaagucaaguauuuucauggguagagagcgaggguggaggaagggaggggcugcgaucggugcaaaaauggaaauaccuuuaaucucccaaaagcuuugaccacuggcaaacaauugaaauaucagcaaagacuacugcucuuaauggucacacccucuuguuuaaauggcgucccccucccaagcauuaaauugcgcugaacuaucacaguuuuacuuaguucuaguaguuauaaucauuagcauucuccuucaggagaaaaucuaaaugcuggaaaucuaauucagagauaacaagccaacuuuaugugcaaacuuuauauuuaaacuguuucuagcaguguuacagugauuguccaaacuggauuagacuuuugcguugaaaucaaaguauggguaagucuagcacauguaauaaaaccuugcuguuucuuguggcuacauuuuuuuuuuuaacuugucugucucuuagccuaccauguagaggucauuucuugaguuaagaugggauggccuaaaagauucaguguguaguuacugaagaaguaagucccggcgccucagagcagucugucucacagccccgcuuccauuuggaaaccugccauucuggaaggaagcacuugguguucuuggaauguucauguuggaaugauuuuuguuguuguuguuguuguugacuuuuuaguucagucuuaguucuuuuguguuuguaucuaucuauguacaucugugugugugguggccauggauugaauagaugacuucuuauuuuauguuuuaggccaagauugacagacaccuaaauguucaugacuugagacuauucugcagcuauaaaauuugaaccuuugaugugcaaagcaagaccugaagcccacuccggaaacuaaagugaggcuugcuaacccuguagauugccucacaaguugucuguuuacaaaguaagcuuuccauccaggggaugaagaacgccaccagcagaagacuugcaaacccuuuaauuugauguauuguuuuuuaacauguguaugaaauguagaaagauguaaaggaaauaaauuaggagcgacuacuuuguauuguacugccauuccuaauguauuuuuauacuuuuuggcagcauuaaauauuuuuauuaaauagacuauguugguuugugu

SEQ ID NO: 8966 - RNA, 20697 nt, Mus musculus
auucacauuuuuaaaaauauuuuuauuaaauaaccuacuuggaggauaauuacaaaauccuuaaguauuaauucccaguagugaaaggcauuuuccuuuaaaaaaagaaaaaaaagacaaaaauauccuuaugauuugcugcuuuauacacaggaaugauuuauuuuacagucaucuguaacaucagcguauaaaauucaaaacauuucuuaaugucugaaguccagagugaaguucacaaugauacgcucuccuaugaagcuaccuaucaacagacaaaccugaacucuaugguaacaacuccacacagaauuuacaaggcaggcacuuugaaucagauacugggaaucuuucacaguuaauauugcuuuuucugaagcuccucucaucaaagguaaccaacuagugaagccaaggcuuccuugugcagaaguacaaaaaaagguuugguuucaaacacuugaguugugauacaugcaagacaugcccuaaauaagaaggaucuucuaaaagaaaaugaagaaaccaaaaagcagcccagaauaaaagcauuuacaagcaucuggauaaggccuuuacgucaguauuuuacaccccuucauucucagguaagggguuaagaggccgagagagguauccucugcgagggugaggauacuggagguuggcaucgcaagagugcucuagcagaggagcaggaggaggaaggagcugggcacaacuggaccaucuugauccagcccguggggaauccagagggggaaagaaauaccugaaauaaugaagacaggaacaaaacaccaaaacaaaaacaacagaggggaaaggagggagggaaacagaagaaaaagagaaaagcaguaaauacaaagagaaccaaagaagagaaaacaugcuggaaggaaggaaaaaaagcuuguauauucaugccacaaccgauagaacaacaguacaaaucaagacuugcacuugaaucaagguugcuuaagaaguauaaaaguuugaaaaaaaauacaauauguuaaaguuaaaaugcccccccaaauuaccaguaccuauguuacagagacauucauuuuauaaaugugaagccuugucuaaucccaucugauucuuucauuuacauugcuuuccacugucagcaguccugcaugugcugcagcggcaggcacaccuccuaggugcguacaugauacugagaaccaacuccaauaaacuacacgggaaagcuggucaugccacaggcuuugaaaaauacaaccauuggacagccuuaguuuccugcaaaaaacuuagaauagcuacagaauuuuggugcaaaaaaggcucauagaauuauaucuaccaucuuauaacuuacccguaauauguaugcaguuuagucaauaaaaagguguauaacuuugucaucaaagucaaaagugucaaaagacaggaacucauugaaacaacacauuaaaaauccugagacauggaauuucaauugcaugcacauuuucugaaaaaugucaacuuauguuuccaaauugucuuaaaagaaacgaagauguguaggaucauaccauaaacauucaugcauauauuagaaacauccaucuuuguaauggguaugagaugaaaacuuagaaguguuuccacuucuaaacuagcaaaugcuaaugugcugcuuggcuacaaaccauuguauagacuguggugccagguuacuaguauuuuuaauuacaagaaaaagucguuguguggauaauaucaccuguaaagugguuguguggauaauaucaccuguaaagucauuguguggauaauaucaccuguaaagucguuguguggauaauaucaccuauagagcaauucuacaaaagguaaacacauuaccacucaaaacaaucuuuaagaaaauauuuauucgauuuucaaauuaaaauuauaaaaacucaucauuuuagcuuauuguuuuagaaaauaaaagacauauuccuauauucuccaaacggaauaaaauuauauuuucccuccucccaaaugcuuaugaggauaauagcaaugcuuucccaaguuagucuccagaacaucccaaaaaauuguuuuggugaugaugugucaacaaaaagccuuuccauuuauagugucaggaggcugacuaguacaaaaguuauauacacugucacuuuaaaggccuuuuggacuguguguaguagugaacgggcugcuggugcaucuuggaagagaucaaacggcgcuggggaaggggaaaaggaguugauuuccauuccugugugcaugcaacaagcagcaaaacagcaaaguuacuccagcuagcuuguacucagcugugcuuucuguuaaaggacacaacacaaacggagaaggagaaugcaucacagaucuaacauagaugguuauuggcacaauaagaaaacagaucaaagcuauuuauggaagaaaauaacacagaacuaaagcuguaaccuaaaaccagauuuuuaaaaauuaacucuacuaugcuuuccuucauaaaauaauuuguucuucuccauaguaacuggaaacacuuucuauaguugcaaauacuuaaaaccucaaaaucaaacagcaaaauuucuugauuaagaaauagguuacaauaggguaacacagagccauuuuaaaguggaauuuugaaguuucccaaccucuauuccaaauuauacucaaaggcauauuuuaaauuuuuuauauugcaaauuuacauauuugaaauaugaaugacaaaaacugacucuagauuaugucaaauuuuguuuuaaauguaugcagaagagccuaaacuucaaaaucuuguauuuuaccacuauuauacacacuauuauacacacaaaagaccaaucauuucacacacuggucucacaaagcuguaguuauggacuuuauuuaaaauuucaaugugauuugauacaaagccuacccaagaggcacuaaaaacauccgaauauuuaucuaagagucagcucuauuaaacaacaucuccuuucacugcugcagaaaagaacacagaaucauaaaacgacuaacauuuuuacugaccacugaauuccagaauauaauucaauggacuuaaaaaacuguccauacuauaaccaaggaagccacuaaauacagacaagagugaaauuccaagaguaagugucacaauuauuggugaauuacuuuauuccaucuuaaaauucaccuuuuaguaugacuaccaggagagguggcucagcaauuaagggcccuggcugcucuugcaaaggacccagguuugauucugagcacccacaugguggcucacaugaauccguaacuccacuuccaaaacacuugacucuuuggccuccccaaacauugcacacauuauggagcagagauauacaagcagguaaaacacccuacacauaaaaagugugcaugggggcagggaaggagguuucuaguuuuucccacagaagagccuaccugcuagcagaaguuccauuuaaugaauuuugaagauuuggaauauuugagcucagugaaggauuugaguuucccagcugagaacucccauuuacugggcucccguuaccuuucaaaauaccaguacacuuccaauuguccauguaauuagcugaaagaaaaaaagccaaauguauuaacaugacuaauauuuauccauauaaauacauaucuucuccuacaggaaaugagacaaaguaugggcuacauuuuuuaaaauauuuguguauaauguaugccuguauucccauucauguccauaugcacuugcacaaacaugcacguggaagccagauguugacccuggauggcucucuuccccuugggcuccccaucuugguuuuugagguaaagucucucucugaacauauaguucaccaauuuaaccacaccagcugccgggauagcuguaaaaaccuuauugcuuaagcucccuugaacuaggauuacaacugcacacuacuaggccuggguuccgcauaggugcugaggagcugagcuccgguccucacgcuuuuacagcaagcucucuuuuuguauuuguuguuuuuguuuuuuuucaagacaggguuuuucuguguagccuuggcuguccuggaacucacucuguagaccaggcuggccucaaacucagaaaucagccugccucugccucccaagugcugggauuaaaagcaugcaccacuugggaggccaacaaacaaacaaaaccaaagcauguaccaccucugccuggcuacagcaagcucuuuaccaacugagccaucuccacagcuccagccagcuacauuuacuucuagauaaguacaaucuuuagaagaaauacauuaagguuuucaaagaauuacuaauuuaaaccagccaagaugacucauacuugaggcagaagaauuggucucaguuuggggcuaacccugggccacacagugaguuccagaucagccuaagcuacagaauaagacccuguaucaaaaacaauuagcuguuuaaaaaccaugaaagcuuuuuacuauuuccuucuuucagagacgauucgaugugacaauuaucuaagcucagagauaaagaaguuacuaucugggcuggaauaauaauucacucagugaagugcuugacuugcagccacguggacuggagucagugacagaaucaaccagguacagugguaugcccuugugaucccagcaacagacuaucagggacagaccaaucccuggggcucaacagcugaccagccagccuagccuagccuacuuggugaguuuccaggcaagaaagaccuugucucacacacaaaggugagucauaacugaagaacaauacccaagaguguccucugaccucugcaaacacaaguuaauaccaaaacaaagucuuuaaaagaaauaaacccaaaugcuuuggcuuucuuacaauuaaucuaaauaaggauuggagcugucuucuuggcuaugcacauuacguggcacuguguagauuaugcucagagauguguacugauaagaaaacuucugcauaacaguuuagugguucauccagcauggucucauucuuugaaugcaaaacugaagucaguaaaucaaaguuaaagagccuaaugggaaacaacgagacuaaaaaggacagaaguccuuaaaaucaaauugaggauaggaaaguuugggcugguccuacugaauauacuguaagacugaaaaugggaggccaucaaggcuuauccaaacuguauuuuaugaagcaaaaacugagggcaaaagacccacugcaguuguauagcugaugcucagaauggagucagccacugugaugcuacaggcaucaaaggcacuguccacugauuguaccaaguccccucaguguagcacaagaaacucacaaucagaaaagaugauggauuuagucuuugagugagagacagaaagugugugcaugugugcgugugcgaguguuuuauuucagcgugugccacagcacccuugcagagguuaauuucagcugucagcccccauuuccaccuuguuuauaaggacucuacugguuuuuuucacugaccuauguguaccagauaaaggacccuaggcuucuuagaagucuccucucucuccgcccccaguucccuaaaggagcaggggguugaagacacucacacucauguccuuacucaagggaggcaaauacuuuuaccaaagacaaacggaggccucuccaggguuuaauaaagcaguuacccacauuagcuuuuccuggagauaccccauguucuaauuaguuuuaaaacuggcuuucuuccacauagaaauaaaacaauucaauuggccauuaauucuaugaacuagguuaucugauauucaaaacaguacaaauauagcacaauuauuuuaaacaauauuaaaaagaaauuuaaaaauauauuucagaguuuauacuuuuaaguaaaaaguaacuauaaggaacaacuaccccucuguuaaacuuuaccuuuccacaaccuaacacagccgucaucuccugaagacgccaggacugucccuguuauguuccaacucacccuccagaccugagaauuaugauuaucaaacugagccacaauauggauuucaaauuuuguuggaccaccagaggaaguaaguucuuuccuaaaaaaagauuuuaaaaguuuucaaaaaguguuuucugugcauauguacucauacauaaacacacauuugaaguaagaaauacaaauaaauacacuuaacauauucuuuccugaugcccacucccccacucccuacucaaccuucggacuacuugaacaucauuccauuugacuucuccaaaaucuggacuuaacuucaccccacagauaauacucagugccucuuuuuuugggggagggggagaagaagaaacaaaagagcacauuacucucucaaacaagguucagaaucuaacagauguuacauuuuacaagacagaguagcagaaagaaagcauagaaucaaggaacugaaacaauucaaacuaaacccucacuccaaaaagccacauaaaacaaucacaagaggacucugucugcagaccugugccuuuacuguucucuacaaaggaagagaagcagaaggaaagaguacuuucaaauuccucauuuuccuacaacuuaccucagagguuuuaaugugaaaauucuuacaucuuugguugcuacugccaggauguggaaagaucuucccaaauuuggagcaaacgcgauaucauggacggggucugugacugucauaagagucucagcuuucgcauauuuccuaauucaaagaaaaaggaauuaaaauuuucagaaauaaaacucacaaaacuugaggcuggagcgauggcucaggguuaagagcacuggcuguauccagugccacagcuggauucccaacaccuacuucaggggguucacaccugccuguaacuccagcuucaagagaucuaaauguuguucucuggccucugcaggcaccagcagauaggugacauguacucacguauacacauguaaaugaacaaguauaaaucuuaaaauagaaaguuucaaccaggcuugguggcauaccgcuuuaagcccagcacuguggaggcagagaggcaggaaaaccuucuaugagcuccaggcccaccagaacuauguacauuucaaaauaaaugaauaacuaauuuuuucuuuuaaaugucagaaacgugaaaaaguucaucaacauaucucaauguuucucagaaaaugcuugccuuuugggggcacucaauaguggcccccaaaugacuuaacucauaggcccaaacuggaauaaccuuauuccaaaaaaaaaaaaaguuuuuuauuuaucuauuccuuauucauuaucacuagaguaggacugacucuaaaauucaaugcccuuagauaagacaaaacaggauaaacagggcagugguagcccacgccuuuaaucccagcauuaggguagcagagguaaguggaucuccaaguuugaggcuagcguagucucccgaguaaguuccaggacagucagggcuacacaaaguaaauguuucuaagaaaaaacagagugaaaaaauacaaagcaggggagaugccuagaauggcugccacagcccaggauucugggcucaaucgcuggaagagccagcaaagagcacagccaagaaagagcacagccaggccaacaacuggauuucagagcucuggccuccauggacagaucacuaauagguaaagaaaaaaauucugucggauuggcccaagaaccaaaauaaggcccagucugcuccuuuacaauuuaaguguaucuuaaaauacuuaaucaaaacuuaucuaaaauaaagucucgguuuggacuggaaaaaagguucauccguuaagagcacugacugcuccuccagagguccugaguucaauucccaacaacuacaugguggcucacaaccacccauaaugagaucugaugcccucuucuggugugucuaaagacagcuacaguguacucauauauacauaaaauaaguaaauaaucuuuaaaaaaaagauuuuauuuauguagaaacccugucuuggaaaaaaaaccaccaaguauaaauagcacagaacuuggaaucucucaggaaacagugaaucagguaacagugaaucccguacaacgcagacaauaaaggacagccguuuaagacguaaacacaauuuggaacaaagcaguacugaccugguauuuucauuguauucaaaaaucugaaccuuggccauugaauuuggacugcuaucaucacuucccacagcgaucauggggggaugagcacgagagcuaggaaggaaggcaaacacuuauguaauacaauaagcugcuggcuuaacaggauucagaccuggacuccaggagacagacaaccuacaagugccuggccuccccaucacaucuggauguucaccacagcccugccgcacuacauguuugugugagcaccucacacacugucccucacgacugcuucucaagaagcgcuucuucuaaacaagggcauuccaacaguuaacacugggaaaaaacuaaacuagagcuuuguuacuaaagcaucacauaauuagauccacuaaucuaaacagaaaacuugauaagcuacaaagaacuauggugagagaguauaucuauaauaaauauucacauaaccuggcugcuaagguucagagucaacuagagcucacagacaaaauaucuauacccauguuaauauuuauagaacccaaacauuauaaauauucaucauguauuuauaacaauguaacagaauugaauagaaagaagucucagcaugaaacaggggcaaaauaagcucauucauucucuacaucucucgccucuuccagguuaucaagacagaauuucucuguguagcccuggcuguccuggaacucacacuguagaccaggcuggccucaaacucagaaauccaccugccucugccucucugccucugccccucuacuucugccucugccaccggagugcugggauuagaugcuugcaccaccaucacuuggcuaauuuucuccuuuguaagagaggaaucauugagacuauauagauggcaaccagguuaagagcacuggcugcucuuccagaagaccuggguuugacucccagcaccacauacaugguggcucucgguggucuacuacuccaguuccagagagucuaaagcccucucuggcuuccacagacacugcgugauggcaguguaaagacauaaacaggagaaauaccgauauacauaaaauaaaaauucuuuacguuuuuaaaaauuuaaaagaggaaucauauaaucuaagaacuaaucacuaaguacagauaaauuuaaaacuucaguuaccagcauaacaacuaaagauuaccacaaauaacauauauaccagucauauuccgcuaucagugcauauaaacaguuaaaaucuaagagagcaagaauaaucaucuaguauguaacaguggcuaccagaauuaaaagcuagacuauaagcuacugacagcauuuccuuucagaaaagagaacuuucggguuugauuucuacucuucuaguuauuugcauauuuucuuaccaaguaauuaaaauaaauaauaaauaaaaagcaaucauggacugggcggugguggagcaugccuuuaaccccagcacucgggaggcagaggcagaggcaggcggauuucuaaguuucgaggccagccuggucuacagaguuaguuccaggacagccagggcuacacagagaaacccugucuugaacaaccaaaaaaaaaaaaaaaaaauugauaaacaggaauaacgaagggacagacaugaugaccaacacucaagagggugaagcaggaaaguucaacaccagagcuggcugguuacacagcaaguucuauaccagcauagucaauaagauaaggaucuuuccaaucaguacauuaauuaauugauuaagggauucacuaauuggaugcuuuaaaauaaauuauauacuaaaaugugaagaaaugaucacaaaguauuuuucugugagaaaaagauccuugaggaaaauggcugaguucuaugcaugacugaguauagucugucuucuuggguugguauguaucugguuauuugcacagagcugucuccgaaaaauauccuaacuuauuuuuauauacauagaaaauuugucagaaguucucaccaaacgguugauaaugaauggguuccuccauuuuauggagcuaggaaaguggaaacugucuucuggauaauauuaucuaauuacaaaaagcaucugagaaauucaagcaguaaauucuuagcuugcaaccugcccuggccacuuuagaaggccgcgcuuaccuggaaggguuccaggaaaugcagcugcagcacagcuuacacgagaccucgugcugcagagaccacuggcugagguucaucacaucgggagccucguagacccuuacuauaccaucugcugaacagguggccaacaucagacccauauguuugggagcaaauuucacaucaguaacagagguucugcuguccacuagaguuguccucuucaccuggaaagaaaaauacaauuuaaaccauacaugaaaaggacugugauggaucugaagaggcaguguguuagauucacaggcaacucugccauucauuauguuuucauucuugcaucagaaauguaaagccacucuugaucucuauuuccagugaagcacuuugcauauacaaucucuaaauaaauuaaugaauacuuaugacuguaagagagagaaagggggcuggcgagauggcaccgacugcucuuccaaagguccugaguucaaaucccagcacccacauaguggcucagaaccuucuguaaugagaucugaugcccucuucugguaugucugaagacagcuacaguguacuuacauauaacaauaaauaaauaaauaaauaaauaaauaaauaaauaaauauuuuaaaaagaaaaagaaauugaaaggaaaauaaaacacuucauacaauaaacuggaacgucuuauacucuaguuuauuuaauucucuacuuugagagucgaggaacaugagcagcacacaggcuaacgaucaacugagguagaguuuaaagcagacaaaggaggggaagcuuggaauagugcagcuccgugacugacagugcaugaagccuuggaaggacuacaaaucagaagccuaaaacucuacacucaacuacuguacaaaaucauauaaaauacacaaauacacaaaaucuggugcaaagaaaacccuaugggcuccccauuggaacaaggaaaagccugguuaccagugugagccaagccaaagugaaaugaacaggagagaauaugggaagaagagcaaggagcuaaucucacccagugacucuguccucgaaguuuaucguuugauucucccacuauuucuucccauacagcugcuguucggucaaaagaacaggaagccaaaacuuguccaaauucaggaugagcccacgucacacgccauacagauccacuaugugucuguuugaaaagcaaaacugauuuuacucacuucacacauaccauuuuacuugggaaaauaauagaacacaaguaguuuuacuucaguaagacaagaaagacacaauguaacauuuaaauaaaaaguuaauuucuaaaaaccuagaacuuuuguaagauauuuaggauaguagacuucuggacuuguacuuauuauuuauucuuuucauauguaugaguguucuguccacacguacaccuauaugccagaagacagcauccaaucccuuaguagauggcaugagccaucaugugaccucuggacaaacagucuucuuaacugcugagcuaucucaucaaccccuagaguugguauucuuuuuaaauuaauuuuuaucuuauuuugaauaagaccuccugcucuuccagagguccucaguucaaaucucagcaacuacucaguggcuuacaaccaucuguaaugggauucgaugcuuucuucugccgugucugaaaacagcuacaauguacuuacauauaauaaaucuuuaaaaaaaaaaauuguugucaggcaggcauugguggcacacaccuuuaaucccagcacuugggaggcagagguaaguggauuucugaguucaaggcuagucuggucuacagagugaguuccaggacagccagggcuacacagagaaacccugucuugaagaaaaaagaaagaauuguuucugagaccuguaacuucuacaagacaguaucacaacaaaaagcaaaccgcccacuucucaucuguucaucuaaucuucugggcuccaccuuuaauucugacuuuuaaaagcuaucaacuggacuggagagauggcucagugguuaagagcaccgccuguucucugugauucugaagguccuguguucaaauuucaggaaccacauggugacucacaaccauccguaaugagaucugaugcccucuccuaggaugucugaaaacagcugcaguguacuuacauacaauuacuuuaaaaaaaaagcuaucaacuaaaagacacacugugcuacauauuugauuagccaaguguuagauucuuauuuuaacuaaagaaugaggucugcacaaagaugucaccacaauuuuuaaaaaauucaauaaucaggcaugguggcauaugccuuuaauccaggcagguccaucucugugaacaaggccagccuugucuacacagcaaauacuagaccaaccaggguuuaaaagcaagauccuuucucucucucuuuuuuuuuuuuuuuuuuuuuuuuugagacaggguuucucuguguagcccuggcuguucuggagcucacuuuguagaccaggcuggccucgaacucagaaauccgccugccucugccucccgagugcugggauuaaaugcgugcgccaacacgcccggcgcaagauccuuucucaaaaauuaaauuaugaagccaagugugguggaaggugcuuguacucuuagcagauggaagacagauauaaacaggacagccugcuugauuuacacugcaagcuccaaucucaaacaaacauaacaaacuuuuaaaucaccaucccuuaaucaacacagaauauuuacuggauguuucuaaauagccuuccaagucacaggacaauacuaaacugagacaggcgcuucuuuugcacauggcauguugauguacauaauaggaagcugagaaagaacuacuacugcaaguucagaauagccugggcuacagagcaagacccuggcucaaagaaacaacuggggaucuguggaacagcuuagucaguaaaacguuugccaugcaagcaugacuuucuauuuuugauacagagcugcaaaauguguggggacuuuaacccaucuauuccuaccauagacccaaagcaaaaauugguuaauuagccuacccuaucauuuacacgguggcucauaaccaucuguaaugggauuugaugcccucuucuggcucgucugaagacagcuacaaguguguuuauuuauaauaaaucuuugggccagagcgagccaggcugacuggaacaagcaggguugaccggaacaagcagagguccuaaauucaauucccaacaaccagaugaaggcacaacuauccguacagcuacaguguguacucauauacaaaaaauaaaucuuuaaaaaaaagaaaagagaaaagaugaagacauacauaaaacacaacauggaugaaacuaaaaaguacgcuacuggaaacuagccagguacaaaggacuauaucuacacuauuacagugcuaugugucucuucuuagggguauccaguagaauucuauccaguggauucuauccaugucuagcugagcagaccagugacuuugcuuggguuacuuacaggaguaugagaguggguuagcacagaaagauaacuguaucaccaagccccccaucagccuggcugaucacugcaugccaccuucagucaaccuccuaccuugucuauauagaaacacccaagaccaaggucagcuucaacggagggugugcugacucuuucccagcucuuucuaagaaagaauauuaacagcucuacagccuucuguauuagcauagagucagccaucacugugcuaucuacucauucccuuacugugacuacagggccaggguauucuggaagucaccaaggcaacucggcuuugugacggcaauagucaugugaggccaggagaaaauagcacugcuacaaacuauggucacauaacaaauacucagaaacugcuuuugcgaaaaauuauggauuccgggacuggaaagauggcucagcaguuaagaguacugacugcucuucuuccagaggucuugaguucaaaucucagcaaccacaugguggcucauaaccaucuguaauaagaucugaugcccucuucugguguguaucaagacagcuaagguauacucauauauaauaaauagauaaaucuuuaaaaacaaaaauuuuuuuuuaaaaauuauggauuccucagagguccacaagguaacugaacagaggauggaaaaacuggcaucucugccuucgucugaauaggucaagcucuaacaagagcaacaagcaacagcucuacacaggcaugcuaagucacugaaaggaguaucugucuaguucaucugaucccccugucaaggcugaagccauggaaagaaaucuguccucagugaaccugugucauguuggguuaugaaaauaccaaccauuccaggacagaccaccccacgccccuuuaggacaaucaauuaucaguaaguauaaggcagaaguauacauucugugaggaccaggcugaggaggaaacagauugaucuucaagcaaugacaguccuaagggccucuuuagaccaauuuuugaaacuuaagaaaagauaaugauuuaaaucuaaaacucauguuaguaccugaaagucauaguuggggccaccgagcugcaaaucgugugaccuacaagcgaccuaucugcaagauaguauuagagcaauaguggcaaaccuacuguggaagaaaccaacacuuucuaacugacucgacacugcuaagauggccaagaaccuacgccuaggugggucacuuacagcuacgauucugacaaaggaucuuaacacuaaagugacuccuaauaacagacugcuaugcccauagaucagagccuugcucaacccucaacagagaagcugcuucuugcaguagaugggaauuaacgagacccacaacuggacaaugugcacccacaacggacucuggggcacucaguccuacaugggacguuuucaucaaagcgucccuucaaggcuaaggcucuguaccgaagauuugaacagccagaagugauagacgacaccaagcaaacagggacuucuagaacaggagcgaugcacauacgaacucauacacuaaggagcauacagggguucaagccagaagggucccaggcugagggagagaaauggacacagggucccaccucuaaacaagacauuaucuauaacugauaccuguuaacaaaggaaaaauccguuuucuucaguggagucucacuguggauaucaaccacaccucaggcagccccauguacaggagcaguuggccaacacaaagaccuccauggacaguuuaugaaguuuuuguuuucuuuuggcauuuuuuuuuuuugucuuagagucuuuugcuuguucuaauuuuuauuuuugugguuuuauggauuuuuuuguuuuuguuugagaaagaacauaaaguugggugggcaguaagaggaagggaaaaaacaugaacuaugcucaaacccuagagguaguuauugcagaaugauacaaaaauacuauuuuccacucuaugguuuuguuuugagacagggucucacucuguauccaagcuggccucuaacucacggcaaucuccagcgucagccucccaaggcacugagauuccaugccuggccagaacuacaaauauucuuauuaucaaauuuacuauuacucuuauaacaaaacaguaauuaaaaaaacaggaacuauauuucaggaaaacacuguaucagguuuaucauuuucucaaagaugaacaccaaauuauuaauaccaaaauagcaaacauuucaauuuucucaaaccauguaaaaauaaacacuaaccuuccagcuagcuguacaaugccagucuccgcucucgcucuuaucccacaccuguaagaaaacaaagguaacugaguguggacacaagggacccucaguuccacaaaggacgcaccagugagggagcacucgcccucaggcugacagucagugaaaaccaaacugagcucagacaaaggcaaccauauuccccacuucuuccuccugccaccccuuccucccagcccugguacugccauuaggggcuagugguguaaugaagacuaagcccaaagucccaugcagagacuuugcaaagucaaaugcucuacugagaacucugacuaaugaaaacacuguuccuagcaguuuagguuccucuaucagauagaacauuuuuuaccaaccaaucaauauauaaucuuuuuuaguguguauuucuguuuaaaaacaccugauuugacauaaacuggccauucaucaacaccuaacucacagccuguaaucaugccugaagggcacggaucugacacaagccacaccacaccuugcuugugcuucaacaauagaaagcauuucaguacugccccuggaaaccauuuuuagccuuggagcucaccaacagaaaggauaagaaaauaaaugcacagcuccuaccuucuuacgcucuugccucucucucuugcucccuuacucccaauucccuucccccucuccacguggccauggccgguccccauuucucuacucucuccuccucucugccuuucucugucucuacuacccucuuaacuccccuccccaugcccugaauaacuguagcacuaaguggauugugaaaaagaauuugcuuacagcaugaaccaaauacaaaggaagucauccuguuccaucuaagccaggaaaacguaaccaggagacuuaugcagacaggaaaagaagugcuugaauacagugucaaucuagaagugaaaaucuucuacagauacacugcagccuacauuucuguaacugauugcagaagcacaguggggccaagcuugguggcauaaccuuuaauccuaacuccugggggacagaagcagauggagcucuaaguuccaagccagccuagucuagaccagauugggguggggugaggggggcugcacacaguggcuauucacuuugagguaacaaauuguaaugagguaaaaugaaauaaaauaaaauagcagcaaccagucucauagauagaugucucagcauauaagaguacucaguguucuucuaccaggacccagguucaauucucagcacccuccaccaucuucugaccucuggaggcacuggagggacagauacaugugcaaguauucauccauucacacaaaauaauaaaauuaaacaagauaacauuuaucagugguauguaaaacaaagcuaaaguaaaauauucaauaaaaacaccaagaaaaucauagacuauaaaaaacuucuaauuuaaucuaucaaaaauguauuaagaacuaguuacuaagaaaaauguaacaauauugggagagaaaguaauucaucacaaaaagcuuacacacacacacacacacacagagacauucaaugaagagguuagaaagauggcucagcaauuaagaacacuuacugcucuuguaguggacccugguucaguucucagcacccacauauggcucacaacugccugaaacuccaagggaucaguuccuucugaccucauacaggcacacauacaugcacauauacaaauaaugaaccuuauaaagucagcacaggcauucaacuaucccagaaugaacuugacaaaaaucuguuuguuuuguuuuguuucacuauguaguccuggaacucacucuguuaaccaagcuggucucuaccucuugagugcuaggauuaaaggcauacaccaccaccucccagccuuuuguuuuuaagacagggucucucuacauagugcugacuguccuggaacccacuauguagaccacacuggccuggaacuaauccaacuaccccagccucccaggagcugggauuaaaggcgugugcuaccacauccagcuugaggacauucuuuaaaaguaaaaaaacauucaaagaacggagaagauugguaaauacagugaguuguucagauagcaaggaacuuacuaguuacuuuuuuuaaagaaucauuuacauguguaagugugcaugcacgcugagugaagaucacagagaagccagaaggcagcacuggugcacgggaucuacuggagccgcaguuacagaugguugugagccgcggacuauuagugcugagagccaagcuuaguucaucucaagaggauacucacucuuaaucaugaagcuaucucuccagcuccacaguaacuuuuuccuaaaagaaagucuaucauuuacacagauuuuuuaaaaaaguguguauaaacacaaaccucuugaguaagauaaaguacuaaaguaguggaguaguggcccacaccucuaaucccagcccuugggucucugaguuccaggacaaucuauuccacauagggaguuccaagacagccugagcuacgauguaguaucaaaaaagaaaaaagaaaagaaaauguacucuggacaaccugacugcccuuaauccaaacaccaacuauauagaacucucccacaaguccagagaaaaguguccaugacuacaccugacugcaauccugaaggcacagcuccagcccagcugccggcacuuuuuacucucucacaagcuuugaggaacucuggaggaccgucaaccauuuccaccaggcaauuccaccuagugaccuagcagggacugcuguaacaggugcuaaaagguugagggcuaaguggcucaaagaccacuuucucugguucuccaagcaggcuacucaggcucacuaagucagucagcuguaggucaucccuccuaaugugauauaggccucauaaaaggcuugagagaugucuuuuucuuuuucaauagcgugaacagagcgagcacacaaaaucaccugcagagaugccagaggggugacuacagcagaagcagcagagacgagcaauccugcgaccaagcugugaaagccacaggcaguuugguagccugacagcuaaaguagccccuucacugguugucugugcacggaagcaagcaucgaaaugcagaaguacguucucucccaauauugcuguauuaccuuaguaaauaccauuccuaaaggcuauaauuugaugucugcuacauaaaucagcugcacuccuuggccaacaaaggacccaggaucgguucucccaacaagauggaucacaaucuuaacucccucuucugacccgcaaagacaccagguagugcaccuucauacacgcagacagaacacucacacgaauaagucuuugaaauugugggguuaggggaguggccucguuccugguggcgcacauauuuaaucacaccacucucggcagaggcaggcagaucacuuggggauacaggacugagacccugucucccaaaaaaaaaaaaaaaaaaaaaaaaaaaaaaaaaaacaucguagcacauucaacgcacacuugugauaaccaucuucagagaccacuugaacaugaacaagaauuaaaaccugguguccagcuauuuuggcguugugaaggaguucagacuuggaaccccagcguggugaaacugagacuggaggacuacagccgggucuagagucuaagauaaucucagaaaacgugugugugugugacuggcguguauuagcccuucagggcaucccauguguccugggcagaggaacacaggcgaggcccacaggaaugacacacacagcgccagaggaaaaagaaccccaaaguccgcacaagcgcgacagccgcggcccacgccgcaggcccagcaugcgcgugcgcuuagcgagcgccccaggccgagagccgcaccgcgcaggcgcgguaggaagacgccgcgagcgcgggaggccgugaccccacaauccgccggcggggagggcucucgccgcuuccggcguggcggcgucggcggcugcggcucgcacgcgccucgguccgggcuaaucccuucugcgccgccucccuccccucccggccgggcagcggcgagugccgcgcgcaccuugacgcucugaucgcuggagcagguggccauccggcgcccguggaagucgaaagacacaucguggaugagguccuugugguccgccgcgaugcugcgcgccacaaacauggccgccgccgucugccgggcccgccuccgagagggcggcggugcggcccgcagcccccggaccaccgcggaggcacguacggcacgucggcccucgccugcccgcccgcgucggccccggcgcgccacgccccgagggacacgcccugcgcgggcggagccugcguccggaccucgcugcagcagcagacgaagcugggagacggaggauggaaaag

SEQ ID NO: 8967 - RNA, 34817 nt, Mus musculus
cacugccgcgccgcggauccgccccuuuagcggacguuuuccuggcgcucguggcuggcggaucuugggggucguggccgggugaggaggggucgucgaugcgguggacucgggggagagggcaaggcuguggcuccuaggcggcggcggugacugcccggccugguggggacacgggccggaggcugggcugcucugugagaucaggcgccggcguguggcccaggcucccugcccgggcuuuggagcggccgcauccuuguucccuccgguccggcuagggauugcucacuucccaaggccucugagcucugugguguuuucuucuugcaaagugcucuggcgccugcuuugcuguaugguggugggugguccuguccuguugccugacucugcuucaggaaguaacauuuuuguucgcucugaggggaggguucuuaugucaaucagugucugcuaagcuuccugcacacuuaccccuaacggcuaaugcaaaaugauagacugauuuuacucuccccccuccaucugcucugcucucgauuucagacuuugugucgugaaacaugaggucccuucugacacagucguuuggaggccagcugucuauaggacagugcauucguucgcacuuacccuuuugaagacaugcuucugguauuuucauuucgaccgaaccaacuuuuucuucagauuucagcguugugggcgaacuucacaguaaguuuuaaaaaguuauauacgaaauggcuacccaauuuugacaugugucacagggugccaauaguuauaugacgauugcuggcaauucaguguuucugguuguacagcguguacuuuuaaaauguauguguguaacuaaguacauaggccuguagugacuacaggaaguaaucuuuuauguacccaugaaugugauucauuaaauacaaguaaaucaaugugugaaaauugaagccacuauacuccuuuaaaaaaacagcaggagacauugcauagguggcuacuuguuuaaaauacaauagaauaauaaauaacauuguauuuucuucacaauacaugguggauaauggaaugcuaagggaaauuugugcgauuuccuauuuaggauuuuuuuuuuuaaagauuuauuuauuauauaagugcacuguaguugucuucagacacaccagaagagggcgucagaucuuguuacagaugguugugagccaccaugugguugcugggauuugaacuugggaucuuuggaagagcagucagugcucuuaacugcugagccaucucuccagcccaggaauguuuuagaaauguauguguuuuaugcauggaugggguuuuuuguuuugguuagcuuuggaaauuuguuaucauuacaugugugcauacacauugccagaggauaaccugugggagagaggauaaccucucuccucccauuauauggguccuagagauccaucucagguucucaggcuuguguuuuuaguuaguuugcauaaaaaaacaaacaaacaaacaaaaaccuuuaauauaggaccuucuuucuucuggcaugguacuggcuauguagcccaggcuggucugaaaccugaggcagucuugucucagccuccuagauugcuagcauauaaaggcuagacuuaggcaggauaguuggaacccuugagcaguggcucaaaauguaauggacaacaugugcugggaguaaguacugggucucagcucuagagaggcauuugaaauuagaaacauaagaaguugauaacugauauagcaggaggaauuagaaucaucagagguacccauguaugccacagcuccuuuguuguccuaucuggggacaacuuaugggaguugauuaucuccuuccacugugugggauuaaacuuaggucauugggcuugacggcaagcaucucugccacugagccaucucaccagcucucaauaccagaauuguaaacuuacccuaaaagucauuaguuuuauacugucuuugcuuuucuuacuaguuaaguuugugauucuucauauuccuuccuccacuaaaccaugggugucuuagaggcaccaugaucaugacaacucuuuuuuuuuuuuuuuuuuaaagauuuauuuauuuauuacauguaaguacacuguagcugucuucagacacaccagaagagggcgucagaucuuguuacagaugguugugagccaccaugugguugcugggauuugaacucuggaccuucggaagagcagucaggugcucuuacccacugagccaucucaccagcccaugacaacucuuauaaaagaaaauauuuaauuggggcuggcuugcaguucagagguuuaguccauuaucaucauggugggaagcauggcagcaugcaggcagacauggugcuggagaaggagcugagaguucuacaucuugaucuacaggcagcagagggacacagacauuccaggucuagcuuaagcauaugagacaucaaaacucgccucaacagugacacacuuccuccaauaaggccacaccuccuaacuaugccacucccuaaagaccaagcauucaaacacaagagucugugaggggccauuccuauucaaaccaccacaguggguagauccaacuuguauuugugugcucuguugguuauaagaagguaaguuuaguguuugggguguguguucuuaauugugagguggccagggggucugaggcuuacuuuaguuagaguguguguuaguaaccauucuuauugauguuacaaaaaucuuguuuuuguuuuuuuguuuuuuuuuuuuuuuaaagagacauuguucuuuuaauuguugaaagauguuaugguaauaaaauauucaacuuauuuuucaaaugcuguuguuguagugagauggaagauuuccgaggaauagcagaagagucauuuccaagcuuuuuagccaauucacuacuugguaauagugagguuuugggaaaugucacucuuucaucaaauuuuggcuugcccauugcuguuucuacacuugccaggagcagacccagcacugacaacagguaagacucacuugaacaaauauuuuuuuuucagguguacaaacccugcaguauacugagaggguagaguguggggugucuuaggccucuggcuccuagugcuucucucuggauaacugcuauucucuuauccugcgauuguggcagucauugcaucuuguuuuccuuuuuuccuucauuucagucaguuuccugcuucccuagguuugugugguugcccuucccugcuagcuaagcuuauucaaugcuucugauuuuuguguuucuuucccuaguauuacggcuugaucccugggccgugugcgcgcuaagcaagcacuuuacccuuauguccccccagcccuugcucuaugauuaugaauuaucuuguauucaaauaauuuuaaguuacucagaucaaguuucuuauuuuuauuuauuuauuuauuuauuuauuuauuuauuuauuuauuuauuuauuuauuuucgagacaggguuucucuguauagcccuggcuguccuggaacucacucuguagaccaggcuggccucgaacucagaaauccgccugccucugccuccugagugcugggauuaaaggugugggccaccucgcccagaucaaguuucuuauuuuuaggaaccaaaccaucuuuuacuuuauuuuauuuuauuuuaauauuucuuagucuaguuuuauaaccaaguacauguuuggcuuaguacauuuuauuucuauuaguccacaugugauauauguacuuuguacacaugguuucauguaugaucuucgaagugugucaauucugauuguaguuaaauaucugacacuauugaacaccuuccaauguaauaauuuaaugagggauagcauuuugaccuuugggauaaagggguuaugguaacacuggggcuucuguguuuuuuuuuauuugauggcgguuaguuuuauuuuuuagcccuaugacauuaguuaauuuugagacaggucucaaguagaccagccuggccucacauuuacuguagcucaagaugacuuugaauuucugaucuuccuguuucuacauggaauuaugaauaagccucuccuaccaugcccagaguguguaguguugggaucaaacccagaguuuuaugcauagugggcaagugcucuauugacaguccuauacuguucucccagcagcguuuuaauuguaaggaauuuaaauucuaacaauuuuguguagguguccugauguccaggaaucauacuuaauugaagagagguuuucaguuccuucugcaucaucucccaguugccagagugacaacccugagccaagagaaagauuacgacucagcuuucagggugaugagugaguucuugccuuagacuuggggaaaauggaugauuuugucuuugauuauuacuucuuagugucuguaagaaagaucuuucuguacaucucucuuaacuacauuuuuagccuuuaaauuuucuuuuuucugauuguaaaugaaacagucauugaaaaaaguaaaaauacuggcaguuguuaagaugacaaugguaauuaucuguuaacuagagaagagacagaugcugauuacauucucuucccuuuucauuucuuucuuuuuuuuuuuuaaauauuacauugcaggggagggugugugugugugauggacaugugugcuugaucauggaaacaugccauggcacauguguggaugugagagucuauuacuggagucuauuuuuucuuuccacuguacugguccugggaaauagguuugguggcaaauaacuuuuaucuauugauucaucuugcuggccuaguaugauuuuugaucuuucauuuuagagguaaaaauaauuuauacauuugugugcauacacggauucugaaaaaccagaaucucuaaaacuaaagcuugacuugacguucuuggugguuuuaguguagacagucuugaagguuucuguuuaacucugcauuuuacuauuggcaagguugaaugagcuaagacauuauucauuacuuucauuuauauuguaaauugccucuugauagacguuauaaacauguuuucuuuuuagaaauuauuuaagccgggugugguggcgcacgccuuuagucccagcgcuugggaggcagagacagguggguuucugaguuucgaggccagccuggucuacaaagugaguuccaggacagccagggcuaagagcuacacagagaaacccugucucgaaaaccaaaaaaaaaaaaaaaaaaaagaaaaagaaauuauuuguuuuucuauuuguuuacucauuugagacuuuuaugucguuuacaguauuuuuaccccugugcucuuuuauuaaagugagauuucccuguauuauguaugagugugcuuugguuuaagcuagagguauuugauacaugacagcuuuaauaaagggggguagagaagaauaggaaguaaauuguagcuagggcaaaggcuguguauggcagcauggcagggucguuaccucuuuaacuugaagcucaugguuuuguuuuguuuuuguugaucuccuuauugaauuuauuuaagcuuggcccuuggucucuaucagaaggaaaauugcuauuaacaaaaaacauuuucaucugaauaugaaauuauagaaaguuagguaugagaagagaggcaggaguagaaauacagcuugugaaaccuuuauguccuggcugguuuugugucgaugugaggagcggguguggcggcagucccaaaggcgccagggacugcagcuaagucguaugacuugcaccugacuuccucauauaagccacaaacaucuugagagcugugcagguguaccaggauaccggugaauccauuuugauggagauaugccccugcugcccuaauuagcugaagcugcgugccuggugaggucguggcguggccugcugugcguggaugggaacugagcguauauaagagugagaggcccggguuagugagaggauuauuauuagugggagauauaaacaagggagauauagagaaagaagaaacaggacugaauaaacgugugcagaaggauccuguugcagcgguguucuuccuggccaguugagcgcacgcaagaagucgacacagcuggaguuaucucagagaaaggagcuucaguuggggaaauggcuccaugagauccagcugucaggcauuuucucaauuagugaucaagggcaagagggcccauugagggugguaccaucccuggacugguaguccuggguucuauaagaaagcaagccaguaagaaacaucccuccauggccucugcaucagcuccugcauccugaucugcuugaguuccaguccugacuuccuuuagugaugaacagcaauguggaagaguaagcugaauaaacccuucccuccccaacuugcuucuuggucaugauguuugugcaggcauagaaacccugacuaagauacuuuauuucccggucauguuggcauacuauaaucccagguagaagcaggaauaucaaagguccaggcuagccaggccuuuauguaaauucaagggcaaccaagaacccagugagacccucuaucauaacaaaaacaaauaacuacaaaaccuuuauuaauucagagauuuuguugucuuggcgaacgcuggucuaguaucugaaaguauaacucauuguuaggaauagcuagguuuuuagcuagguguuuguggcgcacuugggaggcaaaggcauguggcucucuggguucuaaccuggucugcagagucuccaggacagccagggcuacauacagaaaaccuaucuugaaaacagcaacaacaacaacaacaacaaaauaaguaagagagagagaagaaagggaagucugucuucuaggcauaauacuuaaguguaaagaaaaaaaacauuuuuuuuucucaugagaggcagggugauggugauuauucucuuuggagcuggggaacucugugccacagaagcccacauacuuauccaguccccagaaugcauuucuacgaagauagaguacagaacucaaugacagguauuuuuauagauuuaccuaaagguaacuaaaauuuuuaucauaauuuuacucccucaaaaaguucugcucuaaggaaaaagaacuacauagaaaguccagauuugucacaugcucucaugaaaccaagagcagaagagaagcaagcuaacgcugcgucuguucagggccagagccuucuggguggaguuucuccucugcaacagguaccagguauggaguguuagaaauuauuucauguauacauuuuaaugguuuuaauuucccuguccuuugcuugguaucugucuucugcuuuuauccugugguaagcaguguuuugguuugucacgggcuuuuguagagcuuucuugaugaauuuccuuugucuugggaaccaugcuguugguaagugaagcacuguccuguuuauuuuuuauuuuuuuuucaaagauuuauuuauuauauguaaguacacuguagcuguguucagacacuccagaagaggggcaucagaucccauuacagaugguugugagccaccaugugguugcuaggauuugaaucaggaccucuggaagagcagucagugcucuuaacugcugagccaucucuccagcccccacuguucuguucauuacaaagacuccacugcuaauauuccucacuuuuccucccaccagauuuuuguauuaauauaauggauaaauuagaaauucuaaaauaaauuauuauuucuuagacaaucaaguuuauacuuuuuuuuaaaaaaauuuuauacuuuuuuaaauuuuauuuuaaaauagauagauaaaguaggaaagcuacaaagugugaggcucugucaaagugugaaguguugucagcaauuacaggauucuccugcuuguggcuccugugugauacucuuaauucuuucuacuuuucuuuccuugugccccuuuguggguuuuguuuuuuguuuuuuuuuguuuguuuguuuuuuuuuuuuuccucgagacaggguuuccauguauagcccuggcuuucuuggaacucacuuuguagaccaggcuggucuugaacucagaaauccaccugccucugcccccugagugcugguauuaaaggugugugccaccacugccuggugccacuuguguuuuuugaagacaauuuugcuauguacucugacuggcuuuguaccuugcuauguagccaaggcuagcaauaacuuaaagcaauccuccugcuucaguuuccugaaugccaggauugcagaugugucucaccacaccuauguuuccucuccucccacaacuuguucuuucccuuugugaaagaacucaaaaccagaaauugaaaacuauauacuuuugguuugcuauagcaaugauauaaauuggagguauaauucaguacuuauaauaccaugauugaguguuagaagguugaugaguaauauacauuuauaguuuggauaauuuuuagguauguuuguguuucuccugauguaaauuuucaauuaucuaugaaaauagaacagauuaguaucagcuacacuugcaagcugucaagaaagugacaaaacaaccaaaaauggaaagauauuuuucuguauauaauuacauuauaguuuauuuauuuaaauuauuuucuguauauauuaauuacauauuauauauacaagguacuaguacuaaaaauauauaaagaacuuuaauauugaaaagagaaauaugcaaaggguuugaguagacaguucucuguagaaauuuguaugcaagguccaguaaacacacagauuuuucauagcaugagucauaagaaaaaagcaagcaaaaccaugagauacugcuucauacccaaaauagacacaucacagagauagacgggucugagaggugacucggggguuaggagcacuugcuguucucccagggacccagauugauuccuccuacuucccuggcagcucacacccacccacaacuccacuuuaaagaggcccagcgccucuucugaugucugaggggacugcagauguggugcccagacauacagauagacagucacauagaaucaaaacaaaaaacaaaaaaaggaaaaaacagcaaacauuguucaagaguuacagaaacugaaacucaaacuuugaugguagaaauggaaaaugguggcuaggugugguagcacacacuguaaucacagcaugaggaagcagggucaggggagucucugcguuugaggccagagagucuauaacgcuuagcuuccagaacagccaggacuccauagugagaggcccugucucaaaaacacaaaaacaaaagcaaaccaaucaaaacaacaacaaugaagagagagaaaggaaauggugaccuguuuuggaaaugaguuugacaggacuuaaaacaauaaaauagacuaggauauauacuaauaagauauauacuaauaagacuuguuuuuguuuguuuguuuuuguuuuguuuguuuuuguuuuguuuuuuuugagacaggguuucucuguguagcccuggcuguccuagaacucacuucauagaccaggcuggccucgaacucaggaauccgccugccucugccucccgagugcugggaucaaaggugugcgccaccucugcccagccuaauaagacaaguuucuggaaaaccuuaguuggagaaaggauuuauuguaguuccugguuucuguccacauuuggcugguugcauugcuguaggccuggagauuccaagucuuugacuccuggugggcagggauggauucuuguauuaucauccuguacuaucuauucuguuucaagauaaaaaauguuuaguucuuuuauuugucacuuuuaaauaugauuagauugaaaaauaaucugugccuucauuuuuuuguuuuuguuucuuuaacagauucagcucuugauuuccacuuaaaaucauggacaaaucaugaagagcacaauguaaguuuuuauuauuaucaaauaauauuauuuauuauuaacaaaucaugaagagcacaaaguaaguuuucaucauuauccauuccugggugcgggaauggaggaagaguuuauguuacacacccugcuaugucggaagaaacauuuauauuaaacacacacacacacacacaugaugagagagagagagagagagagagagagagagagagagagagagagaacgaacgagaacacacuauagaagcugguacauaacagaacuuuuacaguaaacauggaaauuuaguaagcagugcuuggugguauauuccaaucuuccuagcacuugggaggcuggggugugaaaauugcuguggauuugaagcuagcuugggcuauaugggaagacucugugucuuaguuucucuuccugcugcugugauaaaaauacccuuuuaaaaugagggggagaaagauuuuauuugaguccacaguuccacauuacaguccguuauaacuggggauugacaguagcaggagcuugagugagcugauugcaucagauccauaaucaggagcagagaccagugagugcaugcaugcuccugcucacguugcuuucucuaggguuuuuguuguuuuguuuuuggagacaaggugucucugugaggccuuggcuguccuggaacucacuauguagguugccucugucucaagagcgcugggauuucuauacuauuuuggauccccugcuuagggaguggugccaccuacaggagguggguccuucugcaauuuauuaaucaagguccuuaagagcagauaacugggcuggugaguuggcucaguggguaagaacacugcucucccggaaguccugaguucaauucucagcaaccacaugguggcuuacaaccacuggugauaagaucugacgcccucuucugguuuuucugaagacagccacaguguacuuacuuauaauaauaaaucuuugauuuuuagagacaggguuucucuguauagcccuggcuguccuggaacucacuuuguagaccaggcuggccucgaacucagaaauccggccugccucugccuccugagagcugggauuaaaggugugcaucaucacacuugaaaaaaacaaaacaaaaccccagagaccuaccuccuaggugagucuaacuucuaucagguugaaacacuuaucaccuucugccuuaaaaacaaaggaguaguuuuccucugguaauguggagauucaaauauaguucugucuagaugucgucguggacaccuuugaucccaacacuccagaggcaggggcagaggggcagaggggcagaggggcagaggggcagaggcaggcagaucucuacaacuucaugcuuguucuacauaucaaguuccaagcuuaccacauagugagacccugccucaaaaaauaauaaaaaaaugauaguuauggcacuaaccuguaucuuauguauuuauugcacuagcugagcccauccuguauuaauguaaaaucccauugacaugcaaugguucuuaucucaaaauuaggcacguuuugcagucaacucuuaaacugguauccauggacaaggaaguguuaacuuuucauucugggacgugacugugugugguaaacugcgcaugcccuuugguguuagcuggaccuugggucugagagaagagaaauagguaguucuaaauaaugauaggaaagauugcuuggauuaagaauauuuauuccagcugggcguggugucgcacgcacacccuuggucccagcacucgggaggcagaggcaggcgaauuucugaguuggaggccagcuuggucuacaaagugaguuccaggacagccagggcuauacagagaaacccuguauuccccccccccccaaaaaaaaagaauauuuauuacagcuuuuguaguguauucacuuccuguagcaagccuuguauugcccaaauucaguugugagguauguugaccauguuacuggauuuguaagcuguggaggcaguucgauaguguccugcguuuuaagguggagcagggaaguagaguaggacaggaagggaugcuacuacuccaugcaaaauggaguucuucauugacuagccuguaguuuucauuuauuaacuguacugcaguuuaaauaguuggucuucuuuauagccguguaccauuuguuuccuuuuagauugccaugccugauccuaagaagcauuucgaagccgugaauccaaaccgugauuucagccauaccagcuuauuagacaaugaaaaacuguuaacacugacaaacuuggacaguuccucugguacuacagaaugagugaugcucucagccuuucccuugccaccucacuuugugucuguauugcaauaguuaguacacuuuucgucauugucuucuuugucguuuccuucuaccuguaacaagacucucuugacuugcuuuguuuuguuuuguuuuguuuuguuuuguuuugagauaggguuuucucuguguaacagccuuguuaccaggauguagccuugaacucacagagauucaccuguuucugccuccugagugccuccugaguggauuaaaagcgugugccaucaugacuggcuuuuuuucuugacuauucugagcagcaagauuuaucguuuuacuucuuugugguuucacuguguaggcuggucuaggacucccuagguagauuaugcagcccagaaacucauagacaucuaucugccugccucugucuuggcguuaaaggcauuauuuuuguuuaauuaguaagaggaaaugucauacuggccuugaguucaggaucuucugugucacaguuaacuaaaucagucaaucucuuucugucuguuuucuuguuucuucugugguccugggucuucagugcuagaccuccuguauguuagacaggcacuugaccauuaaguuguguccuuaauccucccccuuucccugauuucuucccccccccaaauauguuuauuuauuuuaugcauaugaguacacuguaccuucagacauaccagaagagggcaucagaucccauuacagaugguugugacccaacguggcugcugggaauugaacucaggaccauuggaagagcagucagugcucuuaaccucugagccaucucuccagcucucuucccuuccccuuccccuccccuuccccuuucccuuccccccucccccucccccucccccuuccuccuucccccucccccuccccucccuugcccuccccuccccuccucuccucuuuuucuucuuuucuuuuuccuuuucuuuuccucuccuccuccccucucuucucuuuuccuuuuccuuccuuccuuccuuccuuccuuccuuccuuccauuuauuauuuaauuuacauuaguguuuugccugcauguaugaguguuuaagggugucagauccccuggaccagaaguuacaaauaguugugagcugccaugugggugcuggaaauugaaccuggguccucuggagugcucuuaacuacugagccaucuuuccagaccaguuccuacauucuaagugcuaggaauuuauagguauaccucuucuggcuuuaugauaguuuucuuaugcuuugcauaaaaguaaaauuaugucauccacugcccugccauguuuuaucagccuuuaugauuaaaaauuauguggaguucaguuuuuacuugaaaaaccuaccuuauuuuucauucuacuuuaucaauagaugaugauauuaaugaugaagaauuuuaugaugaucauuuagaagcauauuuugagcaacuagccauuccagggaugauguaugaagcaggaggacaggagucgccagcagaugauuuuaaguuccccguaagugaugccagucaaguguguucuagucuuugguuuugguuuuuguuuguguuuauaaagaaauuugaccuuguaaaucacugucuuauuagauuuuuuuauguuguuguuuuguuuugagcuaugguuucauguagaccaggcuggucuacaacucaccuggaacuccuccgucuccccaguugcuaggaugaguguccugccacuacaccugguucauuccauguuaauguuauagacuuaagucuauggcuuuccuguggacuucaaauggaugaaaaaauggacuuucagcugggcgugguagcgcaugccuuuaaucccagcacuugggaggcagaggcaggcgaauuucugaguucgaggccagccuggucuacagagugaguuccaggacagccagggauauacaaagaaacccugucuugaaaaaaaccacaaaaaaaaaaaaaggacugucuucucuauuuccucucccuuucgucucccuuaugaaaguaaaagaggagguuaagaagccagcccuugagucgcugguucaggaggauucggacuucaaggccagcaugggcuccaugcaagaaggucggauaaugaggaaagcguaggcagucggcauccuuugucuucauuaagcaauuaucauuuuguugccauagcuuuuuuuucucucuggaucauuugaaaacaaauugcaaaugauuuaugacuauacacuaaaauuugucaccaaugaauaagaacauuuuccaacauagccacaugcuguuauauaccuuugauacaguaguuuaaaauuaagauauaaaauuuaugcauauggauguuuuacuugcauguaugccuagacugcuugcaugccuggugcccuaagaggccagaguagggugucagaucucuugagauugcaauuacaaaugguugugagcaacuauaugggugcuagaaccaaacccaaacucuugagacuagcuucucaccacugacccaucucuccagucccugauacauugguuuaaauuaaugaccauauucaaacuugcucaguuaucucuaaaauauucuuuauuuuuacuguuugugauucauaguuuaauccaccugugguuguuggauuucuuuauuuuagcuugcaauuuguucaugcauuaagcauuuuauacaauuuaggcucuuuguuuuguagacugguaauguggaccuucugaucagugugucccuuaguuagaauaguuagacauuuggcaagaacuuuagugauccauuuuccaccugauuaaguuggcuaggaccggcugcuguguaagccccgccucacggcaguggaugcaucugugcuucugccagccuucuguuugacguuggcucuccccggcugcucuuugguaauguugcucaugucucuuaugcaggggauuuuucuucgugauuaagucaucugugggaugacacagcaaagccuuguaaacauccugucuccagcaaguccuaacaaacuguugcuuagcuuaguuacugaagccucuuggaaucaagcacuccgcugguguuugccagggugguuuuccugauuuuuuucuuuuacuuuuuuuuugguuuuguuuuguuuuucgagacaggguuucucucuuuucccauggcuguccuggaacucacucuguagaccaggcuggccucgaacucagaaauccgccugccucugccucccaagugcugggauuaaaggcaugcgccacgacgcccggcucugguuuuuuucuuauugucuaaguagcaccccucaguaaggcagacacucuguuuuccucaaaauguucucuuuuaauuuaaaagcagauacuuucuuaacaggcaaaugaagacaguaucuuaaacugugaguuucaaucagaaaauaacaguccucggcuuccucaugaugcaugcaccucaggaaauucuccuacugcucacacagagucugagggaggccaugguuguccgccgggaacuaguaaguguugaaaugugauuuuuuuuuuuuccuccuuuuuugguuuguuugauacaagacuucauauaguaaccuaggcuagccuggguuuuacugugcacuccagguugcagucuuucagccuuagacuacugacuacugaaaguuuaggaaugagccucugugucuggcucuccuuuauucuuaauuuggguuugauuuuaccuuuucagggaaaaaaaaacuuuggugugauuaguuuucaguuuauuuuccuuuuccuuucgaaucuuuagccuaaaaccuuugaaaagaguuuuuaaugucugagcaagaggucaguuaccuccugguuaaauuuguuagaaugguuuuguuuuauauguuaaugugaaacugcugucgucauuaauuuuaacaguucugcguauaaagacacuagaaauaauuguaaucaugucugcgugaauugguacucguagaaauucaguaguauguucuuggguggccguuuuaagugauuguauccuauucagaccuuggagaaugagagaucaguucucuguaugcucccggucuuccuauguccaucccauguccaucccauguguccaucccauguccaucccguaugaugcuuguuuucccuugcuuccaaccugcagaauacgucagauggauacagcuaagaagacagcuacugcauuagacuaccuagacuuugacauugcuccauuaaccacuucuccuuauuuuagguggcuguguagguacugucgauaauaaaaugcagguagauaaugugaugucacuuuauucucaugccuggagaaaugagaaggaagcggcacacaauuugaaggauauuguuccaaaucaaagcagaguaaguugaugaacauuuuauuuaacuuccuaguaaucucacguuuguaugauaccagauuuucagaagaaaauuguugaccucugaaaaauauggaaaaaauauaaaauuacuauuccuaugguuuguguuugauuguauauauuauugacuucaugauuauacaaguguauacauuuucuuggcuuuaaacgugugcugucaugcauuuccuuguucauuugaaaaguucuuuagcuuaauauguagucauuuaguaaaacacauagcugggugugguggucuaugcauuuauuuccugcauuuggguagaggcaagaggguugggacuugaaaguugacucaacuguauagcugaguucacaccugcgugggauacaugggaaccugucuaaaaacaaaauuaaaaagaaacaaauaagaaaccauaagcaaacacuuguuuuuuaccuugcucaaggauguuuucauauuaagacuuuucucuuuguucugaugccaccugguuuuuccugucuugaaacaugguaggcauuucugacucaccuuuuuugucugaguauuuguauguguuugucuagccuggcucucuuccccuccuucccuuuccuagacugaaaucgacuuaccaauccaaggcuguauuaauaacuugcccccuaggggucuagagggauggcucagugguuuaagagcgcuggcuguucuuccagaggacccagguucaauucccagcacgcacauggcagcuuaaaacuguaacuaguacccucauauagacauacaugcaggcaagacaccaauguacaugagauaaaaaauaacuugcccccuagacuuaacaaagcagcuuaaagaagggcuauuuuggcaggugguuugaggagaugcaguccuucacuggaaggcuucuuuuuuuuucuuuuguaguccuggaugucuuggaauuuacaauuuagacuaggcuggucuugaacucagagauccaccuaccccugccucuugaaugauggaauuaaaggcauguaucacccugcugccuggcucacuugaaggcuuucacuuauacuaguuuuaugcagcuugucacacuaaugggcuugcuuuuguagagacuuuuauugguaauuacaaauguguaacuuacaguuuugucuugugaugugauggacagagagggcugcuuuugugcuuuugguuuguaagucuguugauguguguaauugcuaugaccacauuuuuuuuuuuaaggucugaucauuucuuuguuagucuuagagauuuacuuuugacugcucucagaauaaggagaguagcauccaucucuuggcagcugguuccuggugucuuuccuuggcuuucuucacuuucuugcucugcugccuucuccucccuuuucuuaguauguuguuucuucagagcagugcauugguguucgaguuguaggacaaguugguaagugacaagaugccgaaucuugggugcuuugguccugggccucuuacguugaugcuuucugacaguuaucggcagacaccaucuucuuuaaaggcaugaaaggcuucuggauucgucuaguucaucugggccucagcugauaaggcacauuagcacggucaugccacgaauacccuucucuccuuuaucuuauuuuuuaaauucuaauaaccaagaugaaaacuugguauccucacaguucaucugugaauagacuugagccugagcacauuuuaaacuuggguuuugguaaacugcuuagcucauacauaguccaggauauacugaauacuauauaggccauuuauuuauauaauaagcauuuuauaguaguugcauugcuuuguucauuaaaugucaagaugagugggaaaaacaaagcuuacuauuguuccuuuaauaacucuuaaagggauguggaggagaggagauuguggugaagaggcugugugcuguggaugagacccucagaucuacuuaucgucacagcacagaaacagaagacggcuuugacccagcugacuauaucaaacaggauucagaaucuccucaccaaaauaagcauuuugcuucagauuuagaaacaguuccgaacguggauagauguuuaaauacagagacuccuacaguguuuauucaaaaagauggagacauugcugcaucuucgaagacuaauggugacaauggaauuaauucuccugauacgcuuuggucaccaacuucugaaaggagagcauguggacuuuaugaguccgauucaaagacuagugacaguaaguagacuauuuaauuuuaaauagaauuaaagaagugugugagauguuuaggcuaagcuuccacauagaacucucugauuauuuauguugaaguauuuaaauguuuuuaugaauuaaaaaaauacucuuuaacaguuuucuuuuuauucauaaacaauauuuucuggccacagccucuccucccuucauccuccuaaccaccuccuucagaucaacuucucauuucccuucagaaaagagcagcccaacagggaugucagcugagcaugguauaagaagguacaauucuagcugggugugguggcgcacaccuuugaucccagcacuugggaggcagaggcaggcggauuucugaguuugaggcuagccuggucuacagagugaguuccaggacagccaggcuacacagagaaacccugucuugaaaaaccaaaaaaaaaaaaaaaaaaaaaaaaagaagguacaauacugugcacaaaccuuccuucauaucagggcuggauagggcaaaccacaagaggaaaaggcucccaaaggcaagcaaaggagucagagucagucccacucccacuaaagccucaggcuaaacaaccaugucauacauuguggucacauucaucccucccuugcccucuucacccacaaacuccuccccaccaaguccccgucccaccuucgugucuuguuuguuuuuguuuuguguuccuuggguuuaauuggagccaguaagcaugguuggaagccuguccucuggaguaucaauaacucccuaguaauuccauuacuaaagaaaauuuucucuucccccuaucagcccuugaaugccagaggauccccuguguagaagaggaccccaugacuuccucccuauguuauuauggguuuuaaaagauuuaaaaauauacuaauauuucaugauuguugcucagaaauaauaaaguuaagcagacagcuagugcaguugucccuuccucucccccauuacaccccauucuuacacacuggaggguaagcuuauguuggugccaucagagguauuucucuuuuuggggaaguggguuuuucuuuguuaaacugauuuugagcagacuugugcaccauuguuaaguuacuuguuccaugcaucaaucaguggauuuugaauuuacccuuuagaaggagagcucucacagaaugucgucuacaaaagugaggacggaagaugggucacugaccuugccuacuacacaucuuuuauugaucaacaagauuuacagaugucuccaaauaaugaaaugaaugaagacuucagaucugguuguaaguauggagauaacuacuuuuauugugccagacucauuguuuaugaugauguuuugaaucuaguuggcuuguauuggucagucauauaaauacaauugccuucuguaaauucuuuucuacaaaggaugcagccaacaguuauagggugugguagaaggagacacagaugagguuuuacauuacuucuguuuguuguucuaacaaguaaacuugagggggaaacaggggccugcuuuaguguuuaaccagugaagaagucaggugacaaaugacaagauuauuauuuuagguuagcugauaauuagauuuauuuuuucuaaaagucugaaacucuucuuccuuaauguccauggcugauuuuugagggguagaaaaguuaacacuagcugggcggugguggcacacaccuuuaauccaagcacuugagaggcagaggcagguggauuucugaguuccaggccagccuagucuacagagugagcuccaggauagccagggcuacacagagaaacccugucucgaaaaaaaacaaaacaaaacaaaaaaacaaaccaaaacaaaaggcaacacuagagcauugcagauuaagugggcgauuccuuaggaaaaguacuuugaaguauaaugguauuugagggaccaggccaauggaguaaacacugcauggugguaacucacaagcgaaucaggguucaucugugcuauccuccuaugggcagaguuuccuccccauccuuccuuggcuguucgauuugguugguugcugcuuucacauuuuaccauaguguuuuuagcucuuuaguuguagauucacagaaacaugccuguauagauuauacuauuuugcauccaauuuugggggcuucgugguuccugauguucagucauagguccucuguuccggugacugcuuccgcagacacauacuuagcauuguucguguaguagaauuccugagcuguguuuugcacucugauuuuccugacuggaagaauuuugccuguucuauuuguaccucagguuguuaacaugagacugucuacuugaccgaaaggauaguuugacucuaauuaguccuuuguggacacaugagagggcaauauccuuguuugggucauaaaaggacuuucuuuucugguucacucuucaccuuucuugaaucuuccccuuucuucacaaucuugaaguagcaggccagacccuggucucauguguguuuuaaaauccccuucagguagaguucugcacucuagugcuguggcuccuucuucucuuuggcccagagacuaggaugugugaucaggcccccccagcccccgcccagguccccugugagagcaaaggugaucaugaggaucuuuaaggucagauaggacaggacugaaugccuguuucuuguuuguuuuggggugugggacucugugagucugguacguuucugaccacacaaguagaugggaauucuagcagucaucuuuguaacuaacuuguagagaggcuuuucagucagauaaaaagcuugaguauacacaaacagcuugcuuucuuuuucuucuuuuuuaaagauuuauguuauuuuuaaaauuauauguaugucuguauaaguauguacacaugagcgcaggugccuauagaggcauuggaucucauuugaagcuggaguuagaggugacugugagucaccugauagaggauugaacucugguccccuggaagaguaguacauggugcuaaccacugagccaucuccccagcucuagacggauuuauucauucuuucucucucuuucccuuccuuccuuccuuccuuccuuccuuccagauguuugcccucaccuuuaccuuuccuuuucuuuucuuuuuuuuuuucuuuuagauaaaguuuucucuuaucuucuuauucacugcugagguggcccaugagcuuccagauucuccuguauuccugcaggacacagggguuauaggcaugugugcuacugugcuggcuuuuauauggguauuuaggauuugaacuuaggucuuccugcuuacauggaaagugcuuuacccacuuagccauugccugagucuggaauuuuucuuauggauuuaaaaaauauuauuaugauuuauacuuauaugauuaugauuuauauaugauuauauuuuucuuauaugauuaugcuauuaacaaguuggucuuaugccccugggcucaaaugauuccccuaccucagcuuccugaauggcugggacuauaggcacaugguaucaugcuuguacucaguuggaauuauguuuaaauacuuuucacaaaucaacuagggcaaauuuuuacaacugaaaccagucagaguauugugcauuuuaauggaaauuugacaaucuuacauacuuaauauaauuguauaaaucaugugaauggaaguuuuacacacuuuaaaauauuuguauuucgugaacuagggaguuguguaauggauaaaaaugcuugcuguacaagcaugaggccugcauucugauucccaguauucauguaaaagcugggaucggaagguggcagugguaugcacuuuacaacccagugagugcugggguaaagcgggaagaugcuaggggauugacagcauccuaaagaggagaaugucagcucagaaacaagacuuagagcacuagaggaagacaccugcaggugacuuguggccucucuagcugacaggcacaccugcagaggugcaccucccccacgugugcaccuguccccaugacaaaguguuuuccuaucauuucauuuuuuaaauuugcuuuuugugugugcugacaugaguguaauuauauaaacuuguuuuccuuuaagcugacgcauuggacuuaauugcaaaagaugaagaagaauucaauaaagaacauccauuuauacaggucugaaauuacuuguuccuaccuaaauuuaaauuuuucuuguauuaauuuaaauuuagauaaaaaacuuccccaagcaguuagucuagaaucacuucacuuuuuuuuuucaugggauggcaacuuuaacucuuuuguucuaaguuacuagcuaaaaacuuacuagcugaaaacugauagacuaaaauauaucuuuguaagggaauguagauuacaggcauagcaguugccugguauauaaaacccugcccuucauuuccagugcuguacauaacaacaguacaguuacuguaucuuuauuuuuuauuuuauuuuuuguuuuuuugagacaggguuucucuguauagcccuggcuguccuggaacucacuuuguagaccaggcuggcuuugaacucagaaauccaccugccucugccuccugagugcugggauuaaaggcaugcgccaccacgcccggcuggucuaucuuuauuuuuaaaggucuguacuuguuuauuuauugugugccugugguagggauguuuagggccagcaugugugugcuggcacauguauagagguuaaagaacaacuuuugggaguugauuuucuucuucuaccauguguccugggguccaaggagauguugucauugucagacuaguggcuuaaauuuuuuaaaaaagaauuaaauaaaauuacuuuuaguuaugugaauguaugcagaaguaggucacugcagaggccaacaguaccagaucucucuggagcuauaauuacaagcaacuaugaaccaucggauacauguggguacuggcaauggucuugggauccucuauaggaaauaguucacacucuugaucaccgagccauuucucuagccccuaagcuuaucuuuaauuuacuuaaaauuguuucuaaaauuuccauggaucucuuuguguuuuaaaauaauacgguuuacagaagguaauccuauugugugugguaaagauguguauauucuacuuugugacaguuaguguuuaaguaacuuauucagacaguacauauuguaaccgguauacaaaaaugaguucuucuguagacuuuaguaguuauucauucuuaaguuuaucuaaauguuuuguaccacauuuugaaaaagcuaguuuuuaaguuuuccuauuucuuuuauuuuuacuuucacacauuagaaaaacaaggagaagccuuuuugaggaaaaaacaaaaaaagaaacaauaacuuuaucuuuuucuaggaugaaaaaauagauguucagaacacuccaguggcacuuggugauaauuccuggguagcgacaguuaauuaccauuuauugagaaaaucacuuggcacaucagauuuugauaaagacaauggcaguuaucuacgccuuucauuaggagaguucuuugcagaaagaucugaagcucuugguugccuugguggugguaaggaugugaaaagaguaaguaugaaaaugguagagucacucauguccauguguggugcuggaccacaagacccaagacuggauaagcuguuguagcaacucuuaguggguggggaaaugguccgugugaaagagauguguguaagagaaaucgaagagaaccauacuuacuuuaaauaacccucuuuucccuuuacuugaccacuuucacugcacccuccccuaauguuuuccugaggguacaucucucuuagagcauaagccccugagagauccuaccaucucacaaucuuuuuuuuuuuuuuuuuuuuuuuuuaaagauuuauuuauuuauuauauguaaguacacuguagcuguccucagauacuccagaagagggcaucaaauuucguuacagaugguugugagccaccaugugguugcugggauuugaacucgggaccuucggaagagcaguuggagcucuuaaccacugagccaucucgccagcccccaucucacaaucuuggggaccaaaccucaacaugaguuuuuguggggacaggcacaaucccagguuucuuuuacuuagaauguuaugauggucuauuuagaguauagcaacuuuaaggcauaggcagaaugggagccuggcagaauagugguuaaaagcuuaggauuuguggucagucagaccugguuucaguucugguucugccuuuaaaccagcucuauggcacuggacaguuuaucuucugugucuaauuucuccauuucuaaaguguagugcucuuugugggauuuuuguaagguugaaacauuuugcuacguguaaaguagucaacacagguaugcacuaaguaacuuuugguaucauggucaauugguaggaagaauucuaggauucauuuauucuauccaucuauaagauguuuuaaaauguuagaauguuuugauuuuuaaaaagugauaguuacauagauuuuuaaaaugcaagcaguucauguagugguaagcauuauaaggaaugccugagcagaaagcugcuucacucugcuguuuagaauccugucugaggggaugacacggaacaaagaggcagccauccagagauccagaggaacaguguuccugguaaaggaaaaccaugugugugaggcccagagaacagguaucaagugguucaucgaaggcagaaagagcuaaugugaggggccagggugaggauaagugggguaggagauuggugguaucucaguugaacuuccgggaaggacuuggagugaguagcuuggucguguugcuuagguucaauuccacauugccacucccuuugccaggagccugcaucguggugaaagccaguaagacacagaggaacagacagccgaggcuuagucagggagaagagacagucaagucagugaaggguggggacaaggaggaccuauuguaacaggaaguuguaaggauuuaagauuuauucuacacagggaacuugaguugcaacauaauuuguuaaauguauauuacagaguguuuauuaaagcugaauucacuaagagcauguguuagcuuccuaguaagacgguaguacaauggcuaagauucauuuaaagaaaguagggcuuauuuugaguuaugguuucacuccauggugguuuggcuuuguuguuuugagccugagucagcacuuuacaucauagcuggaguguggcugaggaaacuguaccucauggcagcuaggagggagcuagggaugcgggaggggagaaaaaagaaggaaaagagacagcagagcaaagagggcagagcagggagagagagacaaggaaggaaguggcuggcguccucauguccccuucaagggcaugcacucagugauagaauguccuucuauccuccuaaaguuccaccaccuuccaggagugccacacugcucucuagguccuuagugcauaggcccuggccaacuauggcacaauguaaugacaucaguuucuucaacuuaaguagaacauaaaacauuuuaaggaagauuuauuuauuuuauguuuaugagaauuuugcuuuauauguguaugugcacagugcacuugcauggugcucauggaaguuagaucccuuagaguuaaaguuacgugaacuugugaacagagccaucauguagggugcuggaaauugaaccuggguccucuggaagagcagucagucaguucuuuuaacuguugagccaucucuccagucccugaauuaauuugaaaaaauuauguguauaugcaugugucuguguguauggauuuguguacauccauauagugccuguaggggccagaaggcggugucacacccuggggcuggaguuacaggcaguauacauuuuaacuacggagccauuucucuaucuagccccucagaaccuaaacaugaaaccaugcuuuugaaccaucugauccauguagugaauuaaaaaaugaaaugcuugaaagagguagauugggguuuuagagacuaugaaagaaauggaaaaauaaccauuccuuuuguauugucuuguuuuucagauaguaucucacuuuguagcccaggcuggccuugaacuuguaguuuucucgucucaucuuacucuguguucaauuguacuugugugcucugaacucuuuuuuuuucuuuucuuucucuuuucuuuucuuucuuucuuuuuuuuaauauaggggauguagcuagcucuggcuaaucugaaaauuguagagcaagcuggccuugaagucauagacuugucuuugccuccuaagugaguguugggauuacaagccaugcauggcuuucugaauuccuuccuaaauagaugaacauagcauuagaucuuaggaauuccuaagagaucugacucagagguuuuguuuugguauugugaaguuucauauauucagcuuacuggauccugggaagaaacuuccaaaugaauaucaacuagaaucuuaagucauuuuagaucugugugcgauacgaaagucauguaaauucaguucaugaaagugcaaauucaguucucuuuaguaaguuccuugaaccuagaucuuucugaaacuuaacgaaagucagugggaguauauuuccucucaaggcguuuucuucagauuaaucuacagagcaagauaggcauucuuuaaauucuacaacauuuuuaccagcccccauucagaacaacgccaauaaacagugaguguccguaacacuuacugaagugccccuucugacuugauuuugacuuuuuaggaaggcuuacuuaacaucaguuacagugauuaaacgguagcugucacugaagaagcaaaagguuuugucuguggcaucucuucuccccauguuggauguggugcccaggucuuuccacgagcagacaggugcuaucaccgguaaccagcucaaagcuucuagauggacuuuuaaaguuugccucuagauuuuugaaguuaaauggcaagaaugaagucauuuggauguuuuaguaguaguagauaaaguaaucuagagcuuuucaaagugguuggaaauuaaggaaaacuaauuuguguuuaauuauuuuugcagccaucauuugguuauuuuauuagaucaccagaggagagagaaccuguugcguuaauaaaaucugauuugucaagaagugauuuggagaaagaagcaacucagccuuaccgugguuucucuucagguaguggauuaaauggaagacuucaaggaucuguugacuuaacuuuguaauugugagaucauguucucugcgugaagauguacacaguguugcuuuauaagaucuccacaugggugggagagguggauuuuuuuuuucaccuuuucuucucuuuccuuuccuuuucuuuucuuuucucucuuuucuuuuucuuucuuuuuucuuuuuguuguuuuuuuuguuuuuuuguuuuuuuuuuuucaaggcaggguuucucugugcagcccuggcuguccuggaacuuacucuguagaccaggcuggccucgaacucagaaauccgccugccucugccucccaagugccgggaucaaaggcaugcgccaccacugcccggcacucacauuuccuuuucaacugaaaguagagaagagagauaaaauccaccuaaguuuuuuuauaaacuacuauagcaaaugugaauaauuuaaaaugaccuaguuaaaucuggcuuaucaaauuauuacuguuauggaauaauagaaauuagagaugcuuugaaauuuaaaguagaauacauauaacauuccugcaauaucuauagaauuuuuuuuuccuuucuugagacaggguuucucuguguaucccuggcucaccuggacucacucuguagaccaggcuggcuugcacucagagauccuaaaggugugugcuaccacucucaacuaauaggagauauuuuaggucagacuuucuuugcuagcuaaguuacugaacuuuaccgaacuguaccuuuuugcuaauccaguaucuuuugcugcauaauuaugaaguugcauaauagugccccauucuuuuuuuuaaauuauuuuauuguauguaccugaguauuuugucucuguguaucuaugcaccaugcucaugccuaccuagugccuacagagcugcuggguggucucugaggauucacuccagguucucuggaagagcagccagcgcuuuuuaaccacugaaccaucucuacaccccaggauaugccugugcuucaguacaggaugaaggauaaaaagccuguuguaguucauuuuuauuacucugaagaaguauauaauuuugaaaucaaguuuugaagcccaaauauauuaaauuaguuuacauaaauaauuuaggggagauauaaauccacagacuuccuucagaaccuguccuuuguccaaaugucugucaauuaaacauucuuacugaggacaacucaacauuuacaguacaaagauacuuuuuuccccuuggcauuuaaucauuuggacuguacuuccuuaucagguuguuuccaaaggguaacuacaugccuuuaaguugaauauuguuuauuuccuauaggagacuuaaaugaacagucccagguacagcuaagugaaggaucgguuaugcucaaggcugaagaacugcagagaaauucccagguggaugaagaugacauuacacuaacugccagcagaaaccagacagagguagcucaagcucucccuaaagggugucuuagauuaucuugcaaugguuuucaaauaagauggaccaaggucaucuguggaaaauguaugcccguauuuuucuggcuucaguuuuguuacaguguccuuuaaaugagaaauauuuaaaaaauaauuuauaauguacauauagaagaauguauaagacuuagagugaaugcauuaucccaguuuguguguccccgauggagaagaacacugaggcauguacauccacccuuguuucuucccgucugauguuccucuucacuuggccaagacagacggucaguguuuaccuccagaaucaugaaaagaaaaaaaagaaugaaaaaaaauagagaauauugucaauaauucagaauucuuuuuaaaaagauucuuuuaaaccguacuuauuaccagagcauuaguaguaacuaguaauacuaguuauaguauuacaauacuauaauucuuaccuguuuuuaacuuuguauaaaagacaugcagcaugcauucuuuuucuuuggcuuuuuuugcuuuaccuuuucuugcuaaaggacuguguagucagccauuuuccuuaguguguuguguuguguuguguucuaugaguguuagugaaugcuuaggcuauuugauaugcuggaacagucuagugccugugccuugucggcugacccacuccaccaccccuguccugugcgugucucuguugagugcaacugaugguucacacauaagguucgugacuuacacugagguuccuuuagaauaguuuuuggagcagcuacaccaauauaguugccucccaguggucuguaaugauuuguguugacauaugaccucuccucacagagugguauuuuuuuuauaccuuuugaguagcucuguagugggacuucuuuguuuugauuuguauucuucugauugcuaaugaaguuaaguacuuuuauacuuuuauuggucuuuuagguaguuucuuugugaaguuccauuucauggauuuccuuauaucuuuugguaggucaugaaaguuuuaccuauuuccuuucagucugugacuuguccccccgacccccuuuuuuucuucaagauagggucucacuguauagcucuaguuagacuuggaugaacucuguuguccaggcuggguuugaacuucugugagucuuccugucucagccucccugaugcugugaugucaugugggauccaccaugccuggcuuauuagccuuuucacguuuuuuauuuuuaaauuacuucuuuaauuuuauuuuaugagguauuuuauuggugugaggaagucagauuuccuggaacuggagguacagaugguugugagcugucaugugggugcuggaaauugaaccugggucuucugaaagaguagccagugcucuuaacugcuuacucagcuuuccagccucagccuuuucacucaguaguaucuacuauuguucauuuaauuacuucaugcuuucuuuauuucaccaguggguugacuuuuucauaagucagauaugcaagauaauaauuuuuuucuguguuaugucacucauauuguugcuuugauguguacuauuguugcuuugguauauacuaaaaucauuuucauacaguuuuuuuuuaaauuuauuuaauguauaugaguacauggucucuaucuucaugcacaccagaagagggcgucagaucucauuacagaugguugugagccaccaugugguugcugggaauugaacucaggaccucuggaagagcagugcuuuuaacugcugagccaucucuccagcccccuucauacaguuuuaauauaccaaagaacuaacccaucagcaacugugugcuuuuaaugagauuaauuuaaucuauagaacaguaaaauccacauuucuauaauagaaucuucuaacccacgaacauuuuauaaucauuguaguuuuccucuauauuuuaugauuaggcaaauuuucacuauguacuucagacuauccuagaacucacuaugagaaccaggcugcucuugaucucaucaagacuaucucagccucccuacugcagggauuagagaugugugccaacuagccggcauuuuauuauuaauuuguuuuuaggaaaaguuguuguucuguagcuuagacugcuugagcuccucuuuguguccccugacuuuguaagaugaauguguagcucacugguuguuucucacugaauucuuucugucuuuccccaguauuuuccucggaugagcacuuaccuaguaggaugaauuuuccuagagcacagcuucugcugcaucuguguuucgucuuucauuccguguucugauauaucaugcuuucuuuauucaguuuccuugcuucauccuucccaacccaccuguaucaaagcuuuucucucccucucuccgucccuuccuccuucccauuuugguugugcugagaagugaaccccuggcuccacacauucuuaggcaaguauucgucuacugauugauagccccaucccuguucaacauauuuugaaaaaaacuuaauuagguuuucaagcauuuauaagauauucuagauuuuuaauuuuauuucuacuauuuuaaauuauuuauuuuuuaaauuacguguauguugaggguagggucuggacauauguguguggguaccuacccccuggacuuugggauugugagcaguugugaaccacuugacaugguguggaaugagcucaggucuuuugucagaaguucaugcucuuaucaccgagcugucuuuccgguccaguuuuccagauuuuaaaguaauugguuuuauguugcuuguuuuguuucaagauuuuugccuuuagucauuuauuuuauuaagacaucuucaguguguguggauuuguccagucuuugaaaaugcauuuuguucccuugaaggagaugccugcuuuugcugccuuuguuucauuaaugcuaaauaagaaugacaguugguugcaucuuaaaauuauugugcuauaguccuucaguuacuuagguuuugacaacauccacuuugacuauauuuaucuguuuucuuuuuuuuuuuuaaagauuuauuacuuuaucuauaugaguacacuguaacuguacagaugguugugagccacaugugguugcugggauuugaacucaggaccuuuggaggagcagucaauacucuuacccgcugagccaucuugccagccuguuuaucugguuuucauuuucagucuauuuuuacuuuaaauuuuuugagguuguaguuuagguucauacaaaucaaaauugucugccuggucaacucuaccauucuacgcaucuccuucuguuccuguuguucuuuuacuccuaagauugcuaucagccacguaaauacaaacuuuuuuccuuaggguugucaugcuguauuuuacccauaauuuuuuuuauagucaagcauaauacauuuguuugcuuguguucauaugcauguaaggucagaggacaacuugccggagugcguucucuccugcccugugccauguuggucuccagguauugaauuuguuuagcucaucaggcuuggaggcaacugucuuugcucacugagacauuuugccagcccuuuacuuuuaauuuuuucuuacucucauuuugaauguuuuuuuucauuuaagaacagaggaaaagauuuuuaaaaaagaaucaguuuuauagcuuuuguccuuuucuuuaguggaauacuaguccgagaaucuguuugaauccuuucuaucuauugcuuguuuccucugagcuugcuuuguuuauuuauugguauucuuuuggauuguauguuauaugaaguuuuuuucuauuaauuucauacauuuuuucuauauuagcaguuauccaagaaacuauaaccugucuccuugauuaaauaauguuuaauaaaacuaacuuucuucuuuccacucuguaauccauccauccuucccucccucccucccucccucccucccucccucccucccucccucccuuccuauuugcuuguuuguuugagacagucucucacguagcccagauuggccgcaaacuuacuguguaacugaggaugacugaacuggccuccugccuguucauuccaagugcugagauuauagauccgugccagcacacugagcaaauggguugcuuuuccauaagcuguuggguuccaguuacucucagcaggaaguuagcauuacccauccuguugucacuagagguacauguuuugguauguguuuaccguaguuguuuauaguuuuugcucuugggcccaucucaguuuuauacuguaguucccauuaugucuugcugugccuaauuuauaaauuuuuaaaguuuuaucauaaguuuguauauugucuagggguaagcauauauauagcuugguaugccgccuuggaacauaguuuuuggauaagagaagacuacauacacuaaauaaagauuaaacuacuuuguacauguccuuguauguagagugaguuaauuuaauucaaguuucuuacuucuaggacacucucuguaguaauaacaagcuucaggaauauaagaacacacugucugguggugaagauucuguacuuagaauaagcaccauugcuuccgccuucgcagacgugucagugagcacugauccugcccagcuuguuaccaugaugaaagcacucagaaauaagggaagaagcaagccuuuucaggaugaugggacacaagaggacuguccaaacaucucucaugucuuacuuaaugauuuagaaaaaaguaauagauccaaugcauuugauauggagaaauaccuuacaaaaacagaauuuaguagcugugaaggugcacgagagccccuuucaagagcaggcacaucugacaugugggauuuauguucgcccgaacggcagacuguucaagacaggaguauggugaacguuugugcuacuaauu

SEQ ID NO: 8968 - RNA, 2586 nt, Mus musculus
acaccugugcucuuccucagcacugucuguaagugcacacuucuuuacuguaacaaauacaccugguuagguaagacguuaggaucagaagugugggggugcacagaaaacaaggguuuccugcauuaucucugcaagucugcuauaaaccucggaauuucugaagggagauuuuuuuucuuuuucuucuucaugagacuuauuagugaugaaagagggagggguguauguuucaaaaaacacaaaaaaaaggcguauauauggaaaagauucguggggagagugggaaguuggcagggcgagagaaucguuagcaugccuuuuauacaguaugaaaaugucaaagaacaaucuuauuuuuuuuuaaaguuccuauagggauuucuuuuuuucaauuuuacagccauccugaaaguauagcccuauauaccagcugcuagcugagauccuugaaucccuuccucgcuccaacugucccucccuucaaaauauaaacuuauggguucucucgcuuugcuuacuacuaguccacaugucuguccaauuccauuuuuuuucagaacacaagggaaccucccaagaggucccuaccaaacugcgauacccaccaguuggcacauaauccacuugaggacccaaagaaccugugagccugugaaagaccucacaccucucuucaaaaggaagagcaaaguuguguuuugaugaugggucaagacauuuuaagguagacaccuugagaaugagcaaaguucauggcaagacgcaggauauagucagaaugacacaaagcccagauccuaaaugacuuuaggauuucaacuucagagagggugugugcuggcaagugucaugucaaccuggcacagacuacagucaucggagaggagggagccucaauugggaagaugcccccauacgacugggcuguggguuagccuguggggcauuuucuuaauuagugauugauguggaagagcccaucccauuguggauggggccaccccuggucuugguucccuaaggaaaaaaaaagacuaagcaagccaugaggagugagccaguaagcagcaccccuccauagccacugcaccaguuccugcccccagguuccugcccuguuugaguuccuguccuggcuuccuucaguguuggaccacagauguggaagcauaagccaaauaaaccauuuucuccccaaauugccuuagucauggugcuucaucacagccauaggaacccuaacuaggacaggggaaaauauuaguuagcuagauagugauccguuagccuugggagccuuggaggauagagcccucucuccuggccaguuuuggauauauauauauagcuguacauuuccuuuguaauaccaaaaggaaagcaucacuacugcccccuccuugggguuuaaaacaccaugggagaagaagacaauacgagagcuuaguugaggcuccuuacugggaggcugcuuccuccgggucaaaacaacaggcccucagcuccaccgcuggcccuguaaggcuguuaucugcuccaaagauuagaacauuggcuacuaucacccccucccuuaagaguuagcccagcuggaccuguccaucacaaagccgauucaccugaagacauucuaaagcgacugggaguagagaauaauuauccccauagugagauaaugcagcguccagaagucccucccccucugcagcugcuugcggaacuucugccauguuuaagucuggcugcuucucugaauucuaacucagaaagcauaauuuuuuuuuuuuuuugccuuuuuaucuuuucagacaccugaugucccacuucgagucucuguugcuguaacaaacacugaggaaaaccagcugcgggaggaggcagggguuuauuuauuuggcuuacaaguuaccgucuaucccuaagggaacccuacagcugaaacugagaccacaaggagcacuguugcaccaggcuggcuuccaggcucaccgccaacucucuuauacagcccaggccaccugcuuagagacgguacagcccucgguaggcugggucuuccuacauaauuagaaaucaagaaaaugcgcccccacaggcguggucacaggccaaucugaugauggcaguuccugauuucagugccuucuucccaggugugccaagcugacacccaagauuagccaucacaccugccaaaggcuuaagcgcgcuuucccgauaggcuaggcuuucucauucucugaagucuucuaaccccugucccgcuccacugugcagcugcuugcagaccuccgaugcugaacgugacugcuuccuugguccccaacucaaaaaaggcaugccuuucucucuucuucuccccuaggcuagcagcucgaugguaccucaaacucuggggcccaccccuucuauucaggaguccuuucucuucccuucucucaagccccaauuuauaaucuuauaauaaaauuccuuccuaaacacaccuuccugcucucuaaauuccauucucuugaguucaugggaccaaagaccuagaagucacuuuguccugguguuguuuuugguggcuguugauuuauc

SEQ ID NO: 8969 - RNA, 2483 nt, Mus musculus
aaagcagagucuagucugcuugucuagacuugauccucucucuguucacccugccuaaucuucugcaacccacgggcugagaaccacuggccuagagcuuuaacugagcccuggaacuuguccccuuggacaaccucaaggagcauagcaugaagacuggcucaccggggcaucccgggaguuuggacuuuuuauucacauaucugugaaaagagacacaagaaguuugcagguuuaaagacacacaucuacuuucuccuucacauuugagaaaccaguuucguguuuuccucuuucugguuggucuugagacagaaaacagccguaccauuccauagaucccaucuguuugauacaaaaaccucagcaucagagaagagacuuaucugauauuucagaucugugucuuuaucauuaaaaauaauuuuuuaagaagugucauuuguagaucuggaucacaaagacuaauuuuuccccaucugacacauuuuggauaggcugugaagagguaaaaaauggucccaauguggugguauuuggaggggcagggaaguaguuuggccaagagaauggggucauugugaacaugcaaucaguuaucuuauaaaagaggccagagagcuagcaagcucuccuccccuauauaagauguacacgaaguuauccaccaguccagaagcaggugacacuaagaaccugcccacgguaucgggucucacaguacugugagcucaaacauccaauaaucaggacugugguaaaggaaugucaaaugucuauaacccauggugguguuuuacagcauccaaaccaagacagacuuuuaaaguuucagcucuaacauuuacauuguucagaaacacauuuuaauuuuuagauguguuguaagauuaggguuccuuacuaccauuuugcauguggcgauccagccucuaacuuccguuuugaaaagccuguuuuguuuuguuuuuuuuucuaauugagggcuuugggccucccuguuggcagucucuggaccaucuuugaaaagguuuguuucaaagcugucuaaucgauuucacugaagcacauaucaucauccuuuaucccgauauuacacuguuuuaauuacucucggcuucauauugauuuuugaggucaagaauuaugagaccagcuccugaauuuguuguucuccuuuaaagccauuuuggcuauugaugguucccagggauaucauagaaguuaucagauggauuuuuuuuuaauuucugcaaaaaaaaaucacuggauuguagauaucuauggauacuacagacuuucaaaacuuaaaaugucaguauuuuauucaucuauaugggaugccuuuccauuucuugucuuguuuacauuuuuggcagcaaucaaaaucaccguggauuguuggaguaauagacaaucuuauuaaagaauacaucuuuagucucuucugugaauuuuacuuugaacuauuaguaagucuacugcaaaugcuuucuaaaauuccuugugaaaucaggcgacccauuguuaaagaaaugcagcugauuuaugagggucaauucuguauccugcuacucugcuggauuucacuuauuaguuauggcgucuuucucuuuguuucagaagacuccucaagguuuuuuauguauaagaucauggcaucugauaacagggcaccuuucuccacccuuucccacugggaugcgguccuggcuauuuuuacaucaacuugacacaagcuagagucaucugaaagguggcaaccuccauugagaaaaugccuccguaagaucaggcuguaggcaagccuauaaggcauuucauaauuagugauugauaugggagggcccagcccauggugagugccaugagaaaaccaugagcaagcuaugaggaacacgccuauaagcagcuuccuccacagccucugcaucagcuccugccuccgggcuccugcccugacuucuucagugaugaccuguggauauauaaguguaaacaaaauaaaaucuuuccucuccaagucacuuucaguuauggguauuucaucagggcaagagcaacucuaagacaaaugucuuuuguuucuccuggccaacuauucuagcuagaacuucaaacaaauguuauguuaaauagauaaggcaaaagcagccaucucugucuuguuccugaucuuggaagaacguuuuaguauuuuacugcugauugaugauguuuuugucugugagcuucucauagaucaaugagaaguuaaggcgaugaaguuuccuuuuucuuuuuccacuucaucaagugauguuuauguaaggauguugaaucuuaucaagcaauuccucuguauugaccuagaugaucauggguguucuuuccugccucuucauucuguuaaugggguguguaauguugacugguuuuaaauucuaagccagccuuacauuccagaaauaaaucacaucuggccaugggguguaauucuuuug

SEQ ID NO: 8970 - RNA, 2250 nt, Mus musculus
uggaagaacauuuaaccucagagaccccuguuccuuugcucaguuuuggguuccagagcugucagguccugaaaaagcaagaggcuugcucugccucgucuuacauuuuauggguaaagccauugagguuugggugagggcaccugugacauggcuucuagaggaccacacuaaacaaaccaacaaacaacaaaaugauuuuggauguuguaguuaggguuucacugcugugaagagacacagugaccacagcaacucuuauaaaaggacaacauuuaaugggggcuggcuuacagguucagagguucauuccauuuucauuacugugggaagcauggcagcguccaagcaggcauggugcuggaggagcugagaguucuacaucuuguucuggaggcagcuaggagcagacugucucccaggcagcuaugaaaaaggccucaaagcccaaagugacacacuuucuccaacaaggccacacccacuccaaaaaggccauaccuccuaauagugccacucccugggucaaguauauucaaaccaccacacuggacacuauucuuuuauguuuuacauaggaaaugaugugaggggugugugugaaaacuggugugaacacagagcaagcuugaacuucccucggccugccccauugucagucacaguuguacugagaaucuccucagaccuuuuccuuucuccuuccagaucaugugugccccacggggcagggauagguuuacuaccccaucuuucauccagagggauccauucagucguuuccagcccaccuaccccuaugugcagcacgagauugacuugccucccaccaucucccugucagacggggaggagccgccuccuuaccaaggacccugcacgcuacagcuccgggacccagagcagcagauggaacucaaccgagaguccgugagggccccgcccaaucgaaccguuuuugacagugacuugauagacauuucuauguacaacgggggaccaugcccaccaagcagccacucgggcaucagcgcagcuaccuguagcaguaacggaagaauggaggggccacccccgaccuacagcgaggugaugggccacuacccaggcaccucguucuuccaucaccagcacagcaacacacacaggggcagcagaccacaguuucagccgaacaacucagagggcacaauaguacccaucaagggcaaagacaggaagccgggggaccuggucugauucccucuagagugcacuuuucaaggagagagaaaccgcggcagggagagagaggcccgcuggccccacugccacaguguuguccagcuuuacugguacagccaaguaaaaccaaaugugcaaacacggucuucguuucugcuuccuuucacgggaauugcaugcaaacaagauggaaacacgauucaaacuuccauccaguuugaccacagacaguguucaccuuggggcaggggguggauggagacaagggcuagagaugguaugaucuuggcuaaguggugugcagagaaaacuaaaaaaggcugcuuugaagacaucaugaaaguaagacccacagagguauuuuugacauauuugauuccaaaaggagacugcggauaaaugaggccacaguggccuguuuuauaauuaacugaauaaagagggaagaauuauuauauauuaucauggggaagaaucagccaguuugcuuuuucuccaaaggugugaaacuuauuuuguuuuaaaaauaugagucaaaacuccuguuuggugugccaagguuuuaaaguuggagaaguuagacgagugagaggaagugauuuguguugugaugguauguuuuaagaguugcacuaucucaauguuuaacauauggaugagggaaccgugucgugugaaguucuauauguugucuugucaccuauggauggcuaccaugcccaaggaaacacucuugaguguccacagagucauacaagaaagguauuuggcaauguacccugguguuuaccaaguuaauguacauuuuuaaaagugguuauguugcaagaauuugcagccagaagccguguacuacugagguauuuggagagguuggugaaaagagaugcuuacacuguguacggagugucacgcacagcuagucuuuuucccagcagggucagcaguucagacuuuuuuuccacaguagcaugaaauauauucagauacauacccuauuuuaugcaauaaaucgucuaaaaugca

SEQ ID NO: 8971 - RNA, 2156 nt, Mus musculus
uggucuugucuauuugguguucugugugcauccuauaacuugauaagacaccuccuucuuuagguuggggaaauuuuuguccgugguuuucuugaaaauauuuucugugccuuugacuuguguuccuaucauuugaggaucuggucuucauaggguccuggauuuccuuugugcuuuauuccuguauuguggguuuuguggguguuguuguuauuuuucuuuuguuuuuuguuuugcuuuguuuuguuuugaguuaacauuuugcuugacugagacaucuauuucuucugccuggucuucaacacuuacaguucucuuuucauaucuuguacucugcuagcaaagcuuaucucugagaauuuucuuugacuuucucaauuuuucacuucaguuuucucucaguuuggguuuucuuuauucauucuuuuucuuuguuaaauucuuuuaugucaugaauaguuuucauuauuuuguuccacuguuucucuuuucacagauuuuacuaugcuguucauucauuuucucuuuaauguccaugacauauucauaauugccauuuugaaauccuugucuuaugcuucagcuauauugccuuuuucacggccuaguuaguaggguuaaugguuucuaguggaagcguauuguuuuggcuguuaauacuucuguuuguugugcuguuuucuaggcaucuggaguuuugauaacuaaagugauucuagguguugauaugugaucuuaucuugagguaggaggagggguuauuacagagcugcaagcugguuauuacagagcugagggagagaauggagaucauaauggaggacaggaaggauaaugugaauugcuggccuuaguuccaauuugguaugacuacugggggugccagguagcuaguaugucuccguaccugaggcuucugacauaauggaauaggaaugggcuagaaggggaggucuacuggaaggagaaagcuggguccaugccaagguuaggugcaauucucaaggaauacauguuuuuaauugauaaaaaugauagacuuuauauguuaauuuuuguaucauacagcuuauugaauuugccaauucugcaaaucuuuugguagacucuuagcucuucuuacagaucauaucauuugcaaacaaagauaauuuuacuucucuucauauacauaugccuuuuaucucuuuuccuuucauaauugcuuuggcuaaagugcuguacugaaaaagaauaaauauccuuguguucagauauuagaagaaacacuuccugguuuuccucauuuuaguauggcauuggcuuuagguuuguuauauguagaauuuguguugaauacugacucuuccauaccugaucuauuugagauauuuauugaauacaugcuuuuucuauauaaagaugucuauaagauaaucaaaauuuucacuaauuuuguuguuaggucuuuuuaauuuucauauauugagccauuaguacaccccaguaguaaaucuuacuuauuaugcuguauaaacuuuugacuguguaguuagaauugauuugccaguuuuuuguuagggauuuuaauguucuuuguuuaccaguuauacuacuuguauccuugucugguuuuagugucagaguaaugcuaaccuuguacaaugaaaucuaacuuuaauuggaguauaguguccaagucaccuugaaauagaagauaucuaguugcuauccucugaagaauuauauggggggggggguguguauaaaagaagaaagggggucacauauuuggucacugaguauugauuaugaaaguaaggagaagggguaacagugguuuuaugauguuacccccugcccuuuacacuaggauuuugcaugggucaaugaagagaauguccaugguuugagcaacucaggauaagaagaugaagaagggaagcuacaauguauaguaauauacuuuaaucauaauaauuacuaugacaacaauauuaguagcuacauuuuaaggaagagggaaaaacuaacaaaggccuagagcuuauuucucauggcaaguucggguugucaucaagaugcuaccugccaaaagugaguugacucaaaaaaaaaaaaauccauuaccccaaaggaguaaguguuuauuauggguccagauaagcgugaugaug

SEQ ID NO: 8972 - RNA, 24521 nt, Mus musculus
uaagucccgggcgcacuccccggaagugacguaacaaggcacgcguggcuccggccggcguuuccgcaaacagaaucguggaugacugugugggugaguguggcguucggcguucuggccuuuccuugccucuuugucuuaaaucuuguguauuuaagagcagagauagccugaacgccgggacuccuggcugggaucguuacucguuagccuccugccuccgguccuugcuuggugggauuuauugugcccauagccggaagcaguguggauacugcuugucuugagacggugggugcuguugcuccuccagaccacaguagcccagggaggacaagauccugugcuucuuucugcuagggccgaagggcugugaugagggaugggccggagacauguugggagccagagaggguuuguucugucuggggcacugccguaggacccugacccaaagguugggcaaaaggcugggcccgggaugggaaccgaugaacuuagucggagagaugcuuuccccuuuccguuucauuggcuugcaccccgcuguagacagucaaggugguccgugagaucaugccugaccaugagcuagcagccacaaacagagaugagcaggaaaaaugauuuacuugagucgcuacugaacuuauggagcgguccuggccugugcuuaccccaucaagcacacuuccgccaccccagucagccaguaaaaagagacgaauucauaaugaaaagcaggaaaaggagauuucacucuaugugaaauugggagguggugcagacauagccauccaguaacccuuccaucuuugugggucuugaaaugagggugagguuuaacuagaaggcaagaagaaugcaaccuggccaaagugugguccugccuucaauuacccgucuuugccugggcuuccguuguuucuuguaagguggucucacuacgccuuuuggcuugcuccuuucccgucucucagcauaaaguuccuaggggaauauucauuuuuuccucuccccccacuuccuucucuccuucccucccucucccucuccccucccacucuacuucccuuauuuugguguucauuguuucaacaauuuaacagcucaagagauuuggguaucccuuuagaauaucuugauuacugugagucaaguuacagugugauugcagguacaaacaacgaacucccugucacucuacuuauuaccauaaauuuccuucugcauuguuccaucaacucaucucucuuuaaguauuuucaauaccauugcugauaguuuuauuauuguagguguugaugcgaagcuagggaucaaacucagagcuagagugugcccuugugaacaagaauuccuggaaggaagcugggaccccagagcuauugauugauuuuuagaaucuugguggucuuuggaacuugagugauuuggauaagguggaguguugcaaguccagauucugauuaucuugguccaucuuuaguccccuugucauuuauuuugcucuuuacgugaccugacauuugugugaccauuagguaaauccuuuagaauguacaaacagaucccugguucugaccaacuaauaaaagguaaaggauucugucagauagcaucugguuccuguagcugagauuugcuugccuuucugugacccaccuaccugaugcuuccaccaauguauuugagaagugucuggauuuaugacuucuuucuucugcaacuauauaacuuacuggaaugguuacuguguuagaacauggaauuuuaguaaccugaaucugagucccuuagucauugucacgaaauuuggcucgagaauaaacuaucuccuauuccccuugaggugagagccauugcaucccuguguaucagguaaagggcuccaucauggagccaugugacauuggauucuagacauucuuaaucauuuuaugguauugaaugcauuuuaugacagccaaucugugaaaguauagaccaugaauaaaauucaccuuaaacaccaguacuuauuuuaggcaauaguuacagcuaaggauacuauuucacauguuuuuuugaugauaaaacuaaguuucuuccaggcauuaaauggcagaggggauguaagaguuuuccuaacucuuuggucaguuuuccuugauacugauuuauaguaguuacucuguaaauucuuuuccuaauugauuuuguuuucuuuguucuuuuacucaguuguuccugugugacacauuuugggguuuuuguuguuguuguucuuguuuguuuugguuaguuuguuuguguuuuugcuuugauuauugguuagugaaagcuaauguccccugcaauccuuaucaguucccagugacuuguuuuuaacuuguucauacaaauaauuucaucuuuucuuuaugcaaaaugucuuuacaaguaauuuaaacuuuugucuuaguuacuuuucuuucuauugcugugauaagacaccaugaccaaggggacuuuuagaagauuuuuaucuggggauuauaguuucaguggguuagagucugugagcaucaaugucagggaacgugguugguaggccggccggccggcagggaacgugguugguaggcaggccagcuggcagggaacgugguugguaggcaggccggccggccggccggccggccuguggcaugcaugguucuagagcgguagcugagaguaugucuugauuuacaagcacaaggcagugagcuagcugugaauaaacuggccuuuagaaaacuucaaaaccuacccacgcgacacaccuccacccaggccacaccucuaauccugcccagacucuagcaccaauugagagcaaguauucaaauauauuagccaauggggcuuguucucguucaaaccaccacaugucuuuauuacuuuugggacucaggguuucuuauuguuuugacuuugauuuccauuuaccauauauuucaguaacacagcuugauauuuuaguagaaauauuuguuauaaauuuaauggagauaguucacaugcauuuuuuuuguaguagguuggcaaauuaauugaaugacugaauacauaggccauuacaauuccuuccuacagauuacuucuuuuuccucccaauuuacacaugugccccagaauauauuugaaagcgauuuuaaaggugagucuucaagcuguucuaaagcuauuuccacucuucgcuuucuguguaguuacaggguucauuaugaaauaaggauuucgggcuggagagauggcucagugguuaagagcacugacugcucuucggaagguccugaguucaaaucccagcaaccacaugguggcucacaaccauccgucaugagaucugaugcccucuucuggugugaggacagcuacaguguacuuagauauaauaauaaauaaaucuuuaaaaaaaaaaagaaauaaggauuucaacgucuugacguccuguauuauuuguagucaaaauaucuaagggggcagcuuacuagaaaagcguggugcauaauuuaggagaguucaggcugugcuacuugguuugggggguugggcccugggaucaggcugaauauuauucuggaggagacaguuuaccucaugguagucaaggaauuacuggcaaccacguauacuugacauacuuacccccaaacagccuuuaccuccucaagucucugggagcucccaacauagugcuucuagcugaaaaccaagcaagcgcucaccacggacuggugccggguuuccccacacaguaacgcuuugcuccagccccaaagaucugugaccauuugauaaucgaauucacagagcccgcuuucaguccucagaguuagcaguuuagugcuugcuguucacaagucuaauguuaacauuuccugacacucaaggcaggcccuuugcuaugagacccuguaaggcaaaaagaaaauuacaugguaauucggaagauuagaguggcaacaggagugcagucagugaggccagguuuaagaggucucgggugggaacaagaaugcuuuggggaauuggacugcaggcaguucauguuauacucuacuaaagauuuaucucugcggugaaacuuuguuauaggcugaguugaaagcugacacacuaguuaaucuaguagaagaaaugaccacauucaagcuuuugguuuuuuguuguuuuugcuuuugagauggauucuuacuggguagccuuagcuggcauagagcacugucaaccugguuccaacucacagagaucccuugaucuuggccagccaagugcugggauuaaaggcaccugcgaccacgcucagacuguaauaugguuaucaguagccacaccuuaccugcuuuacggugagaaucaagagcagaaacauuaagugugauaguauugcugugucacaacaugcuagccuacacacucacauugcuucagaaucguguuccgaaggugucugcacaacguugccgggcagucaccguaugguaacccaccucccugcuacuagucuuaguuuugcaucacuuuggccagaugccagagaaagcaauugaaaagaugaaggauugcucuggcuucagacugugauuguuuggcuccuugcacuuggcagaauaccaugacaacaguagcgugcgacuaaggaacuuuguuuccuagggauggacaggaggcagaggggaaguuaccaaggauggccauaaccuucaaugguaucucuucugugacacuaguccccauguucucagauuuccagaaucucccaaaauagcaccaacaggugggaaccaugcauuugacacccaagccugugaggaaauaauuucauauucaaauaauuuccaaaccaaagcaaugccuuaaugguucuauuaauucaauaauuuagucccaauuauuuaauaaguauauucuaacaaauuuauguuuauaaaaauuaauacacauagcuuagaaggaauaguaccuguguuuaauucuugauugagcaaaacugcuugguaauggcguguauauuugauggcuacuccaagaauuuuagaucuuagaugccaaaccuguauuuguguauuuugacuucauuugucuuuuuaaauguacauacugucuauauaaauaaaauuguagauguuuggaggcauccuaauuaauacuacugcauauuuauagcuucauauguaaugcauauauaaucauuguuuuaguccugguguguacagccuuuugacauuaugaagcaauauuauuacaaagcucauacucgagaacuguacuguucaguuuaugauauuuguguuggguuccauuccugucuauagugaauggccguaaguguugugggguaaagacuagaugugucugcaggacugagauuauuuuuagagucuuagcauuaguauguguaaauguguaaaugauacuuuauuuuuugacuauuccagugucgauugaugagguuuugcugucaguucaaguaacgagaaauggaagguuccgcgaaagcgucagucgcuucugacccagaguccccuccaggugguaaugagcccgcugcugccucugggcagaggcuuccagaaaauacuccuccaugccagcaaguagaucagccaaaaaugcagaaggaguuuggggaggaucuuguagagcaaaauucgaguuaugugcaagauucuccauccaagaaaaggaaacuugauguugaaaucaucuuagaggaaaagcacucugaggaugauggagguucggcaaagagaagcaaacuggaaagaggugaugugucggaagaugagccuucccuugguaggcuuaaccagaccaagagaaaacugcagccucaggacgaugagguaccgcagaagguacacugcaguauuuucuucuuaauucacugugcauaacuaggaguauggagcagcugcagagaaauuacagauauauuuaaacaguuuaggaauguuuugcuuuuaaauaaguauaaucuuaaaguacaauaggcucaacauuuuauuaaggugaaccuugugcugggauaauuuucauauucuuuugaaacucuuguuugaucagaaccuugaaagcuaguuucuauaguuugcuuuuuaguaaauugguuuuuuuuuuuaagauuuauuuauuuuacaugaguauacuguagcugucuuuagacacacaucccuuuacagaugguugugagccaccaugugguugcugggaauugaacucaggaccucugaaggagcagucagugcucucaccugccgagccaucucuccaaccccuacucauuuguuuuuaaagauaguacguggcccaguugguguacuauuuguccuuuuuuauugggugucucagguagacagaugaucacuuaaaguaauaaccgccaagcugugcucagcuuuauucuccucuacgaaugugcuaaagcauaaacuuuuccagcuuccagucugguuuauguagucauuuaucauaauuuugguuaaguugaugcaaaaggcugaugggcagcaagguauaauacacauuugcaaugcuggaacggauacugaggcugaaucugggauuggaaagaaagaauacuuggcaaguuaguaacacuuuguuaccaggucugaaagagaaaguagcaggccaggcucucaccaauaguguccuuguaaaaagguaaucuuaguugguaaacuuggaaguccugucuuaaaguugauauauaaaauaaagaauuaauuagaugcuuugaaaaagauggcagagggugaaggcauuuaccuaccuacuguggaauuuuuauagaaugcuuaggauuuuacuaaaugcagauugaaaaucauuucguuagaguaguguauguacugccgaagcgggcauguuucaauagauuaauaauguuuaauaaaacucacugauacugaguguagccuacuaaaugcuaacuccccuaugucugcauuaugcaucauaacaguaauuccccacugauccuaaaauguagcggcuuauuucuuucacucccuuuagaagcucauccauugacugucuauugaguugaauaaaucgaaacugugaagcaguuucuuaaaacauuuagucguaaaugauacgggugagggucgcagucuggaccuuaaacuggggagcuggggauucguuuuauaaagaaucagggcaguccuucauuauugcgguggguccagccguugcgccugaguugugcgugcuuggucuguaacggaagucaggcgagcugaggcuuuuccuucccuuccagauugugcucuaaccccuaauucuguuccuugcaguugcagaagcuggaggaaggacacagcucagccguggcugcccacuauaaugagcuucaggaaguuggccuggcgaagcguagucaaagucgcauuuuuuaccuaagaaacuucaauaauuggauuaaaaguauucugauugguacgaccgguuuuugcccuuuaguugggagauaaauuuuuauugggguacaucgcuuuucaccgcaccuaagggugcacacauugaaagugcugggcagcuacacuguagccacagcccauguccugcuuuggguccucucucccaguuuuaaucauaugucaggcuuugaacaccaucauugacucuucccuuuguugucacacuucgguuuuaaaacgcuagaaagccagaaguauucccuugggagaaauuguuuuacuauuuguuuuuaguucauuguauggggcauuuauaauguuuaguugcuauugacuuaacagccuuucacguggcagugaaaugccuuuauacuuuuaguaacaacucaaggcuauuacauaauaguuuuagcgaugugcauguuggauugagcauugaguuuuuauuaugucaagaaaaggacagcguuaggacucuaccugugugcuuucccggaguugguguuggucacagagcuugucugucugucugucugucuucuaugauuucuugaggaaaauguuuaccuuugaggacugauaaggacagacaguuuuggaacuaauguuuucucuaugaaaacucaccuuuaaaauuaaaauggaaaugaguagagaaaauaggauuuagaauguaauuauugcuuucucugcuagugaaaucagacuugucuguaaguuuagagaaauuuuaaggguauaucuuaagguuuuuuuauaguggaggguuuuuguuguuuauuccuuuuugucugauuguaauucauaugaauaaaguuuaauaggaauucugcaagugcuucugcaugucacacaucauuuuguuguuuuggugaauaaguauuaagacucaugacagaaacuuaaauaugggacaccuaugcuucgaugaaagcuacuuucauaucuauauugaaaggcagaaauauugguagcgaauauuuagccacccaaauaguauccauacaaauuauaaaguauuaaacaguaacaaaauaggggacagauucacuaguguaucaaguacggcugaauaccucauuuaugucaaacuauuauuaauaagcccguuaaacuguuuggcuucugccugucugaggggaggcuugaggcaguuuuugacuaggucuuaaggcugauugaaaagaacaagaagcaucuacuguuguuguuccauaaagugugucacagggacacacuggagcuaugggaagcgagaguuuuucucuuaucacacauguuacagcuuuuuuuuuuuuuaaauuaggaguuaauaucaccuacuuauccuucaagaaaucauucuaaccuuguaaaaggacaugugaacucuuuacuaauaagggaucaaguuacuuccucuuuguuagauuuuggagagcaccaacuuauauuaaguacacauuagugugguauaguccauaggaguugucagacagaaguuaguagguuuuaaagaagcugcugugguaaaaauagagaaaauguguuaugauugauuucucucuucuaggggaaauuuuagaaaagguacgacaaagaaaaacccgugacaucacuguuuuggaccugggauguggaaaagguggagauuugcucaaguggaggaaggggagaauuagcaggcuagugugugcugguaagacagauacugacaauguaaagagcuguuuuuacaugggggccaguguaauguaauggcucgguggguacaagcacgugccaugcaggucugagcaccugaguucaauccccagagcccacaugaaggaggaggagcaagggcuugcuugugcacagucucucccuguucacacacacaagcacggaugcagugagaggaaugguagguaagcaaauaacacaucuuaaagauaagaauuacuguggucagccaggugaaugggaaguuaaaggggccgcuuugcuaauaugaugcuaagaugucugaaggcaccuucucuccuuagaccaugcaugugauaggugaaaaaugaguuaaggcuuuucuggugguuuuguaauacaguuaauguuaacuugaccuucccuaaagaaagggcguauuguuacuauuacguuauuguuccuauuggguaucaccuucuuucuguuugauggaucgcaggauguaaaacagcauugccuccaaaaguacccaagucaguaguuuucuuaauuuuucuuguuugaugagccauauauacuaaaacaauuacugagaauucauaaauuuauguguguggcuaaagcuguugauucuugagcguguuagaaauugaggcugagauuuuuuuuguuguuuugguuuuuuuuuuguucuguuuuuuuuuuguuuuuguuuuuuuuguuuuuugagacaggguuucucgaaaccuggcuguccuggaacucacuuuguacaccaggcuggcgucgaacucagaaauccgccguaggcugagauuuuuaauuuauacaaauaaaguuuaaugggaauucuggcaaguagacuuugagaaaugucucuacauuuaccaggccauuuuguuauuuuggugaauaaguggcuguaaaugaaaggugguguuagccuuucucagauaauuguagcuucaucuuuggggagaagucaggcagccaguaauucuguaaggggaauuaggugugggaucuguaaggggauuagaugugggaccuccuggcaagcacugcauagucccuuacuuucagacccauugggcugucuuauauuuucagaaugguuucagaauacccggaaaguacuguuugcugaaguuaucuugugacucacaccaagaaaucacauuuucguaauauuaucaccaaucacaaaggugguugauagaaauuuuuuuuuccucagaauugugauuuuuuuuuuuugaaagucaaauuuuaucucuggcaauaagcacuauccauugugucccuugaaaugacccugugcaucuucaauaauacaugugugguagaguucaagagccauucuuugaagcucaaguaacucuuuuuaaacacacugcaaugucagcucacaacccgagaugugcugggugcugcuagugacaggaaaagacagcucauccccauggugaugcucagagaugggaaucagagccaaggucgagcuucuccuguuuuagggaggacguucuaagugaacacuggcuuuccccgcugguguaugguagugaagaacucaggacacuccacaguaccauuuggugccacugcucugcauguaugacuuuaccugucauugcuuuccugucccaagugcaaaugucacagcaaggagaacaggugcauuucaguaugaaaacaaugacuugauauuucacaaaaugagcugauagauguuguuagcuuuuacaguucaaguuggaaucugaguuuucugccucauacuugaaugaauauuuaaaaccuggcucgguucguaaaagcucuugcugugugagccugauaaauucucagaacccgugauggagggaaagacccaauuccugaaagcuguccuuugacuuccacacacauagugaugauaaaacugaucaucuuagccuuggcuugcauaaguacuaccaaggaagcucuacggggacggggaaacugcuuauucuauauggaauguaguugaacauuuacaugagcaaaggaaaaggaaacaaggucuucauuuaaaggaagggaaagaccccugcauccuuucccuuaucuuaugccugggucucaggccacgguguugcagcugaguugcuaguccguguugacauuuccuccuuuuacccugccagauaucgcugauauuucuaugaaacaaugucaacagcguuacgaagacaugagaugucgucgcgauaaugagcauauuuuuagugcagaauuuauaacugcugacuguucaaagguacagauuuuuaguuuuaauuuuuauguuuauguuuauguauaucaguguuugccugcauuuguguuagugugcaccacaugcaugccugguagcgauggaggccggaugaggguaucggaauuggaacuggaacuaaggacaguuuuaagcugccaaguggguucuaggaauccaaccuguguccucuacaacgagcagcaagccaucccuccagccucaugcuuucuuuuuacagugccaggaucaagugcaggcucucacaccugcugcagcucccauuuuuaagacugauccauuuguuaaauugugauuugaaacaaacauuaaaaauccuagggcaugcauuuucaauuuauuacaaauucuguuauaauaaauccuuggauacuuuuagacaaguuuuacuuuuaauaaauggguaucuugaagucucuuuugcuuuuugauuugggcaagauuuguuuucauccucguuuucaaggcugcaagcaauauaugacuaacuagacagguacuauuuaaagauucauaaaucccuugguaucccuaaagucccagagucuacagaaguucaaagucccuuauauaaaauggcauauauuuguggguaacuauacacauaguuauauguacuuuaaaagccuguuuagaugauuuuaguaugguacugaauauagugaagaugcuguguaacuagucgucacacuguuuaggaaauaagugucaaaauugucuacauauucauuuaaacaauacauuuuccucuuaucuugaauccaucauugguugacuucccugucccagagccugaggauaugaauggcugcuuuauuucacaauagaccuggacuuaaaugcauguuuguucaccuuguaguuuauaaggacggcuuccugucagaucagaaccacugugugcuuuucaccuuccauuguuccucugagauucucaacugcaguaaucuucuuuaaguauuuaagagcuuuuaaauaguaccugucuagucagucauauauugcuugcagccuugaaaacgggggugagaaaugugugugcugcuuaacaggugaaaacuuaaguacugguucuuuuggaugccaaggguugaaugacccaagugacuguugaaugucaguuuauuuuagcucucaagaccaacugaaauguuaggcaacauuuuuauuuauuuauuuaacgugcguauaguguguuugggggugguacauccgugacacagcuuccauggcaagucaggggucuccagcuucguuuucaccuuccacuuuguuugaagggaaaaccuuucuuguuuguuccuguccuuuagaccucagguuugugaguuuugagaggauuccccuguguccaccucgucucaccauaagaauggucaggcuccugacacauccugcugugcccugaguuacaugucucccaaggccacaaacucaggcuugcaggcuugcaggaccuaacacuuuaccuacugagucaucucucuggccugacauauuuuagcaugauuucagaauuccccacuuuuuaaaggucaccaugaaaaucaaaaucuugauuauuuuauguuugugcugaguagauggguggguauuggugaauauuggguauuguuccucuucccugggacaggguuucuugaggcuggccagggagcucugcacacugcgucugccucucacuuucacuugcgcuaucuacccagaccuguagauguuuaggucaggguaagaaagaaugcuuuuaugaagugguccuugcuauaauauauacaugacaaagaauaaaucaaagauuggcgagaacuauugauuaccugucagggaacagcuacuuuaagagcccuaaauucuaguaacuuacuaaaaacuuuuaaucuauguuguaauuaguuuaaaauacuaacccauuuacauuuguuacaggaacuuuugguugaaaaauuccgugacccagaaauguacuuugaugucugcagcugccaguuugcuugccauuacuccuuugagucccaggugcaggcggauacgaugcuuagaaaugccugcgggaggcuuaacccuggcggcuauuuuauuggcaccacucccaauagcuuugaacugauguaaguaacuugaauccaguugacauuggucagguaccuuuuaaaauuguaucaugugcuuuuucgcaugcaugauaugauugacaggaugaaaaauauuaaccauaauucuuuuauuuuggugguggaauaacccaauagaagacgccuugaagcuucagaaacagaaucauuuggaaaugaaauauacacugugaaauuccagaagaaaggaaauuauccuuuauuuggcugcaaauaugacuuuaacuuggaagguguuguggaugucccugaauucuuggucuauuuuccauugcuaacugaguaagaaugucuugaccugcuacuuuuucuuuccccucaucccuguccuaagggggcaaaauucauauugcuguucauauuguauuuuaaaugcaaccugaagaaaaagccuuagcugcagaauugguguucucuuuaaauaacuuuccuaagggaagggagccaacggcuuugaucacgguaggggauaacuacccuacggguaguagcaaacacagcuuuaguaagguaaagaugaguauaugaauccaagauccuccuuuugaaagauuagcaaaaguuuguauuucaguauagcuuugaaauugcccauggaauagccuaguugguugguuuguuuguuugguugguugguuuuuuuguuuuguuucuuuuguuuuuuuuuuuuuuuuuuucuuuuucuuuuccuuaucuguacagggucucagacuguauguagcuuuggcugucuuguaacuugcuauguagaccuggcuggccuuggguucacaagagagcuacuugccucugucucccuagugcuggguuuaaaggcaugcaccaccaugcccagcuuccuacagguugaguccugacuccaugguguauucccccaugcacauugauucuugagaauucuggugagcugcaagcauaggaaaaguugaagguacuggauguaucauguggcuucaagacuuugugauagauaccuuaaucugcaggauuucccugccaggagaauauacuaaaagccaacuuagauggagguugcauacagauggcgaaauuucacuuugugcuuuuugaagacaaacagccgaggaagcaggagggcuuugcucaccuagauuugccuggugaguacuguagucuagacccaggcaucuuguaacacuguaaacacagggccuuccugagucaaugcagugucagacccugugacgggugccguggcucagccucgcagcucugugcucaagacacucauauaggagggcuacugugaguuugaggcuauccugggcuacaauguaagacuaucccaaaacaagggaagaaaguagagagcuggagaaagggaggaagggcaagagagaaucgaguaacaggacaugagcauaccacacauuguuacagauccaugcugcuuacaaaauuuuaaauuuuuaaaucaaugugcuuuguauuuaaaauguuuggaaagagauuguccuuuaacuucauaaaagaagaaauuaguuuucuuuuuuuuucauuuguuuccuauguuagcuugaugauucuguguaacagaguuagcaucuuuaauagacaccaaaaaaaaaaaaaugugaaagacuauucagugcugagcaaauauagcauuauuuucuacuuaaauugcuugaacaugauaagcuuagaaaguuauagauucauucuuuaguauauaauuucaugucauuaauuuuuuugagaauuucauguaggaauugcaguuuugaucagauccaucccucccucccucccucccucccucccucccucccauaucugcuucuucccagguuccucccacauccucacaaauucauguguuucuguugcugcaguuguuauuuaaguccaguuaguguugcccacacccuccuggcuuuuuccuguuguguucuguguugggacuuagucaucuggaguuaguuuguugcuuguguguuugauaagagcuuuuucuaguccaccuauguugcaugggaaucuguuucucccuuuguguuaacuaaacuugguugauuucagcuuaaguaggagcagccuacuuaauucuguuaauuaaguaguuaaguaguuaauuucuguuaauuaaauacuuauuuugguuuuugucuggugaugcucagcugauuccaauauaguuuuuuuuuuuuuuuaaauagauuaauuauauuccaugugugugauugcgucacugaggucccuggacagaugcagguguggcugaggcauccaaacacuaauagaaguguaggccagugcugggcugaauccuggaguugaggagaguggaaaagagaccuuaccaguggugugucacuugggugggugggggggggggaaccaaagagaguggcucacauugugggggagcugaggagacacaccagaaaaaccugcuuguguuccuccuaucuggggcucagucaagggaaggacagugugggucaauaguuuuaccaggaaaaugcauggcuacugccuaauacaucauuuuuuaaaauguauuuauuuguguuagcauuuggugaucuaaauguuaaaucuaaaaaauguugagguuuagcuucuugccauuuaauugagaaaauaaacaauaauggaauuaacuuauugaaaagcccgugaauugcacaaauuucguucuuuuuaaugaauuuuuccccuuuuuuugcguauaacuugcuuuuguuucuagugacuugucuuggagauuuauuauaauugaguuuccuuaauaaaagaaguauguauguucauaccgucuaugcaagaagggcuagcucagauaaccguagagucuuaugugugccuuaugcaguagcccagugccaggagccucugacaucccuucaaccuucuccuauucaagacuugucuuguauguuugguuuccuuuacccacuaccugugauuaucuccagguuaguucauguugcugaggguugcauaaacuuaguaaaugcaggagugcuaacaggaggcaggagggaacugaaaggacagcuuuuaagucacauggaguauggauguaaaagacaggaaagcuggcuguuccuacaaaacccgacaaaaaggcugagcuaagaagaggaaggaaaacuagugaggcugaaccaaaaggcaggugugaagagaaggcaguaucuuccacaagugauggguacuaaagaggguaguaauaugaccuuuguauauuugcaagcugaaucuggcuaugccugggaaaguucacugagggggguaguaggaccggaagcaggagauagccauauggugcaggaugacagugaguggauacgguaagagguagacacauggguaagagaaggagagcucugugauggauugaccacagagacuauagaagguagacggguucacugccaugaugaaaaugggcagaaagcagucuugugagguucaaccuuaggaggagaaguuagagugucugacacauccaggcugugagcagugaucacaaguugaauuccagacagcuuccagcaucccauguaucugauagagagaaguaaacagauucuggaacaaacuuuaaagccuuaacauuuagagaaaccuguaaaacagucugccaagaagccacccaagauauucuuuugauaaaaauauaauauuuaucuuaccagagaaugcaggagaugaagcuauuuuaagaaagaugcugcaucauuugcagcuguggggaugcagagagcgaaagcucucuguuugcccuucugugaauuguucuuugccacccuggaggaagaccuggcugccagcuuaggguauuaggaaugcuucuuucuccauaggcugagaacucuuaccuacccuucauuuggaguauucuguuaacauaaguaauuuaguuaaacccagaugucacuucaaaaggaaacuguaugagaaaggaccagaaagauggcucaguggggaaaggcacuugcugcccagcaugauggccccaguucagucccugggauccacaucauggaaagagaaccaguacccucaacuugugcacauaaaugugaugaagucguuucuauaaaauaaauuacgaacaucugaaaguguucccauuaaucuuauuugacagaauggcaaagaaguauaauaugaaacuaaucuacaaaaaaacauuuuuggaauucuaugaagaaaagauuaaaaacaaugaaaacaaaaugcucuuaaaacgaaugcaggcccuggagguaaguauacagacaaaguauaaagauucuagaacauggugaauauguuugguauuuuggguguuuuccagaguucuucaggcauugcguagugagaugaacucugcagguugugguugcuguagaugcucugccuucucggacagaggcugauacagacuucccuaguggauggucaguaaacacacgggugcacgaaugagugggacucuaaccuaguucuguuucacacguagucaguccuacuuuaagguuucucagccucagacuuuguggcauuguggccuggagagacuccguccgaucugggcuccggugcuguauucgcagcacuccugccucugccuauuagaggucugcucguagcagugucccugccaggacaggcaugcuucuggguacaauugagaccucccugucuacaacaguucuuuuaugacuaggucagcaguuuagcgcccuccuggcugggccgagggagcaagugcauaggccaagucugugaggacucuggugacaccuuaauaauuugucauaugccagggcugcuuaacugcuugcuugucccagugaagcagugagauacugcagucauugcuugcuuccccuuucccuuuuauuacauagauagaaaguaucagugugcuuguaacuuacuagaaucauacccugcaaaacuuaagacagucuauuuuauuuagaauauuaauauucuuuucuuacucuuugguuuuucuuugcuuuuguuguguuuguuaugaggcgaggucucauucugugguaccaguuggccuggaauucauuuuguagagcagauggccuucagacuugcagcaguccucuuccccuuccucccgcugggcuccaggccugaggcccaucacaucugcugugcucacacucaaccggagaaagaagcaaagcaguggauuguuuuccguguuuacucuguuaaacuuaaaaauugcugugcgcucucuucacuagaauuugcguuuucccauagcaauacccugcacaugagaacucuaaacuugccucugaaaaggugggugacuacacgcaugcagcagaguaccugaagaagagccaagugagguuaccucugguaagugccaguguugacagccagaacaaaggagcaagugccguguggagacuuagcuuauuucacuuguuuacaguaucugugcucgcuagauugcaaguuuggcaagucauaaucuguuuccccuuaguugugcugacuuuugaugcuguagagcauaaacuguguuuauuucagugagcggcauacagagcuuuuuaugaggccacuaagggggugagguggggggcaaagucccaggcuuggaucgaaaggucuuugcuaacgcagagcuccagagacagaauuccgagcucugugaacuuaaauggguggugggaaaguagccugguuuuaguuguauuggcuuuucaugcagguucucaguuuuuaaaaaaauuaaguauaugaugauaagacaagcuagaccaguuccagggaagguugcgggcguuucccuuaacaucuuagagcuuucuucacauuuacauuaggcuccagaacugaaacucgaucuuaugaagucaguacccugugcaaaguggcacuuggguuucucauuucuaaauuaaagguuuaagauagauacuuguuucaguuuuuaccucccuuucccaacuacuacuaggcagugagauuaacuuccuauaaggaaauuuguuuucuuauuuuguucagaacauuuuaaucuuagucucuguucuuagcuauguauaucauaguuuugugugcaguguguguguguuuugguuuuguuuuuuuuuuuuucuuuugagacaggguuucucuguguagcccuggcuguccuggaacucacucuguagaccaggcuggccucgaacucagaaauccaccugccucugccucccaagugcugggauuaaaggcgugcgccaccacgcccggcuugcaguguguguucuuucagugaauuuaggaggucuugcugccucuauccucuauuaagaaauaagcuuacauuuacuucuguauugacucugaaguucucuuucuuuuguaauucuagggaaccuuaaguaagucagaaugggaagcuacaagugaguauaucaucccgcuaacugaugaugucagggacucuguuuuaagggaucauuaaaacuugaaaaugauagaguuuuucugauacauuuuuuauuuaugcugauaaauugaaacaugucacacacacacacaucuccauuugcacaucuguagagugacgagaaaaauucuguggacuguuauugaacauacuuucauguuuucacuacauacuuguuaguaagcagcugccucuguaaauuuuuuuggcuuaugcaguacuuccauggauaguacuuaauuggucauucagauguugacagcagaaaggggacauagaagaggaauuacacacagcagaguaaggagggcucuuauggagccuguauuugaaaacaaguguacaaacgcauucugccaugaaucuacuuucuucagaggagaaugcauagucuggcagaugugcaaaguccugggcuuccacagaagugugaugcagaggaauuuaguucguagauccuuaauguuacuauaaaaggguucuaaucuuucauaugggugccuugagaaucugagcacaguuucugcuguuagagacauacuacuuaauaaacauugaacacugacuuacaaaagaaauaugaaaggacuuggggggauuaaaaagcaaacaagucugccuucuagaguucaguaggagaaacaaacaaauucugccagacauuuuacgugcuggaaaggggaaagguggauggaaaguugaacguuagagcuucaaacuagcaaaaucugagaaguacuacuacuguugcugaguguuuggugauaucuggacugucaguuauuuugaguuucaaauuguguaucugaaauuggcuucuagugcuccuaaugguguuaaauggaugaguagaauuuuguuuuuaaauauacuuaagugaucuaugucuacccccaaaccacugaaaucauagaacguagagaaugaaugaugcuuuccuuccuuggugccgucugagaacauagcccugaugccaggagucacuggaugcugacgucucucucuguucuuuagguaucuacuuggucuuugccuuugagaagcagcagugagcacguugcuuuagagcagcacuccauccucccagguggagcagaccaucucagaaacauuugacagcuguuuguuuauuuuaauaguaaguucucaauguguaggaugcugccacaaacuucaguguaugaauuugacacuuacugucugugacagguuagcauaauguguguacauagggaugaguugucuugaagaucuauuuuuaaguacuguuguaauuguuccccucuacugucaaaacucuagcaaggcaugucagagcagcugaccuccccagugcugugaugugugagcagcugaccuccccagugcugggaugugugaauguguuuacagagcugauuugacagucgcuagaauuggcagaggaacguucacguuuccuuacaguguuuuucaagauuuaauggauuguguucuguauacuugaauguaaguguucaauauauauugcuaaaguuauaagauuaaauuuugauuuuagauuguccuaagagcuaccuggcuagauuuugaccguguuucaauaaaauaacuauuugcuaauacacugcaauucugagacucuauagacgaacuuagauggcagcacagaguuaguguggacugguuggauguucucuuuagaauuucuuaccguagcaauuagcauaucuaauuacugagguugugauuaagguacgaguaacuucacuggacagugauuccauggcuagauuuccuuaagguuuugugaaaaugccacguccuaauuguguuccauaauguuuuccgauggaugugugcacgugcaguaggaacagcacagugagaugcauuucagaugaauccucaccaauaagacaacucacucaccaaugcuguauccuuccaggucccaacaugcagcuccugcccgucucacaacacugggacucccucccuaaggcagaccccgcugucuaauugucuuucagacauuaacuguugagacguuaaugguguaguagucggcguggcugccuuccaaggguuuacuugcugucccacagccaucaugauugucauugucaguuagagagccgucuucuagaacugaggccacacugaagaaacuugucagccuuuacaucaagaaacuuaagagcaaauauaauuagacauuuguuuaaaaaucacuuacuuaaaggacaauuuacaaagaugcuacuuucuguaaaaaucuauaguacuugcuuuuaaaauaggcucagggccagagagguggcucaguaguucagagugcuggcugcgcguggagaagacccagguucaguucccagcaccuacaugacagcuuacaaccaucaguaacucuaguuccaggggaucugacaucaucuuuuggccucccugggcaccaggcaugugcauaguacauacauauaaugugcaggcagaauacacauauaaaguaaaaauaauuacuuaaaaaaauuaaaguuauaaucuaguuuauauagucacuguucuuaguauuuagaggguagauuugguucuggugcggggguuguggguuguggguggauggggaggaauguucuugcucuuagaaauucaggcucauuuuauuccuggggaaguuccagaaaguauuuugaugauguggcguaguagagaaagcuucgucacaauucaugaucuuaguuaacaguugguacgucauuuuuagucuuuuucugcccuuuccauuccaucccaugggucauuuuuaggagagaagaauucuucaaaggguggaauaauugaugguuaucccaagcagcaagaagagaaauguggaggucuugggcccuucccugaggacucagagaaaacuggccugggucugagaugggcucuagucauuauaccuacugucaaagacauaggagaguuuccaugaugucacccuacagaaacaguucaagcagcugccuuuuuccuuuuguguuccucucuguugaacguccaucccuccaccccuccuugcagaaguucagugacucaggauggauucuugaggacaagaaugggaagguggucuuuuccauuguuucaacaaauaagacuuugcccagcauucuuggaaccuaaauguuuaauuuugucaugacuuguaguaccugaugagaaagguguggcuuuucauugcaguauccagaaagagucccuucucuuggguucagugaugaaaaugguucagaugggcuguucagauacgucuaggccugucacacaguguaugcucagguuguuuccaaaugaagaucaggggcuggagacagagaucucagguuaagagugcuugcaacuuucagaggacuuuaguuugguucccaacacacauaucaaguggcuuagaacuaccuguaccuccaauuaaagguacuucagcacucuccuuuagucuuugcuggcacccgcacauacaugcagauaccuacacguaaauaaaaaaucaaaagaagagcaugugggccauuuuugggaaugacacaacuugaacuagagguaguuggcuuggggacaaagcugcacagcaguaggaccuagaacauggacuuguuugggucuagaauuuacucgggaacaguccaguguauaguguugauggagagaagcugaggaguugucugucccuccccauccuucugguaaccuaaccuguacagagagcugcaagccugucagagcuggcucacacaccacuucagugccccugagcacauuagggacucuuaacagcaagcaaagacuaaguagagucacucauaaguaguggacccugucugauaacugaguggcagagagaagauagagauuucucaaaaacagagcccuguugaaacuucuacucuguagugggcuuaaagucguauguucacacacuucucaggguguaacaggugguuccugcagcuuugagugauacuuacugaggccccuuaacuuagauguauuaauuccugaguaaggcgcuuuaguacauaagguacccuggcaggaauagagauagauuauucuucacgguguggagaccugguccucuaaccggacuugugaaauguaugcacuagaggugaugguguucccccaaccuuauuguguggaucuaucagugcaaaagagccucuuaagagaagaugcugucucagugugaauuaaguaggcaggccucauuaugugaauuugcuugcuuaaacucuguugaaguguuguaucuauacaggcgaucagggauucuucacagacagaacauacaugaaugcagaagccagagguucccuuuugccuacuauuucuuccacagccaccauccacuuuuaagcaaaauccauuucaucuggcuugaaauaugugaaauaaaauaaaaaauacguuccuuggcuuucacucggcaguguucaugagacucuuauucucaauagcuguacauuguucauucucaugauuguacaguauuccguguaugaauaaacaacauuauacagugg

SEQ ID NO: 8973 - RNA, 2077 nt, Mus musculus
uuuuuuuuuuuuuuuuuuuuuuuugacucaauucaguguuuccaagaaauuugggggcggucacauggcgacucuagguacaaacucgcccucacuccauuuagcaugugccacccagagucaaacuagaauggcuuucucacacauaaucauuuaucaguucuuggugucugaaaaguccacauuggaugcuuugaagcaucuuaaccugccccuagcaaccugccccuagcaaccugccccuagcaaccaucaaaggcccgguccacagcaaagacaagccauuuucuccagucuggaguagaggaaagggacgaaagcucaagcaccaacccugacacuggcugugugccuuucccuccuccccaggcuccaccucugugcugaccucucagaauggccaaaaaaaaaaaaaaaaaaaaaaaacuaccugaaaaaaaaaaaaggagaacuucuuguaaaauuugaaaaacauacaggauggguuuuguuuguuuguuuguuuguuuuuguuauuuaaaagaacuauuucacaugggugggaucacacaugaaggaaggguacaggugucaguggccagagcaguguuuuggaugccaagagacuugcugugcucaacagagccacguggcccucuggaucccagcgaagaucauaggguuagaauaagacauugaucuugguggucacacugcuuguccagacacccagcuaucuaucacgagucuuaauucucugcucugggugcuaaaaugacuugcuacaaauccugaccuuuauuuuaagguauuuaagaacacgcuugacggcauuuuaaucucuauguaaacaaaaucgcccuuguguuccagugcuguuauuuuugggaucuucaucugaagcaaaggguacgagucccuccagcucacagguucgguuucgcaguaauaugcuggaauuaguguuuucucugugguuggauacuugacaucuaggcugcuuccaaaugaaagagaaauguaaauaaggcagcggacauacaggucaucccacagugaacuguggguguaagagggguccugucuacagaagauuggaagagcagaaggacuuucuauaguauggugucauaauuagcuuaugagaaugaucucuuuagaagcucagcaaagaaaaacaaaaacaaaaaccauagugcugguguuaacaguaaggugaaugagauguccaaaucuuuacaaaguggaaaacaagcagauuguuugcaacugauuugcaaagagccucuaaccuuucaaaauguuuccuguucauagcugcugaauauucacacgcaggaaguaaaaguucucauuguagccauuauaggaagccgaguucacauuguagccauuauaggaauccgaguccacugucacaguggaugugacugggauauggggugucugaggcuuccucuccucuguacagagcaagcgcuugcgguguuuguaauuuccaaguugaauuuucugccuagaguccuugaguaaucuuaagcaaagugacucuaguccugaucacaggggaagaauaagacauugauguugguggucacacugcuugucuggacacccaacugucacuagucugauucucuucucugggugcuuaaaugacuuacuacaauuaagguauuuaagaacaggcucaacugcauuuuaaucucuauguaaacaauauagcccaacuguuguguucaacuguuguuguguuugggaaaauauaugccuguaguaacuuguuacauuuaugaaaauaagccaaccucaaaaugaaguccccuuaacaagaacaaaaaagaauacacaugcuugccaaacauguggcauuguauguuaguuuucuguuggaaaugcauuugcaugaaggucccuuagcaaaagaauagacaugcaugugaaacaugugacauuguauguuaacuuuaugucucugugggaaacguauuugcuguaaaauauguguccaaagaaauuguuaguaaaguagaaggaugauucaauuuguacuaauaaacauguauauaauuaauaaaauggauggacuaaacuauac

SEQ ID NO: 8974 - RNA, 882 nt, Mus musculus
ugggaagaggugaggaacccaguuuauuacuaacauuuuaaggcuauaaacuauguguucagaaaauguccccuccuuccuggucgugugacugaaagauuccagacgccccaccaggauaauuucuuugcagugguucuggucucugaccaggugccccagacaucggggacaggauuucccaauauucccugggcugcacugucagccugucgcacccaggacaggcucccuaaaaaaggcgcgaguggagaaggaccuucccgcguucccagacuucucccggaauggaggcgcguuggccgccuggauuccaagcugagcuuucguuucccguaggucagaagacgcggugggugggggcaagggugaucgcacagcuguccccaaguccugcugcgucccccgcccccagagucuccacgaaauuugccacacugauguaugcgucucaugcuuguuaggacuguuaagucuccgauguucaaacccuggaaaaaaaagugugagccgcauacagggcuggugucccuauucccauccccgguauccccauccgccccugucccuguguucgggcgauucggcgcuuggaggugacuuugcgcgcuucugagcaucccucccgcucgcucgccucggccacggugaccgugaccccacgcacccugaacccuccgugagccacuguuguggaccggcuuagcccuccucguuccuccuggagccugcggucccccuguucccguccuugggugcugucucagaccguccccggccucuuccacacagaucgagccacagugcgacaaggggauucuggaggcugagaucccugcgggcccagucuguccaccagagaaaaacccacccgggaagaga

SEQ ID NO: 8975 - RNA, 20797 nt, Mus musculus
ugugugagauggguggaaacccaggagggucagggcucuggggcgggauggagaugguacagaggugagcagagugacccuggcugaauugguacuuaugugggauggugggcggaggggcggggggcggcagggggauugcucugaagccacgcaaagcucccugggaaagacuggggcuguggaugugacucucaagauaagggcccggcaucugagggcgccuccaacucuccuaucgcacaguuccccaccccagcccgggaagcccagccugcccauugcgccgggaagagcaguggccuggaugaggacagcaugggucacggauagagucuagaaccuuccuacccgacccagagaaaaagccaagaaagaaaccccaccucccccucccggaggacggcgaccuaacgccccucaacgcccuuugaccucugaacucuucgccgggcucucgagacccuccucccccaucccucccggcgccugguacuacacaugcgcccugcggcccggcgccauguugggucgguuugaaagcgagcgcgggcguccggccuuccugcgguggcggaggaaauagcggucccgaggaaggcggugacgcgcuccgggaugcuuugucgcgucguccgguuugggcagggcuugggcuguccgccgcccggagucuggaagugcgcgcuuuaaaaaaaaaaaaaagugucccggugaguccucugcggggagcgcagcauccuucccgcagcaggagggagacgcgggugcugggauagagggacggagggacagagggacagagggacggggguggggugggggggaaauccuucuaugggagggcacgguauggaggaagaguaggggugucccggggugcggugacucgaggggccccaggaagcuugcgggugcaggggcuugagguucggggaucguugucacucagcauccccugcggccccgggugcggagggaugaagguccucacccaaggccaugucuguguccgcacgcaaagggacgcugccacccuggagccagcccgacagccacacccagcgcacagggauggucccagucucugcagcccaaggccugccauaaccgguguuccagacccguugccuuggcaggcuaaccagagagcagcgguuuccaagaguugugcuccgcuuccagagcguccaucucccuggcacuuuuuugacgcggucgggucgucuguguuuugaaucgagguaguugacauuucuugcccuaacuuuuauucugcaccgcgauggauuuaauucgggagauugaaaccggcgcuuuugaagggaaugguaagauauaugguauuuacuuaaauuauguguauuugugaccgaaaugggagggcggggaucacaaacaauuaaauuuuguugauaguuguuagcagcagagcuguuaggugucccggggucucuuaaacuauuuuacuucgguauggacuugaaacuuuccauaagaauugcggguuuucuuucuugccauguaaauggagauaacucugauaacucucuuaagaacuaaauccaacuaacaucucucccuuuaagcaacaagauguugcuuguucuuaagguuuugugacauaaaauuggcauccugauuugugacaaacaucagggcgaauuaaguugagcuaauuuaaaauuuguaagaaggauaaagaaagcacaaaauugacuuuguuccguuauucuuuagagaaaaacaaauagcagagcguucaggaauggagaagagcauugucuuacauccugcuaucacuacccagugcuacuuucucccucagccugggagugcuaggaagauaggcuagagcuacuacagcccugucccaccuuaauuagaacauuuguuauauuuuaaagucaaauuugacauugcuaauacuacaucaaacaaaacauuuacaaacuuacagccagaauugaacuauugacauugcaacauuguagcgugcaucacaaccuaugugugaagguuuuuaguauagaggauccuucaguucucagugaccacaaugucuugaauuaauacaugucuaucccaucauuucuuguuuacaaaaguagauguuacuacugugcuaaaagcucucucaauuuuacuagaaaaacauaaagcugauuacauugaaugaauuuccaaaccaguuaagcuuucuuucuuuuugggggggggggguucgagacaggguuucucuguauagcuguggcuguccuggaauuuacucuuuagaccaggcuggccuugaagucagaaauucaccugccucugccucccaagugcugggauuaaaguugugugccaccaccccgggcucuccaguuaaacuuucuuaagaaggugaaacuuuuuaagaauuaaaacuauaggagcuggagaaaugcaguggguaagagcacuggcugcuuuuccagaggacucagguucaauuccuggcacccacauguugacucacaauugucuguaacagcaguuccaugggauaugcagcccuuuucugaccucccugggugacaggcauccauaaaguacacagucauaaauguaggcacaauacccauaugcauaacauuuuaaaaaauuaagauguacugaggauaugaaaaaugaaggcgauucuuaacauuucuuuuaauaaaaggcuuauagcuagcucauucugaaauaauuuaaauuuaauuuuuuguaaauauuauuuuguuuucuaaaguuauuuacuuuuggcuaaaguuucauauugaugcuuauuucuaaugcuuuauuuaauggcuuaaaaauugauugccagcugucuguaaugcauggcaguaggcuuauaaaaaaauaguaccuauuggaaauuguuagguauuaugaugucauaaacuauaucaccauaauaaagacugucuauaguagcuuuuaggacuuuuaaagaaguacuguuuccuugguauuccauguauauuggcagauaauuuuuaucugcauauuuccaagcacauagugggcucucagacuuucuccuaaaucauccaugaaaugacugacagugaagacaacagggaacuuccagugcuuaugucggauuaucuauuaucaauaaguaauuuuaaucaagaaaaccuuugcauauuuaauaauuguuauugccuaucaucacuauucauuggcacugucccauuuuguuucuguauuguaguauuuaauggaaaugaauaacuccuuuugagaaagccauggcgaaguuaaacacaaagcucagggguuguucucaagagucuucaguaucuucucuccuggcaagcggcagccugaguggcagccgcuccgacagcgcccacagcgcccacagcucguuuguguauaaggaccagcuguacagcucggcuuccgaggcccugcaggccuauauugaugauuuugaccugagcagagaacauccuggugcaaacgcugucaaagugaacacugacggugagauugguaaugggcugcaauuuuccagcuacguacauauacccgacaaugguacgccuuagucuuuaugcuugcuuaaacucuuauguccagugauuuaacauauuugagaaaugggccuuagaaaguuggaccuuuuuguuauuuugaaaaaaaaaaaaaaccacaaacaaaccauauugcugaaguuuugauaguuuguaaaauggauugucuacuugucaugaucccaggagguuuuugcuaagaucuuuuguccuuggagaagacacagguaccuauaauuuacaguagaaaguagcugauucuaaacugcagccauuuccuguggcaugauagaggauaggcaguguuguuuaacaagcucuuacauaaucccaaucuuaaugaguuuauauuugcucaauuucagcuggugaaggaggaauauuauuuuuuaucgucugcauucuguggaauaauagccauaauauacuaaaaguuuauccuuaagaaagccuucaugaagacaggccuggaaaaaugaauucauaaacucuacugaacacuggcagagaaguguagugugggaagaguaugggugauuuauucgugaagagaaccagauagcauucucugaggcucugccacuguaggguugguggcagacaaagcaaauugucuucccaucgacuuuaauaguauucuguucucugcugcuuacugugauuguauuaauguaagagguguaucgucuggguggaggaaguugaaggaacagugagagaacacacagguuuaucugauugaugcuacauauagaaauuaauuacugaagagauaugaagaagcuuguguucuguguaucaguuuaugugauuaagauuuguauucacagcuaaugacgaagggggaccaaaacuauuucuaaguuucuaaucugcauuuccuguugacuaugauauaugauuaaaaauaaacacaacuauguuuuguuuuucagcuuuugucaaucuugaucccaagcagcacuuuaaccccuuauacuauagaagagagacuguuaaugacauggacgccauuagccugacaacugaugauuuguuaagacuuccagcggauggaugcuuuuccuucccuuguguuccaccugaucaccgaccaaacaagaaauacaguggaagacaggauucaucagacauuaagaauaguccaaguuuuuauguagacgcuacuuccaagagcaagaauaauauaguuccuccuuauguauauacaaauauaaauggaaagaaaugugguaggcccagaaccccaaaaccuauuaacagagaaaauaaauguguuucggaaucaucuuuaucuuuuccuaaagaaucauccuucacggaggacagugcagagcgcaggcucgagaacuauccaagauggcugacuagccagaagucugaccucagugucucagggguaacuaguauaccugacguuaaguauccaauuuggcuccauaaucaagacuugcuaccugaggcaaauacuccaagggguuauaaauuacuuaacgaagaugaauaucgcccuauacauaguuaccaaacacaaagagcaaaucagcuguuaaauaaaauagauuguuuugaauauacuuuuaaaccuucaaacuuaacagacuccuucagugaguaugaaggauuagguaaugaauuuaaaugucagugugacaauccacuucucccaggacaaucccaaaagccauucugugguaauauuuuguuuuuaguuuuuuauuuuaaagcaaaggauauguuaaaaugugauauacucuguagaaguuuuaugauguaauaacacuuguagaaugcauaugaucuuuaguauuuuaaagcuguuaaggucuuuaucucuguguccuugcuuacauuaucccacuguccugauuugauagagacguguacuuucccaguguuuuacuuccuguugacugagguauuuugagauuucuauuuuuuuucuuaaagaguguuuuugaaauuaggugacaaaauugaguugcuuauccugaaggcuaagaagaaucucaaacaaucugcuaaagacuuaccaaaacccguggaaaaggaugacaguccuugcuccuuagauaaacuugaagcagaacgaacgugggaaaaugucccuguggcuuuguaaguaagugacauuguuuagugugccaaaugauaaagcauuaugucaacaucagaugugcuuuccaccacauaacuuaauaauuaaugguggugugaucuagcuuucauauugcuuaagaggcauuuuucauuuguuacucuaagaugauacaguguuucaugugcuuuuauaaaauacaugcugcauguucauuuugcuuugguguuaaauuaucuagaacuugcauaaacauuucuuuugcaaguggaauagugauauugaauuccuuacuuuuuagauguugccuucccaacaccugcuauucaugucuuauuuacauuuugauuuuucucuuuuuccugcuuuccugaaauggcgguacauuuugagauauggucuguuguaguuccuaggguucuucuaauuuguaugcucaaucucccuaugguacuguugcuuggaguaauuaaaaaggcaccugcacaccuaagaugaguaugguacugacuggagcuuauauagaaagaguuguuuucauuaguaacaccacauuugcacuuagcagaaaugcaguuuuggugagcggcaugugugucucaggcucuaaugguugauuauauuucauaauucccguauccuguuuucuuucuugagacagugucaugcucuguagccuaggcuggcccucugcucucaguccuccuccgucagccugccaaguacguggccuccuuccgcuuguuucucagucggauacuuugggugccaacacugaccguuguccucaugucuucccuucuugcuuugauaguucuguaaguucucuauauuuuaaagauagagaacuaauaguuacauacaguuguugagaggacucaauuugaaaaugaaguacugaggcuaguuucugauuggggcaaacugucuaugaagucaguguaguguuccugcaguguugaugauugcucauaaaacuugauuuucuaguuuuuguuuuauuuuucaugcuacaucaguaugcuuuuaaaaaagauuuauaauuagcucacuuauuuaacguccuuuaaaaauuuuuucauuuccuaaucaguuagucuuugcgugaauaaaagaauagcugcaguguuuacuuuacagucaugaucaaaugaggagaaaaguuggagcggagcugagcaggcguggacuuuccaaagcacuuacuguauauguuugcaauuagacgauaagacuugcaguuuauagaguaauagcagugauuggacccaggagcucgcacccagcacuucagucuuggagcaucaguucacaaguauugugcuuguagaaaaagaaaagauggguugccaagaagaguaaauggaucuuagcugaugcuggcaaggcgguccaggaucagacagaauaaaaaaggaagccauaaaguuaguguuggaaaggaagaaugugaauccugggcagccaucuccauggcuaaggggcuggcacucagacuagaggcuggaucuccagcccccaaggaaagcuacaggugguggugugcacuguaaucccagugcuugcgaagguuuguuuguuuauagcaaauuagucuugcuuaauuggaaagccaaagguucagugaaagacuuucagaaauuaagauggguaacaauagaggaagacaugugacauugacuguggcccagacauguauguacacguacauaccacacacacauaccuauacacacaugccacacacagacacacacagacacacaugcccccccauacacacaaacauacacgugccacacaccucacacaugcccccacauauacauacauaccacacacacacauauauauaccacagacacacacacuaaaauguagcauuuaauuaaagucaacaaaagauucuuuaaacaaauuuuuguugugaaaauguuaaaaauaaaaauaggauaggguaaugagcaugucuguucugcaucuaucuucaauauggauauauaaaagcauauuguugaguugugaguaaaaagacuacccagacuaagaaauagcucauggcaaguuauaaguaaaauauuucaacugagaagugcuucuugaaauaauuaccaugcaauguuuaaguguuuuguuuacuagguauuguguuuuuaaguuauaaauauguuauaaugauauauaaaguacuaggguaauuucguuuauuuuugugauaaauacaguuuaauucagaaaauuauuauuuuugacauuaguauuccuuacuacucagaacaucaaggaagaagugauuauugaaugacuacuaaauauguaaggugcauagagaauuauuucacaauuuucucugaaauaaagauaauaaauguagauucucugaauuagguaaauuacugaaggccauauagaguugggacugggauuagaauuuucaguuuggaguuuagauuuuaaaaauuaaaucugaccuuaguuccccccccauuaauaauaguucugagguggguuuguccuguugucucauggaagaacauaaaacuaccaccuagguaaagucucucuggaguuucaagcuuucuauaucuuuagguaaauaauuuguuugguauguaugcauggcacgaaggaauuaaccuagaguccccugcaugcuuggcugggacacucccagcucucacuguauuuacuugggaaaguguacugugucaaacagaugagcuuuugaaguuauuccauaguugaggaauccagucaaggaaaagucguuuacuuuauauaauuaucgucuuuagagcugaaguuauuccauauuuggacuauuuaguugaugaauagaaguuuccuuuauauaaggaucgucuuuaaaauuggaaaggacaagcagaguguauagaaggacugauugugguaucagcuuagggacaagguagaggacuuaauacacggcuuuaauaugaguuguauccgugacauuuauuuuuuggucacuaguaaaauauuuugaagugcacgcacucacguguguguuguguguacauggguugugugugugugccuuugcagugucgaggaaaccagaagagcugguugugucuccuggagcuggaguugcacguggcuaugagccacaagauguggcugcuggagaaggauggaguccugugcaauagcacaaguacuccugccucagcuagcucuacagccucacuugucguuaacagaaaacauuugaacuauauaaugccuacuuuuaagauuacugccuguauccuuuaaauccuguguagcaaaucuccugucccuguuaaagcugaugacaguccucaacaaaguuccaggacacaaugugugaaugcguuucuugaggacuuuuuaaacggugagaaucaggugaguaagguuaauguuuauauuaaaaggagucuguaguuaaauuaugcagagugauuucucguaguuaacauucuaaaacaacacaaaguucacacauucauuuuuccccaauguauccaccaaaauucaaccauuuucaggauauuuaguauuuuaaaguacaagaauuuaguacuuugaggacuuuaguauuguaaaguauaagaaacugaguugauuuauacauguacuuaaauugucauuuuuuuuucuuucuggaaaacauaaaggagaccauugagggggaaaugaucuuucuuuguaggccaguuggucauugaggcuuguguuucucaguaguaauacacaucaucguuuaaauuauuaccuuguuuuacaaagucaguuuauaugucuuacaaggacaaauuauauacaugcauugaagaaaugauacaugauuugagcuaaaagugugaauaugccugacauguucaaggauuaucagagugagucagauuagcucugucagaagaagcaaacaguagaauggugaggagguggugacauggccaggaaaucugggaagcagaagaugccgugugaggagcacguuaggagacccuagagagcugcagucuccagaagaguggggcaguggauuugguaggguaggcacaugggagguacucagcaguugccagacgugagcugugucuugaaggaauccgagaugcuuuagccaagcagcgaggggauggcaucaguuaaggaacauugguggaagaacacauuuuagaagaaauuugaaggucuggcauagguccuagguaguacgcccuguccauacucugccucucuacucuguuuucucuuucuuuugccguagagauguucuuguacucacauuuaucuuggacuugcaucuaguucugucucucuacaugugugaccuuuucuuuuaaacuugagucucaugagucuaacucuccguucuggagaaauauuucaauuucaaggaaaccuccaucccucagcaguaacagugagaaaagaggacaccccauuauaacaucaacaauacuaagucaucagagauagagaaauagagguuagcucgacuaaagcccauuaguaugucaccagcaaccacaggauguggaagugcuaacaggucagaaauuacucacagauagauagguuuagaggcugcaaaagaguguguguguguguguguguguguguaugugucacagugagguaacauaaaggcagaaaaagaagagguaucugggggagauuggagagaaggaaagagaaaagacccagaaacuaacaaauauuaaaauggaagaaaaaugcaaauaguucccaaauaaugaaaaaaauucauaaguaaaauuagauaaaacaacaaaaauauuaaagaauuuuuuaaauaagacaaagucagaacaguacuaaauauaaagaaagggaggcaaaacaaaagagaaaagaaaaauugucucauacugaaaaaauauaugaaacuagauaaguauuuugagaguaaaaaaucgagacauaaaaccagagcuaaagaauaguuaaaaaaaaaaaaagaagaagaagaagcaugcagcaaaaaaggaaaagagcgaaguucagacuggacguuagaauugcuuucugggcugucagauauuggagacucuuaccucuguacaugggguagaggucaguuggguuguggacucuugguguuuuuccuaugauuggugcugaugcugaccuuguguuggauaagggcuggaugucuacuagaguugucugcauuuucuuaucuucccugugcugugugcaccaggacccucugcuucccucugcugccuaugcuuaguugcucacucuagccacucuaaguucuucuuucucaaaguggucaauauucuagcugggaggcaucuaucaaauauuuuuggaguacagagagaaggcagagaguaguuauuuguguaggcugaugucuuucuaaauucuuaaccacugaucauucuauuggagagcugugacuguggguacugaagagcgugcuggagcuucagaguucuugaccugugcagcaggaagucucagcacuugagaguuuuauuuaauugcucaccucagacucugaacuaucagacgccaagguuuuucucgguugaugaagcuacuaagggagguuuccuucuuccucccuauaccauuuauuaccugggauaaaucaacuuaugucugauacauauaaaauuaucagcauauuggaccuccuauucuccauaaaauucuggcaucuguuucagcagcagguugaauuuagggucccuuacuugugaugguuuucuguucucaggcucccaggguaucuuaauuuagguacucugguagcuugaaugagaauggucccguauuuucauguuugaauacgugguccucaguugagggaacuguuugggaaggauugggacaucuggccuuguuagaggagguguguuaucuccacuccuggggguuggguuuuaagauuucaaaagacguaguguguuucuucccugccuccuacuuguagauuaugacauguguucucagcugauccugcuucuguuacaggcucucacucucugaaacuguaagcucaaauaaaugccuuggucaugguauuuuaucauagcaauaggaaaguaacuaagacuaguacaguccucugucaagauccaguacaggaggggugcucuuuauuguucacguagcuugaaggagaagucacaaaagaagucaacaaacuuucaaccauuuuugaaguuugagagagcuaaucuugucuggaggguaugacugcuuguguuuacaccaggagugaugaagggcauguuggccuacuccugcccgagggcugucugguuuggcuuacugcuuucagcucugagcuacccuuugauucucugcacugcucaguucccacaggccagucucggcucuucucuuugaaauagggucuauuucuagcccugauacuucuccauaaccagcuuacauggaagcagacuuuaggcuguuagagguuuaaauaguuuuuuuuuguacguaugaaacauuacugagucacgaacagaauaauuuccccaaacauucacuauuaaauuucagugauaagucucagaaaauugaaugauauguacagauuuuaagcauaccuggaccuuuacacugcugccuuuuucucugagcuuuuauuuuauguaguaaagaauacacgcuauaaauuugcauguugauuuguuuuaagcauauguuucaguggcauaauaguaacgugauauuauuuuaaagaucaccaacaacugucuccagagcuuuuucaucucaagcuaagccauuuaagcacuaacuucucauucuccccccccaucccccaccuccuaagaaaagaaguaucuuggguuuugugccuaugaaguagcuacuuuaggaacuucauaagaaauggcaugagccuguggugcuccgaagguggaaguaggauuuuaaguugcaggccagcaugaguuauaaauucccaaauagacaaauaaauuaaaaccucuguagacucugcaaacacucuucaucacccuguuguauaguuaauauuguuaccuucuucaauacauggaaaguuaguaugaugguuguuaggucuuaaaguggaaggaucuaaagaggcaaaaagacgacaucucugugugagaacacaugacuuagaacauaguuuuaaaucuaguaucuaucagaggaaagguaguaguuuggaguuuagcuuauuuaacaugauuuccaguuucauccauuuucuuggcaaguguaaugauuuuacuuuucuuuaugucugcauaaaacuuuguuguguuuauauaccauaucuuuuuaaaauauccagcuuuuucuggacaucaaguugguucuguuuccuggccauuaaguauagugcagcaguaaacaugacggcugggguauuucuguggcgugguggugcaggucuuuggguauauaaccgagagucauacagccggguuaaauggcacuucuuuuuuucaguuuccgaggccuaaucauuucauuuccacggugacugcaaaauuugacauuuucacaagccagugacuaagacuuucucuuucccuugucccaaccgugaaugcauacuugaaauuuaauugagaucugcuugaaaucuaguucucacucacuugauaaauaacuuucuuaagauauuggaaaagaacaucaaaagcuuggauuuagaggcauuauguaaauguguaauauucauuuuaaagaaucaggaacuaagaggaauaugcuaaacucuuuauuaaguaauuuuaccugaagacagaguguggagaagugaugaguuaguaguuugguuuuuaaaaaauuuccucuaguggagugauacuggguguaucaacagcacuccaagugaggcccaugucuacgauaguuaaucagcaugugugugcaugcacacacccacaugucucccccuuuuuauuugagaauuuuauacauauaugcaauuauauauguuaguauaugcccccauuuucacccucuucucccauaugcucccaacaugucccucucucagcuucaggucuuguuuucuuuauuuuguuuguuuguuuuuguagcacacuaagucugguuagugcugccuauuugugaugaauguggugucauccacuggagcagagaaaccugccaguggccacaucccuuucccagcaacuaucgacuucuagucacuccucaggaauggauggggccuccagaccauuuaccccgucugugcuggccuguugccugguucaucuucuguaggucccguccagguaaccagagcuguuguaagccccagaggacaccacagcacuucucccucucguccaccgcuuucuucuguuuccucgucauugaugcugccguaccuuugauguuccuaguauaggugucuggauuauggcugaguauaucuuguuuuccaucacuuuauccaguuaugcaucucucccuugacuacugucaguguccacugcuaaaagaagcuuccugagagcagcucgggucugugguuauaacuagaaauguuuaggaagcaguuggacagcuuggccucuuagcagaguaacaguaguaaagccguguccuagaccguaggcuguuggcuagacgucaugaaagucccuucuagggagcaugccucagauucaaucagagagcacgauuucauaacagucaugcaacuucuacaccaguaggcacaucucuucugguaaguugguauuacagcuugcaggcucugaugcuagguaagaccacagauguagaagauuugauuucuaaaaacaaauuucaauacauuguugucuugacuuuugcauuaauuuauuuugaggauauugugcaauauaccauuuuccuuuuauauuugaaugguuaauuuuccucauuucauuuaacuuuagagcucuacucuaucuggaggcaaacaucaugguccuguugaagcuuugaaacaaauguuauuuaaccuucagacaguacaggaaaguuuuaauaagaauaaaacuacagagccugaagaagagauuaagcaaguaagcacacacuugggacugagacguaugcgauuaucugcaguugugcuagucacgcgaguggcaggaaggaucugugacagagcaugguuuaucuugguugugguuucacagguuucagccauagucuuuggcucuucugacucugggcccacggugaggcagaccaugaaggcagcaggagcaguguugucugggaguagaauuaggagaggcugggcaucucaggagccuacugagacuaaaagagugagggaggggcuggagaccagugugaccuucaggccugugaucaacuucuuccacuccauuucuacagucuuccaaagaguuccaccauuggaggaccaacacuugagcuguaggaucauucuacauucaaaguuucaucagacuucaccagaaucuguuuuagaauuaccuguaguugucuauaaaugagcauacuaacacaguccaugccagagaauuguauucuaauuauaugcuuuuuaggaauuauuccacucacaccuaguauuauuacaauuacacuccuaaaguguuacuuuuucugcucccaagcuaucuuuucuuuuuauuucaugcuuaugcccaucaucguagagaugcugcugcuacaguuacaguauagacgggcaucaaugccaucuuuacacauccuacagaauucaucucuauggcuucucacaaacacagaaucugugaaaccuagaagauguucuuaauguuagacuucuccaccuguguaucucagaauagcagauuuaguuuugcuuuuauguguuuauuggcauuugugaggauaauguauuuuuauaaaaauuguguauuucuagaaauuuugaaaaauguguuucugcuucguguagcagaugaauuuucaaaauacagaaccauagaauuuaaauucucuuauauguacuugugaauucuaauugccacugaucauaagugauaaaaggauauuuuugguguaauaugauauauuaaauaguuauagauuauugaauggcuaaaucaagccaauugguauauauccaccuuauaacauuuuuuuauggugagaauauguaaaaucuguuacaaauagcuaucuuggacuuacccucuucugcaugugauaucauauauuuacuaauauuucauuugucaucacccagccagccucuaaguuuauucugugauccagugacuuuagaaguagcucagugguuaagaaggcauucucuuucagacggcccacaugagcuucccagcgcccauggaggcuggcucccaacugucuaacuucagcuccggggcuuuaagagugguacuuuucagauuccauauguaaaugagaucuuucauuguuugauuuucugagccuggcuuauuuucccaaucaguuuuacugccauucaguagagcauuacaauaaucaagagcauuacauaugagugaaucagccuggguauuacacagucugugucauuucuccucugacacuccagucauagcuuuaagauacaguguaaucaguccuucaguuauucucuuaaacaucagugacacuuaaccuugucuguuaagauguaauuucaagcagugugauucuggaaugggcauucgcuuagacacauauuuuaggagcauugaacagaaagucaaaguaguuguaauuuccaaaugaaggaacaaugaaaguauuaauugcucuucaaaaaaaucguuuggugcaaugaauugaguauuucaaauguuuuuguuucuuuuggguuaaauaauaggugucagaggaugauuuggcuaaauuacagaugaaggaaaauaugaugccuauuacuaggucucuucacaaguaaguauuguuuacuaauguggacacaaauccauuuuagucauuccuuugacagaaauuagggugaaauuuaguaguucccagguaaauguuuggaaggcacacuuaagguuuuuguagcacauguuauaugugguguguguacuuauguauuguguguguguguuuuuuugcauguagaggccagaggucaacauugucuuccuuagucauggaaugcacuacuuuuuaagaauauuccuugcucuuaaaccuguguaacuuccuaguuaaacagucuuaagggcuaaaaagaugcacuuggacauacaaaacauaauggauaugaguggguccgauucuuuauuucagaauaaagcagacauuugagauacuuaguacugauguggauauccuauaacaauaauaugucaugaaaugaguucaucuagucguaaaugcaucauuacuuaacguaucugaggcugccacgauggcucgguagguaggagcacuuacugccagccuugugauaugcuuucaguucuuggaaccugguuaguggaagggcaaaaccaguccuuacaaguuguucuccgacuuguacacaaaugcagugugugugcacuuucauagaaagauacacgcuuaucuuccuuaguuguccuaaauaaaaauguagugaagacuacaaguuguuucuguugucaggcaguaaggcucuuuauguuugcauuugguuauaaagaugugaggugagaugaucucugagcccugggaggaguggcugugauauagaagccucauuuagguuuuuagaaaaauaaaagacuccccagacuucuauuuucuucauguuggccagaugcgcaccucuaugcuaaucaccaucuccuacugaaggaaucuggugauggagcuugugagaugggucauuaggagucacuguaauaccaugcacauuuagaagaacaauaguaguagguucuccccgagggccuauggccaccuagccaggaggucuuggacauaaugggcaaaauacgaguuaugucuuaugcagcugaccuuaaauccaagcagaaagugccugguuacucccaaaacauucaugccacugucauacgagaggcacaucuuaucagaccgcuaguuauuguagcuuguaggguucacaacuagguagaauugguaacuacuuuucuccuucagucacauacauaguauauuucuacugcgaaaacgaggcaguagaggugcagcuuucgucuuggcaccagcuugacuucucuguguucuagauuuaagugugugguguuuucagcaggaggguuuuaccaucaaauauuggaggguggccaagaacaguggucauagccuauaauauuugggggagguugugggacugcacuggcaaccguuuugggaagugagaacuuguaucugacagugggcuuucuacuugauagccuauggugucuaggaaaggcauugucacacuguaauaggguaauuccacuuaaguuuguaauauguguaugcauauacuuucggauuccacaggucuagauuuccacacagguuuucaggaucuuuaguguuacuccucauacuccuuuugcuuguauuucuucuuuugggaauuuuuaauuaccugcuucaauuaaccuguuuaauugccugcuucaacuaaagcuauuuuuggacuaauuuuuauuguauauguaugaauguuuagccugcuuguguauauguguagcacaugugugccuggacccuuguagaggucaggagagggcacugaguucccugaguuaugaguggcugugagccaucguuugugcacaguugugcucuuuaaccacugagccuucucccagugcugcuccugccccaauguuaauuuggugcugggcuuuuuucuccucccucccuuccucccuuuuucucuccucuccucccucccucccucccucccucccucccucccucccucccucccucuuucuuucuuuuuuucuguuuuugauguuguugguuuugguuuuuagguuuucuagagaccuuccuauauucuggacacuaaaucugugucugcuauauagaugguauggauuuuuuccucuugguaggcugccucuuuacuuucgucuuaaugccugugcuacuggguuuuccuguucggaaacuuucuuccugugccuauaaguuuaagcacauuuccuaauuccccucugucagacucgggcuauugcaucugauauugggccugagguccucgaugcauuugcagcuguucugugaagagagagauaaggauggaguuccggcuuuuacauguaguuaauagaguuugaaguugauggugcgggcuuuauauaaugugcauugugaaagugugugcauagucauccuuacuggagcaguugcuuguuuuucuucucaacaaaaaugaguuuuacugggcugcagagauggcagagagguucagagcacugacugcucuuccagagguccugaguucaauucucagcaauacaugguggugucucacaaccaucuguaaugggauuugauguccucuucuggugugucuggagacagcuacaguguacucauguacacuaaaauaaauaaaauacaucuuugaaaaaagaugaauuuuacugagaauuuuuuuauugacuuuaagcuauaucuuuacauuuuaaaccaucuucaccguuaacauuaaaugaauuacaugccuuguuucuagaugauacauauaguaugacaaaaauuauuuuugcacagcuauuagggaaaguauaugaaaaauauuuuauuaaauaugaugccugugauacuauuguuuauuaggcuccggcagauuaucuaaaaacugaauauuaaagcaaauguuuauauaacauuaacuuauuuuaguuauuauuuguucagauguuaguuuauaaaaaaggaguucucaaaguuuuuuucuguaacuuaauuucuaacaguaacuuugaaguuuaaauaauaagaucaucauuucuugcuucacauauuggcuauucacuucucaauauucauuuauaauguauuuuuuauuuuuuuaaugaagggccuuacaacauuuaucccgccugagagaccuggucgaugauaccagugggagacagucaccaaagaagugaagaggaaaauaagccuucaccgcaauaaacagucaccacacaaugaguuauguacucucugcuguuacuuacaccgagaaggugaacauuagccauacguuauucuguggccaguucaaguggauuuacuucuaagaaucugaacuuggaaauauucauaggcccgauuuuauaugaaaacaaaaggggaagacacuaagauauauccugaaguaguacguggauccucagaccagaaaaauuuuuaacauucagaaguggauaauuuccuuucuugcuguuuaucuggacucaguuuuuaucgacagucuuaucauuugccauuuaauucuugguuguaaaaucuuuuagcuucuucccaaaucaucuaaauguuaucuuugaauguguguguacugaguauuuucaagcaccuacaggaguaccaccuauaacuacucaacaaugaguaccuacauuguuguguccuaggggucauuuugcuacuucuaaaguuucauacauuggauauuuaagauguucuguuuauaaaugacauuuaaauaguuugugacucaguguuaauggaauguucuuuuauuaugacaccauagaaucuuuuuuuacuuaauucaauuaauugauucuuuguaagauaaucuugauaauacuuaacaguugacaaauaauuugagacuauauuugugaauuuaauauuugauauguaauuccccagauuuuagauuuggguuaaccucacucuauuaaaagcuaugacauuaugaaaaaucugaaacugaacaaaaaaaugaguguagaaaaucccaaaacaauuauaacuuaaaguaucuacuauaguguuccaaauuuaucuccagauaggacugaacagaguuguguuuugcaguuucuacuaagcaaauauuaauauuuguaauaaguagaaaacaucuucaucaagaacgagaauuauguaauaaagcauacagaaugcauuuacaagccugaugaaauuaguguauggucaaagacuacaaauuaacauuuuacccaaaguuguuuuuguagaacaugauuuuaauauuuucaacuguuaauauucaauaaacaauaauuauuuuaugauauau

SEQ ID NO: 8976 - RNA, 2774 nt, Mus musculus
ggauagugcuccauagugaggcucucaugugacaugaguuagguuuacaaggacccuguagguggugucugaagcuccucuuguuuugacuagaacuauuuuccuuucuaguguccacuagcugacuaaggcaguagagcacgccagaucuguugccacccugagaggcggccucuuaagacguagcuucauggaccagagcgugauacuuugcuaacgagcaacguuuucuucuguuagaagcgcuaagccuaacuuucugaccacuuaaauugcuugauauuuauuuacuauaacugccauugaauuacccgaugaguuuuuaaaaugaaaacauauuuaaauugaucagagccaaagacaagagggaaugacuauaaagaaauuaagggaaaucaugaaaagaggauccaaaauaaugugcuuuuuuauagguacagucuauguguccgcgugcuggaccugugcugucuggguguucacuuuaaaugagcacacaugcugagcuugcucgagucccuacguucaggucucagcaccaaaaaagaacaaaauaaaauuaggcucaaaguaauguggucaagguuguaaccaccuguguccuugccaccuguguccuuuauccccaggacccccagucccuuccuauucccagggacagugaguggcuggcuucgggcugcuaugguuuuggaaccguguugccaaacuguaaaagucuggaauuuccgaucugauuacauucuuacaugugagccuuaggcccccaguuuuaccgagacaggccugcuggcggaugugcgggcagcucugccugcucugggaggaugguugucagaggauccuugcuaggggcccauccaagugacucaggcugaguguguugcaguggauauugccaucucuuaaagagcuagucugcuauuagaguggcuuccacaaaguuguccuccuauccaaaggauggcuagcaucaauaguaacuauggcuucggaucucaugucuuguucuuuuagcagcacaguccaaaccauuuuacaaacuucccuacacacaucuuuugaaagcaaacugaccgcguacgguacguacuacaaagcuuuagcaguguuacucuguauacuuugcucagguagaaaacaaggugugaaagcccucagaacguggccucuuagugaccaucacucaaggcugagauacuccaaaaucaaauucaucguuuuaucaccacauacccaccaucaucuuagauucuucuacuugggucaaaguugacuuuguucagauggacaaggcagaaauacagaaaugaugcaggaugcggcucauccccuugcucguagcaucugugagucaguccugauagaagugcugccauagccacacaccucaggcccuuccguuccacagccucuaaguucacaggacucuucuuuucucccucuggacuagggaauagcuuucuuuuucucaguucugaucccugucccuucucuuuccucucuguguccccugcuuuuuuuccgacuuccccagaugccuuuaagugcagccucaaaugucagaacgugaauuuugcagccagagagcccaugucucaucccagucuuggcauucguggcuugucagggcccucggucuccaugaguuuauuccuccucggugacacaggaguaacaauaccuaccucauauagaguugugaggauuccgugagcuguuguuugcgagguguucaguacaguuccuggcacuuagugggucaaugcugucgccgccaucuuuguugcuuccaggaggugcucgugcacaguccuguccgugugacuuuaccuccaguacucguuccucuguagaggucuguguuugauuuauugauucguugucucuugaguagaaugugagcuccgugagagcaaggcuguuuccggguacagccgacacagugccuagacuauggcacgucuucagacagguaguaagcacucauuccuguuuccaaaaaagguggggggauggaagaauagucaaaagacucuucauggucucauaaacagcagucucacccuguuacgaucccgcugccuuucacuucaagaaaagccacaccacucgcuccuuugaaauuccuccgcugugcgccuggucccccccuuuuccugccuggccacguggcgaguuccuggccacggauaagugucagcgcgguggcugccucgcccgugguguugccugcccggauuucuccaggcagacacucuuuccauuacccagguucucacugucuuuuguaaauaccuccguggaggcaguuuacuguauuguuaaaaaaaaauguuuugcaugucuguuucuaguguuacacuguaauccacaucaaagcugagcugguguccuuccaucuucaagcccucaggggccucgagcaaugccuggaaugugcuuguuaauaaguauuuguugagugaauuugcgagcgcacaaagacucgugcaguuagaaaacacguuuuaccaagauagagaguugccugguggcuuccaggauuuuuuuucucucucuagaaagcauuauauaaucucuuugaauguaauauuauuuaaauuuuaaaaauaacacaaguuuaauauagaucuucauaaaugauugcaaaagauagcagaagcuuugugaucuuucaaaugauaauagaguucaagauaaauauuugcacuauuuccauagugaaugcuaugaggaaauguacagcaauaaauuuugaugcuuucaaaaac

SEQ ID NO: 8977 - RNA, 19876 nt, Mus musculus
cauucggagagcggcguggggcgucgccgccgccgccgcgcgcgccgggggcugguuaaggccaugaaacaaaagaaacccugagaggggagccgcugccguccccacccacccaccuaguucccuaccucggcuccguucccggccccuccaccccgcccucgcgcgcuccggcggcccuggcgcuccucagcccggggcgcgggcgccgccgccucccccgaggaaagguguuugcgcgcugagcagggccggggcccuguccgccauggggccggcugcucgccgcgccugacgcucccgccgccgccgccgccgccauugacagcgcgccgccgcgaugccaagcggcagcuccgcggcccuggcccuggcccuggcggcggccccggccccccugccgcagccgccuccgcugccgccgccgccgcccgcgggaggcccagagcucgaaggggacgggcugcugcugagggagcgccuggccgcgcuaggccucgacgaccccagcccggcggagcccggcgccccggcgcucagggccgcggcgguggcggcggcggcggcggcgcagugccaggcccggcgggcgaccgggcuggcuccggaggagccuggccgccucgcgaccuccgagacggcggagcuggagcuggagguggacgaagaggagggggaggaagcggagcuggacggagaacugcuggaggaggaggagcuggaggaggcagaggaggaggaccggccgucgcugcugcuguugucgccgcccgcggccaccgccucccagacucagccgaucccgggcgggccccuggggucggugcugcugccggccgcgggcuucgaugcccgggaggccgcggcggcaggggugcuguacggaggggacgaugcccagggcaugauggcggcgaugcugucccacgccuacggccccggcggcggcggggccgccgcugccgcccugaacggagagcaagcggcccugcugagaaggaagagcgucaacaccaccgagugcguccccgugcccaguuccgagcaugucgcugagauugucggacgccagggugagugcacggaggucggucggucugucugucugggcacggcccugggcgugggugggagacggaaaagaaagacgagcgugcgacagaagagugaaccgagagagucccccaaguccaccgagaaggggucugggucgccgagaaagggaccggucaccuugcgaaaacccacgccguuccgccucuucagccggacaagaaguguuaaguuucuugggccacccagucugguguauucguggaaccccaggcuggcgcggccccagaaaccucagugagauggugaggucaggucagaaguugugggucacggaauaguuuccgagagcuucgagauuuggaaguuuguguagccgaguggccgguaaaaagcaaucggccugccuuagagcugcuugugcugagaaguggaccgacauggaggcaugggcagcauuugagagggaagagauguucaaguggccggaucaccuccucccuccgcuauucagaaacuuggcuuuagaagcgcaccccaacucuguugaucuuaggugcucaguguucucauuucucuuuucaaaaagcgcuagugucagucuuuuagaacacuuuagccuguaccgugaagggaaaacugggcauuuggguaauuaaggaacuuuaugcguuagugcaguuuucgauaaauuuucuucacuugcuagcacacccguuccccagacagacuccucccacauuguucagacaaaggaccuaugucucagauuccaggaguagguuugugaaggugggggaaggggaugcacagaguaccuugguauccgacauuuuuagggaagguucuguuugcuucgguguagguuuugccccguuuuacuaccugcugcugcugaugcuguaauacaacaugguugaaacuugccucuuguugaggucaaauauggcacugcugguggaaugaucucauuuucccaaguggucuaaaguacacauaaauaagagauuggugaccucacauguaagagguggcucucguugcuaggauuuugauuaaaaaaaaaaagccuauaugguaccuagaaagaaagaaagaaagagcuuguuucaaacuguuugacuaaucaguuucacaucucacuugccaguaggagcugaucaggauaauagcucaugaggaaauuuuuauguacaugaaauaaaaaugcauuuuauuuauagguccauaaugagguggcuuuucauuuaauaucauugaaagagugcuugauuuugcugguuaaugaguuuaugaaaaguaaguaaacuaaaaauuugagguugauuuauacagaauuucugcucuuuauuaaaaacuaaccauuuaauagaauggcacgaaaguaauuacuugaaggcaauacacacaagaacauacauagagaaugcaacuuagcaaacaaagauacaaguauugaacaacaugaagaaaguguggaggagaccugcuagguggugacuggaaaauacccaaauuucauuacuaauuagaauaugguaaacuggagggggggggaaauggccugguacgggauuguugaggcuguggaauguagagauuugaauggcauagugggaaaacagcagaacuuaauucaguguucaugugcuugugugcaaagcacaagagaagaaagaacguuugcuccguaguuuuaccacgugacaaggugcugucuguauguugguagauugaguuuaacaugaacuuuuguccuuugcauucuuaagcaccuuaacuguacauggguaguauuuauauaaacugaaauggcaagcuuuuauuuugugcuaucacaugauaauugucuuagguuuuuuuggggggggcugugcuuauugguuaguaaagaaauaugaaucuaugucuuagaacauggagacaaaauugcugacuguucuuguacuaaucccuagaguuguggguacuguuaaaaguaugucaucuuccucugucuuaagagcagaaaggcuugcccuuuuccuuuuggaaccauucaauaguggaucauugagccugugccaucccacaccccagcagcaugguaauaacacaccccagcagcaugguaauagaccugugcuugcucacuccuuuagagagagcuaaguggcuucuaacagucacauccuuucacugugcaaaucuucuccuugggagaaccgacacuagugaguuuucaaaaagugagcuggggagugggggugggguagaccauucugaguuuuuuguuuguuuuggaggagcugaauguucauccuuaagaauuagccauuccugccaucucauucauuaccugaagucauaauuuucucuuugacaucucuuaauuaguuuuggaaacaauuaugucacagauggagacauucaugaccagcucugaagcaaagaguauaggauaaauggaagucugagucaugcaugcaguuagcaaagugcuggcagcacuuggagauagccagccucuggcuuugucuuucaaaaaaaaagaaacucuuauuuuguuuuugucauuaaaaaaguuuuuuaucauguagccugggcucacaaacauguauuucuaccuaaccccaggaaagcccuacuccccuuuuaaaaagcuuuauguguauugaguguuugccuucauguauguguguguguguguguguguguguguguguguguguguaucugugugucuggugucuagaaaggucagaagagggagguagggccccuugucacuggaguuaaaacugacucugccaccauacggugcugggaagcaaacccagauuccccaaaagagucacaagugaguguuacuaaauguuugaacuaucuuuccaaucccaagaccuugcuucuuuuuaaauucuguaucuguaugugugugugagugcaggugccugcagagacuagagucagauacccuuggaguugaaagcacaagccgccugauguggaugcugggaacugaacucaaguccugagccaucucuucauccuuccucuccauggaccaguuuuaauaaugaugaagacuggcggagcauuugaccuccuguuuuacucccaggagcguggccuuuuccauauguuaaauuagucuuauuacuguuguuguguuuuguaaguguuguauuuauugugaaacuaacaguuguaauaaauuuuacuaauuauauuuaauaggauaaauuagaaauuaagagauauaucuuuaaauauagacaacaaaauaagucuaaggcugagaagcugacucaggagguaaaaugcuuacuucacaagcaugaaguucugaacugaaaucccuagcauccauguaaaaagcuagaucuggugccauauggcuauaacccuagcucugauccuggagacuugcuaaccagcuagucgagccaucgagcuccagguucagcaagagacccugccucaaaaaacagagugaagaaccauaaaggaggacauacaccaucagccuccagccuccacaugggcgcacaggcgugcacacacuaaaaauauuuguaagaucucauuuuauaaauaugaaauaucuccguuuuuaaguguaguuccugcaagacauuaauaguugacagguuugacugaagacaacagguuuuauuauaauuuacacaguugcuacucuccaguaagucuaaaaagagacuuauaguagaacucuaaauauucuuuacuaucaauauuaaaugccauaaauugaguuucagauaaguguucauuuucagcuacuuuugauaugacuuuaauugauaguauguuuuuuaccuaauagaucucgaaaaguuuuuuuaauuguauacucuuuuccccccaaaaaaaguuguaccacauuauacaguuuauacauaccacaguauaaucuauacuaagaaaaauguacaucauacaaaaauuuuaacaaauaagauaaaaugaaaaauuuuuuuuaaauuuuuaucugugugaugaugcucuuauauucuagaugucacugaggucuagaccauuuagaaaacuuccucauugacugaacugucuugguaaccacucaucuccagugacuguguauuaggggaggugggggaaaccuucccaauguuucaaguuguggguaguauuugauuaggagaaaccgaguacuugcuggucuugcugugcauagauuucccauugagaaguacauauuuauuucacuaaagaauuucagaacaacgcuaaaaucauacugucuuccuucccuacucccaccaccacccucuuuggggaaagggguuguuuuuuauuucuuugcuaaaauacuacuggauauuuuaccagugccauguaacuguuaagacauuuugcagauguugaaccugagguucuaaaagauaguuuaguacaucuagguuuaggccaguuuaaacaguauuauuuucacuauuaguaauuuaaauucaagugaaauuuuugaaaaaaaaaaaacuaaauauguuugcaguuaacauuuucuagggauauaggccagugguagaggauuuaccuaccauuggugagaugagaaagaagagaagaagaaagagauccuguuuuaggaaacaccaaauaaguacuuaaaucaugauuaaaacugccauuuuguuuuguuuuguuuuggaaauuuuaaaaguguuuuucuuugugaaggcuucuggcuauguaguccuaggcuagcuuccugccucagcuuuuaaguuaagauaccacuaguuacuauauagagauuugcaaaaugcgauauggugauuaauaaaggcuuuuaaacuacuuuuuuuuuuuuauuccaggcuugcuuccagucagacuuaagaucucucucccagccuuaugagugcuaggauuacaagcauauuaucauacccagacaauuuucuaauacuagaauuagcaagcucaacuaaguuaaauauaugcauagcauaaugcuguuugaauaguugucuguggccuauuuugagaaguuuuguuauuauucacccuuuagacucuuuaaugcaaguuuuuuaaguuaaauauucagaaugugugguuauuggcuuucuaguaagcagaagacuacaaaucacugcauguaaggaaagccuuauuugaccucacauaguagcuagaaauaguaaggcuuagcuguaaaagaauaaagagaauuuguuacugauacuugcagaugcaguuggagcuagacaugaaggauuuugucaugagcaguguucccucuuauaccacgccucaccuuugccuucucuaaccuaauguuaacuuacccauuguugccugugacuugggauaaauccuuuacgccuccauuuuuuccuauuuggagaaaaccuguucagguucuguucugacuagccccaaaccuacuuugugcugugagggugaaauuugagaugccauuaguauacauuuauuguguaauuuaaaguauacagacaaauucuauaagaaauaagguaaaauuuuuugaaaguuuguaguauguacuucuagcaaaagguuaagcuagucuuaaagagaaucauuuauagauaacugauuacaccuaaaauuuguauuguuuuguuuuguuuuuggguggugcuagagaucuaacccaggacccccaugugugcuagacaagguucucuaccacugagcuacaucccuagccugguaauucugaaauuuucuaaaggguauaaacauaagaucuuuagcauggaaaacugucuuauauuugaacucuucucuaacauacuuaagagggaauuuuagaaucaauaguugaggagagcaaagaugguccacaaggaccaggguucauauccuacauuggucagcucacaaaugccugaauuccagcuacaagacauccugcgcccucuacaggccuacuugagccccuauaacacacaaacaugugcaaacacacaaauaauaaaaauacaucaaaaaauuacuagucuguagcuuugagcaguucuuuggggaggguuuaucaucauuuuuuuuaacuuuauacaauucuaacuuguaaaugcauagaacuagaauauuucauggggcucauaaucuaaacuuuauccagaaaaaaacccuaaagucauguagaaguaaacuagauuucagaucaccaguuagaguaacuccauauuugaguuuauaacacuuuuaacaucuuuuacaauguaaauguuucucuuuagguguuaggcauuuaaugcaugugugcacauguaugcaggugugcauauuuacaaaagccugagaaggaucuuagaugucuuccccuaccaacucuuuuauuuuugugagaccgcgucuccuacugagccugcacuccccauuuuugguuaggcuggcugacuuaaggaagcugagauucaccugucuccgugccacaacagcguuaccuggcugcuuuuguggaucuggggauuccuugcauacagacugagcauagagauacucucuuuuuagacucagcuaauguucauuagacaucaagauauaauguugaaauugaguucuuauaaugugaaaggaacuuuauaaaaaucaaauaauauggcuccucuuguuaacuguacuuaacuauauuacaaagcaugugaaauaguguuguuuuuagaggaaaagaauaaagagcagugaaaagagugugaaacuaagauccuuugcgucuaagaucuaacacagcagcuaaaaugcccucaagucaccaaaggaccugcuaugaagaguaggugaaaauguguguaggagagaaguuuuagaaaaguggagugcuggccgggcagugguggcgcacaccuuuaauccuagcacuugggaggcagaggcagguggauuucugcguucaaggccagccuggucuacagagugaguuccaggacagacagggcuacacagagaaacccugucucaaaaagaaaacuggaguucuuuacaaauccugacuguuucaaagcuacuuccagccucccugguaccagaugaguuugcucaugaaacguugguaagaaacaguggagggaugaggauugguucuaaagcugaaucauguggguuaggauuagcuucgagagggaaggacgacagggaugagccuagggccuucaacaugacaagcauaucagcuauauaacccauucgaguaagcuuuuuauuacuaaugagggaaacuuuuuaauacuacuaauuccucucacaugacaaagagguaaauagaggcuucaugaccuguuuuuaaguucacuaacugauucaugauaguuuguccacaugugacguucugauuguuccaguggguuuguuguuguuguuauuuuuauuuuuuuaauguauauugguguuuugacugcauuuaugucucuauaaggaugucagauccccuggaacaggaguuacagacaauugugagcugccaugugaggucugguuuucuggaagagcagccagcucuuaacugcugagccaucucuccagccccuguuccaauuguaauuuauuugaacuagauuguaaauuauuuccaugugguagcugugacacugaguuaaucuacuguuuguguaugugcuuguguuucauacugauguacuuccuugugaaagccaaaggucagccaugggugucguuucucagggacaacuaguuugguuugguguugaagaagagagauagggagggacggggagggcgggagauggggaggggaggggaggaagaggagagagugccugcuugcacauaguaaagcuagaagagcaucaaacccucuggaauuggaaugacaguugguuuaaaaugacuaaugugaauguuagaaaccaaacuaggguccucugggacagcugcaaguacucucuuaaccccagugccagcucuccagucccccagcuuguuuuuugaugcagucucuccuuggccuggagcugcucagacuaggcuggcaggaccacacccccagggaucugucugcucugagauuacaggugcacaccaacacaucuggcuuuuuauguagguuuugaggagugaacucaguuccucuuacuuaccauuagcugucuucccaucccuguuugauaaacuuaaagccauacacaaaauuucuauuuuucaaaguuccauuguguuaauugggagagagagguauguaugcuuggaaggaaucccaagcuauuuaagaaaauagcugaacaaaaaaugaacagaaacugcacacguuuaugagaugagagagacugaaaauaauuagguuuugccacuuaaugcuaggaguaaaaugaauuuacuucaagaccaauaaauucuauuuuucuugaagauaaugugagcuauucacauuaucuuuucuucccauuuuuauuuaaagaaugucugcauaauuucccaguguuugcagaggacuaccagaaguuaaaaugggcaugguuuugagauuugucuuuaagggcuuaaguuuucuuaacucacuauauacauaugcacacuacauuaauuuauuaaauaauuggaaaguauagugaguguaauuucugaaaaacaaacuuguuuuaaaaaagaucaggaacaccaaaugcccuagacagcaaacccaggugguucugggaggccuuguccugagcacugucacucucuccuuuuucugccgauuguuguaagggcauuucaucucaacgaaccaucuucccccaaaucuuuccuaccugcaagauugcgucccagucugcaauuggagaugacucccuccccauucugucaccugaagauaucaaaaugcuguacuaguuuuaauauccccagggcaccaguuuccugcuuuugcacuuccucccuacuugacaaaacuucuuuaaagccucuucaaaauaccuuugaaguuggccugugcuuacauguugaggacagaggucaguguuagcuuuuugucuuuagccacucucuaccuuaucuucugagacaagaucucucagugaaccuggagcucacugauucaucuagauuagcuucacuagguagccuuagggauccuaacugagguucgcguguauguagcaagcucuucaccauccaucuccuggcccuugaagccuuucauauauuauguauuuuaaagugauaauccuuuugugugcucccacugcuuuggaaccuguuccuuaaguagcuauuguuccuuaaaguaacuauuaauugcaucucuuggacaugaacuccuugaaauuggaaaugaccauguuucuuauuguacuuuuuagggggugggggaggggaagacauucgaguggauaaacucagucauuaagcugaacuaaaaaaguucaggauuaguaaaaugcucuuggagccuaagaagugauuuagauagaaauaucuugacggacacaguccagucaagccuagacagauccagaagggacagaucucccaucuuuauauaagaguccuuacaaauacuuagcuuauaguauguuuuuuuuuuccuauuugaucaauaacacuauccuuuuucaguguuuuuauaaaucuccaaaccaaaaaaaaaaaaaaaaauuaguuuccacagccuggcaguggugguacaugccuuuaaucccagcacucagaaggcagaggcaggcggauuucugaauucgaggccagccuggucuacaaaguucuacaaaacaaaaaacaaaacaaaaaaacaacaacaacaaaaaauuaguuuccacugauagaucuccaaaccucucccuagccaaaggccauuugauuaauauuccuaaauugaguuuaaaauucuaaugagccaauacaucuuucaaaaugugggaacuuggaagaauggaaggagugauauaauuagcagaauaaccccacacauccaaagauuuuuaacccuaacccaccaucaccacaaaagaagcaauugaaauguuugcuucacuaggcauguugcaggugugcuuaaagacaugggcuuaccuuugugaaggauagcuaggauuaucugguaagcccacuugugaucacaggaaucccuaaaaguagaaaacgucccagcuuggugugagcucaggcuaaggaagagagaugagaagcuugacugcugguucugaagacaaagaagaauuaaaagccaaggaauguagaugguucuagaacuacaaacacgugaauucugccaccaaccgaaaucuacaaguaaacauaaccuccuuagagcuuccagaaaacaaaacagucuuacuacugcuuuuauuuuaaccuuguugugagaguucuguggauggauggauggauggauggauggauggauggauggauggauagauagauagauagauagauagauagauagauagauagauagauagauagauagauagauauuguaugguaauuagcaguagcauuggaaaacuauagcagagcuaaagagguggcucaguggguaggagcuccugcuguauaaacauagggaccugaguagacuccaacacucauaaaaaccuuggcuuggccaccagccuaacuccugguucagugagaccucgucuuaaaggaagaaggucaaauuuuauagagcaggacauuggauauacacacacacaugcaugcaggagaaaggggggaacuaaagcaagucaaagaaucugagcuguauguaauugaaugaacuaaaaacaaaccuuguuaauacaggauucacaaugucuuguagaauacuagauuagaauacaguacaggcauauuuuugucagcucucacagggcagagauuauagagcccuuaaaggcuuaagaauuaucucaguuucugugggucagaaaucuguguguggugucucuugguucucugucucagaguuaaaucaagguguucagcuagagguguaguauccucauaugggguacauauccucuccuaccugagguugcuggcagauuuuaguuggaaaaugggggucucuaucguccgggucucaguuccagaauacaguuccuugccaucgucaccauaggcaauucacagcauggauuguuugcuuucuuccacaugagcucauuucuaacuugucuaaaauaagaacucaagauuaggucagaaccucccuaguaaucaggauaaucucuccauuuaaaagugaacugagucagguuugguaguacaugccuuuaaucccagcauucugaaagcagaggccagacugggccacauagugaguuccagggcagucugagccucugucucagaaaaacaacaaaauuaagcugauuuaaggcauaauuuuacaucucuaaaaucucuuuucaggaguaccuaaaucugugucuaacuccaggcaagaauauucucuccuaacuggccaggagcuugcuauuuaguccaagcuggccucaagcucaaaaacccaccugucucugguaugaacccacuacacauagucaaaaagccagaaaucuugaggcagagaaucaucuuagaauucuguauucaggcaaagccuguggcauguagaugguucuagcacuccagagucugagagguugaggcuaggcugggcugaguacuggaaugcuccaucacagaaacugggcugcccacaauguauugacuguaccuucuuugagggaaggcucugcaacucgcaguaguuucauuuuucuuaacuaucgacuccaccaguagucacauaaacaaugguucaauucuuuacauacacuacuuuuucucuuucuuuuugugcaggugucuggaguucacaucaaguauuaggguaugucucaggaacuguccaccuuauuuuuugagaccuuugggccagucuagcuugacugcccaacaaacccagccauccuccuguuucugccccuccaggcacuaggauuaaacuugcaugccaccaugcuuggcuguuuacuggggaucuaacucagguccucaugcuauaacaagcucuuuacuaauugagcuaucuuccuagcccccuauaauggcucuccuccuccuccucuucuucuuccuccuccuccuccuccuccucuucuucuucuucuucuuuaaauuggaaaauauauagauggccaucuguucuuuucuaucaccaucuaaauaagccaccgguuuaagaacagaagcaaacagucuuuguacagucuugcucuagauaucuacaguaucuuucagauaacuagaaaaaaauucaccuucauagauauauuuagacucuggccucuaagaguuagauuauaugaccauagagcagccuucuguaaaugggcucuuuagcccagcuccucuuggugacacucuccuuccuuuucacuccaguccuuuguugaaaauacaucaucucaugcuucuuggaacuaggugaucuucaaaacauccaaaucuaaugaugguaacccauaccaaaaaggauauuuuauauugcagcccaucauacacguguuccacugaaaccaugggaauacacaagaaccaggguucuguugauuaguuuuuaaguguacuuaaaacacaacaaaguuuacuucaacugauaguuugaaaacugaguuuccuccucuuccaacuccaguccgaacaagagagccacccuuucuuuggaagaggucucuuaaccuugagaauugagauagaaugucuugcauauaccaaggagagagaggacaaguuggaggguuuuaacucgaaacagcccuugauagaaagggaaaauggguuauaugccaacuagguaagcuguaggcuuuauuucagggaauuuacuucaaauuaaguugaaauuacagcucugaaauuuguaguacuguaguucuugaaccauaaccugauccagguuucugcccuguaugcugggcaagcacucuccagcuaagcuaugcucccagcucuccacaguagaucuguagaaagaugucuuccucucuugguggauacuaacuaguaaacauggaaaggagauaagccuaaacucuggauaaugcuuugcccuuaauugcccaugauuuucugcuggaugagccauggcugccuguuacuaggaaugaguuaagggauuguuuuuucuucauuuuauguguguguuauauacucauguguaugcaggagccuuauuuagauaccaucucuccuguuagcacuaggguuacaaauacaccugugguggcuuuucacauggcucuagggauuugaacuuggucuuaaugcuuguacaucaaagggcucuuagccacuaaaacaugucuggagcccaagaaugagauuuuaggaggcugccuucuuacagagcuguauagcccggaguguagacuauucuuaacuaaaugauacucugaauauagaauauauaaccaguuaguauuuuaccuuucagauuuucuuagguaucuaugucauugcaugcuauccagcgaaugugaucuccguucuuagucgccccacacacuccauagcaccuacuaugaggaagauuugacuguauaaagagacagaagauuugcugugaucacauaguucauuuuauuguaaaguaaaaacaaaucuuuuuacuuuuacucaaaaguaaccaguaaccaauacccauuuuauuuuaaugugguugaguacauguagucuuaccauagcacuuaaaacguuuucauguuucacaguaguguaaauuuuacuugugauuucuugauagaacacccuccuccugauaacccuacugaacuaacugcuucucuuaagguucugguuggggcuuacaguuaggagugaggguuguuuucuuuuuaccuaacaguauaguucuuaaauucugcuuguucuuuuaaacuauguaacuagcaauaagauuucugaaaguauaaaauaaaggaaaaaauaauaauuuuaggggaagaauugcuucaucuugaugcuugaauacauuuuguuuucagagaaccugacucuggguuuucaugguaaugucccuaagaccuacagugaaaaggcucuuucuuugucauuuccaugguuuguuggaaggaggaggaggaucucagucaguuugugguuaggauucagaaguuccauggugggcuaaguugcuucaaguaugcugugauauuuaaauuuuaauauuuaaauaugcaggagacccuuguguucauuccuuagcacuauacacacgcacacgcacaaccagaaacaaaauuaaauuuuaguccuuucacuaugggugagauuagcaauaugggaccagaagauugaagucuugaaagcuaaggauuaaaggguccaaaauaacauauagcaaagcuccaauguucuaauacugaaaauuagcaccguuccuuuccauaaauguuacauggcaacucuguaauccaugaagacagacauagccagagaaggagcaucagugaggaccaggcaccuaaaccaaaacuagacaguaauuaggauucaagcugggauuagagaggggagaguucagucaugggacaagggagcaugaauaugccguagguugaaguauauaugacagaguuuaaaagaguggaagaaauggcuauagaguaaaaguagaaagucaggaaccagcuaaaauacacuaugcaaagaagugacuguauaacccaugcuauauugagaaagcaucaucuuacuaaacagaauaccaagaaauaacuugccaccaggaaaggcuggagacauuugaaguuguauauauguacuguaggcaugugggcucaagauuauguaucuaaaaagccuuaguuuuagcuuaacuauuagugauuuguuggacaagaaaggaaagcaaaaaagccugcccagauuguggcuacuaucuucaguugcaccuccuuuauguuuuugaggaaauaauugcaugauguagucaugaaaauaaauuuauccuguguaucugcuuguugcuucuuugaaaacuguaacuccagagauuuaagccauaguuuugguuuuugacaguuuggagaccuaaguuaagaauuagggaaaauuaacugucucccauguuuuauuuuaacuuagguacaguuggagguugggacuaaagcaucuaguuuggguuuggagcugguguuccucuagccaucuuccaugagucuucaauauuuguuuguuuguuuuuuuaaucgaucaagaacuuuacaauaggcaaaaauuauuuuacauuacuuuuuuuaauccuaugcuuuugugguugucucccgggaauuuaacuggagccgaagaaagauagccacuagccaugaacauuauuaucaauagaauuuuacaaaggagucauguuaaagcaauaaaauaaaucaagugaaauuuguagaguaugugaaaauuaaaaauucuuagacuaugaaaagaccauagauuucuacaucacaugaccuuaucucuggcuuuguuaguauuuuucuugccaccaauuuaucuuugcaaaguaaaaaauuguuaguuauuauaaaacucaccccuacugguuuauauuuuaccuauagacuauuuuguacaucuuuucaauguauggcugagagagaacuagacuucugaguuguaaccucucaggagggguucccacucuuccaaaagagugaaugccagacaagcacaucucuuccaucucuaguaguagugcauggaauuaggggaugucagcauuaaauguuaaguuaugaggaagaaacuauaaacaacuguacacuaaagagcauuucuagagcuuuacuuaguuugccuuuacaaauauuuuuaaaguagauacugauucugaaauguuuucuuuuaacagguuguaaaauuaaagcacugagagccaagacaaacacguauaucaagacaccuguucguggugaagaacccauuuuuguugucacuggacggaaagaagauguugccauggccaaaagagaaauccucucggcugcagagcacuuuucuaugauucgugcaucucgaaacaaaaaugguccugcacuaggaggguuaucguguaguccuaaucugccuggucaaaccacaguccaagucaggguccccuaucgugugguagggcuagugguuggaccaaaaggagcaacaauuaagagaauucagcaacagacccacacguacauaguuacuccgagcagagauaaggagccagucuuugaagucacagggaugcccgaaaauguugaucgagcacgagaagagauagaaaugcauaucgccaugcguaccggaaacuacauagagcucaaugaagaaaaugauuuccauuauaacgguaccgaugugagcuuugaagguggcacucuuggcucugcauggcucucuuccaauccaguuccuccaagccgagcaagaaugaugucuaacuaucgcaaugauaguucuagcucucuaggaaguggcuccacugauuccuauuuugggagcaauaggcuagcugacuuuaguccaacaagcccauuuagcacagggaacuuuugguuuggagauacacuaccaucuguaggcucagaagaucuuacaguagacucuccugccuuugacucuuuaccaacaucugcucaaacuaucuggacuccauuugaaccaguuaacccacucucuggcuuugggagugauccuucugguaacaugaagacucagcguagaggaagucagccaucaacuccucgucugucuccuacauuuccugagagcauagaacacccacuugcucgaagggugaggagugacccaccuaguacaggcaaccauguuggccuuccaauauacaucccugcuuuuucuaaugguaccaauaguuacuccucuuccaauggugguuccaccucuagcucaccuccagaaucaagaagaaagcacgacugugugauuugcuuugagaaugaaguuauugcugcccuaguuccauguggccacaaccucuucugcauggaaugugccaacaagaucugugaaaagagaacgccgucauguccaguuugccagacagcuguuacucaggcaauccaaauucacucuuaacuauauauauauacauaaauacuauaucucuauauggacucauaaaggcauggguauaaugguacccccaguaaacuuccuaaugaauucuuaugacuguuaucaggcuuuauugggauuaggcuaaaguuguuaguacacuuauaaaaggcugcuaugguaacacuaaccuaaguggucucuugucuauuaguuugguuugaauuauuaauacuaucuuguagacucagagacauagcuuguauaggaauuguuaaaguggaaguuguacuuggcuguguaaccuaagagcaaaauguauccaucugagauuguagucagugggucccagagccuagccgcacuaagaguuuauggagggugccuggcaucucagaugacugacacuuccagugcugccuucuucacacugccaguuuugacaaaaacagguuuguuuuuuuauuuuacaacaacuucugccuaauucugcaggauugcaaguaacuuuuuaaagcauugauuacuuacuaguaauaauagggcugauggcaguuuacuagaucacugguuauaauuugggacaaaaacugcuacauugacucucaucucgcccagagugcucaaggcugguauguucaguggaucaggaauacaguugucuuugauugugaauuccuacccauugccucucucagugaauguggaaauggccgccuggguuuucccauuucaggaugggcuuuuggaagcaccuauauuggcugaaaauuugagaaugcgaacauuccauucauuagucugaucaagcuauuaauuaauauuuagacuguagcucaaaaugugaaacauuuuuuguucaauccauauuugucuugcacauuauaaauauauuuuuauuuuuuaguaauguaggggauggggagggagauaauaaugcccuuggcaugauucaugaaagcagcugugacaaccuccaaucaguuuacuucauuucaaaccuauuuccaaucacaaggaaagauuucuuuaagacacacuuguacauuucaccuguggauguuuuaacgucauccucaguauguccccaaauuugcugguauggaaaggacaaaacauuauagugguggguuuuucuacuaauuauuuuuugaagcguuauuuucccaacacaaaagagcuuuuuuucucaguauaacaaaaauugaaaucuuauguguauucaauaguaaauagacaaaauuuuauuuuuuauuuccacuugaagaguuacauuucguauaaaguuuacaaauaacgguuuuuauuuugauuuuuuucaguauaaaaaaguugccuugauggcauauuaugauguaaugcuaacugcuuguaggauaguugauugucaguauugaauccuaaucucuagcugccgucuuguagauauggacgaaugccaccaagcauguguuuccuauuuuguugcaucguacacugcaacuaauaagccaaggaaucgacauauauuaggugcguguacuguuucuaaaaaccacaaacuaagaaugauaaauuaucaauauaguuuaguauuugcuaauuuuacuacacucuuuuguuauguauauguagggaagucauagggauuauaaauucaauuugaguaaaguuuaaaaccauauauuuuaugauaaagggccuuuaacuuaagauggccaaagcacugauauuauauauuugcuguaaagagaauuauaagaguuuuauuuuucugauauuaaaaguuacuuaauaaagacuuguuuccauuaacuugaaugua

SEQ ID NO: 8978 - RNA, 19876 nt, Mus musculus
uacauucaaguuaauggaaacaagucuuuauuaaguaacuuuuaauaucagaaaaauaaaacucuuauaauucucuuuacagcaaauauauaauaucagugcuuuggccaucuuaaguuaaaggcccuuuaucauaaaauauaugguuuuaaacuuuacucaaauugaauuuauaaucccuaugacuucccuacauauacauaacaaaagaguguaguaaaauuagcaaauacuaaacuauauugauaauuuaucauucuuaguuugugguuuuuagaaacaguacacgcaccuaauauaugucgauuccuuggcuuauuaguugcaguguacgaugcaacaaaauaggaaacacaugcuugguggcauucguccauaucuacaagacggcagcuagagauuaggauucaauacugacaaucaacuauccuacaagcaguuagcauuacaucauaauaugccaucaaggcaacuuuuuuauacugaaaaaaaucaaaauaaaaaccguuauuuguaaacuuuauacgaaauguaacucuucaaguggaaauaaaaaauaaaauuuugucuauuuacuauugaauacacauaagauuucaauuuuuguuauacugagaaaaaaagcucuuuuguguugggaaaauaacgcuucaaaaaauaauuaguagaaaaacccaccacuauaauguuuuguccuuuccauaccagcaaauuuggggacauacugaggaugacguuaaaacauccacaggugaaauguacaagugugucuuaaagaaaucuuuccuugugauuggaaauagguuugaaaugaaguaaacugauuggagguugucacagcugcuuucaugaaucaugccaagggcauuauuaucucccuccccauccccuacauuacuaaaaaauaaaaauauauuuauaaugugcaagacaaauauggauugaacaaaaaauguuucacauuuugagcuacagucuaaauauuaauuaauagcuugaucagacuaaugaauggaauguucgcauucucaaauuuucagccaauauaggugcuuccaaaagcccauccugaaaugggaaaacccaggcggccauuuccacauucacugagagaggcaauggguaggaauucacaaucaaagacaacuguauuccugauccacugaacauaccagccuugagcacucugggcgagaugagagucaauguagcaguuuuugucccaaauuauaaccagugaucuaguaaacugccaucagcccuauuauuacuaguaaguaaucaaugcuuuaaaaaguuacuugcaauccugcagaauuaggcagaaguuguuguaaaauaaaaaaacaaaccuguuuuugucaaaacuggcagugugaagaaggcagcacuggaagugucagucaucugagaugccaggcacccuccauaaacucuuagugcggcuaggcucugggacccacugacuacaaucucagauggauacauuuugcucuuagguuacacagccaaguacaacuuccacuuuaacaauuccuauacaagcuaugucucugagucuacaagauaguauuaauaauucaaaccaaacuaauagacaagagaccacuuagguuaguguuaccauagcagccuuuuauaaguguacuaacaacuuuagccuaaucccaauaaagccugauaacagucauaagaauucauuaggaaguuuacuggggguaccauuauacccaugccuuuaugaguccauauagagauauaguauuuauguauauauauauaguuaagagugaauuuggauugccugaguaacagcugucuggcaaacuggacaugacggcguucucuuuucacagaucuuguuggcacauuccaugcagaagagguuguggccacauggaacuagggcagcaauaacuucauucucaaagcaaaucacacagucgugcuuucuucuugauucuggaggugagcuagagguggaaccaccauuggaagaggaguaacuauugguaccauuagaaaaagcagggauguauauuggaaggccaacaugguugccuguacuaggugggucacuccucacccuucgagcaaguggguguucuaugcucucaggaaauguaggagacagacgaggaguugauggcugacuuccucuacgcugagucuucauguuaccagaaggaucacucccaaagccagagaguggguuaacugguucaaauggaguccagauaguuugagcagauguugguaaagagucaaaggcaggagagucuacuguaagaucuucugagccuacagaugguaguguaucuccaaaccaaaaguucccugugcuaaaugggcuuguuggacuaaagucagcuagccuauugcucccaaaauaggaaucaguggagccacuuccuagagagcuagaacuaucauugcgauaguuagacaucauucuugcucggcuuggaggaacuggauuggaagagagccaugcagagccaagagugccaccuucaaagcucacaucgguaccguuauaauggaaaucauuuucuucauugagcucuauguaguuuccgguacgcauggcgauaugcauuucuaucucuucucgugcucgaucaacauuuucgggcaucccugugacuucaaagacuggcuccuuaucucugcucggaguaacuauguacgugugggucuguugcugaauucucuuaauuguugcuccuuuugguccaaccacuagcccuaccacacgauaggggacccugacuuggacugugguuugaccaggcagauuaggacuacacgauaacccuccuagugcaggaccauuuuuguuucgagaugcacgaaucauagaaaagugcucugcagccgagaggauuucucuuuuggccauggcaacaucuucuuuccguccagugacaacaaaaauggguucuucaccacgaacaggugucuugauauacguguuugucuuggcucucagugcuuuaauuuuacaaccuguuaaaagaaaacauuucagaaucaguaucuacuuuaaaaauauuuguaaaggcaaacuaaguaaagcucuagaaaugcucuuuaguguacaguuguuuauaguuucuuccucauaacuuaacauuuaaugcugacauccccuaauuccaugcacuacuacuagagauggaagagaugugcuugucuggcauucacucuuuuggaagagugggaaccccuccugagagguuacaacucagaagucuaguucucucucagccauacauugaaaagauguacaaaauagucuauagguaaaauauaaaccaguaggggugaguuuuauaauaacuaacaauuuuuuacuuugcaaagauaaauugguggcaagaaaaauacuaacaaagccagagauaaggucaugugauguagaaaucuauggucuuuucauagucuaagaauuuuuaauuuucacauacucuacaaauuucacuugauuuauuuuauugcuuuaacaugacuccuuuguaaaauucuauugauaauaauguucauggcuaguggcuaucuuucuucggcuccaguuaaauucccgggagacaaccacaaaagcauaggauuaaaaaaaguaauguaaaauaauuuuugccuauuguaaaguucuugaucgauuaaaaaaacaaacaaacaaauauugaagacucauggaagauggcuagaggaacaccagcuccaaacccaaacuagaugcuuuagucccaaccuccaacuguaccuaaguuaaaauaaaacaugggagacaguuaauuuucccuaauucuuaacuuaggucuccaaacugucaaaaaccaaaacuauggcuuaaaucucuggaguuacaguuuucaaagaagcaacaagcagauacacaggauaaauuuauuuucaugacuacaucaugcaauuauuuccucaaaaacauaaaggaggugcaacugaagauaguagccacaaucugggcaggcuuuuuugcuuuccuuucuuguccaacaaaucacuaauaguuaagcuaaaacuaaggcuuuuuagauacauaaucuugagcccacaugccuacaguacauauauacaacuucaaaugucuccagccuuuccugguggcaaguuauuucuugguauucuguuuaguaagaugaugcuuucucaauauagcauggguuauacagucacuucuuugcauaguguauuuuagcugguuccugacuuucuacuuuuacucuauagccauuucuuccacucuuuuaaacucugucauauauacuucaaccuacggcauauucaugcucccuugucccaugacugaacucuccccucucuaaucccagcuugaauccuaauuacugucuaguuuugguuuaggugccugguccucacugaugcuccuucucuggcuaugucugucuucauggauuacagaguugccauguaacauuuauggaaaggaacggugcuaauuuucaguauuagaacauuggagcuuugcuauauguuauuuuggacccuuuaauccuuagcuuucaagacuucaaucuucuggucccauauugcuaaucucacccauagugaaaggacuaaaauuuaauuuuguuucugguugugcgugugcguguguauagugcuaaggaaugaacacaagggucuccugcauauuuaaauauuaaaauuuaaauaucacagcauacuugaagcaacuuagcccaccauggaacuucugaauccuaaccacaaacugacugagauccuccuccuccuuccaacaaaccauggaaaugacaaagaaagagccuuuucacuguaggucuuagggacauuaccaugaaaacccagagucagguucucugaaaacaaaauguauucaagcaucaagaugaagcaauucuuccccuaaaauuauuauuuuuuccuuuauuuuauacuuucagaaaucuuauugcuaguuacauaguuuaaaagaacaagcagaauuuaagaacuauacuguuagguaaaaagaaaacaacccucacuccuaacuguaagccccaaccagaaccuuaagagaagcaguuaguucaguaggguuaucaggaggaggguguucuaucaagaaaucacaaguaaaauuuacacuacugugaaacaugaaaacguuuuaagugcuaugguaagacuacauguacucaaccacauuaaaauaaaauggguauugguuacugguuacuuuugaguaaaaguaaaaagauuuguuuuuacuuuacaauaaaaugaacuaugugaucacagcaaaucuucugucucuuuauacagucaaaucuuccucauaguaggugcuauggaguguguggggcgacuaagaacggagaucacauucgcuggauagcaugcaaugacauagauaccuaagaaaaucugaaagguaaaauacuaacugguuauauauucuauauucagaguaucauuuaguuaagaauagucuacacuccgggcuauacagcucuguaagaaggcagccuccuaaaaucucauucuugggcuccagacauguuuuaguggcuaagagcccuuugauguacaagcauuaagaccaaguucaaaucccuagagccaugugaaaagccaccacagguguauuuguaacccuagugcuaacaggagagaugguaucuaaauaaggcuccugcauacacaugaguauauaacacacacauaaaaugaagaaaaaacaaucccuuaacucauuccuaguaacaggcagccauggcucauccagcagaaaaucaugggcaauuaagggcaaagcauuauccagaguuuaggcuuaucuccuuuccauguuuacuaguuaguauccaccaagagaggaagacaucuuucuacagaucuacuguggagagcugggagcauagcuuagcuggagagugcuugcccagcauacagggcagaaaccuggaucagguuaugguucaagaacuacaguacuacaaauuucagagcuguaauuucaacuuaauuugaaguaaauucccugaaauaaagccuacagcuuaccuaguuggcauauaacccauuuucccuuucuaucaagggcuguuucgaguuaaaacccuccaacuuguccucucucuccuugguauaugcaagacauucuaucucaauucucaagguuaagagaccucuuccaaagaaaggguggcucucuuguucggacuggaguuggaagaggaggaaacucaguuuucaaacuaucaguugaaguaaacuuuguuguguuuuaaguacacuuaaaaacuaaucaacagaacccugguucuuguguauucccaugguuucaguggaacacguguaugaugggcugcaauauaaaauauccuuuuugguauggguuaccaucauuagauuuggauguuuugaagaucaccuaguuccaagaagcaugagaugauguauuuucaacaaaggacuggagugaaaaggaaggagagugucaccaagaggagcugggcuaaagagcccauuuacagaaggcugcucuauggucauauaaucuaacucuuagaggccagagucuaaauauaucuaugaaggugaauuuuuuucuaguuaucugaaagauacuguagauaucuagagcaagacuguacaaagacuguuugcuucuguucuuaaaccgguggcuuauuuagauggugauagaaaagaacagauggccaucuauauauuuuccaauuuaaagaagaagaagaagaagaggaggaggaggaggaggaggaagaagaagaggaggaggaggagagccauuauagggggcuaggaagauagcucaauuaguaaagagcuuguuauagcaugaggaccugaguuagauccccaguaaacagccaagcaugguggcaugcaaguuuaauccuagugccuggaggggcagaaacaggaggauggcuggguuuguugggcagucaagcuagacuggcccaaaggucucaaaaaauaagguggacaguuccugagacauacccuaauacuugaugugaacuccagacaccugcacaaaaagaaagagaaaaaguaguguauguaaagaauugaaccauuguuuaugugacuacugguggagucgauaguuaagaaaaaugaaacuacugcgaguugcagagccuucccucaaagaagguacagucaauacauugugggcagcccaguuucugugauggagcauuccaguacucagcccagccuagccucaaccucucagacucuggagugcuagaaccaucuacaugccacaggcuuugccugaauacagaauucuaagaugauucucugccucaagauuucuggcuuuuugacuauguguaguggguucauaccagagacagguggguuuuugagcuugaggccagcuuggacuaaauagcaagcuccuggccaguuaggagagaauauucuugccuggaguuagacacagauuuagguacuccugaaaagagauuuuagagauguaaaauuaugccuuaaaucagcuuaauuuuguuguuuuucugagacagaggcucagacugcccuggaacucacuauguggcccagucuggccucugcuuucagaaugcugggauuaaaggcauguacuaccaaaccugacucaguucacuuuuaaauggagagauuauccugauuacuagggagguucugaccuaaucuugaguucuuauuuuagacaaguuagaaaugagcucauguggaagaaagcaaacaauccaugcugugaauugccuauggugacgauggcaaggaacuguauucuggaacugagacccggacgauagagacccccauuuuccaacuaaaaucugccagcaaccucagguaggagaggauauguaccccauaugaggauacuacaccucuagcugaacaccuugauuuaacucugagacagagaaccaagagacaccacacacagauuucugacccacagaaacugagauaauucuuaagccuuuaagggcucuauaaucucugcccugugagagcugacaaaaauaugccuguacuguauucuaaucuaguauucuacaagacauugugaauccuguauuaacaagguuuguuuuuaguucauucaauuacauacagcucagauucuuugacuugcuuuaguuccccccuuucuccugcaugcauguguguguguauauccaauguccugcucuauaaaauuugaccuucuuccuuuaagacgaggucucacugaaccaggaguuaggcugguggccaagccaagguuuuuaugaguguuggagucuacucaggucccuauguuuauacagcaggagcuccuacccacugagccaccucuuuagcucugcuauaguuuuccaaugcuacugcuaauuaccauacaauaucuaucuaucuaucuaucuaucuaucuaucuaucuaucuaucuaucuaucuaucuaucuauccauccauccauccauccauccauccauccauccauccauccacagaacucucacaacaagguuaaaauaaaagcaguaguaagacuguuuuguuuucuggaagcucuaaggagguuauguuuacuuguagauuucgguugguggcagaauucacguguuuguaguucuagaaccaucuacauuccuuggcuuuuaauucuucuuugucuucagaaccagcagucaagcuucucaucucucuuccuuagccugagcucacaccaagcugggacguuuucuacuuuuagggauuccugugaucacaagugggcuuaccagauaauccuagcuauccuucacaaagguaagcccaugucuuuaagcacaccugcaacaugccuagugaagcaaacauuucaauugcuucuuuuguggugaugguggguuaggguuaaaaaucuuuggaugugugggguuauucugcuaauuauaucacuccuuccauucuuccaaguucccacauuuugaaagauguauuggcucauuagaauuuuaaacucaauuuaggaauauuaaucaaauggccuuuggcuagggagagguuuggagaucuaucaguggaaacuaauuuuuuguuguuguuguuuuuuuguuuuguuuuuuguuuuguagaacuuuguagaccaggcuggccucgaauucagaaauccgccugccucugccuucugagugcugggauuaaaggcauguaccaccacugccaggcuguggaaacuaauuuuuuuuuuuuuuuuugguuuggagauuuauaaaaacacugaaaaaggauaguguuauugaucaaauaggaaaaaaaaaacauacuauaagcuaaguauuuguaaggacucuuauauaaagaugggagaucugucccuucuggaucugucuaggcuugacuggacuguguccgucaagauauuucuaucuaaaucacuucuuaggcuccaagagcauuuuacuaauccugaacuuuuuuaguucagcuuaaugacugaguuuauccacucgaaugucuuccccucccccacccccuaaaaaguacaauaagaaacauggucauuuccaauuucaaggaguucauguccaagagaugcaauuaauaguuacuuuaaggaacaauagcuacuuaaggaacagguuccaaagcagugggagcacacaaaaggauuaucacuuuaaaauacauaauauaugaaaggcuucaagggccaggagauggauggugaagagcuugcuacauacacgcgaaccucaguuaggaucccuaaggcuaccuagugaagcuaaucuagaugaaucagugagcuccagguucacugagagaucuugucucagaagauaagguagagaguggcuaaagacaaaaagcuaacacugaccucuguccucaacauguaagcacaggccaacuucaaagguauuuugaagaggcuuuaaagaaguuuugucaaguagggaggaagugcaaaagcaggaaacuggugcccuggggauauuaaaacuaguacagcauuuugauaucuucaggugacagaauggggagggagucaucuccaauugcagacugggacgcaaucuugcagguaggaaagauuugggggaagaugguucguugagaugaaaugcccuuacaacaaucggcagaaaaaggagagagugacagugcucaggacaaggccucccagaaccaccuggguuugcugucuagggcauuugguguuccugaucuuuuuuaaaacaaguuuguuuuucagaaauuacacucacuauacuuuccaauuauuuaauaaauuaauguagugugcauauguauauagugaguuaagaaaacuuaagcccuuaaagacaaaucucaaaaccaugcccauuuuaacuucugguaguccucugcaaacacugggaaauuaugcagacauucuuuaaauaaaaaugggaagaaaagauaaugugaauagcucacauuaucuucaagaaaaauagaauuuauuggucuugaaguaaauucauuuuacuccuagcauuaaguggcaaaaccuaauuauuuucagucucucucaucucauaaacgugugcaguuucuguucauuuuuuguucagcuauuuucuuaaauagcuugggauuccuuccaagcauacauaccucucucucccaauuaacacaauggaacuuugaaaaauagaaauuuuguguauggcuuuaaguuuaucaaacagggaugggaagacagcuaaugguaaguaagaggaacugaguucacuccucaaaaccuacauaaaaagccagauguguuggugugcaccuguaaucucagagcagacagaucccugggggugugguccugccagccuagucugagcagcuccaggccaaggagagacugcaucaaaaaacaagcugggggacuggagagcuggcacugggguuaagagaguacuugcagcugucccagaggacccuaguuugguuucuaacauucacauuagucauuuuaaaccaacugucauuccaauuccagaggguuugaugcucuucuagcuuuacuaugugcaagcaggcacucucuccucuuccuccccuccccuccccaucucccgcccuccccgucccucccuaucucucuucuucaacaccaaaccaaacuaguugucccugagaaacgacacccauggcugaccuuuggcuuucacaaggaaguacaucaguaugaaacacaagcacauacacaaacaguagauuaacucagugucacagcuaccacauggaaauaauuuacaaucuaguucaaauaaauuacaauuggaacaggggcuggagagauggcucagcaguuaagagcuggcugcucuuccagaaaaccagaccucacauggcagcucacaauugucuguaacuccuguuccaggggaucugacauccuuauagagacauaaaugcagucaaaacaccaauauacauuaaaaaaauaaaaauaacaacaacaacaaacccacuggaacaaucagaacgucacauguggacaaacuaucaugaaucaguuagugaacuuaaaaacaggucaugaagccucuauuuaccucuuugucaugugagaggaauuaguaguauuaaaaaguuucccucauuaguaauaaaaagcuuacucgaauggguuauauagcugauaugcuugucauguugaaggcccuaggcucaucccugucguccuucccucucgaagcuaauccuaacccacaugauucagcuuuagaaccaauccucaucccuccacuguuucuuaccaacguuucaugagcaaacucaucugguaccagggaggcuggaaguagcuuugaaacagucaggauuuguaaagaacuccaguuuucuuuuugagacaggguuucucuguguagcccugucuguccuggaacucacucuguagaccaggcuggccuugaacgcagaaauccaccugccucugccucccaagugcuaggauuaaaggugugcgccaccacugcccggccagcacuccacuuuucuaaaacuucucuccuacacacauuuucaccuacucuucauagcagguccuuuggugacuugagggcauuuuagcugcuguguuagaucuuagacgcaaaggaucuuaguuucacacucuuuucacugcucuuuauucuuuuccucuaaaaacaacacuauuucacaugcuuuguaauauaguuaaguacaguuaacaagaggagccauauuauuugauuuuuauaaaguuccuuucacauuauaagaacucaauuucaacauuauaucuugaugucuaaugaacauuagcugagucuaaaaagagaguaucucuaugcucagucuguaugcaaggaauccccagauccacaaaagcagccagguaacgcuguuguggcacggagacaggugaaucucagcuuccuuaagucagccagccuaaccaaaaauggggagugcaggcucaguaggagacgcggucucacaaaaauaaaagaguugguaggggaagacaucuaagauccuucucaggcuuuuguaaauaugcacaccugcauacaugugcacacaugcauuaaaugccuaacaccuaaagagaaacauuuacauuguaaaagauguuaaaaguguuauaaacucaaauauggaguuacucuaacuggugaucugaaaucuaguuuacuucuacaugacuuuaggguuuuuuucuggauaaaguuuagauuaugagccccaugaaauauucuaguucuaugcauuuacaaguuagaauuguauaaaguuaaaaaaaaugaugauaaacccuccccaaagaacugcucaaagcuacagacuaguaauuuuuugauguauuuuuauuauuuguguguuugcacauguuuguguguuauaggggcucaaguaggccuguagagggcgcaggaugucuuguagcuggaauucaggcauuugugagcugaccaauguaggauaugaacccugguccuuguggaccaucuuugcucuccucaacuauugauucuaaaauucccucuuaaguauguuagagaagaguucaaauauaagacaguuuuccaugcuaaagaucuuauguuuauacccuuuagaaaauuucagaauuaccaggcuagggauguagcucagugguagagaaccuugucuagcacacauggggguccuggguuagaucucuagcaccacccaaaaacaaaacaaaacaauacaaauuuuagguguaaucaguuaucuauaaaugauucucuuuaagacuagcuuaaccuuuugcuagaaguacauacuacaaacuuucaaaaaauuuuaccuuauuucuuauagaauuugucuguauacuuuaaauuacacaauaaauguauacuaauggcaucucaaauuucacccucacagcacaaaguagguuuggggcuagucagaacagaaccugaacagguuuucuccaaauaggaaaaaauggaggcguaaaggauuuaucccaagucacaggcaacaauggguaaguuaacauuagguuagagaaggcaaaggugaggcgugguauaagagggaacacugcucaugacaaaauccuucaugucuagcuccaacugcaucugcaaguaucaguaacaaauucucuuuauucuuuuacagcuaagccuuacuauuucuagcuacuaugugaggucaaauaaggcuuuccuuacaugcagugauuuguagucuucugcuuacuagaaagccaauaaccacacauucugaauauuuaacuuaaaaaacuugcauuaaagagucuaaagggugaauaauaacaaaacuucucaaaauaggccacagacaacuauucaaacagcauuaugcuaugcauauauuuaacuuaguugagcuugcuaauucuaguauuagaaaauugucuggguaugauaauaugcuuguaauccuagcacucauaaggcugggagagagaucuuaagucugacuggaagcaagccuggaauaaaaaaaaaaaaguaguuuaaaagccuuuauuaaucaccauaucgcauuuugcaaaucucuauauaguaacuagugguaucuuaacuuaaaagcugaggcaggaagcuagccuaggacuacauagccagaagccuucacaaagaaaaacacuuuuaaaauuuccaaaacaaaacaaaacaaaauggcaguuuuaaucaugauuuaaguacuuauuugguguuuccuaaaacaggaucucuuucuucuucucuucuuucucaucucaccaaugguagguaaauccucuaccacuggccuauaucccuagaaaauguuaacugcaaacauauuuaguuuuuuuuuuuucaaaaauuucacuugaauuuaaauuacuaauagugaaaauaauacuguuuaaacuggccuaaaccuagauguacuaaacuaucuuuuagaaccucagguucaacaucugcaaaaugucuuaacaguuacauggcacugguaaaauauccaguaguauuuuagcaaagaaauaaaaaacaaccccuuuccccaaagagggugguggugggaguagggaaggaagacaguaugauuuuagcguuguucugaaauucuuuagugaaauaaauauguacuucucaaugggaaaucuaugcacagcaagaccagcaaguacucgguuucuccuaaucaaauacuacccacaacuugaaacauugggaagguuucccccaccuccccuaauacacagucacuggagaugagugguuaccaagacaguucagucaaugaggaaguuuucuaaauggucuagaccucagugacaucuagaauauaagagcaucaucacacagauaaaaauuuaaaaaaaauuuuucauuuuaucuuauuuguuaaaauuuuuguaugauguacauuuuucuuaguauagauuauacugugguauguauaaacuguauaaugugguacaacuuuuuuuggggggaaaagaguauacaauuaaaaaaacuuuucgagaucuauuagguaaaaaacauacuaucaauuaaagucauaucaaaaguagcugaaaaugaacacuuaucugaaacucaauuuauggcauuuaauauugauaguaaagaauauuuagaguucuacuauaagucucuuuuuagacuuacuggagaguagcaacuguguaaauuauaauaaaaccuguugucuucagucaaaccugucaacuauuaaugucuugcaggaacuacacuuaaaaacggagauauuucauauuuauaaaaugagaucuuacaaauauuuuuagugugugcacgccugugcgcccauguggaggcuggaggcugaugguguauguccuccuuuaugguucuucacucuguuuuuugaggcagggucucuugcugaaccuggagcucgauggcucgacuagcugguuagcaagucuccaggaucagagcuaggguuauagccauauggcaccagaucuagcuuuuuacauggaugcuagggauuucaguucagaacuucaugcuugugaaguaagcauuuuaccuccugagucagcuucucagccuuagacuuauuuuguugucuauauuuaaagauauaucucuuaauuucuaauuuauccuauuaaauauaauuaguaaaauuuauuacaacuguuaguuucacaauaaauacaacacuuacaaaacacaacaacaguaauaagacuaauuuaacauauggaaaaggccacgcuccugggaguaaaacaggaggucaaaugcuccgccagucuucaucauuauuaaaacugguccauggagaggaaggaugaagagauggcucaggacuugaguucaguucccagcauccacaucaggcggcuugugcuuucaacuccaaggguaucugacucuagucucugcaggcaccugcacucacacacacauacagauacagaauuuaaaaagaagcaaggucuugggauuggaaagauaguucaaacauuuaguaacacucacuugugacucuuuuggggaaucuggguuugcuucccagcaccguaugguggcagagucaguuuuaacuccagugacaaggggcccuaccucccucuucugaccuuucuagacaccagacacacagauacacacacacacacacacacacacacacacacacacacauacaugaaggcaaacacucaauacacauaaagcuuuuuaaaaggggaguagggcuuuccugggguuagguagaaauacauguuugugagcccaggcuacaugauaaaaaacuuuuuuaaugacaaaaacaaaauaagaguuucuuuuuuuuugaaagacaaagccagaggcuggcuaucuccaagugcugccagcacuuugcuaacugcaugcaugacucagacuuccauuuauccuauacucuuugcuucagagcuggucaugaaugucuccaucugugacauaauuguuuccaaaacuaauuaagagaugucaaagagaaaauuaugacuucagguaaugaaugagauggcaggaauggcuaauucuuaaggaugaacauucagcuccuccaaaacaaacaaaaaacucagaauggucuaccccacccccacuccccagcucacuuuuugaaaacucacuagugucgguucucccaaggagaagauuugcacagugaaaggaugugacuguuagaagccacuuagcucucucuaaaggagugagcaagcacaggucuauuaccaugcugcugggguguguuauuaccaugcugcuggggugugggauggcacaggcucaaugauccacuauugaaugguuccaaaaggaaaagggcaagccuuucugcucuuaagacagaggaagaugacauacuuuuaacaguacccacaacucuagggauuaguacaagaacagucagcaauuuugucuccauguucuaagacauagauucauauuucuuuacuaaccaauaagcacagccccccccaaaaaaaccuaagacaauuaucaugugauagcacaaaauaaaagcuugccauuucaguuuauauaaauacuacccauguacaguuaaggugcuuaagaaugcaaaggacaaaaguucauguuaaacucaaucuaccaacauacagacagcaccuugucacgugguaaaacuacggagcaaacguucuuucuucucuugugcuuugcacacaagcacaugaacacugaauuaaguucugcuguuuucccacuaugccauucaaaucucuacauuccacagccucaacaaucccguaccaggccauuucccccccccuccaguuuaccauauucuaauuaguaaugaaauuuggguauuuuccagucaccaccuagcaggucuccuccacacuuucuucauguuguucaauacuuguaucuuuguuugcuaaguugcauucucuauguauguucuuguguguauugccuucaaguaauuacuuucgugccauucuauuaaaugguuaguuuuuaauaaagagcagaaauucuguauaaaucaaccucaaauuuuuaguuuacuuacuuuucauaaacucauuaaccagcaaaaucaagcacucuuucaaugauauuaaaugaaaagccaccucauuauggaccuauaaauaaaaugcauuuuuauuucauguacauaaaaauuuccucaugagcuauuauccugaucagcuccuacuggcaagugagaugugaaacugauuagucaaacaguuugaaacaagcucuuucuuucuuucuuucuagguaccauauaggcuuuuuuuuuuuaaucaaaauccuagcaacgagagccaccucuuacaugugaggucaccaaucucuuauuuauguguacuuuagaccacuugggaaaaugagaucauuccaccagcagugccauauuugaccucaacaagaggcaaguuucaaccauguuguauuacagcaucagcagcagcagguaguaaaacggggcaaaaccuacaccgaagcaaacagaaccuucccuaaaaaugucggauaccaagguacucugugcauccccuucccccaccuucacaaaccuacuccuggaaucugagacauagguccuuugucugaacaaugugggaggagucugucuggggaacgggugugcuagcaagugaagaaaauuuaucgaaaacugcacuaacgcauaaaguuccuuaauuacccaaaugcccaguuuucccuucacgguacaggcuaaaguguucuaaaagacugacacuagcgcuuuuugaaaagagaaaugagaacacugagcaccuaagaucaacagaguuggggugcgcuucuaaagccaaguuucugaauagcggagggaggaggugauccggccacuugaacaucucuucccucucaaaugcugcccaugccuccaugucgguccacuucucagcacaagcagcucuaaggcaggccgauugcuuuuuaccggccacucggcuacacaaacuuccaaaucucgaagcucucggaaacuauuccgugacccacaacuucugaccugaccucaccaucucacugagguuucuggggccgcgccagccugggguuccacgaauacaccagacuggguggcccaagaaacuuaacacuucuuguccggcugaagaggcggaacggcguggguuuucgcaaggugaccggucccuuucucggcgacccagaccccuucucgguggacuugggggacucucucgguucacucuucugucgcacgcucgucuuucuuuuccgucucccacccacgcccagggccgugcccagacagacagaccgaccgaccuccgugcacucacccuggcguccgacaaucucagcgacaugcucggaacugggcacggggacgcacucggugguguugacgcucuuccuucucagcagggccgcuugcucuccguucagggcggcagcggcggccccgccgccgccggggccguaggcgugggacagcaucgccgccaucaugcccugggcaucguccccuccguacagcaccccugccgccgcggccucccgggcaucgaagcccgcggccggcagcagcaccgaccccaggggcccgcccgggaucggcugagucugggaggcgguggccgcgggcggcgacaacagcagcagcgacggccgguccuccuccucugccuccuccagcuccuccuccuccagcaguucuccguccagcuccgcuuccucccccuccucuucguccaccuccagcuccagcuccgccgucucggaggucgcgaggcggccaggcuccuccggagccagcccggucgcccgccgggccuggcacugcgccgccgccgccgccgccaccgccgcggcccugagcgccggggcgccgggcuccgccgggcuggggucgucgaggccuagcgcggccaggcgcucccucagcagcagcccguccccuucgagcucugggccucccgcgggcggcggcggcggcagcggaggcggcugcggcaggggggccggggccgccgccagggccagggccagggccgcggagcugccgcuuggcaucgcggcggcgcgcugucaauggcggcggcggcggcggcgggagcgucaggcgcggcgagcagccggccccauggcggacagggccccggcccugcucagcgcgcaaacaccuuuccucgggggaggcggcggcgcccgcgccccgggcugaggagcgccagggccgccggagcgcgcgagggcgggguggaggggccgggaacggagccgagguagggaacuagguggguggguggggacggcagcggcuccccucucaggguuucuuuuguuucauggccuuaaccagcccccggcgcgcgcggcggcggcggcgacgccccacgccgcucuccgaaug

SEQ ID NO: 8979 - RNA, 3378 nt, Mus musculus
ugauggugccucaccugcugggcaaaggaagggcuggacacgaguuuccagcagucaggaggaaaagggccccugcucucuucccacugugaagcagagcugggaaacuugaugagggcauagucggugcacggauggucagcucugaggguuucauuaaaccauuuuccaaggguggcuuccccaccagaagguucucucagaaucacugugaaccccuuaaguggagauuuccuugucuucagagcccuaagugaccugggggggggggggggagaaggauucugauggcaucuuguucucacacacuaaggccuuggugugggccggcagguagccguguugcugcugguacaguuucagggugggguucacuaucuaguguuucuucguuucuuuuuuauuaaaucuuuuuuuucauguauguugauuuuguacauuucucaaccucccagaucugccuacacacucaacuucuuguucuuucucuuugucucuauuucucaacaacaacaaaaaccagaaaagauggaaugucacuagggcaguccccaagccuaggaguagcuggccaaaugcaaacacagcccauggguuuugucugggcgugugugugcuuuugguuccgguuuuugguuugggagguuuuggugguggugguggugguggugguaguuugguuugguuugguuugguuuuugucugguugguugguugguugguugguuggugaggucucacgugucuaaugauccccuuggugcccaggcuguuggugcagaugcaaaacugagcauguugcauugcaccuuugaacugagugcugagaaacugugugcuucaguuuauaugaaaucauauagaauggcuuucaucuaguugucuuuaauugauauuggauauuaaguuaauaaggaaacuuuagacauaauuuuucugaaaacauauaaucuaggauacuuuauuaagcucauaaaaucuagugaccagguuguuuuguuguuguuguuuuguuuuguuuuguuuuguuuuguuuguaagaguagcuauccacugucuauuuauggaacaguuuucuuugaggaaggccuugaugauuuuucucuaacuuacuggcuucugaagagauuuuacccaguuaccacuggauuuagacugcucuuuccaggagugcagaguggagcaguagucauuuguucccacggggaguggagacggugcagggagccuggccguggaggaaguacagaugugucacaauggggucaguguucuccagcucuccuaaccaaaaucagcccuaaggagcauucaccauagucaagaacauuaauacaaaccugagagcucccuuacuggaguuccauguccaauccucauugggcuagcagcagcauccagguuccauucaagacguguuccggugcagaccuguugcugacugcacacaggagacaggucucaucagccacugugauuugcacuuguacacaguguuaaaaugaaaccugcuagccagguaugcugcaugccucuagucccagcacuuggcagguagaagcaggaggaucgggaguuaaggcuagcuucaacuacauauggagaucagggcuagccugggcuacaggagacccugccucaacaaagaaagcccucaaaggaugagcugaaguuauacacuaaauaaguaaauauucaaaauaaucuagccuuagaaaaccacuucaucugaagucaaugucuuacuucgugcuugaagaaagagugcuguuuuuuauuuauuucaaauuucaaggcauucagauaaucaagaggggacaugcguuguggaacugucugaucuuuauuaugauuuacuuggaguaauacuuggauuuuaaagcaacuacuuaaaauugugucccugaaaaggaaaaggauggcguucacaguugguuguguucccugcaugguuaauuuuaccugugugucuagaggaaggcccaggcuagugcgugcauuaagcuagugcgugcguaucuucggcuaggugucauuucccaaugacugaacucucuucaucuuuuucuuccaauuaaaaauguaugugccguuugcuccuuaagacauuccauacccuuaagucuuagacucggaggggucugucggucuguuggucugcccgucuguaucuucaguucucaggaguuuucuuugcuugugugcucauuuguguguuugaggcagggccacauaaccgaguccagccuuacaacuugcgacuuagccucaccugugcugaaagagucugcguacauccuagaaacuuuauuuucuagaaauucaccgauucucauguggucauugagugccaccaguacaucugauggauccaguuggcacgucaugacagauugacuugugugacugugccugcucugugucggguguucaaagcaucucccauguacgcuggagcccugcaucucugacccuguuuuacaagcaagggcagcgccacaggggaguugaagagcucuugugagcucagccccuucagucucugcaggcaguucuagccaaggggacagucuucuucgccuguuuggacaagauuaguucucaguccuuuggaaugcguuuucccaguucguaggauuuuuccccccuuuguuccuacuuaacgauucaaacacacuauaaaccucuuacuuguuaauuauuagauguauauauuaaguuauuuguuuugaaugugauagauuacgccaaagauucucaguagcuaguucaaucuugauuuaguaauauucauagagccaccggcugccgucacuguucuacaaaucaguguccuccgcagucagucauccacuuugcgacucuaguccuguccccgcgcccccagaagguauucucugaucgaagucuguuauguguacuuccaugaaggaggacuaugugcagaaugaagagagcuaucuuagcugaacauuugacaaaauuccuacccaguguuuugauuguacuuugccugauaaguuuuaaaaucaccagaaaguaaaacaauuuuuacaguucaugucgucgucgucaucgaagaaaccacacauccugugucauugcuuagcauuucucacuguguguguguguuggggugggggggggcggaugugggaaugacagguuuuucagaggugauucccucaugggaagauaaaggggaaugcaugcucucuguagaguauuucaugcuguguugacuucuuacggagagucccgagacugcuauaaagacuugauaauuacgugaacuguuuuucccuuuuugugauauauuccuuguaaugagauguguucuuauauuuucuuaguaaaaauuuucuuauguguaaaaau

SEQ ID NO: 8980 - RNA, 47048 nt, Mus musculus
accuggccggugaucgggauaagccacccugcgcuaucccauggagccgauuacaacccugcucccccgaagcacguccguccucccgccgucggggucgcacgugagcugaugcaugcggccucagaacaguuaacacccaggaacucggcgcaggaaggugccgccgagaggaaccgagccgagggcggaaccaggccugagccacgccccgcgccagcuccgagccucccauuggcccgcgugccugucggucagcccggcaccggcccgcgccucuuucuccgcuaccucugcgcguguggggcggguccccggcagagcgagccggagcuggcgccggcugccaggagcucgcgggaggcuggcaggguggcgccagggccgagcaucuccggcuguagcgccgcggccucucugcuugcugcaccaccuggcacgggccaggcguccgguaaggcgccgagcggagggccuggcucgggggugggggguggccccgggccuuuucgcuccgggaacugcgcgcgcggcuuguguucgcgcgugcggcgggccuggccggugggcagcggggcggagggaggggcgccgcgcucucugggauuccgggcucgcuggugccaggacaccgcgcuuuccuccuagggcuccagccagguggcucccagaccucgagcaucccaagucuccuuucccacugcgcuugggaaagacuuauuuugugguucaaacccucuuuagcaagauuucuuucccaaccgagcucagggaggcacaggaguugggaugugugcauguguguguguaccuuauuuuaauagaaagaguuguggcaggcaaaaguuccaagauuggcgugguucuguccauucuuaugaaauggcauaugugcaccgggauuggcaggugacucuuaacgcuuuucauaaccaacccagagucagguguugcguuuguuguggcuuuagguucgaccuuauuuauuuauuuuugguacugacgaucguucuagaaaaugagcauugcuuguggugagaagcgugaucaaaauaacugaccucaaccgaagugcacccuuaguauaacauugggucccuggaauuauccucuuaauugcuuguggcaaucacuucuaagcaaagcaguuaauaucguuguuauuucugcugguguaggaauuguuagcaaccaguagcaacacuguuguuagaaauggucugggcacuguucucugaacagguugcuuccagaauaacccuuucagguuagugcuauugugucccagcaaauacuucagaagguuaaguaacuuauuucaagacggggguggggggucuuuaaguaagaaaggacuggauuuaagcugacuucauaguuguacucuuaaccaggcauacuccuuaagcauuguuuauguugucaagggauugcaaacgaauguuuuaauuuuaguuuccaaauauucugggaguuagaggagaaacacaucucccuaauaaauaaaaaaguacauguaucuuguguaugcaucuuaugucuaaccgcuauaacaggcuggcuauauaucugcuacaugguuuccagaaauucaggaaaagaguuuguaacuuuuuaauacuggacuucuaagaaauccuguuugagcuucgauuugcaagcugagccuggcucuuuugcguagucgugaaagcuugaaaguuagacacagaggccagaagugaugagauaaugccuucucaucguuagggcugcuggaccuggcuuuuauuaguugggucccauuccuucuccccaagcugcuggugaagaagcgacugaguuacauucuuauaaggaguuuaguaaacuuaugaaaccuacauuucaaagucauaagugacucaccauuucagggcuguguuuuuauuucguuaguugguugguuuuuagacagggucugacaccgcccaagcuggccuggaauugacuccugcccagggauucccaagcgcuugaacaccagagccuccacaccugcucguuuuacaggcuuuguccuuguuuaaguuaaaagcuucgugauuccguuuaugccuaauuuguauuuaauuccauuuuuuaaauucucaucuguauuaacuuuuuauauuauguuaaauuaaaauuauaacucauugauugugaagcaaacuuguuauauuugagacacaaagaaaacacaaauccuuugaucuuagggaacaaaucugggguuaaaguuauauuugacuucauuauuuuauugcagguuagcuaguuuacuugaagguaaaugcuuauggcugaaauaugcuuauauggaugaaacugaucaauguuuacaaauuucaaagugacaaacacguuacuucuguagcuacugcaguauuuucuguugucuggaucucugugcuguucauauggguccuuccugacccggauagagaaugagguauuuuaagaguuaaucuugauuauccucauagccucuuaauuuagucauuaaaaaauguugaugcagaaacucgcuggcauuuagaaugcaacuucuguccagguuagccagcagcagugguuauccuuauaaggagcguuuauuauacagcauuucaauaagcauuaugggucuaauuuaaagcuaucuuaauuuaagucuucagggaguggaggaagcccuuugagucguuccugcucugagcuuggaggagaacugaaacacagggaggguguaacuuaacuaccaaauagugcuguguacccacagcaaguggcaaaccaagguuuaaguccaggcaguauugacugcggugccugccaaaugaccuuucuuuuuauuggaaaaaccuucaagucaggcagcagagcuuguaauaagaucacaacauuaugugugcacauccucugacacucugugcguuucacaacugggcuucucuuuccuuucgugucuguugcauuuguguguacuaaguauggaggccacagccgucuuccucaguuacuucuccaucuuaguuucugagacaggaucuuuuacuaguccucgggcugaccuuugucaagacugacuagcaggcaagaucugcugccucaaucccaugacuccuggcacugcaguugcaugcaccuaugaaacuggcuauaaugaggauuuuaacucagguuccucaugauugugaagggagcacuuuacucauugaaccaaaaacacaaguguucuaauggagcgguugguucccagacuaaacuuuaauaauagcuuuuguugucguuaaguauauauguagagguauguuguuauauauguagguauuugggaccagacaugagauugccaguguuucuugaaguugaaagccuuaaagacuacuguaaauccuguuuggcaggcaggagggcugcuaugauuuugagacccaccuuuugugauuagugacuuuaggaccaaccuuuuggaacauagaacugugucuuuaagacaguaacaaaagccccugaaaagcucacugaccgacccugcccuaagagauaggauuucaccaccagaaagggaagucauaguucauaacauaaagacaaaggauagaguuaauauuaugagcaaugcuauuauauuguccuaguuucuccguagguggucacagcccgugaaaaggugacugaccccagugccaauucaaagaccguuucugaucuccagagugacugcucaugcgaaacugguaauuauccgaguccacguucaaguucaggucucuaacugccaaacuugcucauuacaccaagucaugaccucuguuuucugaauagugggaaaggcccuggucucuaguggagauagccuuuccagauggugaccagcucguuucuguugccaagauaugcagugguagcugggcgugguggcgcacgccuucaaucccagcacuugggaggcagaggcagguggauuucugaguuugaggccagccuggucuacaaagugaguuccaggacagucagggcuacagagaaacccugucucgaaaaaccaaaaaaaaaaaaaaaaaaaaaaaaaagugcaguggcuuuacaguugaaauaucuucagcucacuugaauccggguuuggagcuauaccucuauuuagaauauggacuaauuuaagaacugguuuuaggcuguaaacccuggaucucacugaagcaaacuugcaguggcccccaaaaguuggcagaaaacaguggucacggucaaagaugucugccauuuucaaaagaaaaugaccucggguaaaaauuaugucaggaaagaaaccaaaauuuguaucuuaguacuagagacauucaaaugauuugugaaggguccugaaaaggucuaggaguauguaaugaaaccagaauuuuaaguuauaaaauaugaacaggcgaauauaagaaguguucaaguagacauguggacaaauaaaguggaaagagugcccacccgcaacagguaaucggggcggggauguagaaggcugaguugguagagcgcuugccugugugccugguuccuuggguuugccgucuagcacagcagauccagccaggcggggcagugccuuugggguggcggcgggaagauuggaagcaugagggcucacaucugagacucgucucaaagaaaagaaacagagcacuaacgacauaugagaauuuaggacagggacauuguuuaacuaguaauuuuauuuggaaggaugggauuaagagggacaggaaauaacuacaugaaauuugaagaaacaaaacgaaucuaaccaaaguuucaagggcgguggguuuggaacaugaagggaaagccagaucagaaauccagacaguaacuguuaaguggggugaaagagcgugugccaguuccugucauugagcugucaugguuuccaauaaauuaaguggaagguagguggaacuguaggugugauucaaggaaaagcuguugaguauguaaauccacuaaugagggcaggguuaacuaagguuacggauuugguuuaagaaucuaugaucuuuggcuuuaggcagaaacguuuacuugauuuggaggugcagagugcagcccuacuccucaaaaaaggggggaagaucacaaaacaacccccucuccaaaagacaugauaguuggaaggggacugguuagggucaugggaugggaagaggauguguguguguguguguguguguguguguguguguguguguguguguguuaccagaauguauuacauacauguguagaaugacaguaguauuuuauuuaaagaucuaaggaaagaaagaaaaaaauaccagggucacauucacauauccuaugacucugacauguauuuguucuuugcugagagcugcaauucucggaguuucuugagugacaggaaugucacuuguuguucuugguaagacuuuuugaucacaccauuuuaugcuaaugagguaacuuggugguguuccuggagaguuccaggaugggacaggguaaugcagggacccaagggcuggaacauugaaccucaccccugaucucugccaaggguggggcaggacauuaagcucugucaaaccuccugacuuagaaggguucaugcucuccuggguugccaagugcguggcagagcagagaaggcugcgcauccugugucuuugaacuuugcccaguacaucucuccgucuugcuguucaucugcagccuucccaugucuuauaacuaaacgguaaauguagcaagucucccucugaguacuguaaacuauucuacaaacuauuaagcccuuagagagugcuuguugagaaggacaggugacacucugcgugagugugggucuuuaaccugcugguuggcacuaugucugcuaucacaguugaauguauucguagggcaccucuguuaccugcuguagaguuguuuguauuggaguaagucccuauauacaucugcgcagucauuuguuguaauuuauaggagagaugcuauaucuucauagaauugguggcugaaauguaggagaguaagacguuucuauaaauaaauacauaguuuuguuccuuaguuguucuauaggauacgaaauaaguuacagugcuuguguguccagaggagcggggggggggggggggcugcaugggagggaacacaaaaccauucacuguucucuuaaugcugucuucaguuuccaauguguaaaugaaaaguacauuuaaaucugaagaaaugaggcuauuugacuuuugggucucugggcuuugugaucuucagacaguaaacuuagauaucuuuauagauauucagguuauguauaaauaaaauuaaaauuuuagggaugaaugccaggaagugguggugcacaccuuuaaucccagcaccugcaaggcagaaaugggcgaauuucugaguucgaggccagccuggucuacagagugaguuccaggacagcaagggcuaugcagagaaaccaugucuugaaaaaccaaaaaagaaaaaaaaaaaagauuacgugaaguaaaaauugaaaaauugucuuguguucucucuguucuccgucucuccagauuguaauuacguguuuguuuauguuuguacauuuguuuucaguguguuauuccuguuacauguguacagucuucucuaaacacagaacucugcuuccaucuaaagacuuuugccaguuuuucucacuuaaaagaaaccacagcugcauuuuaauugcggccuggaguuggaucauagauggucuuugagggccccaacgggucacuuaugaagauuuugauuguuaguucucccuccaucauccauuuuucucuucucaccacugccucucuucucagcuuagaucuccucccuacaguugaacaaguucuugucugccuuggucuuuuauggacagugauuuuucacuuccuccaagaaggaaacccuguucacagguucuucucucugccuucauaaccuuucacacuuuguuuagaaguuccuuguaucuaugauuguguaaagcgauugaaacacuguugcaagccuucagcuuugccuuacacaagcgucagcaucccaucuccccccccccccccccaggaugggaguguguuggugggggcugcgggcgccaagcagaugccccggaaacacuguaucccaucuuucuuucaguuucuggugcgaggcagaaaacagcucaaaagaguuacuuacacggccaguauuucaguguccaggacuaagggauuuaccuuggaaaacucaccuuauuuuaauuugcugaucacuggacugaaauauuuguagaaauaauucagaaaugcugcuggcuuccaggcccauagcgugugugugcuaguaaaauaugugugggagauuuucuuucuuuuuuugaaaagauaauuuauuuuauuuuaugugcacuaugccuucaugugucugugugaggauguuugaucuuggaguuaggagaguugugagcugccgugugugugugugugugugugugugugugugugugugugugugcugggaauugaacccagguccucuggaggaguauucagugcucuuuaaccaccaagccaucucuccagccugcaggugggagauuuucuguucuccagaugacaggguuuguagccucugcagcaggguccagcagccuuuuuuuagguaaggaaccagugaguggauaguucaggcuuucugagccacaaguguuuuguguguguguuguaacccuauaaaacugugaagcccauucucaggcuaaggacccuguagaacaaacuggccaugcauagucugcugcuuuuagaaaagcaucuuugauugccaaccuacacuaaauuccauaaagcuguauugcuuugucaauaaaacaguguagucuugagauacuuugaagccagugucuucuuugaugguaaaauuuaaagugugguaugcauuuuucuucacuagagaauuccuauuguuuugggaucaucucccgugggaagcaggaggagaccagaaacugggaggaaaggaaauccaagaacaccguacugucccuguagcagcugugaaggcuggaacgagagcuuuauucuauuuuaugguuguucuuuaggaauucuuucuuuaaguuggucuaguuguguuuuguuuuauugcuugguuaagcacuccauuggcuuugaacuucugcuuagcaaaggaucuuccuguucgguaggaaacuuggaaagagaaguggagaagcgaaggcuuuccauaacaucaccaccuagacauucgggggcuauguuucagcccuccauguagcuucauaauuccagcuuuguaugcaaugccauuucagccuuccuuaaggucuuauaauaaaucaaugguuauuucaauguuugcgggcacgcuugacacuacuauauacguuucucuuuugaaguaauuucugauguauuuuacacaugugucaugccuuuuccaccuguaacuuuguaacaugcauucaaaauggaguacgguacuuguggcuacuguauauuugcuuuuuuuugguuguuguuguugcugugaucaaagccuggacaaagaaccuuauaaggagaagacuuuauccuggguaaggaccauccuggcaggaaaacauggcagaguucacgacagcaggaggagcuuguggcugggaccaagggagccgagggagaugaaggcuggcuucaucuguauacaucuuuuuuuguuuguuuguuuuuuggguuuuguuggguuuuuuuuuucuuuuuucuuuuuugguuuuacaagacagaguuucucuguguagcccuggcuguccuggaacuuacucuguagaccaggcuggccucgaacccagagauccgccugcuucugccucccgagugcugggauuaaaggagugcgccaccaccccuggcuguuuguuuguuuguuuguuuugguuuugguuuaugacccuaucccuugccauggugucauccaggaaggguaggacuuucccacugaaccuuucuggaaaugggcucacagauaccuagacgagugucuccugggggauucuaauuucagucaaguugacagugaaauguagccaaguuaccaaggucaggaaguauaaaugucuccuccugucaguaguuuagcucccuguuugucggcuaucucgaggauacccuguauuuauugauuuauuaugcacccuaaucccacuucucuuccuguccuuugugucugcacuuggcccuuguaaccuccccucaacacucaagaagaaaauaaaaaauuaaaauagaaaaaagaacccccaaaaugaaaacaaaaaccuuccuguggaugcugcagugugucacucaguauauacacacacccuuuugucuacacaucuuugcuugcagcuguuuguugcauugagucauuggucuauucaaggccucugacuucugcuacaucaucaauacuggauccucauggggacucuucucagauauccuguuguugcccugugucauggagacccugcagcuuuggaucuguagaaugggccucuuaaugaacuucauucaauaguaguacaucaaugggguagguguuggggugagcugacucaaagcccuggaucugggccuuggguggaagcugagucagucagccugccagcucuuccucacaccaccagggaggguucuccagcacugcccugacggggucagcucucaggcucuccgguggcucaccagcacccacaccuccagggucaaguucuacugggcugcucaggagagguguagggccugccuuccccagcgcugcagccuuugaggaguaaggccagcucugcacuucccuuggauaucaccaugaucccaggcaucagggacguccaugugaccuuuggugguaagauaggccauggacauugauacagacuccugucuggauucagauccaaacauggccaucaacacaggccggaguuuugccauggccucaggugacaguggaggcuucucacacgaggcuguuccuccccacccuugagucucccgucccuccccucuucauagugcugaauccauccugcugcucucacuccccucucuccaucugucucaguguggguuuuacugcugugaacagacaccaugaccaaggcaacccuuauaaggacaacauuuaauuggggcuggcuuacagguucagagguucagucguuaucaucaaggcgggaacauggcagcauccaggcaggcaugguguaggaggaacugagaguucuacauccucaucugaaggcugcuagcagaauacuggcuuccaggcagcaaggaugagggucuuaaagcccaaccuacuccaacagggccacaccuucuaauagcaccaccaucugggcugaucauauacaaaccaucacauacuugcguaaagggauguaguggcucccagugcuggugggaugccuucucucucggugaugccuuaaaacugaagcauuuuucaguacgcagcaaguauccacaucugcuuuugaaaaugcuuacaguguguggugcuguguggugcuuaccauuguguugucuuccaggggagagaagauguuuucccggcuaagagcuguuaccacuccuuguaccuugaccugccgccgagugcaccugaaagagaagggcaagccacucauguugaauccaagaacaaacaagguuaguaacgucaacagcacuaacguggcuugucuuccugguuaggcagggcuguguaaggcuugaagauuuugcauucaguagcucuguagcagcgcaacugagugaggccuucuggggagaguugccuguuguauguaguauguaucuuuuccauugggcuguuucaucccuucuaagucuuacucuucacaucuuuuacugcuagaaaaggcuugacugcuuccuagugcuaggugagggcaguaaagcagcauuagugugggaaccaccucagaggggugcucuggccaggaccuuuggcaagaggguuagguagcuuuaccuagcuugaaucagggaacucacccugggacaauuagaccuuugguugauuggguaaaaccuugaaaugaaacccuuguugaccuuccagcucacacccaucguuuuggacacaaaucauugcauauauuuuuggcuguuaauucagcaaaugcuacaaaggagaaauugccuugacuuuuagauuaucacuaguagggcagaaggcaucaguggaagauccagccagguaugucuucaucuuuguguaagcugggcucaauaggcgaauccuucucaguauuuaguagucauauuaaauacuaagcaggaucuacuggacaggacucuggguuuugacuccaguucgacacuggcaucugaauaaucucucuuggcaacccaccucauguauucagaaaggacuggcggagcgguagcuccugcacgucgaugcuucggauggagagacuaaaacgggccuggacaugcucugcauagugccugccuggcaugugguuagggucuggaaguaauggugggagaauaguucagugauggagugcgugcuaccagguuucuggauucaguacuuagcaccacaaaaaugacgugaauaaaaugcaacccuggguaaauauauacacaaaauagcuuugaaauauaauucugaagagauauuucuuagaaaaagcuuguaagaugacacagagagguugucacagugaaugaagugcaccuuuugagaaguggugcauugagauuagaggugugaccuauuuuaaaaaacuugccauaaaaaauuuugccaaucuuuuauuuuuauuauuuuuuauuauuauaagagaaaaaaauaggagcuguuuaguauaacacguuuauaggaguuucaggccugcaaaggaaaguuaggugcgggaauccucucguuagcaugcuugguacuagccagagaguugcacaggccaccaauuaaaggaagcuuagugaagaacgucccuucuuguuuuuuucuugacuccaaauaucacuugcucuuuagccugucacucguuuccagugcaggaccagagcuguagugucauggaagagagccagcauagcaugcuuggagacucuggauccaacggccagacacauuacaaagcaagcccgagcugaacaccaggggccuuugacaccagcguagacaggagaguccucggucucugaaaccuggcagcagcuuuuugccccugucccucuggcaucaccaguguuuuccuguucugcugcuuuuuguaucuuaagaucauguuuccaugaguuuauaucuuuuuauuuccuguuucuuugcagcaauuaccauucucuauuuuguaucuuuuuaaaugucuuacagcagccauuuugugaauccguuggguuuacuuauuuuacuuguguguaugugugucugucugucugucggugggucugugcauguguguguaggugcuugcagaggcaacagugucagaauccucggagcuguuacaggugguucugaggcuccugaugugggugccuggaguugaacuugaguucucuggagagcagcaaguccccucagcuccugacccaucuuucuagcacacuaugccuggcuucuuagacuggcagauguuuccuuuucucucucuucuuucuuucucuuugucuuccaaucccagcacugggcccuguacauguuaagccagccucugucacugagcuaugucucaaguucuacuuuaugguaacauuuaaguguguguuuuuguuacguguaucuaaugaagucucugguuagguuggaggucagcuaaagauucagcaaagccuuaaaugacuggagcuagaaccgugcagucuugcaugcuuccuuuccuaagggcuccguugcauggugugugcaggcccacaccgcugagccaucgaguagcuccugcucgcguagccugcagguuugcuucuagcucugccugguaaaaugcuccuugaucguuguaagccuuuaguuauuuuccagaacuaagagaagaguugaucauuuggcugaugcucucagcccuuuuaaggaggaaagauuuuuuagaaauccacacccaagcauuuuugcugggcucauuuuaauauaauuuaucccacagcuaaaaacuggaaauugaauguucagacauagacucauuuuuaacuguauauucuugguuucauuuauguguuacaugcaucugaacgugauaugaggucuuaggaauguuuucuaagcacaaauggguuagcagugugcuuugauuggcaacucugaauuauucaugguguggauauaccauagauugcuuacugcacagagaugaccuuuaucuagucugugaucuagggacuguuagaacugcucgauguuauauaccucugcauucccuagcuaucuagagauguaucuggaauggcuaugugcaggucauauugcuuaacuacaaaugugugcauuaaaguauuuaaguguagccaaggugguagugcaugccuuuaauccuagcacuagagaugcagagacaagcagaucucuugaguuggaggucugccucguuuauagaacaaguuccagggguaugcagagacucuguauugaaaaaaaacaagcaagacauaugggcuggauccuuaggcuguuuuccagaaucuuauacuacacauuucucugugagagguaacucuuugcauaugcucaucaggaugugauggcauccgccucaaagcauuuugaaauuccuggaaaguguauuuuacuuuucagaauuugcacucgaauuguguuuuaaaggacagugcuauugcugcuguaguuacuacuaauuuuaauucuuuaauucuuucuguuuuuagggaauggcguuuacguuacaagagcgacaaaugcuuggucuucaaggacuuuuaccuccuaaaauagagacacaggauauucaagccuuacgauuccauagaaacuugaaaaaaaugacuagcccuuuggaaaaguaagaguugauuggcgucugauuuuuauguuggcagccuuaucuuagaaucguggugugaugaaggcacagggugugugcacuccacacagugacgucacacagugacgcuguucuuuugucgcuuugcuccugugaugguuguguccuugucacuuuacggugcgcuugccagggaucacugugguggaguuuggcaggaguaaguuguaugccacugauaauuacuugcguucacacucugugugugaugagaacauuggcaacaugagguaucaucucauuugcucacgucucauuccacagcguucacugaucucccacguugcgugugacacucugcuaauagaaggcauccagggauaaguggcuacaucuuccaguagagacuguauauauaauuuuaaagguuuacuuauuacauaugaguauaaugucaccgucuucagacacaccagaagagggcgucagaucucauuacggaugguugugagccaccaugugguugcugggaauugaacucaggaccucuggaagagcagucagugcucuuaacugcugagccaucucuccagcccugagaccauacauuuuugagauuguauaggacaucgaauagugagggaauggucuuuuacaaauagguuccaucugucgacaacuaaccugcgcccuugauagcccagaagcuaauccaguaaguagcauacagcccugccucuggguguugagcagcggugcuaaccugcggcuguucugccuggauauuacuguagaaaaacugcacauguggaaucuauccugaaagcaugagaggcguggggcccgacucgaggaaccagauaaaacuucccgaaggauggaauaucugagcuaaaguguaaaguguguuguuguuaacaaagcaucaaaaugagaaaggacaaggaauggcaggcugggggagcagucggaauucagggcugacugagucuguugcaggacaugugaacaccgcuggccugugaggagugucagugucgcgacaggacaagagaguugcacugagaagcgggugggugggaaauauagucuaccccaaagaagcucgagugggaaggaggaaagacauuggacuauaaaacacguggaccucugcuuuaaauagucucacacguugaauauguucauaguugcacagaagagagucccgagauacugccacagcaaguuugcagaggaaggcauaggcucaagggcagagcuagaaagucucuauuaauccagagggagauaaauacagacguuacggguaaagaugccagugauggcucugaacgcaugccuggugguugggguuuucuuagugaaacagaauguggacaucccagauaaaauauggaagggcuaaugucaagcugagaaagccuguccugucaggaauagccacuugguuaggaaguaaagccccuccaagguagguuagaaaagagugacccuggugcugugguacagaacacccacuucucacguguugcagcacuugagaaacugaggcggaaggagcaggagcagauguggaggaagagccuuggcuacauagugagacccagccuggacagacagggugagggcagccccuggaggccuuguggaagggucucgucugcugugcugcuaugcacagcccuguucuuuucuacagaaaaggagaacuguaguguccacuaggcguuggcacuguuccaggguucucacuguaaaguggaauucagccugcuugucuggaguugagugugagauuggggauggggacacaugcucuggugggguugugcagugguagagaugcgugcagcugcaagcagauggugagggauugcucagagugaggggagugaccccgagacucacagucguagaugggccguaacuagacaaagugggagcccauggaagugcuggguagggaguucaaaccauuaggaagugaggccgugaauagcuaguguaauaaugacuagguaagguaaauggucaggcuguggccaguguggaguucagggcagcugucggcccuaggcuuucagagcccuagguaggagcaagaucacugagaggcaaacacaagugugacuaaaggugagaguagucgccugaagaggcccagcaaugucccagcuuccccucccaugcccgauagaccaucuguuucucuucuuuaacccuuuguacuuuucuuucagaaagcuggguuuuguuuuguuuuguuuuuugguuuuauagccugguugcuuuuggcucuuucccuccagugagaagaaaucuucuaucguauucuaccuaugugugucaucuuuguucccaggagcaaugcaguucguuggcugagugcuccacuuauguauucacccaguaaaauacagaaauacagaagucuuagccuaagguggaguuauagucuaacaaaccauuuguaaauugaaaauauuacaaggugaguguauguuuagcacacccaaccuaccaaauacagcucagcagcccaguucauuucagagcaaaguccugaccuuugguugcguggcucccuggaagccgaggcucacuguagcugcucagccugagagaacauuugcacauagccuacacagggauccucucuuaccgacgagcacucccuuagggugggccagcuuagaauuaaaaacaaaacaaaacaaaacaguauaaaagcaauguaaguugaauacacaagaagucauacaguagugugggugcagaacacaggaaaguugaguggaagugggggguaggagaggggacuggccucugagcuacaguaagagacugaucgaggccgucagauacauggcucccagggaagaguuagacauaagucaguguggaggaagugagggggauuggagcagggaaggaaagcuguauucagacuaguuagugguuuaggcuggauguggggaaaagacauggccauauuugaaggacaccugcaguggaugcuuugggccucgaugaucuauaccggauugugguagagaaaggucggagaaacuaagaauggccuccuguucaaugcauucugucucaguguuguuucugcucccuguauggaagaaugcuuaaaacacaacuggagggcuggugagauggcucaguggguaagagcauccgacuauucuuccgaaggucaggaguucaaaucccagcaaccacaugguggcucacaaccaucuauaaugagaucugacucccucuucuggaguuucugaggacagcuacaguguacuuacauauaauaaauaaauaaaucuuuaaaaaaaacacacacacaacuggauucuaaacccuuuagcaugggacuccaggccguaccucuggagucgccacuuccuuuagcuucguugucauuuacguggacgccuucuguugacuccuuagcauuuccaggccuuuguucaaaggguuagcugcuguuucucuuguuagcagcuaccauuucaguacgucugugucuugcuaauuuuuaggucugaguguucuagaauuauaaguuaggguuuuggugugguuucuuuagugaagggugugugugugugugugucucugugugugugugugugucugugugugcgcgugugugugcgugcaugugagcucaguuuuaaacauuuagguugacuuucaaaggucaaaauuuccagugugauguaggcuaacuuggaugugauuugcugugcuuaauuucagauacauuuauauaaugggcauccaagaaagaaaugagaaacuguucuauagaauccugcaggaugauauugaaagucugaugccgauuguguacacgccaacaguuggucuugccugcugucaauaugggcacaucuuuaggagaccuaaguaagacuuauuuuuaaauacaaauauauauugauuauuguguaauaaaagaaucauucugugacaucuaauuagauuucuuguguguuacaauauuauccagccagguuucuugccucauaaaagccuaauuuguauuaaaagauauuaauaaaaagucaacauguucacaucuuuguuuuuguagaaacagcucacuuaaccagcuccugaucguuacugccauuguuggaggaguuguguaguagcuguuuucuccuccuccccuuaggaccggaauuacuguuaagccuuuugguaguuugccagguugggauugcgucucauuuaucagcuuuaauuucugaugcuucuccucuuccccuuuaaaagaaaaauuagcuuucgugaauuucaaauuucagacuguuucaacuucuaucagacauuucaguaggaagaguuuuacccccugagccacucccucaaguccuugagugagcacaugacugguugucagccaaggaugacugauccuguuggaaaccaccgaaagggaguaaugugcuggaucuaagacuauuuuuuaucugaguuuuuaugccccuucugaccuguuguuuaccuuaacccuuguuuuuucccauggccagcucaugcauugauaucaguguaggcauccagacagggccgagcgugacccucagcccccgcaucucaucugaaggcuccucucaacuucacagugcauaagaugcauucguugaguuuuuuaaaaggcugaccccugccagcuuucuccccacaagacuccaaugaggaagcucuggcagcugaaguuagccagcacccugaaaagcccuguuuaaccuaacccguauggugcugucaccaacguauguaaaacaccucuaggagguagccuagcacacgugugcauucuuguuagaaagugucucucagcucagauuagaggagcaaggaaacuggaagcacgcugcccagcccucccccucagggggucugggucucuggcaggcgugggcccagguguagcugagaaugccccugcugugacucuggcuugcaccucggaugaggacugagcggagaugaggcgucauggggcagagauuuggaucaugccgugaauccacuguacccauuguaggaauaguuacuucauuuuccaccuggaugcuuaugauguggacacauuucucuuuggggauaguaaucacaucaguuaacaauaaucuuugcuagagcuguucgguaagcaacguaauuaucauuugaaagaguugaaauguuuggagauaaaucagugcuuggaaauuaaaccguaucuugauuuuuaucagaauaucuaaguaucccaauuauggacagaaacguaggaaaaaaaaaaaaacaaaaaaacugucaugaaaugcaaagguguuuuuguucuguugcaggggauuguuuauuucaaucucagacagaggucauguuagaucaauuguggauaacuggccagaaaaucauguuaagguacuaagagcacacccucccuugcacaaugucuccuuucuccuuguaagucaacucugcauugccaaggaccagcuuccccgucucucugcuuacuuauaguaugaacaugcaaacguaugcuuugugucugaggagaugcugcgagcaucauucugagguggauccccagggccgugcuuggccccgagaaagacacugacaccaguguacagggcgagccugggcauagcccccacccccacccacugcuugacuuucgugguagagaaaauuagaugcuccaccaagucugcuggugcagaucuaauccuuacgauacacuugaucccuuggcagguaagggcaggagggucagaagcuugaguguaaggccaucccgggacacaugagacccugccucaaaaagggaaggagaugacauaaguucugggugguaguuaugugcucgcucucucucucucucucucucucucucucugucucugucugucugucucucucucucucucucucucucugacuaagguagauuuagauccuuggcaaauaccacacuguaaaaagaguuuuuaauguuuuaauguagcaaauacaaaaaauacaagccaggaucaauguaacuauuuuaugaggcaaauugaauaaccuuuuuaaagaucuuuggguagcuuugugcuugucacuacagcaaucuuacugccuuuauuaugccugccuucuugaccagaguaaaccaugaugaaccacgaguucagccaggggccagggccaacacuuuuccaaaguggaagcagaaagaucacgugaucuuucaaauaggccagcuugugcuaaauuuccuccuuuuccuccauccuuccaaaaucaugaguucagaaaaauuugguaaaauaacuaaauuuacaguauuauuuuucgaccucauguguagguauuuauauauuuauauuuuacaaaucuauguuguuuucucccuacuguugcuaagguuuuucugacuguccuagguuaguagggcacacucuuuauuucuagacuuuauugugguaaccucagacuuuaacuuacuucucccauguuuaauuuauggaaacaguacuugcauugguccuucugcccccucauuguguuuccaauccaaagucagcuggaaaaccccucuaauucuccuuaauuccucaucguaggcgguagccuaguuugaguaugcucccuggguuauacugggaauuagacuagugacuuguccuuuguaaaugagaguagaaauauagcaaaagaacccauccuuuaaaaaagucacuucauuacucuccuacuuuuggcaguuucgaacucacguuuuguuuuacuuuguuugugauaaaggcuguuguggugacugauggagagaggauccugggccuuggcgaucugggugucuauggaauggggauuccaguagggaagcugugccuguauacagccugugcagggauacagcccgagaagugccugcccgugugcaucgacgugggcacugauaacauggugagugcaucucuccccuuccccacccaccccuguuugcagaugauuuguuaagggggaaagagcuuauaauuuuugauguuagucuuuuucuuaagcuuggcuuuuaauguuuauguaaauaacagugaguuaauaagccuauuaaguuucuuaaagacuuuauauuauauguuuaauguaaauaaauggaacaaaagacuuuauuuuugcauuuggcuuuuuauauaggcacuauuaaaagauccguuuuauaugggcuuguaucagaagcgagaucguucccagcucuaugaugaucugauggacgaguuuaugaaggcgauuacugacagguauccuaugaagccgacggguaugaaagagccucuguaagggaaggguuaagcugggggccuuucgugcccagugauagcgcgcuucuguugugcaucccuggcugggauuaccugauuucuggaaggaagucuguauucacggcuccuaaacccucacagugcgugcguuccucccauaagucuuccauggccagccucauucccaccaccccaccagagcucuccugcagcucugacaucgaacuugggccuguuuucuuggaccuguuuauuucuuuaccuaccugcuuauuuauguccuggagguguguccaucuguguuacuaugcgcauggggagaucugaggacaccuuuguggggacuguugucuccaucuaccuuucuguagguugaaugcagguugccaggcuugcuuggcaagcacuuuaccuggacccuagugaauggauccucuaaugcauauguuuacgcauuaugcauaauggauccuuuaugcauauauuuauggcaugcuauccugggaguggaauccaggaccucauacacaccagacaagcaccugaaugacugagcuagacugucaguucuugcaugugaucuuauucauaacuuguggucuucauacaugugacucauaaagcacccguguggggccccccacccccccaccccccgcacucgcagcugcugggcuauccugccuugagaaauuccguuaccgcauccuguuucuaucucaaauggaauucuuuccaaacugccugcccucuguauucccaagugcuaacaguggcaguagcguucacccauugccagaucuugaaucuuggugcuguuuguggcucuucuuuaccagccaaccgugccaucagggcuuccucaguaucagccgcauaagugcgugucuucuguuaccacagucuucuuucaacucucccggcuuccuauaaacccuucuccagcuucucucuaguuaauuuccaucuaacacuaggauuaaucauauaaaauaggcauugucuuacguaguuuuuugcaaugguuuucuauagccacagauuaaaacccagguucuucaucuuuauggccugccugugguguaugugugugugugucuguggggugugugugugugugugugugugugugugugugugugugugugucgugcauggaugugcaucucuauuuaugacccaugugccaagucaagcauguggaggucaaaagacaaccucugguguccaucccuacuucuaccgugaaucaggaucuucuuaguguuuuuucuacuauauacucuuaucugacauacucuuuaagcugcuagccggcucccaagcuuccagagacuacugcucugcauucugucccuguaagaggcuggguuacauaugcucacuggacccagcucuuauucuugguauuuggacucaguccucacgcuuaaugggcaagcacuuugaccagaggggauaaaauucuggaagccaucuugcaaacucagcuuuuaaaauuacaggcaacaaaauacucagaaaugaguuccuuacucuagguaaagacgauggcagauucaaggcugaacugcucgucuucuuacacgcuguccucugguccuuccuccuucacuugccuuccccggacaagguggcguuuucuuagcugugccacugccuuagcagugaacuggcuccucacucugcagucugucuguucucauggcacgugcuucauguuuccugugucauugcuucugucaucuccucacaugcacgugacacccaccagcaggcuaccuuggugaauucuucccucgacagccuucaggaagucaacaugagacauacaaguuccuuguccccuccuugacuuagcuucuccuuguccuucagugugaauacacuggcuacugaacgugcaaggucuugguuaacuccccucucugcugcgucuucauuucccaggugcagacucagugaaacugccuuucuauucuucucugccuuuucuuuucuuugguuuauuugucugagucagucuccccuguguuuuuuagacuggccucaaaccugugguccuccugccuuggccccucugcgucagugcacgugugccuccauaccugccguggccuuccuucccuucuuuccacuguucaccaagaaagcccucagcuggcagauguuuuuuuacuuaauacaucuuccuguuauauaagcagacacauccauuucagagcuucacccucuaaucuguagaaagagucccuuugggggcuaaguacuggccacucuccugggccucuggaaguaguuuauacaggccguggccacagacucauuugugcugcguguccuugaaauaacaggugucugcagucuggcucuagauuuucacaagcucugaagcucauggccuugagcuaguauaauaacuaacucucagacucuagucauagaaacaguaaaugggaaaucuguguaguagugaugcuuucaacaaaguuauuaagacuuugguguuucuagauacggccggaacacacucauucaguuugaagacuuuggaaaucauaaugcauucagguucuuaagaaaauaucaacaaaaauacuguaccuucaaugaugacauucaagguaaagcuaaaauaaaagacuuccccccaccuucuaagcguuuauaauguguguuuuguuuguuucguuuuuaaaaugucggguuuuccuacagggacagcugcaguugcucugucuggucuucuugcggcccaaagaguuauuaauaaaccagucucagaacacaaaaucuuauuucuuggagcaggagaaguaaguuuuuaaaccuuuuuacaauuuaaaggcaaugcucuguuuucuuuuguaaaguccgacuggccaggggugguggucaugccuuucauccuauugcacucagggggcagaggcagaagugaguuuuaggccagccuggacuacauagugaguuccaggacagccagggcuauagaaaggaagcgucugaaaugaaaguaagacaacacauuggugcuuauugaagauaacaaggaauuuagaauucacugaaaugguacgagaaucuugaccucuuauaaaauaaguaauuuguguucagagagacugacaaagaaucuacuuacguauaauuucuacagggagaacaaagcauaugggcguucccucauaaccuagucuugauuuuuaaauguguuuacugggcaggcugcacuuggaauugccaaucucauaguucuaucaaugguggaaaguggucucucagaagaggaggcgcagagaaagaucuggauguuugacaagaguggcuugcugguuaagguaagggugcagaaccuggagaagcagccgagccucuggcugugguguuggaguugggcauugacagcacccucucuugccauccuaccccucacugaccuggcaguguacaggagccggcguccacugcguccccagcacagucaccccgccuggcuggcuggcuggcuggccugcucucaguuuuguggcugugauaaaaugacccuaaccaaaaguaaugcaggggagaggagacggggcucccuuggcuuauaguugugauuauaauccauugcuauggggaagucaagaaacugauacucacugcacaggcaagagcggagagaguaaagguaugagugcuugcucucggcagucagggcaggcuguccaucuaagccuaauuaaggcaauccagacaccaccucacacacacacaaccuucacacaugugucuaacucccccuaggcaugcaugcccaaaggccagccuggucuaaauagcuccucauuuagacuuuuaucaagugaucuaagguuguuguugaaacuggcaauugcagauacacugucuuuuuuuuuuuuaguucauacuuaaaucauaaucugcuugcuacaagacacacucucuagcauugugcucaggcucuuaggagauggaauaauuaugaugucugauuguaucuaacucuuuuaaacugaaauguugugugguacuaaggauucaucccaagguuuuauaugcaugcuagucaaacauaaacauccuaccauugggcugcacccucaaacuaaguuuugaauuggaauucaacauccugcagaagcuauuagcaauacaucuauuuaauguuugagcagaaacuccuaaagacuguaauguuuaaguccuaaucccugguguuaguccauguguaggagggucuucccuccugagccugccugcauuccuuugcguuguuacuccuacuaauuagcuaacgauuuucauagggcauauguuacauguguguuccauuuauccaguaugacugcuauucuaguuucccaugucuacaccauaaucuaaugacaggacaucuccuucccauucacaugcauacugcaugcuauccacauacauuuauauauauggagcauggauacgccucucauccuggcuauuuucuguucaugucaauaaucagauacugggauaacauuagauguuauuaguccugucaaaacacauccuuaggcagggaggcuagggucugaggggugggugggaguggauauuggguuuuuaucuuguuuuuguuuuccuuaugaaauuuuuuuagcucauuuuuuuuucuuacgaaauuuuauaaccacagaaacaaguuuaaaaugaucauugagguggggguggguggguauggaggacuuuugguauagcauuggaaauguaaaugagcuaaauaccuaauaaaaaauggaaaaaaaaaagaaaaaaaaaugaucauugagggcuggagggguggcucagcaguuaagagcgcuugcugcggaggcuuuuuuuuuuuuuuuuuuuuaaugaacagagauuuuugccuuuucaaagucauuaguuucaaagagacagaggcagaauacaaaccuaagcguguugccugaguuauagaguccagacucugacucgugaagcuguccccacggcacugugccucaaguguuugcuagcauauguuucuacacauagugaaggauugugaacgucacguucuuaccuagaggggaguaugucucugcugacagacagcucagaccuucaccugguugucaucaaggguauggguauaaaaugacugccaccuuggugguggauacaacagcuucccccacagccaagaauuccuguuuaccuccaaccucaaagccugucuuugcucuguucuuuagaauguauagguagcuuggcugugggccuugggauuucagaucucuucuagugauccuaaaccugucauccuuuugcagacgcugagugucccccuagauccccacucuccagagcugggaugaugccaagacaguguaagaagccaguauucugauuagucuuagccuccuuuaauuagagauggggagguggggcagggcuuuaacuccguagugagcuuuagaccagcugaggcuagguacccuagggagaaggcaguuggggagucggccuuaacaacaguaaagcguuugacuaguauguucaagcccugggguucuuuuucuaguaccaaaagacaaaacaaaacaaaacgguuugauguggcuguucauaaguuuguuaggcuguggucuucacauauggugggcaaauuuauaauacuuguauacugcuauauuacauucuuaaaauacuaaagauuauuaacuguaaauacggauuuuaggaggaugaguuuuugagaggcacugcaauguuucuggacagaauugauuugaugagcuguguuugaagucuguaaaguuagaguuagcagauagagguggaagagaaaaguaaaccaaagacauuagugguucaaggacaaaaucuuucuaacagacaguucauauguucaguuuaucuuuaauaugcccuuacugacacuguacuuuaucaaaacccacaggggcggacugcuagcauagauagcaaccaggaaccauaugcccaugcggccccagagagcauaccugcgacuuuugaagaugcaguaaauaaacuuaagccuucaguuauaauugguaagugaagauguucguacguaauccuguccuuuaacugucagccguaacucgcauguaggauuacuaaaguaaguugcugcauuuuuaccucgccuucagcguaugcagguggucucucgguguguuagggacuggugggacagcccaccggacucaccgaagccuggugcgccuaaguccccugugcucagagggguagggcugugcauaacccgugcacgucuugcagugcaccugagugcaccucuaguggcuugcugagugggugcugugugagugguucuucugcuguauuguuggggaugaugcagaaaggcgcacgugcucacucugugcacagcuuuguuucccucugcacucuugcccuauguugaaaauguccauguauugagucucacagauagagagggcuggcuccaaauauuggacuucucugcacaaagguuuuaagggacaggauuccaugcgaggcauguggugcacacuuauaaucucaacacagcagagacuaaggcaagauuaugaguucagggccaguuugggcuacacagugaaacaccuaaaauucuggaaaggggccggcgagacggcucagcagguagcggugcuugcugcugaaagucugaugaugugaguugagucccuaggguccacuuggcaggagcagagcauuugccacauguuguccucaccacauguacucuguggcagggugcccgggugccccagacucacacauacagacacugaguagugaauguaacuacacggaagcagcuuugcucuccuguaaacuggcuuugaacaucugggcuccagugugugucccaccugagucucccaaguugcuggggcuacaaaccuggcucuuuaugguguuuugcuucuagaguuguugugacuguuaaacucagcuuuaaaagaccaaggucauuugacagacuauaccaggaaaaugcagugcagagugagaauuucaaaguggaaacuuuccauguguuuccugaugucgacacuuguugcugugcugacacagcgaugaguucuuagcacagacgcgggcuguuugauucucuguagcuucuaguaguuuucaugugggaacucuguuaauguuuaacuauaaaaucuucacaaugaguuccuaugcucagaaaaaugucuguuuucucucacacaggcgcgcgcgcacacacacacacacacacacacacacacacacucgagcaugcacgcacgcacaccaagaagaucuuacaggguuuucuacaucacuucucuuaaaagucgguauggaaaugugagaauguagucacucgugugucuaucuccaggggagcaaggaaacagaaagaaggugagggacuguucucagcaaaggccacauuuaguuaccuccagaucccaccgaggccugaguguucucccuucacacagaucuuucacaaccuuguacaauuugucuuuaacaacuugcugaagaaaaaauucugcuuuauucuuuugucgacuauaaucuggcuguauuacauucuuuuuugcuuucuuagugcuagagaccaagccuaggguuuuguguuugcuuggcaagugaucugcuucuuagcuaaauccccagucccuacauccuacauccagcuuuuguuuuguuuguuuguuuguuuguuuguuuuuacgagguuucacuauguagaccacgcuggccuuaaacucauagagauuugccuaccuuugccuccugaguguugcaguuaaaggugugcaccaccacacccagcuccuauguuuauucuuagaccuaguggucuaauuuagugucugggacauggugagggcuuaguaaagguaaaucaacugcgucgaaaaagugauugcuuuagucaggacagucuucugaccacuuaagaauaccuauuucugaguuugaggccagccuggucuacaaaagugaguucuaggacagccagggcuauacagagaaacccugucuugaaaaaccaaaaaaaaaaaaaaagaagaagaagaauaucacuuaagaauuuccagcugcagucaggcuguuaacuauauauauauauauauaggauuuccauuaccggcaacucuacguugaauaacguagcacucccccuaucccuggcagcugcucucuggucucucucugaggguucuuuggggucacucagaugaguagacgcucacacagcacugugaaccucgucacugguuagcaugauguagauucucccacgcuggacaguuugcccuagaauuuacugugugugcuagacaauaaauguguaagugagaauuuccaacauuucauuguuugccuguucauaucugaagcugugcucucauacucuucucucagcaauacaaaguccgucuuuguaccgauacccgugguuuccucgugguaaauguuuuguagaaacacuguucgugagaaccgguuuguuauaucugugcugaaguuguuugguuuuuuuuuuuuccuuucuuuauugcaggaguggcaggugccggcccgcuuuuuacucacgguguaaucaaagccauggccucuaucaacgagagaccuauaauauuugcucuaaguaauccuacagcacaggccgagugcacagccgaggacgcguacacgcucacagagguauuaucagugagaauccugcaaguugguucugucucguuggcuuguugguugcacuucuugcacacucaguucguuaguguuugaguggagauggcagugagucaccaagucugccguaagugugucaguucugagagaguuacugaaugccggcuacugcucacuggcucacucagcucugggcuaagccccuagugcuuuucuguguauuuugaaaccaaauauguuucuuuuuuuuuuuuucuuaauucuuuguauauagaaacuauccauuuagaugugccuacauuuacauuuuguuuuguuagcuugcuugcuucugucuuucuguggccaucccuccugccuggcugcuucugucugggaugguuuuccuccucccagaaggccuuaaguauggaucugaagaauucccauggugccauauuuuaccugcaucuugaagggcauuuucaccccacuuggaauuaagaacugggaguugcuguaguacuuuaaaaguaguugguuguuuucuggauugugucuugacaccauuccucuggguuugaaccuacauaugacuuauugguccucccuggaggcuagaguacuccugagucuguaguugauaacugacugcugcgguuagcuuugguuugacacaggccuggugucucugcuuuggccacguucgcuguugugagacucgauugccaguguugaguguuuguguuuuugugugugcugcccacuuagcucugccucggucugacugccucgguccuuccacuugguggucacuuuccuacucugucguucuguccuuggguucuuaguuuuaguucuuauguacuuuucagucauaaaacuucaagauaaucagaaacucugcuuucuugcccuuauucuauaaaccauccuuuuacuugccuuggaucccuuggccaucagcuuuugccuuucuagggcugccuuuaucuuguuuuuaaaccaauggcugucuggaauggauuuuuuacuuuucccccagccugguagcaggccagugcuuuggggccuuugacgcuguuguagagcguuucagcuacagaccccagcuucugcgcugucauguagugggcuuccccgugcucugccggauggcguuuuagccuccacuguggaccguggaaucacuucuugccuccuuguaggucaucagagugauuucgggaacugggagcuuuuggguuuuuguucuguguaaugaaccuacuacagccuugcagauauacacauuuaggcaagcaagcuaccacuaagcuauauuccuaggcccuaggaagugaauuuuacaguucuguuuaccaugauauaucaaauucucauguaacuucuugaauaugugacuacaguuguuggguuauacucucaagaauaaggaauguaguaagucuuuaauauucucuccacuaauaagucaccgguaaucuuguuuucuuucauaucuccucggaugauuuuaaagaucuuggauauugauuguaggcauaucucucagaaguugagucucaaauagcauacaggugcuaguaagacggcucagcagguaaaggguucugcacuggccuuggcaaccuuguucagcuuccagaauccauguggugggaggagagacccgacucccacaaguugucuucuuagcacuaccugugugcccugauaggagcucguacauccccguccaguaaacaagugcuuaaaauguauaauuauaaauaguacugugccauauuuaaacuuaaaaacaugcuuauuuauucuguguguaugaggugggcacacacacgccacacaacauaucguguauguguuggucggaggacaaccuggggagccacuuuucuuuaucaaauuuaggcuuggcagcagacacaguggccaccgagcccucucacugccccugcaguuguaauguuuaguacuuaguuuacucccuacccuugccuucagcuuucuucugaagaucuuuuucccuuuguggauuuguuguuuguuuugaaacaaaguccugcuguguauguagccugggcuugaaccguaguaucuccugcuucaacuucucagaugcugggauuacaggccugcgcuagccaccauaucugacuguugacauuuuuugucguuuuauuuacuuucuugaguaugugaauucuaguuaaaguuucugauuguaacaaagucucacuuucuguaaauccauuuuuauuacuucccucucucccaacuuaguaauuaguuuuuaauucucuucuaagcauaguguuugcuggcuuuguauaucugagugcugggugauguggauggcagguuguaaguugcgggaggcuuggggugagccuaucuuacuuggggccuuuacuucuccaauggcuguuaggcuggcuuugaucgucauaacucacuuggcucaucagguaaggucuagaguucuauccuguccucaccccuuccagcugggcagcucuuuggguauaaaucugcccugaagaaucucuuagcagcuuuuaugguuccugcucccugcacuucagugucaaagcucugcugcuggggaccucagccacaccuuugcugcuggcgucacgugugggucucaggagccuucgucuuccugucccccaguccuuaauaccauugccguggugacugacacccugcuucuccucgggaagguuuuggacuugguccauguugcagacuuccguagcacuucuuuuucucuuuguuacggagugcuuaucuccugcuuuccugucgcuacuguuaggaaaaagucaauucugugaauauauuagagauaaugauauaaaccuuucauaccgauugaaacccuuucuuuuuaagucagucacaaaucaacauaaagaguuuuuccagcucaucgcuuccuuuccacccuucccaggcaccgggcagcacagggugcgcagacacgcgugcagccaaacacacacagggugcgcagacacgcgugcagccaaacacacacagggugcgcagacacgcaugcagccaaacacacacagggugcgcagacacgcaugcagccaaacacacacauaaagcuuucauuguuuccuaaaauuugugcuuaagcuuuaccauuauuauuaucaucauuagcgucauugcuuauccuaucuaccagguuauuggguauaguuuaccuaguuuuauauggguaaaauggugaugacugcuguucuccaaguuaagccuuucucuugcacagugaauauaaggcucagauccaauauaucauuagcucugacauuuucaaguaaaauuauguauaacuuauuugcauguggguagacauauguguguguguguguguauaauguuuuauaaaguaguaaaguaauacugcucaggucuuugagaaauuuauuucugaauaugagugugcugaguaauauuauugaacuaaauagacaucuuugaaggaauaaaauucuccaaggagaaucguuggauaaacuguaaucggucaguuuggagugcagacuuuaggcugcaggaauggcucagcagguaaaggcccugacccccgagauuaguguucugaguucagccugcaguuccauguggaaggaaagaaaaaccugccagggguccuccgcuuuaucuuaauguguaaccaagcaccaagugugaaaacucuucagaccugcaucucuccacagcucuguaacuuugaagccuuaccagaauaaaaagcguggagccauugaaucauagcuuauagauaccuucucccugccacgcaaaacacugguguuaaauuuugaauuugccuuuuaaguuuguagugccccuccguugaggggagaaaagacuugcucuaacacccucugcugcucagugagaaaaacacuuucaguguuguucagguugcccuugaacccugcuaucuuuuugccucugccuccugaacuaccaggguugcaggugacugaagaaugucuuuauauuucaguagccaguuagagcuggcgugcagaacgggauugcuacgucaugagaucugaccgugugggcgugggaaugacucagcauauggaguugugugcucaggaugcuuaccugagccgucagcauaguuguucccacaccuuuuuuguuuuguuuuguuacagugagcagaagguaguaccagucaaaacagguuuucaggaaagguaaacgaccugaacaccacaaagaaagcacccaacacagagcuagccgagcagauguuccauagaugggagcaaauucauuuuacuauuuuucacuucacuuaugagguucacacugcugaugacucuuucuuauuugagaugcuauuuauuaccaguugugcuuuuauaaacggaguagaagugcuaggguuuaaagagagccucauuucaguaaaagaauuuacaggauuguuuuguaguaagugauuucuuguuuccagguaauguaguugucuaauguuuuaugaauuuuccugaauaagugccggaaaaaauuagauuauuuuaugucacuaacagggcaggugucuguuugccaguggcagcccauuugagccagugaaacuccaggauggacgagucuucaccccaggccaaggaaacaaugcauauauuuucccagguaaaugccuucauuacagauguuauagauccaucauuaauugcauaaaaaauauuucagaggacugacucagagcaccaggggcuuuuccagagaaccugguucgauucccagcacacccucauggcggcuccagucccagggaagcugauggcucggcuugacuuuugauugacuuuugucagccaugcauaaaagugcugcaaagcauagacccaggcaaaauauccagauaacauaaaguaauaaaagaacauguccauggaauucuuuaggaguuuaaaguccacauaauggauaguauuuacugaagugugauaugucaagggaaacaaggaauucaggaauucuaaccugcucuguuuucuuugaaaaugucaucauacuguuagguuuuauuauagagauaauacagugcauguucuauaaauguucagaaggacagaaggcuaugguuuucagcucuguuauaccuuugcaccacacucuggaauauaacugcugucagguauuugcccuuuuucuuguggauacagucaguaggcuuaucccuuuaucauggaccuucuaaauugccuguagguguggcuuucccagugugauccaucagcaguacuacacaccuuccucugauccucuccugcccugcaggccugucugccuuguucuccugagacauugagcuuuaccugauacaacaaaggguuuuguuagaaguuuacguuuuccuguuggugugugcgcacauauguguaugaaugugugcacacagaugcagaggaggacaucuguauccuuuacugcucucugccuuauucuugagguguggucucuuucugaaccuggagcucauguucuuucagcaaguauggcagccagcaaacccccgcaauucugucuccaugccuauaaaccagugcuguguuuacaagugcacacgagaccaugccuggcuuuuuauguggguucugggauccagacucggguccucaugguuguacaacaagcugccugaaccacugaguugucucaccaguaccaccgauuacauucucaucagcuugccaggugaagaggggaaacuaugcuaauguugagcuuugaauuuauuccacucuugguaaagcucacuugcuauuucugcucuguggaguucuucagcaaguguggugauccaucaguuuccauguucugucuaguuugauugaguauucaaaacuauaaguagaaaagaagacuuuuaguagaaaagauuacguaauuagcauucaccaacuagauugucacuugguaagaauagaauucacugucauugcguuuguccacaagaaucaauaugguccucccuuacaguuuccuguccucaccuaaagauuuauuuauauauuuuauguauaugaguacacugcagcuguacagaugguugcgagccuucaugugguugugggaaauugaauuuaggaccucugcuugcuccagucaaccccacucacuccagucaacuccgcucgcuccagcccaaagauuauuuauuauuauaaauaaguacacuguaucugucuucagacguaccagaagagggcauagaucccauuacaggugguugugagccaccaugugguugcugagauuugaacucaggaccuugggaagaacagucagugcucuuacccccugaaccaucucucuggcccccauccucacuucuugaucucuguaguaaagugucucagagcucaccugcacgagugcccaccuucuauccucuguuucuagaauauaucuuugaauaagguuuuuaaaaaauucuaaagaaugugugaaaccauguguggccauacaggcccaugacccuacacuuggaggcugaggcaggagaauuaucaugaguuugaggccuguuuaggccacauaggaaauguaggucagccaggauugcauagcaagacauccucuccagaaaaacacucaugcacauaaaauaaaaauaaaugagucuuuaaaagaaagacagaggccgggcaugguggcgcacgccuuuaaucccagcacucgggagacagaggcaggcagauuucugaguuugaggccagccuggucuacagagugaguuccaggacagccagggcuacacagagaaaccuugucuugaaacaaaaaaacaaaaacaaaaacaaagaaagaaagaaagaaagaaagaaagacagacagacagacagacagacagacagacagacagacagacaacgauaugacuaaccagccuuuggagaucagaagccaguaauguauggacugauaagaugugagauccugggucaagauuaaagagcagagagcaugcugaggaggcuagaguuuguaauccccuuagcacgagaaacacacacugaucaggaaauaaacaaccaagggacaaguuauauuugcccuagaggaaagauaguauugacauuuguccaguuaugaccccuccccuuacgaguggcuacccaucuugggccgaaacccuacaggacugcaucugggagcagacuguggcuguagcuguggcugguuuagaaauguccagccuuugcucuggaugccggugccuggcggaaccaaguagaaguuuucucuggaaacgcagcaccgguccucaaguuguuuuucuagagaaacguacaaaugccacucuugucuagagggaaaagggagaccugugcaaagaccggacuacccaaguccagcagacaagagggcagguucaggucuaaugggcagccagugcuguaacacaggcaugauuguuauuuuacaacagugaaagccaaguuugagaacauuagccagaaucacugacuucugcaguugaguagcaauaaugaucuaaugggugaguggagaugagaccacagcaaguaacuggagggcagcacagaagaaacuggaaaugaagcggaguccaaggggaaaauacaggagagcaagcaagagaccuguaauugcuaguaaaguccuggaagacggugaguauggcaaggaaggagaggcagcaucauaggcuguguggcuaagagugccuuccagcauaccucaggaaaaggaaaaccugugggguagaccagaaggccagaccucagacccucacuuugaggcuucagaaagucccgaggagaagucauggcagcggcugguccacauauaggagcagcauuugguuucucagcaccgcugagggccaagaggaagaggagugauguguuccuauugcuuguaggaaauacuuggcagccucgaguucaguccacaagagcuagagcaaaauggagacauuuuaggaauucagagagcucucugccugcauacuugagugaaaugaaaggacagggaguguuguuccucaggccagugggaaacagucccagaagcucggguguaaaggaagggugggcaaacaugucuuguaaacaugcagggaagacagagcaaggguuuauagacuccaaacagucacacugggacacagaugcacagcauugcuccuucaguuaaacagacccaacguguuaugagggauccacacuagcaggaagguacauuuuaagcuaauggaaaaaaaaaauuuuuuuuuugaugaggauacacaauguaaacuugaggauaauacuagaauaccaccacaacaacucauuuccagucagggaauauuuggggagaaagugaaacaauugaaaaacaaaagaaaaaaaaggaacuguacgccaggcaagacagcugucagucaaaacaccaggcuuaagugucuucacucacgacacagcccacuaacagagaaggagaggagaagcuguaagaggaaagagaccccggggaagggggguggggugggggacuggagagaccgcucagcaggcgagaacccuggcugcucuccagaguguucaucuaacacacgucgugcaaaagcuuaaaaaaguugguaucauaacagauaaagcaguguuuaaauaaaaaggggcaucuugggagaaaacaggucccuacaggaaaaguuugaaggagcuguaaauaaccuuacagagauacuguauuucaaaugagaggguuucagguuagaaacagcaaauucaugaaauaaaaguugauaguagaaagaauauaagaaagaaguugaggaagccacuaaacaguugggacaggagauagauaacaaauaaauaaagucacuugucuguuccaugauuacagauagauaacaaauaaauaauaaagucacuugucuguuccaugauuacaaggucagaaaauggaaauuucaggacaaaaggaaagaaaaaaaauggaaggacaucaaagacuucagaggaagggcucaccucugagugugagacacagcagguguggaaagauaccccaagacacaggguuauaaaguuagucuaagagcucugugcuuccagagaugaaaagacagaugccuaaacaggacgugacaccagacagacccugggccaaggcuggaagccaggagaugcagagcucugcaggaaacacguuuccaaacuaaaauccgaagcccagaugagcagaaagagggaaacacacauuuucagaaaugcggguuuucaaaaaagagaaaauuuauuuccuaucaguuguuucucagaacaacugcaggaaaaucuguccuguuagaaagagaggguaacagaacaccggcaaaggggaguuaguaauugaagucagagaaacccgucccugagugacagggugagaagagaggcgagcagugagagcugcagagauguacgccagaaaacccacaggcugcaggggaaagcacacaaagaugggcaacugaggaagagcuccaggagggaaugauguuagucacuaacagaacaguuaagggaggaacagaacaugaacucuggcgagacaguccacucugccuggguuaaauagugccuacaaaguccucauguaaacggugaauguagguggacccaagcuauguuucuguccauguuggggagagagagaaggcuagaaguagcaagagggcagguugcuugcauucgaucaggaagaauuggaagucuuuaaagcucaagaaucuaaagaaacuagagcagguuagucaagacucggaaacagugagauagugagcugaaggaacggacagcagcugcucggguugaaauccgggucggguggcugcuugguuguuuucuuaaagguuagcaaguguguacuucuacuuggcugauggauguuacuuuugaguuuauaugucugucugucugucugucucucucucucucucucuuucucauuuuuuggcacuguugacugaagaaggcccuaacacaaacccauaaauauuugcuauguugauaauugucaaaacacugcaccuauuucuaaaaugcuuguguuaguggugagaagcaagcauugacaaagaucacuuuaauucaguauugcuuucucuggggcaguugcauugggagcuuauugcaguuuauuuuuucucaguugaggaauuuagcccuucauaauuugaaagguggccuuacuaaaugaacuguguaacauguauucuagguguggcuuuagcuguuauucucugugaagcccgacacaucagugacaccguuuucuuagaagcugcaaagguaauguucuaaauacugcugauuuucuauaaagcauagauuguagaggugcauagaucuuaaaacaagagucauuaaaucugcauuauggaugaaaaggaaguuagcaauccaugacuuuuuuugucuacuucuguauuauguuaauuuuuuaaaaucccagcuuuucaaaugucuguagacgcugcgauucaguuuggauuuauagcauguuguacuguaucucauguuccgugcuaccauugugucaugugaccugucauaugauggcagugcagacagcaucagugauuacaacauagauaaaaauauuaacccuucccucuuaauggaguacugcaccuuuccaaaggcacucugcagagcucacaugaguaccagugguacugucuauucucuucuuagcugcugguauccccagcguucuaugugugaagcaggacguguaccccuagaucucuagaucugcuuauuuauuguucaaugaggaauuguguuguuuugguucugguguguguugguggggccuuguagcuuguagcuuuguuuucugacugugaagugcuggcuagccuagaacuuacauuguagacaaggcuggccucaaacucacagguccccuguuuugccucugggugcugaaaugaaaggugugucccaccaugcccagccaugaugagcaguugugguuuuuuaaaaagaauuuuuauuuuauguauaugaguacauuguagcugucuucagacacaccagaaagaagaaaauaucagaccccauuacagaugguugugagccaccgugugguugcugggaauuagacucaggaccucuggaagagcgguuagugcucuuaaccacugagccaucucuccggccuccaugaugagcaguuuuuguuuuuguuuuauauuuauuuauuuuuuauuagauauuuucuuuauauacauuucaaaugcugucccaaaaguucccuauacccucccuccacccuacccacucacucccgcuucuugucccuggcauuccccuguacuggggcauauaaaguuugcaauaccaaggggcuucccuucccagugauggccaacuaggccaucuucugcuacauaugcagcuagagacaugagcucuggggguacugguuaguucauauuguugucccaccuauaggguugcagaccccuucagcuccuugagugcuuucucuagcuucuccauugguggcccuguguuccaucuuauagaugacagugagcauccacuucuguauuugccaggcacuggcauagccucauacaagacggcuauaacaggaucccuucagcaaaaucuuucuggcauaugcaauagugucuggguuugguggcugguuaugggauggauccccgggugggguagucucuggauaguccauccuuucgucuuagcuccaaacuuugucucuguaacuccuuucauggguauuuuguucccuauucuaaggaggaaugaaguauccacccauuggucuucccucuucuugauuuucuuguguuuugcaaauuguaucuuggguguucuauguuucugggcuaauauccacuuaucagugaguacauauugugugaguucuuuugugaauguguuaccucacucaggaugaugcccuccagguccauccauuuggcuaggaauuucauaaauucauucuuuuuaauagcugaguaguacuccauuguguagauguaccacauuuucuguaucuauuccucuguugagggacaucuggguucuuuccagcuucuggcuauuauaaauaaggcugcuaugaacauaguggaacauguguucuucuuaccgguuggaacaucuucuggauauaugcccaggagagguauugcuggaucuuccgguaggacuauauccaguuuucugaggaaccgccagacugacuuccagagugguuguacaagccugcaaucccaccaacaacggaggaguguuccccuuucuccacacaugaugagcaguuuuacuuucuacaaugguuuaguguaguccuauaagaaauaaaaauuuuguugucuauaauuuucuguuucuccagugcuuuuuccauuuuucuagauuguucuguuuacauaaagauacgacgcuguuuuuccucucaggcgcugacgacucaguugacagaugcagaguuagcccaagggaggcuuuacccgucgcuggcuaauauucaggaaguuucugcuaacauagcuauuaaaguaagcaauuuaugccacuuuacauaaacucuaaugacauuuucuuguccaaguaauauaagcauauuagacauaaguuucuaauauuuaggaaaauuuauaugguacacauucugauguuuuguuuuauaaggaugugauguagcccaggcuaguaugucacgugugacacagugaaggagacccacauauucuggaugaugguaggauugugagcucaggcuuguugcacuccuggccuggggaagggagggaaucugcuguggccacagagguuggcauuccuuuuuaagagacaaggcucaggaaaauaugcacggcucugugcccacaggagccugccauccccaccuuauagcccagagacuaugugccugcccacaggagccugccauccccaccuuauagcccagagacuaugugcccgcccacaggagccugccauccccaccuuauagcccagagacuaugugcccgcccacaggagccugccauccccaccuuauagcccagagacuaugugcccgcccacaggagccugccauccccaccuuauaguacagaggcaggagaguugugcaucagggcugggcuccugugcuccugaguuuggugccagucaccugccugcgugcauggccaaccagggcuccuaaucugaucuuuuuugccagccugucuguuggggagaaauugccagugggaaccacucuguuccugagccuugugacuauuacagauuaaacacaaacuuacauugacuguagcagcaccuuauuguuuuaggugccugcuucguaucuacacacugugacaaagugucccauccucccuugaagaaugguguccccuuuugaugaaaucuuuucuuuuuuuguuccuuccccuuuuuucauccuuuuuuuucuuuuuugagauaauuuuauauguguauguguuuugucuacacuuuauuguauagacauucaaaugucccacaucauuguaguggccagaaaaguguaucagaccuccuggaacuagaauuacaggcaguuguaagucaccauguagguguugggaacugaacccagguucuuggcaagagcagccaguacuccuaaccauggggccagcucagaauuccaaguuucuuuguugucugacauuguuauuucaggaugggccugagaaauuuauaaacuuuuagcuuauucaauucuuguuaugauagaauugaugaggguuuuuuuuuucauauuuuuauauuuuaaucaaaagugaaaaaauuuuccccuuuauguuuaagagaaaagcacuaaaaauauaagaaagauaguuuagaguuugaagaaauaggguuuaucacacugggcaauauaucucaagcuggaaagaauucaaaucaaaauugucuggaaugcucacugacagaguccgggccauacagcaaggcuuuggucauaagaggguuuguagauuuggggcggaguccagaauucccacaugacgcugaugccugggacccaagggccuugauuagcauuggcaagcacacauuggaaugccuagaagcuaagcacugucccggcaccagccuggauagaugguaagaaggaggaauugucuagagucaagaucaggaaguuuccaucaagaagacuggcauacacaaagauucgcucugaaggcagcagaagccauugcagggcugagucagccccgcguacuucagaacaguuggcugaccgcagcugacgccugcaagucucugcuccuuuguucuguucguuuggugcaugcuuuguucaguuuguuuuuugagacaggguuucucuguaucccuggcuguccuagagcucgaucugcagaugaggccugccuagaacucagagauccaucugccucugccuccaggaugcugggguuaaaggcgugcgcuaccaccaccugucugacgaauagggcgguuuugauuagagucuaagcagcacagccccuuucagcagggcuaugggaauagaggcugcuacaucaccugcauggagauugacauccuagaacuuagacgugccuguugaauguaaagaaauacuaagcauucuuuucuacaucaggaaaggugaccagaacacaucaaagcuuucacgagaugacagauaauuuuuauuaucucuuucaaacuugacacguuuuaaauaauuugaaaugagucaaagucauacuuggcauuuuggaaaaagugaaguauaauucaucuacacgugugucugugucgugaugcuauuugauuucucugagcgacagucggagccuaaacagugaugcuguucauuucccagcuugcagaguaccuguacgcuaauaaaauggccuuccgguacccagaacccgaggacaaggccagauacgugagagagagaauauggcggagcaacuacguuucccugcugccggacguguaugacuggccagagucuucacugacaccuccucagaucacagaagagaagcuuccccacugagacgcuccggccuucagggaaccacuauuuuuagacaaaaagauaauauucucugaguuacggugucaucugugguuuauucuuccguacccacuuugcuuggcuuuuuuuuuuucccugugaaucucaguuucguuggggacagacaugcuggcuauacuguagugcccacagcccaguucugggaaugcguccguuccgaugggucgccuccugcgcucugcuuuaagcuugcgacgguacugucgcuguuaacgugaauguaucucucacuuccccccucagcccuccagugcugugcacgugagcacagaacguugagaaggagugagugcucaccgaauuccaaagaaaacuugucagcaccaagaaacugcucuguucuugucacuuucugcucugacgucccuuuguaguuagacagauuuggggaaauacaaaaaaaaacuuccuagaacuaaaucagugcuaacuagcauuauagaagagugggaggagccacugcugccuuuagacaaacuggacugucacgugcaacaguguacaaaacccacuuuuauuaauaaaaguaauuccuuacauuuaauugcuucaguuacauuaucuuauugaccaaacagaaacuuacguuuguugauugugagaacaguuucaucgucuuucucugcugagaauggauaauagguuccgagcuuaguggagaauaaauaaaugaacuagaccaggaaaugccuucuuuuguauuuucaagacaggaucucacuauguagcccuggcauuccuggaacucacucuguagaccaggccagccucgaacucagagauccuccugccucugccuccggagugcugggaauugaggacguacacugcucccccuggacuguacaccuggcaggaaaugccuuuaaaaaaaaaaaaaaaagauuuauuuauuugaguacacuguaacugucuucagacacaccagaagagggcauuagaucccauuucagaugguugugagucaccaugugguugcugggaauugagcuuagggccucuaaaaaagcaaucagugcucuuaaccacugagcuaucuccccagcccaacccaggaaguacuaucuuucaauccaaggguaacaucaguguucaugagucauguucugaaagaacccugaaguuuguuggagaaauguuaguguuuguggcauucaccugucuagaugcuuugagggacaaaguuuguucuucuuuugagauuuuagcaagcugaccugaaacucacucugugucccugacuuucuuccaugcauguguuguuaucauagccaugaaccacaauggucaggaacaaaacuuaaaaaugcucaccccagaaugguggcaguacagagcgguuuguagguacauaccaguguguguuuauacucuauaggcaaaggggacuucuucccaucuuccugcuuaagauugacuugaaguucugaagguguguucagacugcuuaguguacacgaccuuggguucaguccacagggccaccccagagaggcagucuuacaauggcauugcaguuuuaaguauggguggacacgaugguuaauuuaacauaaguagcagucuguucaauacaauaaugaaguaaaucauugauugaaagaugaauacacagguacgagucuaguacugaagcaggagaaucucaacuucaaagccagaaugucuacaaaagaacucacaaugugauugcaagaugguucagugguuagggcucuugugucucugagccuccacauuuaaguuuaauuccaggacccauaugguggacagaaagaaccaauuuccagaaguuauuuucugauuacccucccccgcccccacuugccacacacacacacaccauaaauaaaugaacaaaaaugaagagaaac

SEQ ID NO: 8981 - RNA, 2502 nt, Mus musculus
uucucuauuuuguaucuuuuuaaaugucuuacagcagccauuuugugaauccguuggguuuacuuauuuuacuuguguguaugugugucugucugucugucggugggucugugcauguguguguaggugcuugcagaggcaacagugucagaauccucggagcuguuacaggugguucugaggcuccugaugugggugccuggaguugaacuugaguucucuggagagcagcaaguccccucagcuccugacccaucuuucuagcacacuaugccuggcuucuuagacuggcagauguuuccuuuucucucucuucuuucuuucucuuugucuuccaaucccagcacugggcccuguacauguuaagccagccucugucacugagcuaugucucaaguucuacuuuaugguaacauuuaaguguguguuuuuguuacguguaucuaaugaagucucugguuagguuggaggucagcuaaagauucagcaaagccuuaaaugacuggagcuagaaccgugcagucuugcaugcuuccuuuccuaagggcuccguugcauggugugugcaggcccacaccgcugagccaucgaguagcuccugcucgcguagccugcagguuugcuucuagcucugccugguaaaaugcuccuugaucguuguaagccuuuaguuauuuuccagaacuaagagaagaguugaucauuuggcugaugcucucagcccuuuuaaggaggaaagauuuuuuagaaauccacacccaagcauuuuugcugggcucauuuuaauauaauuuaucccacagcuaaaaacuggaaauugaauguucagacauagacucauuuuuaacuguauauucuugguuucauuuauguguuacaugcaucugaacgugauaugaggucuuaggaauguuuucuaagcacaaauggguuagcagugugcuuugauuggcaacucugaauuauucaugguguggauauaccauagauugcuuacugcacagagaugaccuuuaucuagucugugaucuagggacuguuagaacugcucgauguuauauaccucugcauucccuagcuaucuagagauguaucuggaauggcuaugugcaggucauauugcuuaacuacaaaugugugcauuaaaguauuuaaguguagccaaggugguagugcaugccuuuaauccuagcacuagagaugcagagacaagcagaucucuugaguuggaggucugccucguuuauagaacaaguuccagggguaugcagagacucuguauugaaaaaaaacaagcaagacauaugggcuggauccuuaggcuguuuuccagaaucuuauacuacacauuucucugugagagguaacucuuugcauaugcucaucaggaugugauggcauccgccucaaagcauuuugaaauuccuggaaaguguauuuuacuuuucagaauuugcacucgaauuguguuuuaaaggacagugcuauugcugcuguaguuacuacuaauuuuaauucuuuaauucuuucuguuuuuagggaauggcguuuacguuacaagagcgacaaaugcuuggucuucaaggacuuuuaccuccuaaaauagagacacaggauauucaagccuuacgauuccauagaaacuugaaaaaaaugacuagcccuuuggaaaaguaagaguugauuggcgucugauuuuuauguuggcagccuuaucuuagaaucguggugugaugaaggcacagggugugugcacuccacacagugacgucacacagugacgcuguucuuuugucgcuuugcuccugugaugguuguguccuugucacuuuacggugcgcuugccagggaucacugugguggaguuuggcaggaguaaguuguaugccacugauaauuacuugcguucacacucugugugugaugagaacauuggcaacaugagguaucaucucauuugcucacgucucauuccacagcguucacugaucucccacguugcgugugacacucugcuaauagaaggcauccagggauaaguggcuacaucuuccaguagagacuguauauauaauuuuaaagguuuacuuauuacauaugaguauaaugucaccgucuucagacacaccagaagagggcgucagaucucauuacggaugguugugagccaccaugugguugcugggaauugaacucaggaccucuggaagagcagucagugcucuuaacugcugagccaucucuccagcccugagaccauacauuuuugagauuguauaggacaucgaauagugagggaauggucuuuuacaaauagguuccaucugucgacaacuaaccugcgcccuugauagcccagaagcuaauccaguaaguagcauacagcccugccucuggguguugagcagcggugcuaaccugcggcuguucugccuggauauuacuguagaaaaacugcacauguggaaucuauccugaaagcaugagaggcguggggcccga

SEQ ID NO: 8982 - RNA, 12522 nt, Mus musculus
cuuucccuagcggagucugcgcuguuggaggaacgccuuugugcgccugcgcggccgcggauccggcgggcuguuugaauuugggcucuggaagcuggcgucuggauuuggcguuucggucguggaccggugcgcgcuugguccccagccguagcgcaggcucuucgcuccagacucccgcaaggucgcuggcuccgaagccgcccgaagaggcaucgcuuagcagguucggggagcgggcgacucggaggguuggcccccgccuuccccguuccagccugcgcaaaaucguaauuguuaugagggguuggguuuguuuugccauuuuuaauuucuucuucuucuucugccauuuuuaauuucuucuucuucuccuccuccuccuuuuuuuuuuuuuuuuuuuuuuuuuccuuccugagacagggcuucucuguauagcccuggcuguccuggaacucacucuguagaccaggcuggcuuugaacucagagaucugccugccucugccucccaagugcugggauuaaaggcgugcgccaccacgccgggcuguuuuguuuugccauuuuuauucuugguaguugcauggcgcgguucucaagcauggacuugacgaugccgcgucgcguugucagaggauuggaucggcaccuuuacacucuacccucgcaaggaccuuuccuuccaccagccuggcggaagauggcagcuaugguuuaaggugucaggauugcaggagccuccaagacacguuagcauuguguacuuguuagacacugaguuuuguagaauuggaaaagaaaaaaaaaaaaaaggcuacgguugcguucuuucccuucaaaguuguuugcuugugaauauuuuuagauauugaaagugaacagaaauuuggcuuuacuuuauuuuuaaaaguguuucucuuacguuuuauuuagacgcuuaaaggauggacucagagcuagaagacuuaugcucuuauguuaaugagaagauuggaaauauuaagaaaauucugucgauaagaaaucuugguaagcgaaacagacucagauuugggguaagcacaauacgucuugauuauuguucugccguggcugucgcuuaguuuuagauuuccaauaaugauuuuuucaaaacacuccagugucacugucuugaauaaugcagaggagccguuaaguaaugggugaacauucauuuucuuuacauucuucugggaaauaaggaccaauaaucccuguacuccagaggcagaggcaggcagaucucagaguuuaaggccagccuggucgucauagugaauuccaggacauacagagcuauguagugagacccuaucccucacccccaccccccgccccagaaaacaaaacaacaaaacucaaaaaucucugaaaugaacuuaccaauucauuuuaguuaugaauuuagugucagauagaauuagcaaggcaaaauaagaguaacacacuagaccucacagcgauguagugauuggcauuuagggaguguuaagucuuccguguccuuucaugaaguuaaguuuuccagccaccuccuguaacagguacugcuaugucagacuccaggccaggaaugucuaguuagucccuucugcuuccacacagcaaauaccaucaaaugcucuucacuuacuuguguuucauccuuugcuuuuuuuuuuuuuuuuuuuuuugagcuagguugucucuauguaguccuugcuguccuggaacuuuauaggccuucaauucacaaagauucuucuccugccucugccucccgggugcugggauuauagguaugccuaaucacacugacuggucuuaaaacuuucaaaguagccgggcagugguggcucacaccuuuaaucccagcacuugggaggcagaggcaggcggauuucugaguuugaggccagccuggucuacaaagugagguccaggacagccagggcuacacagagaaacccugucuccaaaaaccaaaccaaacaaacaaacaaaaaacuuucaaaguuauucuuuuuuuguuuuguuuuguuuucaagacaggguuucaaaguuauucuuaaagcaguguuuuguuagauuuuauuuacuuauguauuuagcgucugugcuugggggaguugcuucuuugcuuccaccaugaucaaaaccagguuguuaggcuaggcaguaggugccuuuaccugcugagccaucuagcuuguucaguuguauuugcagggaggaagaaacuuaagcuuuuccaaucucucauagaucuaugaaucuuaaacucugagaggugcuaggugguacaagaaguguaaacaugccguuucuaaaugucucgucuuugcuucuuccaggucuucaaggguuuucaccagucugccuuuguuguucuucuuguuguuguuucuaucucugguuaaggguuuucacuagcgaggaugaauugcaaacuuauauuacaaauucccaaagcgagcugccgcuaucuucagguucacccuuauacaaacacauuugaagggcagucuaaacauaaguuuaucucccuggcaauugaauauccuuaagaauaugucgcggcacacacuuuuaguuccagcacuaaggagucagagggagguggaauuugaggccagucuugucuacagagcaaguuccagggcagccagggcuauacagagaaacccugucucacccucaccuccuaaaaaagaauauguccccugaaguagauaacagccuugcgugagauuuuucacuucugacacccugugguuugaggucucagaagucauuggaucuucuccauagucaagucaguucuuugcuaugggucuguagucacugagaccagaaaccuccucucuagcgucccuccacauguacugccugggcuuguagccucugcccauaugcccugccuggugucugaaucccagcucaugugggucccuggggagacuugccucuuucugauaacugcucagcuaggccgauauacagguguuuauuauuucugaagguuuuauuguuuugagggaauuugccagaaauaauagcugcaggaaacacuuugggcuugccucccuuuuccuucuugucuguacuacuuggaaaugaaaguuagccuaggccugguggcacacaccuguaagcccugcccuggagaagccgagcagggggauagagggagauacguuccaggucaaccugagcuacugcacagcaagaccuugucauacauucaccaaacaagacagacaauguaagguuaccuaugaggacaggucuuaaaugaagaagaauuuguccuuuuuccacucaaauguuuuuccgaguuguaggugucugucccaagaguucccgugggucuuguauguuuggauuuuauauagacuuuguucuccauuuucucuuucuuuauccuaggccaggacccugccuugaagaccaccuuaaguaaaauaggagaugagaucauugcaguaaaugagcuucuaaauaaauuugaauuggaaauucaguaucaagaacaaacuaacaguucacucaagguaaugcuuuccugacuuguaaagagaaggugaugaggccagaaacucuucaucaccagguggucauuuguaaggauccuugauguuuauaaugucuaagacuucguaaacuauuagucuguaaaauaacaggguguucucaacagagaucagaaggacagccauuucuuucuucauguuaauggccaauagcauagaacuuugcuagaaagugaauuuucuaaagaauucuuuguagguguaauauaaacaaauggugccuugggcgaaugccgagugagaacagcugccuugcacgagacaagaugcgggcccucuccuuagucuucucugccacccugagagagccaugccaccucuugaggucucgggguucucauuuaaagaauaauagcuguuucuuagcuacccucuguuuccuccuuuuuauaaaauauagggacuccucauugaagaaaagcuugaacuucacucacgggcauguuuuguucuaaauacaucuucuaauuaacuucagcuaauaagagcauuuguguacuuuccuaaugaggagaccccucugcaccgugauuaucccacgcggcuguuggugcauuggagugcucagugagcuuggaaagguagcuuccagguccccuccagucugcaguccuugucugagaagacuuuucagcucuaaggacgggcauaaccaagcuugauguaaaucuccuguuaaaaggaaaguaguggccaugaacaugaaaagaaaggugucauagguucgaaauggagaacaggauuggucagugaguuuuccucucuccuggaacucaugguguagaugggaguccggagugugcucaccugggacaugaagccuggucacaugauugagggucggagggcaggaagcuuuuuugguaugaguuccuugucccagguucuagcagaaauuaaauaaaacacacgcuguauuacacacugaacacauccaacuccacaugcuguauucaccccccgccccacacacuguacacagauacaugcuauacacuguauguacucucacacacuguacacagauacaugcuauacacuguauguacucucacacacuguacacagacucccacgcacagacaccaagacacaccaaacaaaaaaaaaccuaaauguaaaacucagaaaucagaaauguaugaaaagugccucucaccuggcuugaccuccucgcccugcuccuguugcaagggcagcacuggggagugugcgcugacucaagagcgaucugcuaaacugaaagacgucagugcacucacucuucaucuguuucuuagacgcuucucaagguuaacauguuugggaaagacuuaaacuucaucucagccccacaguggcagugugguugguuagugcuugcucucuaaaaaugcaggagagagagagagcuaccacccuccaggaagagccgugcgucccugcuuuuggcacuugcaaggacugagagcaucaugguccuuccugagggcgugucuuacaucacacaucaccuguagaggaagaagucuugcucacaagcauuuuuaaaauuuaggagcucugugaaucucuuagagaagagugugaagauguggaacaucucaaagaacacgucccuccccaucugccucaagugacggcgacccagagcuugugagugcgcuucugcggguucuugcugucugggggcauuuguggaaacaaauaucucagucauuuucugucacaugcucgacucucuugucucucgcaguaggagccguaccucccugucuuccccagucuccucacuccuucaggccguucuuugccaugagaauacucagugguaucacuggucuauuagaugccagucuccugccuccugccagagugacaguggaggucuuuccaucaccaagauuuugaccucuggguaguagcuccccgugacccuugagaaccaaggguaaucacugccuuuagggucagacaggcucugugagcccugagaagcagcuggagaagccaccaacuccaccacuccgccagcagccagcgugccuggcauucagcuaccacugcacugcuccugugagaaugauggcuacgugcuuccucagcuccaugucugcaucccuugcucacccacuuuguuccuggauguucuuuccauacugccccguuuccuugacugccaucccgcauuucucagaugggguuguguccccucccucccucugcgccucgugugcuucugcuugccugacccuaguugucacuaguugucagugcuccgaaguguccaguucuagccuugacaucuaguucuggugaucuuguagccuccuggaagucuggugagugagcuauauucucgcaaaguuggcagguccaaggcugaacucaguggcucuuucguuacccauguguccacccuauggguuuugguugccuaggcaaaccuauggcuuguguugccuaggcagggucuuuugucuucacuguuuuuuguucuaucagccaccagcuauucaguaugucucucuuguuuugugucuuauccucugcuuuguucacauugccuggcucugaauuagcucuucugucuauccuuuuugucuauaagaguuucucuguugugccuccaccuuuccuggacucucaucucuacuccaucucuccaguccugacaccaaaacugguucuaacagguacuuucagcaaguacaaacguuccauagcuaacuuaauuuuugaaguguaguauauauaggaaagugauuuggguaguauauguaaaauuuaaagaauagucaacuaguaucuauauauguaugagcuaaauuuagaacaggauauaacgaguaccuuaaaaaacuucugaugcagacccucuuuccacuguacuggccuugaugacucuuagacuuucccuacaaggagagagcacugcugaagaaagucccagcugagcaucaaaggaaagacgccucguggucaucagucagacuacagagugggcuggacaguagcuagcuagaggaguguggccagcagaacagagcugccaugacccagcuucaguuaucagccaggucaaagcuaaaguuuggaauagcuugaaguggauucaguggggguuaccaggcguguccuuaguacauggucaagaagagaaaguucagggaagauucagccaguuuaaugauggaggucaugugggcguucaccaaagaaaguauggugccaucacuuuguuuguuuguuuguuugguuugguuuuucgagacaggguuucucucuauagcccugacuguccuggaacucacuuuguagaccaggcuggccucaaacucagaaauccgccugccucugccucccgagugcugggauuaaaggcaugcgccaccacgccuggcaaccaucacuuuguuuuaacugugauuccugcuuuaauucugccgcacagcuaggauagaguaguccagauuuuauugaccgcccacaauaaccuguuauguuuguugcacucugggucuggucucuggggaguuucucugcuuccuucuguguuggaucucuuauuuucccggucugguauuuuuuuucuuggaauaguucaugcauuauggcagccaaugucucuucugucugggcaguuaaacagccugagagcuauagccugucccuggacuucacucacuacagugcauugcuagacuccauuugcuauagagugaguucaagggccgcccuugguucuugcugagucugcgauagcuuagugacacaauaguagcgacuaacagacgacacuaggguacagggaagaugacugguguuuccaggcuccgagcuagggggaugaagaagagacgcuggaguuaagcccagccuuacacguuugacucugagaagcaaacaggaauacuggggaggugugugguguccguucugugggugacagacaugguuggcuauauacaugaaaacagccauacucugaagauuuacuaacuugauuuucaaaauuccucuuacaacugagaucuucauaaccaagggguuagggauacaaagaaaaguuggcuauaaaauuauuaaacaaggauaugucacacauuuacaaaucccccccccccaccccccaguuuaaaaaacauguucacucugcuacuucccucuggcacuugccugucugcauguucaucucuccucuguagaguucacaagccagagccggauccuaaagagucagacaaagcugaggagccuggacugccgaagaagccccccagagagcagaggauuaucaaggaaaugcaauuuauaacuauggaugaauucagugacguuccugcgugaguacuaaguguaaauucuaguguucaacuguaguguaauuaucucaggugucuggcccuuuaaaggggcuccgauugcuagucaacuggcucuuuaagaauucuuagcuguuaaaacuacuuguccccaccauugcauacacuagcugaaaggacccagauauagcugucucuugugagacuaugcuggggccuagcaaacacagaaguggaugcucacagucagcuaguggauggaucacagggcccccaauggaagagcuagagaaaguacccaaggagcuaaaggaaucugcaacccuauagguggaacaacaauaugaacuaaccaguacgccccggagcucgugucucuagcugcauauguaucaaaagauggccuagucagccaucacuggaaagaggcccauuggacuugaaaacuuuauaugccccaguacaggggaacgccagggccaaaaagggggaguggggggggugugggggaguugggggaggguaugggggacuuuugggauagcauuggaaauguaaaugaagaaaauaccuaauuaaaaaaaaaaaaagagcccagagcaguaaaguaauuaaaauuuuuaaaaaaucccugaaaaaaaaaaagaacuacuugucccaaugaccuucaguguugguugccucuuggauuucugggaacaggaucagauauuaaaaacccagcuaaagcugagaaagauuggguuagcagagugagaagagaaggcaguuggugcagaagaugucauuaggacgaaguugagccaggagaaccugagcccagcagauaggauaggacaguuggagcugccaauacugggaaacugggagaaggggacugcuggggagcugagggaggaaugguugggaaagaaauuagauucaggggucucuuucuccccucuauccuucuuucucugcuaguuuuagggagugaaaaugggugcaggggaauaaaggauaggaaaaagaggaacccacgaaguagcaaagaccagcugcauucaagcaagcuuucuggcuuaccaaucguggcuguugaugagcagugugcagaagugaaaagugucugucagggacucacuguggaguccuggcuggucuagaacucauuguguagcucaggcuggccucaaacucacagagaucuaccuaccugucuccucucccaagcccugggguuaaaggugugugcuaccaugaccagcguguacugucacuuugugguuuggugcuugccacucuucuuguagaaacuucugccuuuuaggaauguucacaguuugcaggggauggugucaucaagaaagaaauacauuucucaaaggaaaaguuugccgucacaagaguugccuuggucacggugaugauuucuaaagaauaacugcauacauuagaacccucagcucuaaaugacaugucucaaucaaaucccucucgucagggcucagggaacccuguagaagaggaggugggaguauaagagccagaggagauggagggcaccaagggaacaaagcccucuaagucagcauggucaaggcacauuuaaacucacagacuaagugugcauauacaggucuucaccggguccucugcauauccugucuuaguuaggguuucauugcugugaagagaaaccgugaccaaggcagcucuugcaaagggaaacauuucguuggggcuggcuuacagguuuaaagguucagucuguuauuagggcaguguggagagacauggugcuggaggagcagagaguucuacauccugauuggaaggcagcgagggagagacuggcuucugcaggcagccaggaggaugcucuuuuuuucugcacugggcagaacuugagcacuaggaguccucaaagcccaccaguacagugacacacuuccuucaacaaggccacaccuccuaauagugccauucaaaccaccacauaaaucauccaguuuaguguuuuuaggggacuccugagugugcaaacaagugaguccugguucuucugccuguucguggacucucuuccuucuuuuuuuugcccaauuccaauauguuuuguuuuauguuauauuuuaucuuauuuuuaaaaguagcagaacuaagucuuuaaauauauaauauuuuuauguuuguaauauaaauaaauaugaaguaaacucaaaaaugaauaacuacauacuuuuuuuuuuaaacagguacaugaaaucccguuuaacauauugucaaauuaaugauauuauuaaggaaauuaacaaggcaguaguuagcaaauauaagauuaugcaucaaccaaaagcaucuaugagcucugugaagagaaaucucuaccagagauuuauuaaugaagaaacgaaggacacgaaagguaacgggaugggcucugagggcggcagcugcuggggaaucucagugagaaacgcagccuucuggacaccgcugccccuagcgguuggucauccacagcuaagcugcgugucaccacgcgcucggcagcuugcggggccucaguccucacuacaccuugucucacuuugcagacuggacagacuucuuggcucagccaaggucuuuaguuagccgguaguuguagguucccuuugcuaauguuuccacagaaugucuggguggcgguuagggcguaccaaugucagcagggaugccuuguggcccucguagaugcaacaugauuuuagcaggaagaccauugcuuuccauguuuuguaguuggagagggacaguaagagacuuggccguuuagaaggagacaccauaaaaacuuagaggagggcuggccgugugacaaucagccugccgguucucuuuucaggucaucacuucaucguggaagcugacauaaaggaauucacggcuuugaaaguugacaagagguuuuaugugauuaugcacauuuugcggcauugccacagacugucagagguccgagggggaggacuuacccgauacgucaucaccugaggcuuuugaagacucgggacugauuggcagcaggguaucgaggggggucuugaaauuucauguauguuuuuagcuucuccauuuccuggccuuguuuguuacagaaguaaaacuuuggauaaagcauauauauuuucaaaacguacugccuuuaggaacgugggugaagcuggagcucacaagcacaguaagccaguuaggaagacugacucguguggaaccuguguguguauaggagucgggggaucaugaggccaggaggaggaucuggagaagugcggagaaaagaggaacagagaaggcaguggaccgcugugauagaguaggaggaaagaccgucugggaacagccaggggaaggguggcaagcacuugggcaggagguggaucaggauaaagugcgaugccacaagauauaaaaaugcaguaacaggacucauuucuuugugugcuaacauaaaaauuaauuuuaaaaaucccuuccuuucagcaaauauucaggcacugcccugucaagccucugcaugaguuguauaauggacagcgugucuaguucuguuaagugcagauaccaugagcauaguaugaggucgggaaagauggugaauacccagguccucuguggcguaaagucugauuacuguuuuuccacgugcccauagagaacagcuugccuaaaaugcauucaguauaagcuggaggcucugaaguacauugagauacugucacauguauuacauaugauauguauuacagcuuuacgucugguuccuuguucaggguuucgaaaaauccuuguaacguccuaagugguaagggugcgucuuguguugaacucaguucuugacuguagcuuucaaacgccuuugaaacauuuuucugaucagaacaucuuuugcucagauucuagugaggugauucuugggcgccuucaaggcgggcacuaguuaccaaaauacuaagccaugacuaggaaguugcaguuuggagccauucuccugcucccggggagggagacacccuuguugcacauccggccucagcaacucaguuacagggggagauuucuugucucuaaagccaaaaccacuuggucaaagcugucaaguucugcugccugaugaggcuagagauguuuggucaugccgacaggcuucguccuuuuuaaaauuaauuuaaaaaaaucacugcucugggccuccaugcagggacaccccugucacacaucuggccucagcaacuuaguugcagagagagagauuucuugacucuaaagccagaaccacauggcuaaagcugccaaguucuguugcuuucuggggcuggaguauggcccuguuguucaguuagaucuucaccagcggucugguuuugauaguuuccuucacugccuaagcauggcugucuuggaacuugcucuguagaccaggcugcucuugaacucagagaucugcauaccccugucuucuaagugcuggaacuaaaggcguguaccacccaccacaccuggaccuaaacuuucccuuaauuccuuuucauuuuacaucguuguaagcauggccacugugccucacgauauggauuaaagguucguguucauccacau

SEQ ID NO: 8983 - RNA, 5416 nt, Mus musculus
ugagagagagccuuguugguucuucacauuuuuuauuaauaaaaccuguuuuugggggguggguauaggcaaggaugaguaaguuugagucucaccccagcccugacuauggaaagaggagacagacggugacaaagggaaagcagagacccuuugauaagggcaaacggaagccaaaacguggauggugaggaucaaacuaagggcagcagaagaaacagaugaauggaggaacggacagcuggcaaugcagggccucuccccuaacugaaugcagggccgagaggcucugggcuggugaagucagcggucggcacuagagcgaaggucgguagugaguggaucguguuggaucguuuggugaagcaucagggcaaguagcccugcucuguuggucauggcugugcguacauuacguuccugcucaaagagcucguccagcuuguaccacugccaaggaaauggaaggaagcaugagaagcagccccuggagcccgggacucuggucacacccaggguuacaccuaccacccgcacgcgcuccaaguccacuucugcacgccgaagcuucucccagcaauaauggcgauuacacuggcgcuugggcaggcggcagaagucaccugugagcucaaagacaucacguacaaguggacacccacagaccucaucagcuggcaccugcagagacaccaagagucgguguggcuaggggaggaggaguggaggaucugaaggagagugaaaaggagacaaaaggguaggaaugggagauggcuaaacaguaaagggagggcggagcugacaggaagagaaggaaggaagaaggaggaaaagaacaaacggaugugcgacauggagcaggggagaacaguaugcagaggguuugaggagaaaccuuacuuuggggucccgggagugcucaggacacagcaccuggagccgcuuacaauaugucuugcucugaggauuguagacaucacagaagagucggguagcccugggaggucagcaggaggguggccuugaguagcuccaggcccacguccaaggccccaccccagccacccuucuccuaacuccacauggcagccucacucaccccucgaugcgugugggguacauggacccaaaagacgucuggcucucauacuacagggaugaacacaaagaaaaggacuuugggcgcccuuucaugccacccaagcaacaaaucuguccccugugggcccacagacaccccugaacuuuccacuuucuuaggacggccuccugaccuuagcauagcaacguuccaugugacgcaaggcaacucguggguugaugggaugcccgcaggagacgcagaagaucugcagaucugugucaucacugucguucucguuguucugcauagguugaaaggcaggaugaggcuaggcaggacuucguacuggguccugcccacucuacggccucuuuaccuccucauccucucgcacagcuugcugcuuagcgcgaagaaugauggccucaagcucguggaaucugcgcuccauuuccugaaggcgggugcgggcgcucugcugcucacggcggauccgcucaaguagcuucuugccgugcucuucagcgaugcaggggcuuugcugccacugcuggaugcgcugggggaggaucucauagauucggcugaagggagagagugaagugcgggcagagaggcaccagaagcagugagugagcugaccaagggacagggaacaaggaugggccaccugaacagcugcaaggcugagugaccgaagggagcgggaggggcagauggugagugaauggcggcuucccguaccgauguuugacugacuaguacauagacaacugacuguagcuauauggagggaagucuggccauacccucacuuuccuuccugacccccuucagugcccugggagacucacuuggcugccagcuucaugccacagucaucugaacaauacuuggacccaggcugggcagcccgcacacagccaggccccaggcacugcgggagagaugcaggguccuuggcaucagcccucucuggguguuuccauuugucuuuauguuucugcuucugucgaugccguuuguaccucuccuccuucuagagggcaagacucaugucaggguucaacagaggucagccucagacccuggcugccuugccaccgcacaugucuggcucugucuccaucucccucccugugccagccucuuccucugacacccgcuuuacccucuccaucaccuucuucucggacuucuucucccggcgcuucacgugcuucaccuucaccgcccgcuuccucagugcaggauccaggaacggggacucuucugcaucgcucauccagggcugcaagcagggagugcacugacccaccugacaccucagggccacgcccacccgcucaguucccaagcagccuguuccccucuguuccagucccacucugcagccucgccuucuccccucccucccccaccacagaaggagccugucacucacuaggccgugaucaucaaaggccccagcacagaaguccugguacagaucgggguccagugcuagguccucaucugaaaguggcucagguguugcuguagccucugguggcuccuuaaccacugaugacaacacuguccccucaucuucacgaauacgccccagcuucugggacugcuguggcugcuguugagugggugguggccggcggggccuuggcagggccucugagggugucaccggcgagagcugcggggcagaaucucaggacuggcccugaccgcccugcccgcagcccugccccgcccuggggggcuggacucaccgaggaagggaaguacuuguacgauuccugugcgcaggaggaaggccuaggucagccccaggaaaauggagggccgcccuguccuagccccaucuacuuauccuugccuugccugucuaacaaagguaguuucaucccuccccacaccacaaagauaggcuccauccuaccccgcugugcccuggcaugccagacaacguaaaucuauccaguccccuccagagcugucaucugaacuugcuaggccccucccacccgccuagacacaaccaagcuccacccccaccuacacuuucucauuuguagcucaagccgcccuacuugggccuccagcccaugcuccccuaucugaucuugcccagcucuguccaugcucacccgugcccgcagcugacacugacgaagccggcacuucugccggaucuuguuggggcccccaaacuucuucaugucacggcagaagucacaguggccacaguccucagugcgucggcaggccucgcacucaccacacauccgagcugaucguuugauuugcugcugcugcugcugcugcuguuggugguggugcuaggagacaacauccaggguagagcucaggacagagaugaggcccaaagccgaacuuucccccaaccccaagcacugcagcuacucaccuggcuagguguggccaccaagggcuguggagaagauuuguggggggaagcagagccccgagcaagcauggccccaaccccugucccugacccugcccggcgcugcagcucuggaucugaagccggccucuugcgcccuccucccucaucccggggcucacugccggcccgcucacugccaucccucucccggcacuuuuuguggcgguaacgaaucuccagcuucggguccuucucugugaggcaaagaguggggccaggguggguuugugggagggaucugaaugguccuagaaccucuuucucuuuuccugccccgccaaccugucuggcucaugcuacaggagagagcugcccuuuccuuugggauccuucacaacugcuagaauuggaccugacuuuccaauucaucauucuggccaaacagcacaccaucauuacccaggaucccucccaugauggcuccucuucaucucucggagcccaauucccacgcacaggccucaccucggcacucccgacaguaccauucccggauggccuuggccaucuucucagugauccggaugcagucuccauggaaccacucguugcaguugucacauccacugcauaugacagagcaagugguagagacgugagggguacgccuccucagggggccccauccccaccagccaucagcccgcgccccuuuucuccccgacucacaucaugaagcaauugauguccgguuugcgacagaugcaguagaugggagcguucuccccauucucagacuugcugucguccccggcauccggagguuccaggucugagccaucuccuuccugugagacccacccccacaauggcuccuuagucccccucccgacuuacagccccaccacgacucaccacaaauuccaacugugucuuugaacuucccauuagccuuuccacucuaguucacccagacccucuuccaaaccuaacccugggccucauuacuuugccuaaacgcuacuccaucacucggacccucccaucacacacacccauccugucaagcauccugucacgcugacugcucaucacauacacuuaccacacugugucccccuuaaagaguucuacucagauagcacuuaauuuauccagcugucgucccaugccggcuucccacaagugucuacaacuuagcucauagaccccacccccgaugacgguucuccagagccugugcaaauacauucguggccaaguccuuaucucucuggcgaaggaacuucgcgugaagguuucccaccaaacugccaucuggagucccacugaacuuccacgauggggucccguccccuccccaaccuacaacggaucaucaaagaacucacagaugguucacccccaaccucacucaccggcccggagacugggcacacagcucgccggggaccccgugcgccugccaacaggcagcgguuuucaguccccccgaccucugccucugaaccccgauccgacccgguacucaccauaucuccgcucacagagcgcccgcucuggaccccgugcaacaacccgcgaagccgaacgagcuccccggcagcguccgcggcgggagcaaaggcgcccgcaaaggcgcccgcaacuacuuccgccacuggucccgccuccgcggccccgcacucuuuaacuccucacgcccggcgcgacggcuuuagcggcaaacaaauaggucucccaccuagagccgcgaaggucucucugucgccgccaucuugaccaucgaguccguaagacagcggagaccauacguuccgggaagcauggccgcgccuacaguucagguccuccgagcgcgccgccaccuugucagccaaguccguacgguggccgccagagggcaauauggccgcauuugc

SEQ ID NO: 8984 - RNA, 4909 nt, Mus musculus
aucauauacccaauaguuuauggaugaaacacuuuauaccuacaguuuuugccaauucaauaaagcuacuagacagucauauuuacauggucacgugguuuugaaccaucuauuucacuguuuaauaacaugcuucuccauguuaaagcaccucacucccaacagggcucauuaaagaccaccagaagaccuuuaacuuuaucugccuuuauuuuaugcugaauuuauucccgggccaugaguuuuuguuucuucaguuucuucugggauaucugagaaggaagacaaaggaaccauuuaaguuucuggacuagaacaaacaucaaaucuuggacucaaauucauaccuaagcaaacagggaaagcucaaaagcugaagacuaaggaucaaggacaaaggcccaagugcaaaaaaggucaaauugguuguagagacaccaaaggccaugacugauccaguggggacagagguucugcagugcuaugccacagaagccacauuaaaguggguaaggacugggcaguacacuucccuucaugguaauuacaauggcauauguccuaaggcagucaccacacaccacaugucucuccagcaacacugagccauuaccuuuuucuucugugcaaccuccucuucuggcuuuggaacgaucuguuccuucucagugaggaucaucucaauguggcagggggagcucauguauggguuaauccggccaugagcucuguagguucgucggcgcaucuuaggugccuuguucaccuggauguguucaaugacuagagaaucuacgucuaaacccuggaaaggggagaaaccaggcaagcuuuucaauacagcuuaaguucaauaccccaggccaguuucuaacuuggaugaccuugaacuuuuuguucaccccgcuuuaucuuccugagugcaaagaaugucacuuugcauaggucacuaacucaaggcauuaaagauauucaauuaccauaaaauuuagccuguuaaauagaugcugucuguaacccuuaaggugacuagaaacagaugguugccccgucucacugccaucaaacaguacacauucuuuuuaaaugaaaauguuucuuuugggguacaacacccugaucugcuauaagcccucagaccaaagaaaaugcuucuuuuauacaacgaguggagguaacuauuaggacauagcacacccgaugcuaaaccuuauguaauauucuguaauaccagacagaggcacaagacaaaaggcuuucuucuaaaagacaguuuccuacuguguagaccagaccgaccucaagguguagguguaacaaaagaacagcaauggcucagguaccuuaaguucagcguuacucucagcauuuuuaagcaugugcagcaaaaauucagcacucuuuuuuggccaccgacccuguguccagccccacuguuuggccugaaagagaaaaagcagcuuguuacugcccgugaugaaucaguacgagaaccaguuaacuacuacggccagcaccaagguugcucagcacuuguuugauuucacgguuaauccaaagguguccuaagauagucaucacagcaacccaacugacgguacaagacuauagcccacuuucccacuuccuuaaaaugugcaacaccauacuuucaagauuucucaccugggcgcaccuaccaacuccaccauuauaccgccggaauggcacacauugcuucuuuaaggugacauccuucagauacuugguggcuuugcggauaugcauucccuugauggccugggcaguuucccggguguucuaauagaagccagaaagguuagguuaacagaauuaaauuuugagacaaauccaguuaaguaagcuaauuauacacccguguuccacaccaguggugaguuuuacuccagcaccccccaccccaacgauccauuuauauaaagguggcugcucagagguuacuucuuuucacgguaaauccaaagguguccuaagauagucaucacugcagcuaccuuuuaagaccaaguucaggagcaaacuaggauuccuuaacaagagcacgccuuccuuaccuuaaagugaacacgaagguuugacccucuugauuugcaugcugcaaacgaagagagauccguuuuuguugcauaauaaacacccccccccaacaaacagcauaacccacacaucaaaacagaagcuuguccuugucugucacuuacauuuugugggguuuucugggucaagagaguagcgaaccaucuuggcaggugaccugugaacacagcagcuaguaacuaacacaaucagcuauuaaccaaggaagggugaaacuaccaacagcugcucagaggauaguuauuuucaugauuaauccaaagguguccuaagauaugacaucaucgcagccaucuuuuucccuuuuuuugguguguguguguguggggggggugugggugucaggguaaccgcccaguacgcggucgacccuuccccaucacaccccgugccucuccaguuucaggcuuaggcacagagcagugcggaccccuccugcccccgaccucgcagccuccaccgggcgccgaucucagcacucccgcuccguccuaggccaccccucaccguagaagccgagccucgggcguccccguccgguccgagccccccgcagcuccgccggcggccuggccccgucacccaugcccgcccccucucgcugcuccgcagccugcacgccccggggcuccaagucggaggcgcccgcgcgccccuccacgcagagcacggccacccgcggcgaggacccauggcccuuggagcucagcugccgggauggcgacgccccagcgcucccggagccacgacaacaacgauggcggaggauucgccccgagagcccggcgccgaguuagcacucaccucuggccgcuuacaggaagaggaagcgcgaaggcuacugggagaauucaugagaccucgaccucucgcgagacuuccagcccaaggaacgagaucugaggagugggcgggccgcgaaggaaggaaguguggaaugcuuuuagaaaguuugaaaaggagugcgugcgucuuuaggaacuuucuuuuuuauuuuuuauuuuuaauuccgaaauuaaaauguauggguuuuaggugacaguaaauaaagacagucaugaagcguaggacacacgaagcacaaacacaguagcucgcguagguaacuucaguuccugggaauuagaugccuuccgacccgauaggugccaggcacacccguggugcacacacacgcaagcaaaauacucauacacauaaaauaaauaaucuaauuuuuacauuuaacuauuuauuuauuuaaaugaaaauucagugccagucagcacuacaugaaaccccgucaccacaaaaagaugaaagacugguuuauaaaaaccaguccuagucugcgccucccugacaacaggugccggugucuuucucuccccgcugauggaaaaguaagaggugauccucguuguguucaggggcaaaccagggaggcaguagaauguuaaggacuuaacauugauaauguugauagagauucaagugugaaacuagagaauugggaauauaaauuaauccgcagaacgcugauucgauuguuuuccuuuacuuaaaucuaaaaaaguaaaaacgaaauuaaaagaugaaagagaagauaguauucagaaugaaauaguggccacuugggagguuugagugaaauccaagguguucacucaggaggcugaggcaaucauaagcuagaggccaacuagagucaccgaaaaagacaacggcucuaaaaaacaaucagagcuaauaaacucauguuguucauugugucguucaaaaaaacaaaacaaaacaaaacaaaacaacaacaacaacaacaaacaaaacaaaaaaaaccaguccuugggccgggcgugguggcacacaccuuuaaucccagcauuugagaggcagagguaggcggaucucugaguucgaggccagccuggucuacagaaugauuuccaagacagccaaggcuacauagagaaacccugucucggaaaaaaaaaaacaaaaacaaaaacaaaaaaagaaaaacaaaacaaaaaauuaaaaaaacaaacaaacaguccuugggaggcuaaggagguagggugggagugggggagagaagacagggauggggugagauggggagucagguguauauuaauugugaagauuaggcuaccugaagacucugguucaagauuacuguccccaaggaccaauuccagaucuucguuguuuguagcaaacguguugguauuuucuuccccuuucuugucucugauuccguuacagucuggcuuuaggucuucuguguuccacauccaggcagcucagacucccagggacugagucagcuuacaaugcuuugggcucacuuggcuucuagauagaauguguauguacuguugaacggcucuaggcaaggaagaaaugauacaauucauaauuuaggaaaaaugacccugacuuuccuguagagagcaaacuugaggggugggaguagaaagaaggagagggacgauuuugcaaacucugagggucacuuacaguaggcuggucccagugguugaaaaaaggagcaccuauuuugaaaaugaagucuaauugaguggcagacaagugaugaaucagagaaagauuugacagaauaggauacgcccaacucucaagagaagagaaagaaagggaagcuacuuaagggagagacagacaggacagaauugaagagagacaagcuagacacgggugaagacagaacaagccagagaaugaaaaggagucggaagauuagaacagauugcggggcauaguuuaaggccaagcagagcaauucaga

SEQ ID NO: 8985 - RNA, 1047 nt, Mus musculus
aacaaaaaacaaaaaacuacuguccccauauauaacuaauuugugcuguguaccaacaagaaccugcuuuaaauuuccauaccaauuuacaacccccagacuguaccaggcaagguuaguggcuauugaaaauaccaccaggacagggcuaucuaaagacucauuugguaguguguuaacuauacaaaaaaagacacuguacaguuuaaaaacaaaucuuacacagccuuacauuucaauuuuuuucuuuaaaaggagugaguuguguacagggggguuaaaugcuuuauagacaagaaaaaaaacuucgcuagaaccaacuuauucaucaucaucuucuucaucuucguuuccucuuccucauccucuucauccuccucaucaucuuccucuuccuucuuuuucuugcucuuuucaaccuugaccacccccuuuuuugcugcaucagguuuuccuuuagcucuguaggcagcaauauccuucucguacuucuccuucagcuugacagccuucuucucauagggcugcuugucuuucgcugcaguguugauccacaucucuccuaguuucuuugcaacaucaccaauggauaagccaggcugcucgccuuugauuuuggggcgguacucagaacagaacaagaaggccgaaggaggccucuugggugcauugggguccuugaacuucuuuuuggucuccccuuugggcggaauguagguuuucauuucucuuucauaacgagccuugccagccuuugccauaucuucaaauuuccccuuuucuuuagcagacauggucuuccaccuuucugagcacuucuuggagaacucugagaaguugacagaagcauccgggugcuacuucuugugcuccucccggcaaguuugcacaaagaaugcauaugaggacauuuugccucucggcuucuuaggaucuccuuugcccauguuuaguugauuuuccucugcgaggcacagagucgcccuguguccguccggcucacgcuugcccuggcgcugucucuauggagcucaauguacugcaaug

SEQ ID NO: 8986 - RNA, 1759 nt, Mus musculus
acaaaaaaucaggcuuccuaugcuuuucuaagauuaauuugugugugugugugugugugugugugugugcgcgcgcgcgugcgcgugaacgcagugccguggagaccagaagaauccagaaucucccggagcuggaguuacaugcaguuaggagguaccugaagacauuaggaggccaacucagguccccugaaagagcauccacugcucuuuacuucugagccaccucuccagccccuucccguuccuuucuaagaugacacauuuccuagacuacauuucugucucuuuggucaguccuucccugccuguaaugguggggucaucccuccuccauuuccuuccuuggucuucuugacugcugucuucuucccggguugcuuuagaguguucacacaccauuccaauaaguggcauuuuaauuuuuaguagaauuacuaugccauccaguaauuacugcuuacgugccccucucuguccgguccugcugaugguccuauacuguugucuuccuuccacaacguagggcucccuagggagagaaucaugugauagaacuuguugguuuucuuuucuaguuguaagaguuuaguguggaaggggaauggucagagaaccuaauucaaaaugaugauuccuaguuaguguugcuagucacugaauccagggucucuaaggaauuauacccccagcccucuaaaugugugucaauuaucuaucagguuagaaacaaacguuacuggaaagaaaggguauuuauaauuuaucuuuuccagaacauaucauuccaguggcaagaaauaaauauuauauuccacaucugguaaaaaaaaauucuuuuacccccccccccccccguaaguuucaugacuguccuaauguuacaauuucaagcaacuuuucaaaaaccuacuaaauaugucagguuggaucaccaugccaacuaguugucucaguaacauuuaacacucuaguacuauccucagaccugcuccacggacuuuugcuugacaaauaccuuuucuacuuccuagcaaucacuugcaucuggggauagcuuucucuggaaccuauggugaaggaauaaacucucugacccuaagcaggccccgcaugcgauuggaugcucuaagcaggucugcuggcugggcaagguuagcgcgccgggaggccgaguggcgggugccggaggucuuccaggccgggaggaaaccugccggcggcgcgcgggcgagcugcaccccuccucccuccaggaugcugccccucgcugcucgucagccugccaaaugcauuccagagcugugcacaagacacacuucuccaggcaguccuagaaacccgagcccggagcgggagagggcgggagggagcgcggcggccgcugaggucacauucgcgccgccucuccgcccucggccgcccggcuguucccucuagcgcacacuucccagggccuccguccuggccgguguaaaugucuuugaaacagacagcgaucuccuccccuuuccaagggauccgccgccagggccuuaaaacaaaacgaaugaaugaagcgcccgggcgagcucugcuggucuaaaucgggccacuaaccggcucauuccgcuccaaacucgcccgcuccaugcccccagcucuuccgauuucccccugcucccgcugggucuccgccgacccccggggccgucucggccucccaccucccuccaccguggguaccccucucuagaccugggagaggguggcaguaacu

SEQ ID NO: 8987 - RNA, 1759 nt, Mus musculus
aguuacugccacccucucccaggucuagagagggguacccacgguggagggaggugggaggccgagacggccccgggggucggcggagacccagcgggagcagggggaaaucggaagagcugggggcauggagcgggcgaguuuggagcggaaugagccgguuaguggcccgauuuagaccagcagagcucgcccgggcgcuucauucauucguuuuguuuuaaggcccuggcggcggaucccuuggaaaggggaggagaucgcugucuguuucaaagacauuuacaccggccaggacggaggcccugggaagugugcgcuagagggaacagccgggcggccgagggcggagaggcggcgcgaaugugaccucagcggccgccgcgcucccucccgcccucucccgcuccgggcucggguuucuaggacugccuggagaagugugucuugugcacagcucuggaaugcauuuggcaggcugacgagcagcgaggggcagcauccuggagggaggaggggugcagcucgcccgcgcgccgccggcagguuuccucccggccuggaagaccuccggcacccgccacucggccucccggcgcgcuaaccuugcccagccagcagaccugcuuagagcauccaaucgcaugcggggccugcuuagggucagagaguuuauuccuucaccauagguuccagagaaagcuauccccagaugcaagugauugcuaggaaguagaaaagguauuugucaagcaaaaguccguggagcaggucugaggauaguacuagaguguuaaauguuacugagacaacuaguuggcauggugauccaaccugacauauuuaguagguuuuugaaaaguugcuugaaauuguaacauuaggacagucaugaaacuuacggggggggggggggguaaaagaauuuuuuuuuaccagauguggaauauaauauuuauuucuugccacuggaaugauauguucuggaaaagauaaauuauaaauacccuuucuuuccaguaacguuuguuucuaaccugauagauaauugacacacauuuagagggcuggggguauaauuccuuagagacccuggauucagugacuagcaacacuaacuaggaaucaucauuuugaauuagguucucugaccauuccccuuccacacuaaacucuuacaacuagaaaagaaaaccaacaaguucuaucacaugauucucucccuagggagcccuacguuguggaaggaagacaacaguauaggaccaucagcaggaccggacagagaggggcacguaagcaguaauuacuggauggcauaguaauucuacuaaaaauuaaaaugccacuuauuggaauggugugugaacacucuaaagcaacccgggaagaagacagcagucaagaagaccaaggaaggaaauggaggagggaugaccccaccauuacaggcagggaaggacugaccaaagagacagaaauguagucuaggaaaugugucaucuuagaaaggaacgggaaggggcuggagagguggcucagaaguaaagagcaguggaugcucuuucaggggaccugaguuggccuccuaaugucuucagguaccuccuaacugcauguaacuccagcuccgggagauucuggauucuucuggucuccacggcacugcguucacgcgcacgcgcgcgcgcacacacacacacacacacacacacacacaaauuaaucuuagaaaagcauaggaagccugauuuuuugu

SEQ ID NO: 8988 - RNA, 28574 nt, Mus musculus
augcaguauacauuuuaaaaauuguuuaauggaacauaaacuccuuuagaaaaacauucagcuaggugauaacacccauagaaaaaaacaccaaucuuguguuuaucuuuuuuuuuuuaauuuggcauguuauuugcauuuauauuaaagcaaagugcaucuuuucuuuauucuucucguuuauacacauugcacaauacauaaauaaugaugcuuauaaaacgucuuuauauuuacaaguaauaauauauuuauauauaacauaaaauacauuuuucuuuaauaaaucucagcuuuuuuuuucuuuuaaggaguccuuuccucucucaaagcacuacaaugcuaaauuuccaaugagaaugcuucucuuguucauuuaaaccuuuguaguuagaaaaauagcuuauguuaaauucuaaacaugcucauugagcuaagaacagugucaaaguaucauacgagcgagcguaugagcugagagaagggcugggagccagccaagggaugguaccuuuguugugacggggcuacacccuucucagcaggaagggggggcacugcgcaggucccucccugaugccccucgcuggucuacagagcucagcacacaggaugggggauggggugcugagcugacuuuccacaucugggagaaaccugaugaaaaaaccaccacggcugggacccgguggaagggccugagaggguacugggguagcaauacugugacuggggcugucccggcagcccuugggaagcccaucucaagagagagauccaggagcagauggccaaaaaagacagacucgacaauggcagcgggugacaggcggcaguaagacagggaugaaaacaauugguucugguucagccuucuagcaggcuggcuucucagaagccuguggauaggcccguguccugugggggcgggggcggggcggggcggggcagcuucggcaggcuggagcagagcuuggcaccugcugccagucugcccagguacugccucugccccaccgagcguguccaaaaggcuagagagacacacagcuuggcacuaugagccucucagccgggggcauccauaaagaacacacacacaaaaaagcacuucccccaucugucgcucggguacaccccuacgcacggacaaccgaaacgcugauccaaagggaagguggugcccacuuucacacaccaugcuuggcagugcugacucucguuuccugucuucguauauggggggaggggguguccugccaaccacacccaccaccucaaaacaaaaacaaaacacacacacacaacccaacaaaaauccgcaccauaagcuaauuucucaaagaacaagacaagcgggacacacggaugacgagaaaggaggaggaaaaaaaaaaaaaaacaaaccagaacagaacaaaacaaaaccaacaaugaauggcaauaacaacaccaaccaaagaguuugcaugaaaagcaaucacucgggaaagguuagcagcaaguaguuugaacgguggccugcucggcucacgauccgcccuguccucuucuccccaccacacgaccgacuaccggcuguugaagaugaccuccagccagcacgggcagcugcugaugaacuggcggguguagcacuggccccagcccuucacaaagcugaucugcacggugaaacccguccaugguugcugcaugaacucguggucauugggccgcugcaggcuguaggcuuucucauagucaaaagccuugauggagaaaccagggaacacuuugugcaccaacagcguccuggaguccggguuguccaguguggcggacuugaugaagaugggguaacugcugcgguuguaaacccacacgccauccacuucccgcgucagcuggaugccacagccgaucuugcuccgcacuuucuguaccagcugacucuuguuguccgaauugagcuguccgaggcaaaagccauuccccugagguagaucauagaagauauccagggagggcucuuggacacaguagagccuccccacgcgagucuucuccucccaguaugccaccacgcaccagugugaccgauccccaggcuccagaagaaguugggaaucugcaagacaaaaauggcagacaaccguugguggugacagagaccggguucuuuuucuccuucucgaauauacauagacacauuuguacacggugcauucauguggaguguccccauaagcaguauaaaaacaaaagagggagugaggguaagccugggcuagcuguaggguaagccugggcuagcuguaggguaagccugggcuagcuguaggguaagccugggcuagcuguagggucuacagugcuaauggagggaagacaucuuaauccaccuuuaauuacgaggcuuacugcugucaucuucccuucucgucucaucugagccugcagccucagccccagugucuacuuguccccagaagcacagacucugggaccguugauaaccugguccugcuguuucgagcgggauaaggccucagaaauagccuaaauuaagaguugcuucccacggguguggaaccuggagggacaguuucucuacucccccaagaccuggaugagagaugcuggccuacuggguggugacccagucagaaugagaagccaggugguccaccugcggccucuguaccagcuuguucgauucucacauccacaucgaugcccugcucccaagggaacaucagacgguaaaaauaaagaugagggugacucugaggauguuauuuuuuuaaagccaucuucccgacagaaacgcgcucucucucucucucucucucucucucucucucucucucucucucucucuguaugacagcagcagccuguacaaagaagguuauuaguucaaggccaagugccaaauuacgacaugcagggggacaucagccuagaccacauggccagcccagacagaagaggccacgucuaaaauaaacgugaccauccuuguauacuccugccagucuaucucgcuggcgugcccccuucuccuccaguuugacccugcacagcccaugcugcccucugugacauuuucaccgaccugucugcccgccccuccuguaagccacccccugcccccgccccacaacaaccuggaagugacacugguaaggugacuuuccuaaacaagaguucugugaacuuugcggggggggggggggggggggaggccauguuuaagaaagccccucccccucgagugggcagcagacuugagagaacaggccccagacugaggccuauaaaucucccagccccgcugggcugcaggaacgcugugguuuguggcggcaggguggagagcggaagucuuguauuugcuaacaaaaaugggggaaggcaagagggggaaggaguguauauggggggggggagcaccaagggcaaaauugaaagccuccuccugccucucucccacuccaguaagucuggugggcccugaagauggagcuguaccgggaaugugucuaguccucgaggccuuuguuguuucugggcucagagggcuguccccaugcaggggcaggacugagaaaacucagcuugcugguaacccagggcagccugguacaucaauccaguccaaguuuuauaggcauguuaggaccugggaaccagucagaucguugcuugcuugcuugcuugcuugcuucuuuuucuuuuuuuuccacaaagguagccacauacacacaaauccugagugacuguccccuacuuacagacacccccucuagcuggccuccccgacccaugcccagcuacacacaaagaggaugccaagauaguguuggauuccuuuccugaauccccacgccacuggggaaaaaaaaaaaacaucacagaccugcacuguccccugcccccagugccauggacccacaacccaagcauauaagaccgcaugugucugagugugcguuuaugaugguggaaugucugugcccgcacauacuagaaaggacgaaaaacaagagagggacgagggcucagagcagaaggugacucaucaggcauuaacuuguuucugcaaaguauccaucaacugcuaauaaacucgugagcgcuggcaagcucugaacuuucuuucuugcagagagggagcucagcucugaaggccacaccaacgaccccuaaaguuaguuaguccaagaaaguaagaaagacacuucuggacacaagagugcucacccaaaguguguggaacuugggucaagaaacccggacagggaaaggaagacuuggggagcagcugaaggggggagguuggggagacucuuuaagaggggccuuacaaugccuguuucaugcagcccagccccacugaaaccuggcaccagacaccaaggguagggggaagggaaugugaaggaggaaggaggagggaggaggaguuugggaucaaguugcuccccaugccaggccuguuggccuccuuagcaaggggugaggguccugucugccaggcaagccucugggacagaacaaacugggcaaugcuggagccugaggcccguggggagagaguauggaggggaagacgccugccuggguuucucuuucaucuacacagccagucuacccagcaauuugccgccaggcuaccucccgaggaaaaagcccuuuucuguugagguuaauggcccagcccagauaaaugguagugugugggugucguccccucaacgagcuccaggaagaccccugcuugcaccucccugucuccagccccacacaagucagcuucacaagcccccuugcuucuugaccagacuauuucugaggcccaaaacacuccagcaaaccccucagugcacgcauucccaacgcagaagucccacaccuucugagaacgcagggcagccgggcacuaugagacaucacccaaaugccccaccuuggacugaaaaauggcugggcucacuuaugggaaauacccaacaucguuuuucugcggaacaaauaccuaagcugggcccgcagcccacagucuuccaacaaagguuaggguagggauuucucuccuagaguuucacaggacacacgggcagggccagcgaagucuuggucaccuuaaaagggacgggaagaggacaggaaguccaacucuggcuuuaccgcuugcauccccagcgcaaaccgacuacugcucaucgauucucccagcauuauaagcuuucugguguucuucugcaacuuuuccaccccagaaaguguacaggggcuugcguuuaaacggcgcguacucauucaaaagcauccagaagaaaaacuacauuguaaaaagcuccguaaucagaugccugcucacaauuuuuuuuuuauuacagcugaggggauuuuuuuuuuugaagcaauaccagaaaaagugcugaauagaucuaaaauuccauuaagguguucgccccucccccuccacauuuuccuaaugcauaaaaucuucccuuuaaggggaagggagcaguagagaccugagagggaggguuucauggugucugcacuguucauagggaagaccacugagcaagaagagcuagcaccccggucaccaaggaacagacacuuauagacuagacucacgaaugccucuuauacuuuggaccucaacugcacccaaggccacccguuagguacagaagaaaucccaccauuuaaagguauauagagcugucgagauggcccaguaggccgaggugccaacaaccaagccugacacgcuggacuccuuccacccugaagcccagaugguggaaggagagaacuagcugaccuccacacguaaacacuguauguacccuugugcuccccccacaauaaaaaacaaaaaucacacaauaaguaaauaacuaaaacuuaaaggugugaagagaaaugaggaagacugaggucacccacaaacaacgggauuccgacuagacaaauacacccccaacaguugggggcucacauacagguacucauggcagaguccugguguuuagaucucuugugacagaaaacaagauugcaaaaugaagccagaauagacagagucacagaaugggcacucacaagguuaacuguccccaacugccaagaaagacaugggguggcuggcuggaguaggagauggccaaggaggagggucucacccacucucaccucugugaggcacuuggacuguaaaguccuauuuuucugccaaaaccugaggguaggcuggcaugcaagcuccuccugcagucaaucaccaacgucagggcaaacaaagggucaaggcaaacaaagggcagaccaguagacacaaaggcugggccagcaaccuggagcacaaacacugacuaccacaccucaccugccacaggucaaggguccucccuccucagaacccgagagccaccagcccuugucccauucuacagcagacaucucaaagguuaacagcacugccgcccagcaccuccccacugagaaacugagugugcucaaaccaucccaggacaaaggauaaaaaagaagaggggcccaaccccuaaucuaggaucacccagcaucaugauaaggacacucagcuuccuucucgugaggcaaacgaucaaaucccacagccaacagggaaagcuacgugguuuauugacuuggacuggccaugcguagaaaucacggagaacucggguagaaauacaacuuccagaaggucccacagcagcucgggauaacucugaacuuggggagcaacuuaagaaagcugaaaugcuucaaguuaacucuccaccaaugaaggugaugagacucggccuccccuucagcaagccgagcagagugaagucugaggaccacagacuacacugagaaagaucucucucucucucucacacucacacacacacacacacacacacacacacacacacacacacacacacaauaccucacugacgguugcuggacugggaggaauggucagagcguguuggaaucuccuucaaggcuagggugcucagucaaauuccuggguccaauccagcuggaucccuaaaugaguccuuccuuaggucccugcccccaauuauggcacauuccaacucuggcgggaugcuuaaauucauccuaaaccagaaucugggccagccucagaguuacuaugacaacucaacacgaacgugaccguggguagcccaucccacgugguaugcuagacacacccagaacccucaacucuaaucuaaaccucaacuacugagaagaugcugacccgcaccugccaaucacacaggugagaggauaguucaaggucagugcuaacauccaguaagccuuacuguguuccaaaaggcccagauuauccgccugagacuguguggcaucaccauuuuaugacuucaaaagcaaggaggcccaacucacaggccuaagaauaaagcugggauccaagcccaggcuaucaaaaggugagcuaccccgggccacuaaaugccucguucugaaaguccucuccuauuguuccaagggaaaacuugaguuaaggguccaguugcuuuaagccaaggagagggaagugcgauagcuuucuugccaguaagucacuccguagcuugcuucccugggagguaucacuuugaucugucuauaaauuagaggaaagcaguuugggcaaaacaggccccuggacucacuuuauggagagcauggacgugacccgagcuaucagcaguucccacaagcgcuugccuccauacauccccaccaccuucuagagaggaagaaaaaucucaggaaggaguugggcaguuuugcauuuaacuuguaaaaaaaacuaaacagcuaaggagaaaaaaagggcgucaaaaaaaccucgccaugcccaccucuaaagcaauguuuugguuguuucuuuuauuuccaaaggaguucuuucucuugucacucauucgucuccuuuagaaagaguggugcccccaaaacaaggucucuuaucagcuuccuauuuccacccugcagccucucuccuacugcccuccuguacagugccccgagcuuccacacagccuucuggucuagaagggugauuaguaacucgguccuuggaccagccaugaugaaucacaacgauuagcucuaaggugugcuacccugcacugcccccacccuuaggguccaaggcugaagcccacaacucuggggucucuucuuagagcacauuuagccaucagagccuagaacaggguagcagggcccaggagggaagccacagaaaucaaaagcuccuuucugucucgccaguugggcugacgcggcuuccuguggcccuguguucagccaugcaaauuauaacauguacccggcugcugcugcugcuguugcugcugucugaggagacgggcucugcccaacuccgaguggcucagaggaaggguggggccucccaacccagccaacuccauucauaauauuuacaguaaauggccucucuggcugcuggugaguguauauccagccuaauuaccucugggguuugccuacaaggcucuuccccucccccaagcucccacaaugaccccccaccccgagaauaacucagcagccaucuccugugagaggguuuuuugucauuguuuauuuauucauuuacuuuuggcaacugaacaucuggagcccccagaucuagauaguauccucuacuuugccuacuuuaugucuugauaugaacccagucaggccccagaaaacauaagaagugggugaauacucugacaaaguccacuuguaggcccaagaaagacagcccugcuaaacccagcuccucugaagagcuccuaauuccagaccuggauugucaacugcaaagccagcucuggauacggauaaauguacacccaagaaucuggcagaaagaaccguaaaggcgccaccagagucguccccuuugcuucuuucacuaaccauucuaaguaaguauguuagcugcaugcuagaaguucaauaagacccuugaaacagcauaguauacacaggucccagagugccacaaugaaacucauuccuuugugugcuaacuuuuaaaaagcuccuuucuaacauaaacggauacauugaaucaguuucccaaaagggcaaagauucucaggcccguagaacccaaaaccaucuugccugcuuucucccuagacuucgcuuuaaugaagucccaggccaugcugacccccauccccagaagcugccaacucuccauccauucaguauuuuucuagacgguaagaagaacugucagaugacaggaaaagccgggagaagcaagcguccuucgcaccccucucuuccccgggcuccccuuguuccacaaggauuaugaaaaacugccggacgggaaggcauuuugaauauuuacagcauuccagccaauaaauuccagcgcagaagcugauggaagaaaggccucccucuccagcgagcucccucccugcucccuccuccccuguucagucccagcccucauuccucuuuucuuuacaacccaggcccaggguuagccaggccagggcugcacuguacuuacaggggaaaaacaaccgagagacagccuggagacugugugcagacuggaaaaguuaaucauuacuucugucugccucuguaaucuaaucuccccagcuuggacacacucacugcucagccauccuggcccuucacccccaaagcacccaggaccuccuagaccugagccucccggccuacacccccaaccccuccccuccccccagugugggagcccgugggaauggaaggcuccggagaguccucuuauaagccagagugguaccacaggggucgggaguccaccgugcgugcauggcugcccccuucugugggaugcuccaggguucuaaauauuuccuagccucacaugauguggguuccaaucuggcuaguacauuagcgucgcccccccccccuuacucugcugcuuucucugugugggauauacacuuuaaaaaaaaaaaucggugguuaaauuaaguguuguuuuaccacagaaagaaaggguaagcaggcagacugcucgcggguagaaugucugcacugugcuaaugauccuggguucgaggcccagcacaggauggaaagggaauccccauuuuccaaagccucuagguaucaccgugagccuguucuccuacacauaggguuuuagacugcggauuaacaggaagaaaaaaagcuccccugaccgaccaacagcagcgugugugcacccugagcggagggaggauccuccacuuucacagaaacguagaagaguuugcaagacauagaaagaauuauaaucuuauuuuuagcauaaagaggcuguugauggcucccuagacacucccccccccagcauccccccuacucccgccaaaccacaaauccaggaagcuucacagaucuaagggugagaggggauuuggugaccaagccuagguccuuuucucuaaagccacccgagguccagaacacaaaaauggcuccuuccauggccaugcuccccucucucgggccacacugucagucucuaggaccuacaaugugggaacagcaaaugugugggggaggggagccugcugagacuucugacucuuucaggaaauacccccacacacacaccccagaacuggagauggggccaaucuauccuuaagcaguaggcacacacccaguucagggagaacuuuuucuuuucccucuugguuacugauuaaugaggggagggccagcccugucuaacaggcagccugccacugggcugacaagaauucccacacaguacagcagagcucacaaacagcucagauggcccucacucuucccaggagcuagagggcaaugaucucaccccccacacacaaaaaaaagguagccaccaaccgucauuaucuuggcacuguauucauuugugucgguugggcaaagaucccagaucaaaaaaagcaaaaaggcuauagagaaauucaccaauccaggagccaacagcgacaguuacuggccugguuaccugugugucuuuuggcuaagagaaguucccagcuccacacggugaaacuggaguugggaccaguccuuccuuuucggcuccaagucaaaccagcucucccagccuucuccccagccccccccgggggggggggggggagaagcaccagagagacuucuaggauaauucaauuagcgggcccucagagcucacagaagcccggguuagucccccagggaacccacagggcaggagcaguguagaaaugaaugaagaaccuugauaaacacauucuuagauugcuaugugccaggaaccccagaucaaucauggcuucucaaucaagagguagaccucagaaauagucguaggcucugaaaauaucccaucucuccucuagcugccaauuauuggcugcugcccaauguugcauaagccgugucccccaucaaugguaucacuaagaacccagcuccccggucacuucuagcagccuguggccccaggugcuacgagggggucugcaagaaugaguggacaucgugccuugaauucuugcuaugaucaagcaacaagcagagagggcugaaaccagaccggggggagaccucuauuuaucuauagacuuugcugugguucaguuuuucacagaagcagaggcagggcacaugaccaaaaaauaaaauaaaauaaaauaaaauaaaauaaaauaaaauaaaauaaaauaagcccugccugccccaucucccagagagccaucccaguagaaucucugcugcacaagccaacuauauaagauacugccccugccuucaaggaggcuuuuuaucuaacuccauccucugggaaccuagacccugauccuccacacuacacggggccugauacaugguaacuucucaggaaauagcugaugaauuaauaaagcagacaccacuggcuucucccaacacaaauggcccacucagcuucacaccugggcguaaauacucccaccagggagaaggagaggacgaagggccucuccagcagagccagccagaaggaccauggcuugucuuggacccugcacaguugggaagagacuccccugcucuggggcugaaaggaugcccagccaguggcuggcacaggcugagagguguuuccaagguaggcgccggccaggcaaccucugcggguacaccaccugcccacagcguucugcucuggcguccugcucuguuuagacaaguuacccucagcaaguguucaacaaugcuuuuacacaccccagggcucuuguuguguuaugaaaacagaacaaagcacgcuaaggaaaaaaaaaaagcugggagggugggggugagagggagggcagagcaggcagccacacacagucucuuucuuucuggucuccucuccagcucugggcagcacugucucacauccugagccaucagaacaagggcaucaaaagagaggacccggauccccagggaugaauacauagaagcuguaucuuaucugcacgccucccuugagggaugcuuaugcuucuugaagcacugauggacacaugaccuauuucaauaguuguaucgauggggugugaacccccuugccccauccucggggacugugagaaggcguuaugacagcaucgagguccaaaccguaugaugccagcuaucgcuccaaaaagacagcuacggugugaaacagcuaaggaguggaguaaauuccuaccuacacuuccacaaaaaaaaaaaaaaaauuuuuuuuuugcaaguuaaaacugagcuaaugacacuggguggggcucaggguucgggaugccaaagcuaaaccaaaauuaguucccagccaagcauugccuggccucuccauuuggggaagggagcugggaaaaaaaaaagucaugaaagauucuucagaaaacugggaaauaaggcugcagugaacaguucaauuaagggugaccccucugguaaaauauuuuuuuaaauaauaaaaaauaacauaaaaguucucaaacagccucuuucuuaaagaaaacggucuaaaugucuucacgggccuggaagggaagagggacaggggcaaugucugacagacuccucagguacacuacuuuucauuaaacuuuuccccccagaaguucuuaaaacacaaaacaaaacaaaacaaaaaagcacggugacgcaauuuccugucuuaucccgauauuuccuguuagcugacaaggugaaaguuaucacugguuuaaauggcuguccuaaacuccaucaaaccuuucccugcccaguucuugacuucacuacaaccugucuccaucuuggcacaucaacaguauuguuuucuacaucuuuaggagcagucaggcaggcaauccuucuauggugacaguuuccuccaggaacagggccaagggcugggaugcccaaggugaccucauggggagaagcaggagagacaggagaggugauauccaccuccuaccaacggguauacgcugggcaacugcaaucagagaauacagcuuucuugguguuagccacuccacugaggauggugccucagcaguuaauaauaucuucccucugaaaauagcccagagaggaagccuccgugugacaguaggcaggcggccagaugcugggccauucaauccucaucgagaaagaugcgagggccaauggugaccucccaguggcuacgcuuacaguauccucucucagacucccacaaaggggcaccugccugccuggaaauacaggagggaugucgcauggaagcuagccccuguaccuucugaggacacgacaucuggggagaaguaagaauaaguguacucccccccccaccccacccaagacgggaaggucagacuuggggaacaaacuauaagaaauuuccuaauuaagguuuuugcaacuugauuggaaaugggaaggccgaggaaggugaugguccuuuugucccagcccucgggaggcagaggcagaggcagguggagcucugagucugagaccagccugggcuacacagagaacucugucuccaaaaaccaaacaaacaaacaaggaaggaagcucaauccugaaaugcauuguucacucccagcaagcuaggcugagaucuguuccaggcagggccaucaguggaccaauagucccagagaccucuaggugcuauggaaaccugcauaacccgucaauagauccagccccugccagaagucucgccucuccucaccagucacugcuccucacugauagaacaacaacccccacccccaauacacuuaaaagcuacaucuguaaaaauugucguaaaauccacguagcaugaaaugugccgucagugacagaguccauucaaagaacuacaucucaccguaagcacaucauagcagcaguuaagaucacacuggcugcgauggccgaggaucuggguucaguucccagcacccacauggcagcucacagcuugucugucuguaacuccgguuccaagugauugccuccgguaaucauuuauuuuggucaagaacaacaaccaaaaaaaaaaacaaaaauagaucguacgguacagcaggauguuuggcauucguauuuugucauauugguugucuaauauuucaaaaagaagucuuucuuucuuuuuuuuuuuuuucuucuucuuugagauagggacucaucgugcagcccugacaggacaggaauccacucuguagaccaggcuggccccaaacucagagagaacggacugcuucugccucgcaagugcauggaauaaauaaaaagacuuaagugcugcucaaaguucaaagcacacacuagaguaaagaaaaggccaaccuagggaacaggaugggggccuuagcucacaguagggggucuuugcucacaguugagcgccugcucacugugcuagaggggucaccacacuuaucccuaagcacuuuaaagaagagaagaacacccuguuaucacacagcauaccaucuaaagaauuauuauggaguuaauauggaaagaagccaagaaagccaaacccugucaugagucugugacucgucccccuuucucugcugcuggcccugaaacucuccaagucugagcaugagccgucuacagugggcucugagagaccuaaccaaaugggaguuggggugggaaugggugugggggagcuguugcaggaccacagccaaagucaacugccauccuagcauggccuuuuugggccccccccccccgccacuccacccccucgcuggccugacuggguucugccuggggacaggaugcagaggcagcagccaucucgucuagccggcagagcggcccaaauuugcuccagagauuuuuaaaugcugucacccugcauuuaaccccugccugacuaccucauucuuuccaggacaaaagagguuuaucagggagucgcucuccaggggcggggcccaugaccucaggcccuacagaagaggccagccaacagccccaugcugcccaggacuggucuacaccagggugugggugugcaucaggugagccgcccaggccuagagccaucagacugacuugguuuaaaagagaugcagacuguauucuuggaguuccagacaagucauuucucaagugaccuggagagaacacugcuagcggacuccccaaggccuguccuuucuaacagcugugagcucagugugugacagacccacccucacuuccaagcguauuggaaaccagagguuaccuguuccuaggcaugaggaagagacccuggaaacagcacauaccuaaggcccagacucucuaguucaguaucacagucucaugccauacaauuaaaauacgucuucacauuuagcugaauggcuuucuuacaucagaauggagccaucuucccugggaacugcuugguuugagcccaagucacuguggacuaagccagggcagcauuucagauuauauauauguguuuugaagucucuccucagacacuaaggcagaugccagcagggagcaaagaggagacagacuuguccuuguaguugacuugguacugacucaaaaucuguccucuccaaaccuggccaccaaaagcuaaguccuuaaagcaaaggaacuagccagccccucauagccccugccccuccucacaaacaugacuacauagauauagacgggagauggaguuucuucaaugccccuaagaccccugccugcuucaaguccccaguguccaucccucaacuccaccuccaccccaguccgagggaguuccuccccccucucacucucuagacaggggcuacaaagaugcagaguugagagcaguucuuccccgugguggagggcccggaccgguacucaugccuucuccuccacugggcugcagagaaguuccccagcuaugacaguccuugccaaggugggucucccggccucauucgaguccaagcagcauuagcaacggccugaccuggauuuugcaugccuuccaaaagacaccggugcccaaagacagagcuaaacccaggcuaaacccaaacugcaguuccgaacccauccaaauaccaguccccacacaguauacaaaacuucauguaagggacacccgaccagagcaggaccccagauucucucaagacccugccuguaggcacagcaucucucugcucaagugucaacacaugagcuugucugucugucugucuaucugacugcagugugugagcacacgcacacacacacacacacacacacacacacucacaagccugcacagagcaacccaucugucucagagagccggcugucaagaaaugaaaguacaauccccuggaaccaaauuauugccuucuaaaaaugucccguuuucccagacugaggaaacucacaagggugggguguguuucacugcagguccccaaggaccuuggccugucgucccccugcccuccccacacacugcaaggcuggaauuccaaccugaagccagccagggugcugcucucaguccacacccacuccccuuccucuagcuggcccucugcaagggcgcaggaaagggaagggccagccuuggagucaccccugcauuucaggaggggcugggccugugagcacaccccacccccaucuccaaggcaccacauuuucacauucggcugcuuucucuuucccuucuuccccugccaagagaaucaagcccuggcucacacugccgaccuuccucccacccuaaacugagccccauucauuaagcccgcucucagccagggcaggacaggaaggaaagcggcacacagggccugugaaagagacucccagagguuauuucggagggggggggucacuaccccccaccuugauugaugcccgaccuguucuagcgcugccucaccccagcguccaccacaggagcccccuucccaucuucucuggccucacucagccaccccugucuauuaggagcucagccuacccaaagaauacacaucuaguccccuacacacacacacacacacacacacacacacacacacacacacacacacacacacacagcaccaccucuguaaaaaggaggcuuggccuuccagaagguauaaaaacuucugccaaagcucaagaaaccacccuuugagggcauucgcgggacaaagaguauaggugguuucucucugugcuccuucaccucaacuccagauacccccaaagcacuggcaucaacccaaaaagcucuuccuacaaccccaucccaagcacauugcaacuacacggcuccaacuacguacagaaagaagaaagcgcuccaacuucgaagccuugggaauuaguaaaccaagagcugaaauucaaaacaaaugcucuuucauguggcggccuccccgcccaacccccuuuuuuccuuucugcaguuuuguuauaucaugccgucccuugcaagacacacuccugcacccuagcagaaccucacccaucucagucaggggcugcaguuacccagggagggggguguggggaguggggaguggggaacgagaaugcugcuucucagcuccucucuagaacuggauggacucugggaauuuugggaaacaagguuggcugaccaggucaggcugccuggcuccucgggcggggcgaggaacucucgggggccgcugguucucagccuggugucgucauuuccucuaguagaggagacagacaagauguuaucaauaagacaaaccuuccgaaaggcuccacuucccuugcuuauuuuaugugguuuggagaaccuggggcuccucccugcacacccagggcuuaaaaaucguaacaagccaacaacauccugaguguguuauucuguucagacucuuccucucuuguuucuucguucucucaagaacucucaccucauuucagccuuagaaagcaaagccgcgaagccuucccugggcauacuggcucccucuccucagugacuagggcccacucccuccucccccggaggcccugcuuuuccugcucaguucucauuagaagcuuugaauaaacaauacccucggucucagauaacagucagaguacacugcacuggaaucaaaacaaacaggguccccauacagccauuccccagcaggcuccacuccugcaggggagagagugggccaugaguccaaaaugaacuguaucuccaacacauaggggaagcucuucaacagucagucgccaggacccaccuacccugcaacaggucuaagggaggucccguaacuuccacuaagagaugcuaaaacaggacguccaccaauggccugaagaccagcucugaugagagcccagaacuguccuggaauuucgccacccuugguucucuucucuugcuuuaacuaguucuuaggaaaaaaaaaaaaaggaugacguggauggagaggaagggaagaaaacauucuuaggaaagaaagaacuucgcucccagagcaaaguugccauauuauccucuuuuguccucugggauaauaauccacuggcuuuccccaggauaccuccuccagcaccaucucuccagggcccagagaaagccugucuagcugagggcagcuucgguaacuauguaccuauagcaagcccugcccugugacuccagaaccccacaguccacugagcuccuucuugcaccugggcuaugccucgcaaaccugcugggucugccuccuucaaggcacgugugcaagagcaaaauaaagaguuuaagcacaugagaucaugccaacguuaacaaauggaaguaacuuaagucagggguugcuuuaaaaaacacgagggagggcgagguggaucccauaggaaauagcucauagaauaaacgugcccgccaccaagcucuagauaucugugcucugucccugaagcccacagggugggaggagagaaaacaacaccuacagguuguccucugaccucugaggaacacacacacacucaacuugaaagauagcccuggggaugugagauggcucagcggguaagagcacugacugcucguccagagguccugaguucaaaucccagaaaccacaugguggcucacaaccauccauaaugagaucugacgcccucuucuggugugucugaagacagcuauaguguacuuauguauaauaauaaauaaauauuaaaaaaaaaagaaaagaaagauagccccgaagcucggcacacacacaacacaguucccaggugacuccagaucccccauuccugggaaugggcaagguucuggcacaaaaaaggacccuagaaugacaagcugaaggaggccagucaccggauggguucgguuuaaaguauauguaaaugacaacaauuccagaccaacggggguggcugaaggccacccccaugcuuuuauuagcauccaucgaucucuaggaaaagagaaagucucuuaccugaaagccccccaggggccagauaauucguucccccgguuuccgcggaggaagguacagcaucuggacagccugcugcagucagagaagagagaaaaagucaauucacaaagaagaacuaucagcgcucacucauccugaugaaacacugagagacgcaugaaagaagagaccacacauuccaaagggcugacucacagccgcgaugcagauuauuaauggucuacucggcuucaugguccagccuaagacagaccacagcaccuugucaccccgucuaggcuccaggcggccggccaguuaaucauuagucaggucaggcucaaucacagacugccuggaauuucucuuccauuagaagucucccauugagcucagguaacucccaaggucaaggaggggucgagguguacuuucucaauccugcucucuucucccaucgagcacaaagccuccugccucccacucccagagacaagggucucaaucccugccuuuagaaagaaaucgcacaggcucaccaacuuccaccagucuuaucauggauucagggucaagacuucucagcaaggacccagccagagagaaaccuuucuaccuacuuccaagcugguccaaacccacaucuggaaacccugcucagacaccuagauucuacaaggcugccugccucaguacccccacaaucuuucuggcacgauauucuuccauuuucucuacuagaccuuaaccagcagauuucauauccucuaccccucucccaacucccaggugcucaaugaccagugaccucaauguuaacaaggauaaugacaauuccagcugaguaagagacagacccuauggaaggaacagccuccaagcaacaacaaaaaaaaauaaugcccacgaaccacaacuaaucaguccccuggaccgcaaacgcagaggccccuguaaguuucuucugcaccacugccaaugucaaacgucuuccuaaguccccauagacaguuuggcuccggaaaagcaaacgcacuacugguuuguacagacuccauccaguccucccacccuggcuaccaggcauuagcagaugucucucuggccauagagguaugaaugcuagcuacucgaagaaaagagcagccuagauagagacaagcaggacagcuuagggauggccuucuaguuccugaccaagggaaggugaccugcccagaagucacugcugaggaucccuccccucccucuuacacuucccuccccaaggcugcaguggguuggaaagauugguggggguuacucagguauaggcagcgccugcccaguguguguuuaaauuuuuaagaaaaaccucuucuucuaaacgggagggaacacggaggagccagcaaggggauaagagaacguuuaugucucauuucuucaaugaagaggauaauuccugccaggaauaugcagcuuuacaggacccaugcuucaucgaauggaaaacaauggggggggggggguuggagggagggcacacaaaggaguaggaugcaagucuguacuuucuggccccaccauuuucuagagauuggcuucucauuccccucccccucacgcucccccagauggaagacaccccgcagccacucccccaacucuggcuggccgugugccaggggcaagguguauuucaaaggcagagccuggccucuccagggcagagccuagagaccucagucagccugucagccugucucacaucaaaggugagccagcuccaagaugcaaccacaagugauuuuuaugaaaugcgcucugcccucugcaucgccuuugaucuuaggagggcuuuacacacguuaauuaggccuccccuaccaccccugggaggcagcaaggcauuugagaggcacccagggaaacugaggugccacuccacuaggccaggggccacccaagcagcuagcugagccacccccaaguccaguuucuaccccagggcuugcuuccauucccaaaccuccuucccuggaguuggccaggaugaaccuggucucuggugucuagauuuccaccuacccaagacucugcaaagauaacucucaagucagaaaucucucaccuuccaccaccgucuccugcuccccagagcccagccuggcagacagcagagcugagcuguucuuggcucuccucuaccaccgcacauuaccaaacaccuaauuaagcccuggguucuguggaacaaagacgcacacccccuucucccagcaguuccaggagcccgaggaacguguaagguucuuucccacaucgcucuucugagugucccugguacuacuuuguauaaugacugauggaaacaacaaccaccaaauaaaugaaugaaugaccuaaucauucauuaaaagggacucggaaaaguuaaagagaccuaaauuaagaggggccagauggcagaucaagaugccagccguucugguaggauuugaagguuguaccaugagaggccaucccugcagcagccagucuccuugccuuucagcagcggacacagagcugagaagggacagagccccacucaggcuccccucccccuccugcaucugucuacaggcgagacguggguacacaaacagcaaauccuuuuuccuuucgggauggcagagugggaguaccuucgugccuugcaaaagccacccaagucagagccacuccugcccugagguccaggcaagaguccuugcacacaacuggucugggacauacagaaccgggugcagaucuaaauccgggcccuuccgguuuccaaguucaaccuccaaaggaucccucagcucaacuaucccaggccccagaaccuuucccucugccucaucugaagcaggagaucucgcuaaagggauucccucaguagugcuggcucauuaagauuuuaacaguuguccacuggaaaacccuauuuucuguuucaccuaccuaacccaacaccaaacuccucaaccucaacccgggaaagaacaucuacauccgcaggucaacacuuucccacacacugggugggaaggaggggugugggacuugagagcguccccugcauuucuagcuacuacaccccugaucaccacaaccagcaaucaggcccuagaccagucccuugggccaguccugagcccagcucugcuguccggaucaauagcucuucucaauggggccuuucggcuccuuucccguguuccacaccguguggugccugaguguggguucuuuuucuuguuuuguuugaagcaaaacauuuggggugagcagccagcugcucggguuuccgauuggcagguuaaucacuuccuauugggugaugggagaagguugcuccccuccuuggaaauggcacauuccugucuuuguggcuucucuguuuacacacauuuugcuaccuaaugucaacacuugcuaaugaauaaauauaucacucuacuccccgaaaaugagguccuggccugccagaaggacugcugaaaucuugcgaacagauuuaccccaguaucuuuuuggcaaauccaagaacacaugguccuucuuugcuauggaguuuggacuuuaggggaaccucaaccagagcugucuucaccucuggagccacagggccuucgcuuugaaagacgaaugaggaaacacaaagccaaaagaaagaacugagguggacacccugggagacgugaccucauggaacaauucuggauccuuuaagccauaaacucaagacaaguuauagcccucagaguuugcuaaugcccguuucaaguuuguugcaaacacagagagccaguuaucuugucauuaaugaccauuuaucugguguuuuguaaaucgaaagcaaaauaucagacucugcaggccaccuauuagacagacaccaggcaagcagcaacgccuucccaacuugagggaacuggcgaggcacgugaagggagggcuagcuggggcuuugcuuacacauucauuaagcauuuaauuuaugacaaaguucccaaaaauggggggagggggggaagcccuacaacagccaaaacucaugaagcaaaagguuccaagagcuaaacgguggccagcccuuuacuuucgccucuccuuggcaaagcaaagacaucacaaguguugcaguuuucugcuguaaagcaccacagaacagacacaaaagacaaaagcugaaaccuggccuugcagcaaacgauucuguaauucuuccacuguaagaaggaagcaggacuugucccugcggccaucccccccacccccaucuguuuugcugacccuguccccuggcacugucagcucuaagggaugggcccuaggacugccagccagaagcugaaugcagacaaccacaacagggcuggugccagucucaaaugggcuucugcccuggcccucugccauccggcaagagagcaacaggcaggcagagcugugcggaaaacuuuuauggucucucuaccaagaauucugagaaaaccccaggagaaagcagacuugugggugacugagcaggcgggaacauaauccucgcuaaacucgcugcacugccuaaccuaguguguuccuccaaacggaaggaagcuugccuucggaaucgcuccucauccauguacccaucccuacccacagauccgacuggcacuuacaaagcuucagaauuguuuccaucaaccuguccuauuuggcucccaaaacauucaguggauuaaaagccuccauguguuaaaacugaacuaacuuccgucacacaguucaaaugcauuaaaaaaaauaaauaaaaaaaaggaacaaacuguaaaacguaucuggggagggggggagucagauacuuuaugggggaaaaaaaaauccaaucacaacaagacaaaaauccaaacuuaacaacagaggaaaauugcuuugagcaacccaaacaccacucuaggccccaaccuagacacaaaaaccaagguucuaagaaucgaaagacuugaaaaccaucuacucaccaguugguuugagaaaauccauuggguaucuggaguaaggaggagggggagacucugaaauuaaaaaaguaaaaggauauaaaggcugagccaugagaaacagagauagaaacuuaugauaacucaggcauucuuuuagcccaacuguuugucuuagcuguggggguugaaggcagggccgcgaggcggugauugccuugauauuuagcugucagauaaacaaaagaggccgccuggcgccagccucggcgcucugcuccuccacgucugcggccgccgccaccgccgccgccgccgcgcucggcgggccgggcuggaaaccaccggcugggccagggcuccagcggcugggccgcgcacggaacagucucuaggguggggggcgccuggggcugcuuagugucccacaacuacagaugccgcuuccccggcccuccccuccucuaggagcaccagucaccuccacccccgcugcugagcuuggcacccacgcacucaacuagggaauccuacccagcccaccugagaaacacacacacaagugugccgcuggugaacuuggaagauuuucaaggaguaggguaugcuccucuacccugagcacaaagacaaggagcaagcagaaggcaugggcaaccuagcuaucaggauagcacggggaggaaccugcucagggucccagccaugaagcccaggccaauuauggagcagggaagaacaucaccgaaacucagggggugggagugucggacacccuaaggaccacuaacuguaugcuuuucugugcgaaauaaagauuaaaagucgaggccacccaacuucuccaagcuguuccuucucaccccgaagcucgcacagcugagacuggauacccaguucagucuccauccuaccacugcccccaaacuccaaagcugugaggccaggacaguaucugggccacucgugucccacgugacuguccuuauuuacuaaaggagagacuuuccagccuuuaaagcuaguuucucccagccuuccuuggcgggcuugggucgaauccaacucggccacacaccucaucgccuuuccgggugcgggggaagccggauuccccacuuuacucuguacccccuugcagacccggaaauuagacugucucauuuucugcagcaugucuauucaguagaaggauaagcaguaguaacccuggguccccuccucuggaggcgggggguggggggguggggugcaauagagaaaaaucuuagagggaaccccaagcuuccccuggucccuucucugacuuagauuccuugucuccuccaggagguuauacacacauccucgagcauuuccacgccagagggaacgaaagguggacucagaacaacuucuuaccuaguucacagagucgacuaaggugauggggguugcagcacaccagcucgggguugaucuucccguaagauucacagcaacacagccucuugacuuccgaggaaugccugagauccggccaccugaacacuuugcacagcaggagggggagcgaguaggacgagggcggcugcgcgggcugcgcgcuggcgggcgcccccgggcccagccugcaguccaggcggccgggcagcaggaggcacgcggugcgcguaccgccgcgggacuccacggccugaagcagcagcuccagcugccgcuccuugaguuucuugagcaccgagugcgugagcgccuucagauccgccucggcgcccccggccgccccggcacccgagguugggggauggggaugguggugaccuuuggcaccucggacugccuugcccaggcagcagccagcccugcccgcaccgccgccaccagccccauaagcccggccguccgucgccccuucuccccgcagcucgccuccuccgccgccaccccccacgcccuccuccucguccucgccgccgggcgcacggcuccuccagagacgccggacgagcgcagaucguuugguccugaacaugcggggcgaggaggcgaggagaaaagucguuugccggcuaaggagcgaacaugaccuccgcacaccaugaagaagucgggcgccgaguuggggcagcaggcgcaggcgacagcagcaacagcaggggcccgggcagaagcggcggcggcccgaggggcgcuccguggcaugcgccagucucccagaggccggggcgcgcgcgggggcccaggggcgccugccggggaucggggggcugcgcuucggcugccccacccggcgcggcccgcgcccugcgcggcuuucgggccccggcgugcccuggaggaacgcggccgccgcuucccugggggcggccgaggcaaccccgguagacgccucccccaaaaaaggccccccuacaguggcucccgagugucgggcucgccagccucggcuuccuacauggaagauccucgggggcaaaaaaaaaaaaaaaaaaacgaaagacguuaggcugagcuacuaaagggaggaaaaagccucuuucccccuugcuaagcaacuuaauuuggggguggggagaagcaggcaauuaaaaaaaaaaggcaggcacgauuuauuuuuuuucuucuauauccuuaguaaccggaucuccucgaauucugugcacgcgaagacuugagggaggggaccgaguagacuucaccccucgugagaugucuggagggucucucaaaacccccaaaaccaaaauaugcaaagcccccaaugaaaaaacacaccaccuccucgcaccucggaggucuggagggcaccggauggagcccggguuuaaaagagaaaauguuuacaaaguaaaacaagauguuggaagggugggggaaaaaaaccguauccacgaguuacaucccccuuuuuuuccuugcugaacccagccggucuuccuuuccuuuucuucugccaaaaaaaaaaaaaaaaucguauuucuuuuaauccacagaaaggucuggcuaggcugcuucaaucuugcguaucuggguguuuuagagucucuggucuuuccuccugcguucccgggggcccagguccucggcggggacuuccuccgcgcuggggaagcagggacagaagaugcugcggcggcggcugcgccccggggggcugucagcgcgggggagggcggcgcggcggcgggcuccggcgggucgcaagcucucgcccccgagggcacaggcuagugugggggccuccggugcuccuucuccuggccgcggguggccgccggggcugcucucaugagcugcuggccccgacccgacaguggcggcaggaggcccggguguccucucgcagccucuuccucggagacucucuucgucgcgccccggagccuccucgucccccguccgcccucuccuggcgcucgaguccuucugccgccgcugggggcucgccgcgccgcacucagggacuccggggccgagcgcucggcggcguggcgccggcuggcuggcuggcugcgucucaggcagcucucuccggcgcggcgagcggaccgagcgaggcgcccggcuggcucugcuggcgcagcucggggacaagauccucugugcgccgaucagcgagcgaaug

SEQ ID NO: 8989 - RNA, 216 nt, Mus musculus
caugccucggaaaauugaggaauuuaaggacuuucugcucacagccgggaggaaggaugccaagucugucaagaucaagaagaauaaggacaaugugaaguucaagguucgcugcagcagguaccuuuacacccugguuaucacagacaaggagaaggcagagaagcugaagcagcccccuacccccggguuuggcagugaaggagcuaaaaugaa

SEQ ID NO: 8990 - RNA, 2158 nt, Mus musculus
uguauuuuuaccauauauggggggggguuguguugcuagggaucaagccaagguccucuuguacuccacuuaagcgcucugccauugagcuaaccuccagcccuuaccacuauacugauuaagagugcuaacccaaggacacgucaaccaagaaggcccuuaacugcuuuugcuuuggaaaucuuucuguuuucucuuugagcucaggaaagaaccauggaaguaugaagaguacgguucuguggggcuggggagaaggcacaguggguaagaaugcuugcuguggaugcauggagaccugaguucaaauccuagcacccacauauaaagcuggguaugcccacaugugcccgaaaacccaacacugggaggcugagaccaacguccccgaagcuugcugaccugguagccuaaacaaaguggcgaguuucagguugggugagagauccuguuucaagggaauaggggagaaggagcaauggaaagagaugagaguggggagagggagcaagggaaagagggaggaagagagggagagggaaagaaaguagagauagauacugagugaguguguauggguacaugcgcccacauuuacaaaagcguuccacaugauaagcaaugugagugcaaugaguaaugacgaauacaaggcagaguaagguacugugcccuugaugaacuuccagcucaacugguaauauaggaagugucagggaggaaggcugaaagaggaagauauaggaagugucagagaggaaggcugaaagaggaagauggucaccccgccaccugcuguuaauguucaagauucauuccuauaugaacuuguguuggagacugguucuaauguuuugauucaaucggagaucugugugucgagacacugaagguauuuguucccaauuaguuuuugauugaucaauaaagauaucaauggccaauggcugagcacuuagaagaugcagaggaacaagacuuucucugugacuaggggaagaaggaugugaugcaauagaggcaggagcaaaagccaaccagacaugugagauuucaggugaguagccacuggccacuucuucgauugggccugggguaguaggggaaggcuuaggaguguucagccauugagguaaccaaagcauuuaaaaauaaacuaaugugugugucuuucaucuaaagauaguuccuggguggauaugcucaugggaucccccucugcugggagccaaagcgauguagccaaaacucucacugcuacacauuugccagaaguucuuuuuuaaauugcuacauauuaucauauuguaugaacauguuacaauuuguuuauuuguccccagagagggcaagcaagugggagauguugccuauuggccagcacaucugucucagucaggguuucuauuccugcacaaaacaucaugaccaagaugcaaguuggggagggaaggguuuauucagauuacacuuccacauugguguucaucaccaaaggaagucagggcuggaacucaagcaggucaggaagcaggagcugaugcagaggccauggagggauguucuuuacuggauugcuuccccuggcuugcccagcuugcuuucuuauagaacccaagacuaucagcccagggauggcaccacccacaaggggcccuuuccccuugaucacuaauugagaaaaugccuugcagcuggauuucaaggaggcauuuccucaagggaggcuccuuucucugugauaaccccagcuugugucaaguugacacauaaaaccagccaguacaacaucuauacauagucuuccaauguuauuuuguagaagagauuggaaauaggagaaugggacaguucagugaaaggaaacaaugcaauaaauaagauuaguuugcucgucuuguguaugcuuguguguguguaguguuuguguguguguguguguguguguguguguguauaguguuuguguguguguguauucaucccugaaugugugugcccacaugugggcccgcacugcaggguacaaguagaguuuggagacaacaguguggagcucacaucuuuaugugcuucccaggcaaauccaccucucacccugugguuccagaaaucuaauacaagguucagaugcgaggcucucucagaugcaaaaaag

SEQ ID NO: 8991 - RNA, 3370 nt, Mus musculus
uuuuuuuuuuuuuuuuuuuugauguggcacacacggacuuugccuaugccuuucucagacauaggcauaggcccuccuuacccaaaagcacugcacaguauuaguuacguguuuuaauuccaguuugccuauggccaauuagugauaauaggcaacauugauguuuuaaacaaacauaaugaaauucaagcuuauccuguaaauauacuuaacaacaccacauaacuguguuuguuguuuuguuuuuuaaggccuugaaaagaacuagagaccuaaucucagaguuacaugaugaacaugaaguaauugagaagcuuccugguugagccauaacuuccugucugagaaaaagaacgugcacagcccuguuuggcuuggaacagcccaaacauuaaugaguugaacauuuuuaucacuaguaaagcagguuuacuauuaaaacugacauagcauccagcuauaauaaaaacagucuacaaaacacuuguuaaccuuguugcuacaacaacccuugagguaacuugacuggagugucucccaaccuuaggaacgccuguggaccagccugcuguagugcugguucucugcaguggagacgguggcugcugugugugugaaguggcagaaccauuaagcucuucacacuuggacaucacucuuccuccucaaauugaauugcguuccuuuaguacaggaggcagaaguguggauggcaggcugauguuauccccuguaucguucuuuaguggcacacacguccaagacagagggugaggacugcauuagcuagugaauauuugugggaguagggcaagaggguucaguagguaaaaacccuucuugugcagacuucuauaccugagcuugauccccaaaacccacaugaagguaggaagaaacguguccucugaccuccacauuugucuacucacacagcauacacagaauaguaagaaguugugucucuuccuccuucccauccguucaucucagacagacuuuguuuccaucaaaaucaagacagucugaaauuuagaaguucacaacaggagucugaaagucuucagugaauaggcaugugaguauuuguaaaaauccuuuuaacugaucguuuuggugcaaaguagcaaaaagguuuaugcuacuuuguacauguuaggacuauaggauuugcauucuuuuuuuacuuuuuauuagguauuuuccucauuuacauuuccaaugcuaucccaaaaguccucuauacccucccacccgcccacucccccuuuuuggcccuggcguuccccuguacuggggcauauaaaguuugcguguccaaugggccucucuuuccagugauggccgacuaggccaucuuuugauacauaugcagcuagagacaagagcuccgggguaggauuugcauucuuaaacauacuaacagaaggcaagaucauugaguccaaauucacacagaugcucagggguaaaucaguaauagaucaagcuugcuuccccaggaaguuugggaguugaaaguuaccauaacaauuaacaaugugaauagaauuugagguuauuuugucccucuuugccucauaauacuguuaauuacgucaagaaguucuaaaauugggaaaaaaaaugugauccagaggaaagcacaggugcucugaacaccugacccaggaaggacauugcgaggccauuguucaaggauucauuccauuagggagugauuuagagugaucuugaggucuuagagugcaccuugugcaugugaacaaggaagaaacccagacauuacuuacuaagcagccacgucagugccgagcagaagauugacagccacgagcuaucauaaagucuggguggcuggcggcaagugccacaggugacuguacuaggagcguucaggaguguacccacgaggguggggcgcauggcagugugguacgcuccguuugcaccagcagccucugcgugugaagaugcuggcuuugguucauuuacauggcugguuugcuagagaacucccugagacucuaguggugccuacguguuugaugguaacagauggacaguuuucagccaguugccuaacagcaguuugcuaugaagccacacuugaacagcggcaggaggauuaugcccucugcuguuaaauggcauguuuccacgggagaucuugucucuguuggcuugucauuagcagcauuuaaucauagugcaucauguaaauaccauguuuaugcacaugacucacuuuuuagguaguuauuuguauaaaaguguuugggcuacagugagaaggugaggacugagaagagcccauuuugcccuuggaauaaagcauuuuaauaggaaugucuagcuugccccuuucuguuaaaagggguuaaaaaaaaaguguuuugccuaagaacccaacuuucuucauuccaucuuuuguuuuuguuuuucgagacaagguuucucuguguaacagcucuggcuguccaggagcucacucuguagaugaggcuggcuuagauggagcucacuagagaucugucugccucucuuuccugagugcugggauccaagacgagugucgccgugcccgaccucauucucacuuuuuagccacgcucuuguguguggcaguucagaacacucuuggucaaccaugaacacauuuugucaggaauugaauuuuauagauaugagugcgugcuuucacgugcaacagaaucggcggccugcagagcacuacuuucucgaaaugcucuguaguaguuacaggaggaucuuuuuuauuacagucuaccugaggguuugauuugguugguugguugauugguuguuuuuugagucaggguuuuucuguguagccuuggcuguccuagaacuugccuugaauuuacagagauccgccugcuucugccuccccaagugcugggauuaaaggggugugccaccaccaccaccaccauaggcuaccauuguaagggaagcaauaggcacagaaaaaaauacuuuucucaaaaugaaaaucacugaaaaaaguguuagauuuuaacuuuuaaguaaagcauucuacacacgacauacccuguuacucuuuuuaaauaaaaccaaauauaggugaauaaaguugaacuucugagaacuaaauuuuggugcuuggaauugcuaacaguuuacagggcgcaauuuuauuugccagaaugucaacauuuucuacccugcuuccacuuuuuuacagucuguuccuuauccccuguaauuaaagaaacccugaggaaaaaaacauuaccagaauauguaauuguaguauuuguuaaguacagcaaugcccagagucgagagcgauguuaccauuaaaaguaaguauuuuguguccaca

SEQ ID NO: 8992 - RNA, 1708 nt, Mus musculus
ccagugaauagagugugaugguuugaguaacucccaugggcuuuuauauuugaaugcuuagucacaaaugauauuauuugaaaggauuagaaggauuaggagguguggccuucuuagaggaagugugucagugggaguaggcuuugagguuucaaaagcccaugccaagcccagaguuccucuaucagguuauagcucucagcuacugcuccagcaccugacugaauacugcguugcucccuggcccccauaacuggacuaaacugcugaaacuguaagcaaggucccaauuaaaugcuuucuuuuauaauaguugucuuggucaaagugucucuucacagcaauacaaccacugugauuaagaaagaguauuuuuuuuuuaaaccuugagucagcuguccacauucuacucauuaaaguucaauuauuuauauguauaccguacuucaguuagcucuugggcaagaguuuaaggagaggcagucuagagcuuaguuuuguuuuuguuguuuguuuuucuauguugggaauggaggccaggaacuaacagagucuagcccagagcuuaccacuggacuauggccuaaccuuaucaaggcauuugaauuaguauguuugaagaaagauccuuguaugcuaaggagaacugacggagguauagaauaggaauucuuugcucacagaucaacacuuuaaaacucauacaagugcaauguucucagaaugacuguaacuggaaagaagccuuagguaguaacaauauuaaacggauuccgucagucuuaucaaugaaaucugaacugugugugaccagccaguuugacucugcauuaugucugucauuauguguuuuuuuucauucucacacuuuauucuaggcuggcuuccacccggcugcauaacaaucgcucauccuccugcuucaacaucccaaguccaaguaucuguuuuauuucuccuuuuuucauucuuccaucgaaucugggaauaucggcaaucuuucuucuaucucucgucucuucauuuuauuuuucuucagcuaucaggauuuccugacuuuuuucaucagaguuuucuggggugcucucuuuuacuucacuuuucuccucaccguacccacaauucuuucaacguugcuguccaggccguugacauccccuucaaggucaggaaaaauaucagccaaggugaaaaauuaagacacaaauuaaaaggucuuagccaacugggugugguggcacacaccuuuacucucagcacuugagagacucaaggagcaggugaaucucaaguucgaaacugcuccacgaaagaguuccaagcaagccuggguuacacagugaugcccucccugucucaacaacagaaacacaaaacaauucuuauccgcgaucaccauuaacuuggaacaacgguuuccacaucacccuuacuuggcuuauccuaucacagccacucuggggauggcacugagagaaucuucucgaguguuuccgugaguccuguccacucucuucucucggucacuuccucagccgaggcgguccuccaagucccgggagaaggccacaguuccgguacgagccucgggagcugcccgcucugccggugcggggaacagggugaggggaggagacaggaagcggcgagcaggaccgcgcucgguagggacaggccaccaaccggaagcgcgugggucgggggcgcg

SEQ ID NO: 8993 - RNA, 2220 nt, Mus musculus
acacagaugcuccugguauccgacccugacuacuugauuuggugcaucagaacgagcguuagacauuaauaugcaagugaagggaagcuuggggcagucugcucucucuagcaaguauggaacuuucccacuucccaucucauaaccaauuaugggggcaguugaacuccuccguuauuacuacauccaggagaguggaaaugugauuucuggcaagguauuagucaaauucugugacauacaacucucauacauuggaaauuucuuuaaaaguauuguuuccuaaucagacuuuuacauugguaccaugaguucuuuaugcuuugccaagacauuguuugagggauauagugggaucauagauugguuuaugccauaaaugugauuaauucccuuccccuccccuccaauuugaagaaccagaaccagaaccagaaccagaagcagaagcagaaaccuggcuguuugucacuggcgguucuagugcagcuacagagccgugguucucaaccugugggucacggccccuuuaggggcgaacgacucuuucacggguugcagcgucaggaagguugagaacuaacuguagacuaacggacgccaucaguaugagagaucagcccuagcaugcgcuugucagcacaguuccaaagcaugaccugccugguuugcuaguucagucauuuguucaccuacuguuagcaaauuagcaccacaaggaauuuaagacagauguugccugcuucuuuuguacugugucacgggcuugcaaaagccuggggcacaauuuagucuuaguuuugacuuuuuuuuuuuuuuuuuuuuuuuuuuuuuguuaaaggcaaagagccgagccccaauuccuguuucccuguaugugugugaugugacuuccauguguauauaaaacuauugcacccuaaccaaacuuccucagacugugcacuguuuguugaaaauaaucacguauuuuaguucaaugcuguuguauuuuuucuuuuuauuuaaaacacuacuuauucucuaacaaauuucaaaggguagugaucuaaaaaaaucacuggaaacuaggaaauguuucuguuguugcuuuguucuuuaaagagugcaaaggucacggaaucuuuugcucuucuuaccuugaacaugaauugucagccauuguguggcuaggaaccagugcacuuggcguucacagaucugcuguugcugggacugagcguggacuugaugcagugacaacaaaucacugcguagacggaauguuuuccaaaugugcaacucaaguuuguaaaaugaauuugguucuuuacaucauuauuuagguuuuguuuccauuuaguauuuaauggucuuuggagaaaaaaaaaacagaguguuauauauauauuuuuuggugcaagauaagauuuuguuuuuugaaauaagucuguagcauaaagguuaaacuauuuuaagauaaaauaaaaauagaguguauuuaaacagugacucuuucugagaauguuuucuuccugucucaguuaauaagguggagucugggaggaaccuuucccaagcuauccuuuggagaugaaaacguguuacauuuuguuaacagaccacucauuauaagaagccuaguuuucuaaucaauaucuguauccugucuuuaagauauguuacuaaggcaugucagaucaaggggaaagcaguuuaaugggauuagggguuggcucaguugguaaaguacuugccagaccugaggaccuggguuugaucuccugcacccacguaagaagcugguggcuggcacacucucacacucucacacucucacacucucggagcacggcuggcucccacaccggggagguguaagacaagaggauugauccccggagcacagagccuggacaggcugacucugccuccaggaggcggauggcauuccugcggaugacaaccaagguacuucuccaugccccuccccauaaacacuuggggacgugcccucguacaaagcagugaaagacaaaaggaaagacagcuuuacauuagcuucccuauagccuguaucucucucuuuagcuaaggccagugagauuuuaggcacaguugaagggaccuuugcucccaggaacagaauuccauugagaacuagucacuuuucagaaaagaacaugccgggcucuguccaccaugauuguaugugauuugacaguguuucaguagccccgu

SEQ ID NO: 8994 - RNA, 2449 nt, Mus musculus
ccuuuucuuuucuuucuuuuuuuuuugguuuuucgagacaggguuucucuauguagcccuggcuguccuggaacucacuuuguagaccaggcuggccucgaagucagaaaucuccugccucugccucccaaguacugggauuaaaggcuugggccaccacugcccggucuuuuuaucuuuuugucuuacagagaggcacuuuauuagcaggaauuggcugugaacucucuuccuccagauacuguuagaaacgauggggugaugucccauagcaaacagaaacucugaaggcugacugggucagggguuuugguccuguuuccuucuauggucuggaguucgagaugcagggcagcgagagccagccaggagaggacucaucucaggaaaccuuuaccuuugcuuucacaagucgcugggcaaauggguguucuuugcuagaaagaccaaugacacagaaaaguuaucugaauggugcagagauguggcagaugccaaauacauuucccucagacgcuuaucaagaggcgcauuuguuuuccgucuuugccuuccauuuucucggucugcgucgucuccagacuccacaccagaaaucagaacauaucuuuaccaguuuaacagaucucaaaacggugagacccugucucaaaacuggauaaaggucugaggacguaaccgaggggugaagaauugccucgcaucugcagggaccaguucaauuccccgcaguauaaauaaauaaacaaauaaauaaauaaauaaauaaauaaauuuuaaaaaagguacagaugacuaucauuuucuucucuuccaaaaccugcacugcucguggggagucagaccuugcauuguaaacuuguccuccgcgucggucucuggagcucucucuacaugcuaaguggagacucauucaucccauuuucucaaggucccgagcccaacacgugccccgagcccauuuuuaagguccggucugcaaaacucccaauagugugugucacccuucccaaggcgggcugccaaaccaaggagugacucugcagagguggaauucugagcgucuggaggcgugcguuggcuggcggagcgggguccccuggaggacugugucaccggcagguggcgcgcucgccgcaagccccgcggcguuuccagagcccaaacuugaacaggacguuagugcgggugucggagccgagcaguucccgggagccgagcugucuuuggcccccgagggaaaguggggagcgaaagagauuggacaccuugcuggggugacuccacgaaucggacaucgugagcuuccuucggaaaggcuucucgagugggugaguacugggcagcccucgggaagcggagccccaugcuuuuaaggcucgggcuuugcccggcccgccaucucggcccuccgagaccgacguuaccggaucgaacggagggcgcgcgcgcgcgaaagcccgggaagcgggagcgcuggagcccgcgcucagcggagggcgcgcgcgugugcgugcgcguccccgccgccagauggcgcugcgccgcucgcucccggccggccgccagcuagcuuagguucccgccgccgcggcggucgcucuagccggcaggcgcugcucugugguuccgggcggaagugaggcgcagagcggaacggccucuggugacauuuucuuggggcggcgcggacgacugaagggaauuugguguuggaggcugcggaggcggcgagcuccucucugccccgcugcaggggcuccagccgcgcuccucugcucgccgcugggagucgucugaggagaagggggcggcggggccgagucugcggcccgucaagcgccgcccggggugggcgcgugccccgacggggcgcgcggggccggcgaggaggcgcggacggcggggcgcaggugaggcacggaggggcgcggggccgcggccuugguggcggggcgagccucggggucggggcugccucccggggaggugcucgugagguuggaggggagcggggccgggcugcgggcucugcggcguccgagcuuggggucacgacggcggaggcgcggcccggaccccucgccggcucgccgcugugacccucgcguccucugcccgcccgucggagugcccucccccggccaccggcacggaggggacggcgggcugaagggaccgcagccccccaggccgcggaguuguguuggagcaacuuugcggagcccgacccgcgggacgcucgguacccgagccuggcgcccaccgcagcccgagcggagcugccgagagcccccucccgcgguggccuuggaggagcgagaaagggcuccccgggcuuggugcuggccucuggccgcuuccucgacugugggucggcagauccccgggaucagugugcguggguccccgacguugaccugcgacuucgucaacuuuaaaggccauc

SEQ ID NO: 8995 - RNA, 3790 nt, Mus musculus
ggagucgguuuucaggagcaggaaaaagaaacaguucucuuuucccggcuuggaaggcaaguuccacugugcuagacacuggcccugucauuuuuaggaaagggaaaaggucacagcuugagagccuugucccaaugcuuuggaagcucuugggcuuguccccuagaacuggccuggacccucuggagcagcagagggaggacuggagucagguuuccuguuggcucuugguaagcaccugaagccacaaggcugugcuucuguccccacccagccaacugccuugucucccuacaucccaccucuccaucggucccacccuccccaacacgcuucacuccgaccgaccacccacucaucccaggagcagugagugcaucgugaacccuccgccuccccucccccaacacucucuuugcacacacagcuaaacucucaucuggcuagcuaaagggauugucccuuauuaaauuccucgggggaugaucucauuaaaccucguuacggggcacuucuauuucagggacaguaaauuugcugcaaucuaugggcagcuaguuaauugaaacccgaggaaggggcugggggagggggcggcggccgugguagagaagccugaacuggguggcccagccuggagcugacgcagggaacuggaggaggcugagguacggggaggagcugggguacacgugagggcagcugauaaagggaagaccugagccucagagggggaggagacagagcagcccggugcgguaagcuggccuuguagcugccugccaggccuugcgcucaccccagacugccagagaguccagacuggccccaagugauaaggcccuaggcugggacgcggccacugcaauggaaaagcaggaggaacaggagaacuuggaaacuaauuugauacggggaugagggagagaaaggagcccaagaugaccucuaaagaucccuggagaacggggacaggugccggagcgcaagcccagcagaggccucagcccagugccaaguuaguuugcucuauuguuucaauagucugucuucacucccgucuucagaaagcguuuccccgucuuccaguuuuucaucuauucaggcuuacauucagcuccuaaucuucuaccgcucagcucuuaacuuaagcugaguccagacaggaucaguacaaacaggggcaccgccugggucagacucucccucggaaccccugcagagcacuuagcugcacucagaaccucccugacuucaauucccucacuacaagcaguuguauaauuuccaggacagcugcagaggagccaaggacauaauaagcaccggaaagcgucugguagcaggccucaguggcagaugagcuuggaacuucugacagugcuuggagacaaguggccucuaacgccugcauugugguucucuuaagaggccugggcuucacuguguguagaggaagacgggaggcuuuggugauuucucacaacuuuauuuuuuucuucugugucguuauugaauggcuguggaagcgccugccaguguggucucaggcugaggauguagcugagugguugagugugggccuaacaagugugagggccuggguuggcucccggcacuccaggaaaaaggaaagacauacuucgguuuccauuguaccgguucuuugauucuggaaaaggacaacaaaggcuugugacauaaaacuucauugguuuccuuguuauuuccauguagcuagggugcucucuguaugagccaccaugugguugcugggauuugaacucaggaccuucagaagagcagucagugcucuuaaccgcugagccaucucuccagcccuuauuuuuauuuauaugucucuguguauggauauggauuuccagggagaccagaagagaguaucugauccccuggagcugaagcuacugacaguuaugcacugccugcuguggguguuagggacugaauucaggccaguauguacucuuacgcagacccaucucuccagccccucuggccugccucucucagaaggaagaauggccugcuugagacaagagcugcuggagaggagcagcccugacucucugcagagcuugccugccuacaaccccuuucgccagcucucaggagaggugacugucccagugcuagguucaguguugcucuggaggggcauucuguggucacacacuagccgggcacucugccgcagguguccaugaaguucccacuguauuucuuacggucuucuucuccaucccuccuacuugcaggugacugucaggcugguggcuccuagugucagggaccugggugagaagggaccgagguuaacagcccuucucgacuuucaagagaaaucugaacuuguuuccacgcaugcuguugaguggggaagggaagugggugagaggcggggaggcauuuugagagaagcgguucucugagccuugguugggagaaagauggcgcugugcccucccuuguacagccauccauuuacagagggguccuaagagaaccuuggagauuccagccuugggaaaggucucuucucucauggcacgaggccagagacccugccauaguguauugcuggguuuggacaaguggggaaugugcaucauugaaggucuaaauccuguguuuuuguacaguuggacucugggaguaucuagcagggaagggagagaacgaggccuugguaauaaugaaaugagcccuucugguagcccuucccaccgcucccaccgcacacagacacauguacuauagagauguugccagaucccuaacugacugagaaucugcucuauccuuccacacaguuuuggggaauguuuugucauucccgagacuggguagaugguggccaucuucacaguggcuugugccaacugggcacagagguaaucucaucaaagggugggugcuuucagguggagaccaaaggcccagcuaacuaaugaguccuuccauuguuccagcauugaagaccagaguggagaggauggcacagauaaaggucaaccaacugcagaugaaggccuaccuagaagggucugcgcaggacaggcagagucccuccagaucugaagacuaugcagccagcuagcaccaggccuacaccaggggacaagaccaagaaugaagagaccaaggcucccugcagaucacauggccgauucucauugcuuccaaccuuggcugccuggaagaaccuuaucucuacauagauacagccagugagucuacacuagacaaggcaaccagagaccaaagagaagaaaaggcagagcggggacauccggagacaagagagaagcaacagcuguuggcuuggaauaccacagaaagaaacuugagguagcggcuugccagucggcuacugugaaaccagaggcaugguaucuuuucugccacuagccuggcaggcauugacagggagguuggccuuggcagugagggagcauccccaaucccaguagccuggggcaaucucuuucuggaagacagcggcuuccuugcuuuugcuggcucuuccaguucaccaucaccugagaguuuccggcugugaacacagccugccaaggggcaagcugaaggaaacagacugcaugagaaaauggggaaccugucaggguagaagcaagcuuccugcagccccauggcacgguucuccaguuuggguugccucucauuuuggcauggauuugaggagauguguucuaaaguuucuggagaaaauuagaaggauugcaaguaaaguuggguagugcucuau

SEQ ID NO: 8996 - RNA, 9145 nt, Mus musculus
acauuuccggagcagaguucucuuuuuaaucaaucacaaaguacuuccgaauuucauaguggacagcuuugaauuaucuauccaugcugacugcaccagcaagaacaggguaagagagcaauuugccagcuauggcagacagacugcuacaagaauagccuaggcuagccauugcugaggucacacaguaagcucugucuuacaaaacuaacuuauggaacucaacaugaagucgugcuuuaaauaaaaaccugcauuaaauucccgguggaaggaggguacugucauacaggcuggcuguccucugaccaccacacaaauccugguacacaccugagcccacccccacacaaacuagcacacaguauggaacuuuuauucaugugauuucuguacaucaggaauacaagaguaacccuuuacaaauggugcugauuuuaccagaauaaaugacaaaaccaaagcaguaucuggugacagugacagggcuuuaugguucaaacccagccaagaaguuuguuacaaucucuuugagcuuugcgucugacuguucugagauuuucccaucagaccuguuuggaaauagaaacaaaagaguaaaugacucguuuggaaauagaaacaaaagaguaaaugacucgugcaaaugacccgaguaaagauucaaugacaaggcuaaccuacagggaacuguuaaacuuuccuaaacaugguagguaguuuacaccugugauccuagcacuugggaggcugagacaggacugccaaauacugagaacacucaggcuacauagugaaugccaagaccaggcagggcuaguaugcagcaagaccagauuccaacccaacccccaccuccagggaaagcaagacuacgauaaaaaugcacuagucacaauaaaggccaccaacuccauuuauaccugauauugcccaagagggacuggugcuggcugauaacgugagacaagaaagcauucucaaacuuugugaucuugcugggcuccaguuugucaagauaaccccguacacccgcauagauaacagccaccuguucuucaauagccaugggagcugcaaacaaacaaaucaucaaauaaaugauuuaaaugccauuuuaccauagucacagauuuucccuccuaauacuaaacacuguccuaugagccaccccuucugacauucugaaccuacaauuccacuaccacucuuucccauccucccgaaaaaacggaaucgugaccuuuggguacagccuauaagcacugcuuaugcccuggcaguguuacacagcauuugugguguaauuugucacaaaauaaaaauaucauuuuuuuagcuaagauaaaaagcaugccaauauucuuuuaaauuccacauuuauacauaaagaggcauuaaauauauuucuggucacuaauuucaacacuucauucaaauggugguacaggcuacauuaaugguacagcacagacccuaauuacagcaggaaccugaccaaaugaaaacaacucacaguacuguccuugcuuuagcaacucggucagacgcacaccacgacucaagagcuguugaguggcagcguccaaaucagaaccaaacugggcaaacgcagccaccucccgguacugagccaacuccagcuucaugguaccugccaccugagcacacaaguuagugucaccaugacuuaaugccacacaacaguauaagacaaagguccuacauuuaagauuuuaagcuaguaacaaacuccugugucaaagagaggaaaacuuaccugcuucauggcucugguuugggcagcagauccgacacgggacacagacaaacccacauuaauggcagggcggaugccuuuauagaacaauucuguuuccaagaagaucuacaauccaagcauacggacauuaguaagcuuaaucuuuucccccaaauuuaagucacugugccaaaaacugaaaccaguaacuugaguaagauugcuaagugacuuuucagaaauacgugaaucucagcacucagaggcaggaggaccacugcaaauucaaagcuagucucagcuacaugcaaucccuggccagucuagacuacaccaagucccaaucucaacaaacuacaacaagguaguaauauaacuucucaaauaugcuuuaaaguuaccuagggcuagaaaauaaugaguguauauaaaccaaaagaugccccggcgggugcagaggacacaugcuuuaaucuuaacccuuaggaggcggacacaacaaagcuggacggucuaagccaugcucagcuacauggauaguaagacuagcccaucaccccagaccuggaguuacagaugguuaugagcagucaaaugggugcugggauccaaacccugguccuccacagagcagcaagugcucucagccaccgaggcgucucuauagacccuauucucuucaguucuagguuuaucguguuccauaagaacguaaaggcaauuuacaaauaaguucaugcuuguuagucucaacuagugccuuagaauaaucaaucauuuuuacacuaauuuuagucaaucuaauaccuguccgucagugauggaaauaacauuuguuggaauguaagcggacacaucaccagccuguguuucaaugacugguaaggcagucaaagagccaccaccaaaggaaucguucaucuuggcugcucucuccagcaggcgggaguguagguagaacacaucaccaggauaggccucacgaccagggggucggcggagcaacagagacaucuggcgguaagcgacagccugugguacagaaugugauaaaauccaccuguuaaacaaggugcgucuguuaauuuccacuaagaugcaaguacacagguuauaaaagacauccuuugaccugcuuggauagaucgucauagaugaucaaagcgugcuugccguugucucuaaaguacucucccauggagcagccggaguagggagccaaguacugaagcggggcagcgucagaggcaguggcugacaccacgaugguguacuucauggcaucugaggagaaaaaguuacagucacaaagguaccuagacagauuuuaaacuaaagguuacgacacaaaauuguccaccacccucauucuauucaugaauugagagagggggcuucgggguacuggagcuugcuauguaagccugccucaaucccuggaacccacagagaagugaaaggagagaaugcaguugguagacacagccuaacaaggucaaggucccagguuugauccuagcaccaaauaaacuaagaauggaguuaucuuucugauucuaggagguggagacagaggagccaaaguuccagguuauccuuagcuauauaacaaauccaaugccaaccagggacagacagacagacacacuacacuccuccucacacccugugaaauauucaagccaggcauggucgcacacacuucuaguuccccaaccaggaaguagaagcaagagauuguuuaaggucagccagagcugcuugagaccucaucuuaaaaaaacaaauccaggggccagcugauugaagagcaucggccuugguuaggcagaggcuguuccaagauuaucuauagaggccaggggaccagagcucucuaguacccgcauccgucagucucuucaccagcugagccacaguggaccgcuucugaccaaucgcgacguagaugcaguacagcuucuucuucucgucggucccaucguugaaacguuucugguugaugauugugucaauggcaaucgauguuuuccuuuaagagaggcaaaaaugucacuaaaugcaggauccccaagcacaguugugcuauaccacuguuaauuuucaccugcuucugccucauuacaaccacagcauucaccaucccaagaugcauaauuauuuacuagcaauccauguuaguuagaacuuuuaacagauuuugagucauuacccagucugucugucaccaauaaucagcucacgcugaccccggccaaugggcaccaggcuauccacagccuugaugccggucugcaucggcucccgcacagagauucgggggauaauuccaggggcuuucaggcccacucgucugcgggucuuggaaccaauuggacccuauaaaaauaucaagaauuaaaaaugaaucaaaggaacccucagagcgauuagcugugaugucggccacgagagcacccauaagcaguaacccaccuuuccaucaauagcauuaccgagggcgucaaccacacggcccaacagcuccucgccaacggggacauccacgauggcgccuguccucuucacaacgucuccuucuuuaauuagcuugucauucccaaacacgacaacuccaacauugucggguuccaaguucagggacauacccugcacaaaggauaaaggacaaugagaccggugggacaauaucacacggcagcacaccacacuguugccuucucccugcucugcuccucugguuaagacuucauggacuagcuaagagugggugccugacccgagaugaccagaggcaggagacccuccaggcuguccugaccgccacacugcacacuggagcgcagcccccaaccuccccaagcaucugcggaacucacagcuacacacugccucccugucagugauggaucuguucuuucuucagguuguuuuauuuauuuacauuccaaaugcugcuccccuccccagcccccccuccagaagcucuucgccccauucccccauuugccugagaggaugcucccaccucccccuucucuagagcaucaagucucaacaggaugaggcagguuauuuguacugggaaaagaacuuaguucauguacacaaacacuuuugccaagucuccacagcuacaaaggaacugauagggacucgcugaaauuuaugcaaauguuugcuaaacuuucaauuuuggugccucgggcuacaacuuauuuaucagcacaugaggggaagagagacaauggaacuuggcuuagucaaacucuuucuagcuuacucucuuuacaaccuauaauagagaagaaaugaggcaaaaugagacuuaaaugcuuuaacucuugacaagcucugaauuacuaaaugagagagcaaagcuacagauccugaaauagcaaaccucccacuuuauaauuuaccuuuaagccugaagagaauuccaccaucuccucugcuugaacauuccucagcccgugcacucgcgcaauaccaucaccaaugcuuaacacacgcccagucuccuccaggucaacagacgugucagcucccagaauccucuccucgagaauggaggacaucucagcugugccugagaggacaacgcaauuuaaacaaucagguccccaacaagcaguuucaugaaaauaaucaaaaucauccuaaaacauaaaaugaguuguuuugguagauaucuuggugcuggagagaugguucacugguuaaaagugugagugugagugugcgccaccgcagccacugccccugcggagggucuggauccgguucccaucacgcacaugacagcucacaacugaugaacuucaguuccagggaucugagacccaccauggguaccagacaagcaggcagaacauucacucauaugcauaaguaaaaacaaauauauauauuuuuuugguuuuucgaaacagggucucucuguauagcccuggcuguccuggaacucacuuuguagaccaggcuggccuaaaacucagaaacccgccugccucugccuccugagugcugggauuaaaggcaagugccaccacacccggcuacaaauacauuuuuauagcuguuugcugaucacugucaaaauuauugaaaacucaaagugauuaaagggaaaaacuucacuggguagacaauaauguuaacugauaaaaggaaauauuacugugcccuaacguuuuaucuucuuuucucacuuaauuucuaaagaaucucugcacauauguuagaaucugauuuccuggcuaaacuuuagaaacauuuuaaaauaaagcguguauuuaaaaagcaaugggagcagcagaauugcaagcucaucuggaaaauguucaccccuaacagcccaaccuucauccccaaaauccaccagguggaagagcagccccuccaacgcucucugagcucaaccaaugccuugaggcaugcaccggcacacacacccagcaugcacccgcuccgccccuccccuccccuccccuuaauaaaaugcaacagaaccaacagcuacugagauguucucagccaucugcaagccugcaagccugguaaacagaguuccagccccaagacccacaagguaggagagaacuggcuccugaaggcuguccuccgaccuccacggccgcggcucggacacacaaaguuauaaaauguccccuuuaaagaaccuaaguaccagugcuaauauuacuauguaaauacacuauguauacauuuaaccguuacuuuaaaauuccuagcgcauagccgggcacacugcucaguaguauuugccuauaaagccccggguuccauccccagcaccucuaaaagaaaaggaggaaaagcccuccagcacaucuccaaagaaacuccccaccaccgugaccuuucaacaguguccuuuaugucugucuggcuccucacuaaccuacugcaccucgaggucuaacaggcgcuacugucuuugaaaaagccuaucaguaaaaacuaguucauuuucuuauaauuuuacauaaggcuuauaaggagagagggugccuaguguauuguuuucauucaaaagaaaucauuagaaaccauacuacauaacagagaaauacaaacaacaguuucauuagacaaaaggaucuaucaagacgaagcauuuuaaaugauaugcuguggcuaaaaacaaaaaacaaguuucuguagcaacauuuuaaaaagagaaacauuuaaggcggggcaggaaucuccccucuuaaaaacugacuuaccagucuucugaagucgaguguuagaggcauggagauuucuugcaccaacaaaggaugaccccaaagcauuuuuggagaccuaguacaaaaacauucuuucaccaaucugauuguuuagaaagcacuccucacacauaagcuaugcucgugagugcacacuuaaguaaaugcaugugugugugugugcgcacgugcagggcacacucacacacacacagucuucauaaccugggugugguggugguggugguggugcgugccugccuguaauccuagcauucaggaggcaaaggcaggagauccccuggaauuucaaggcacgcugguuaacacagcaaguuccaggccagccagaacugcacagaaggacccugucucaaaaucaacaacacaagccgcaaaaccuccauaaacggagaagcuuaacuuuggacuuaugcugaucagacuaaauuuugcuaaaaaguuggugacuuaauuacacaggaaagaaugauacaugcaucuauuauugcaacuacuaagauacagcuguuaaaaucauucccuuaaagacaucucgguaauacuauguugauguuauuucucaccugaguuguagaaaaucucagaaagauaacuaccuaacgggggugagucucaguguagcuccaauuuuucuuucuuaaaggggcagauaaguauugggugagcauauuaaugccgugguuagguuagaaaaugacaucgauuugucauugccuugaacaaaucuagcagcaaaguggaaccagagccccuggaauuuuucuuucuacuuccaaugcugugauuggccacucugaacucugaaucagcuaauuuuuaauaggaaccgauacaaaucuuuucuuaaaauaccuuuuucuuucuuuuuuuuuuucccuaacagaaaaccaagauguuaccaaccaguauuuuguuagggaagcaggguagcaguagauuucgccuuuuaaauucgauugucuuuauaaugaaaagguauuuauaaaggauucaaaggccaucuuuuuuuuuuuuuuuuuuuuuuuuuuaagaauuagucucaacguccugggagaucaugagguggacaacucaagggcaaaaaucuuuuaaagugucaaacaccagguuuugugccuaaugcaggccauuuacaaauacgccaucgucguccacaguuuaagccacagacacugcuucugcgccucacgauguugucacgaccuuucccggggucagcuccaaauggguaaaccaucccacaaugcaagagucacuuucauuuauuccuuucccuuggauugaccucggagcagaggugaacugcuccggccuguugaccuucacacaaugucaggcucgccuccuccuccuccuccggcacaagacggcugacagcuccucugaccuucagcagagccggaccccaggacaagcuuccgggcaggccagacgagcagggcacacacccugaccuucaccuccaggcccgcucucaccccaagcccagaucccuccuagagcccccuugcucagccacgccgaggucccagacccccgccccgccgcgcgcgccccgaaggcccgcagcaaagccccucggccguccgcgcugcuccgcagccacggugcaagauggcgccguccgccccugccccgcgcugcaccgcuccggcuccgcuccgcagagaccugagaucuccgcucccgcgccagccugccuaggccccggugcucaccagucccgcccgucgagggagggcacgggccacggccgcggcgacgcgcacagacagcauccuugcagcuucucggagagaccgucugcagccgcagccuccggacgacuggcacaaaauggccgagcgcaaaggaaggucaaggcagccagcccgccugacccggaaguaccgccccucuccugcuccuccggacgcaaaucuuuuuuuuuuuuuucuauaacuuuuucuuuuucuuuuuuaaguuuagaacuaaaaaugaacgaauacauuguuuccagccuccucccugguacucaacauuuuaauuuuuggucuuuuugaaucgaccuugugguugcccgggagaccacgugaguagcagaaccagaggagacgcgucc

SEQ ID NO: 8997 - RNA, 1870 nt, Mus musculus
gccacaagugaaaaugacauaccccaccucgaugacccuucagccaaaggcaugacagcucaggaacacacacggacuuguugcacacagaaaugugugcacaggaaaggagaucucgaguucuuuagaagaaagaagucauucuucaccacgaugggcuuauucugcucaggaaucaaguuugaaaaucuucaagacuuaaggagacugugucacuggggucccaucauaucccuggguguuauagcaauauguuccacaauggccaugaucgacucugucuugugguauuggcccuuacauacaacuggaggaaaugugaacuucaucauguugauaaauuggaccgucaugauucuuuauaauuacuucaaugccauguuugcugguccuggcuucgucccucggggauggaaaccggaaaagucucaggauagcauguaucucuaguauuguaaagucugccaagcacacaaggcgccacguucacaucauugcagaaaguguaacagauguguaaugaagauggaccaccgcugccucuggaucaacaacugcuguggucaccagaaccacgccucguucacacucucccuucuguuggccccucugggcugcacccaugcugcuuucaucuucgugaugacaauguacacacagcuuuauaaucggcucuccuuuggguggaacacagucaagauugacaugagugcagccaggggagauccaccuccaauuguucccuucagauuggcugcauuugccaccaucuuguuugcccugggauuagcuuugggaacaaccauagcuguugggauguuguuuuucauacagauaaaaauuauucucagaaacaaaacuucuauugaaucauggauugaagaaaaggcuaacgaucgcauucaguauuaccaacugagugaagucuucauuuuuccuuaugauaugggaaguaaguggaagaacuuuaaacagguguuuacauggucuggagucccugaaggagauggacuugaguggccaauaugagagggcugugaccaguacagccucacaauagaaccguugaagcaaaaagcagacaagagagucagaaguguucgcuauaaagucauagaagacuacaauggugccugcugcccuuugaauagaggagugagaaccuucuuuacaagccccugcacugaggauccucagauacggcugcagaaaggagaguucaucuuagcaacaagaggguuaugauacugguuguauggagacaaaauucuugaugauuccuucauagaagguacuucaagaguaagagggugguuuccuagaaacuguguggaaaagugucccugugauagugacucagauccagccccagagggggagaagaacagauagccacuguuaaagugagaucauuaagucuucauuacuugaaaauccacauguaguaccugagaauuaugcaacgagccuacucugcuuaagauauucuuuuccucaaacaugcccuagugccaugacuucaaaauuuuuauuaccauuuugaaacagaagccauucugcagaugccuuugaauuccugccgucuuuccacuucuuccuacugaaggaaggccauuccagccaagugagcaacuugccuuucugugugcugcacaucugacuuccccugcaggucuaauuccccacuggauaggagcaucuugcaugugguuacucuguuucuuccucaguugacauuuccuucauaaucuucuagagacuguaaaacuugucagauucaauauaaacucaaauuugguuacuuuuaauaauacagauuuugucaaauccaauaaaggucaauggauguucuggaaaaaaaaaaaaaaac

SEQ ID NO: 8998 - RNA, 1685 nt, Mus musculus
cuuuauucuuuuuuuuuuuuuuuugauuacuaauuguguauugaaagcgguaagagguuccaugacaccaaauaaaccaguucugagauuuccccaagauaaauuuaacagcuccagcuauuucaguguuuaucaaaauacaaaagaaaaaaguagaggucaucuuucgauggcaaaucggacccuugcaggcugagggaggaagcuacuucacacacagagauggggaugcuccaggaugugggucuguaauggaccgacccucccaccuugcacucacuccugcuggugagacccaggccuccugccagcgcauccaagugggcccaagaguaggcuggguaugcaggcugccauugggccuuacacacaccaaguacaagccagauccugcaccccacacuggcucccugccuacccuagguaaccaugugagcacagguacaggcacaaugcuauggaaugcaggugacccaaagacaggcgagucacgggggcucuacugugaccaugcagcggauggugguuuguucgucaccuucucuccuguucccacagcgagacaggugaucugauaacuagcauucaggccauuaacuacaaaaccuacacuaggcauagucuccguucuguguguucaaguguucuuguccugaauuuucaacuauuuuuaaaaaaugcaccgaguuuggcuuaaaaaccaaccaccaaauggauaccgacaccaguccacagcccaauggcucccggaggccaggugccccuacacccaaaucccuucucaguacugacaguugaguugauucucuuuuuacaauaaaaaagcuaaguaauauugcauaggaguaccagaaacugccucaguggaaacagaaacuauuuacauuaaauaaaaacuggcuggcugcaggcuacaucugcacauguacagcacggugcgaugcacacugugaccaacccauggagacagcuucuggcacucaggaccacagagucgcacguaugccacaugagaggaaagcagaggguggagaagaggaagugaggggcagggaggggucugguucacuucugguucuggagcugauuagacagccaaucuaguccuucauagagcccguccccgcugguggcacagguggccugaauguaccaguuucuguggcguagagagugcagccccacccagcuugucugugauuucggccgcauucauggcauuggggagguccugcuuguuggcaaacaccaagagaacagcaucucggagcucaucuucagcuagcauccucaugagcucuucacgcucucugucauugcuguccacuaagaagaucaagccuuggguguucuggaaguaguggcgccacagcggccggaucuuguccuggccgcccacgucccacacggugaagcugauauucuuguauucaacagucuccacauugaaagcaauggugggaaugguggucacaauuucgcccagcuucaguuuguauagaauuguugucuucccugcagcauccaggcccaccaugagaaugcgcauuucuuuuuuuugucaaaaaggcccuugaagagguuugcaaagauauuccccauguuugugggcacguggaaucgauacuggccaaagaucucugcggcggcugcucccagccagacguugguuucgcucccggagc

SEQ ID NO: 8999 - RNA, 878 nt, Mus musculus
ccaagcagacaucuggucuaggccagcgugaccagauaaaaagaguuccggcucuucuuugccugcuugcaagcacaucuguuggaaccuacuucuacugcagaguagcggaaccaaccagccucgugggaccgagcaacuaccgacuagauucuuggacuuucccuucacagcugaccuuucuugcagcaguuggacuacagacuguuuuauccccacucccacccccacccccugccugcaguaaugggacgaaggaaguccaagcgaaagccgccccccaagaagaugacaggcacccuggagaccgaguucaccugcccuuucugcaaccaugacaagucuugugaagugaaaauggaccguggucgaaagacuggaaucaucuccuguauggugugccuagaggaauuccagacccucaucacacaccugucagaaccaguggauguguacagcgaauggauagaugccugugaggcagccaauuaguagcgaugucaaggacgggcuccuccccagccgccaucuggcuaccaauccggaagguuccaggacuccaagguacagguccaggacugggacagcccuccucaguguggauggaguggaugugaauguggaggugugcacaacugcagaugugauuguagcgauggaggcgagugauugcaccaagccgcccaugguggccucacagaacccaacaccucaagugccucugaaagcuuugaguugcucuggucuucagccacgaccuugcauacaagcuugagguuccugucuucuccagugacgguuccuggcaucccaggcaaggaacagcuaugggacuacaagucuccucagacaccacaccagcaccuuccccagaaaaa

SEQ ID NO: 9000 - RNA, 25750 nt, Mus musculus
ucacucauggaagcuuuacugugaaagagcaaaguucagcugggacugccugagugaagggccuuuuguguccugcuaugcuaacuuaacuaggccuuucuuucauuccucauuaagguacccagauuuagaggggugccuagcacacaguaaauacucuagaacuaucuccggauuaguuuguauacccgggaagaugucucacaucagaguguuuuauauaucuuggcacuuacaagagcuacauagaagacuaaagacacauggcuucaagccacaccuugagcaaggagauccagguuuaagagaaugacaaacuuguccaugaugcucucgucucagcacaaauccagggaaguaccucgaauccugagcagacuggaccacggguugguugccuacaugaaccuuagcuucugccucugcaaaacacaaguugcagaguaacaucggcaugaaaggauauggggaaacuuaaagggugacauguaacacaccuguuaggcucucaaagccucccugauucuggagaagcucacacagcaaguauacaccacccugcuugacuuaagaguaaugucuuagcguuacaagaauugaacaguuuuauuuucagugguuuaacaaauuuuaauucaaaaauagacacucugaaaauuaaaaaaaaaaaaaauaaaguccaacaagcucugaauuuacaacagaguauaccaagucacaaauaauugccucaaaauccauuuuaguaaucacaugcaaguauuauauuuaaaaaugcuauauagcaacacugcagugcuucucagaggccaucaagcccucauauucugaaggugggccaaacccccugcuugcugcgcaucaccgagggaugguuuggaccagagcuggcugguccucauuaucaauucuggugcuguacauuaguucuuaucacagaaggaaaaacaaacaaacaagauuuggcauccacaggacugugaaaauucacugacucaccauccccuucaccugaacaccuaacucuaacacaucuaccccgagcuacucuaaccacaggaagagcuucuggucugcuugacaccuuaugccugaaacccgaauuccaucucaaguugugucucagucaagagcaggacccacaugucugucccggguuccuccuuccugcuaggcuacaagcgacccugaggaaggaagcaccugcgugguuuccguuuacucuaaaggcacuaaaagucugucuuaccucugaauagagaaaugacuugucaucacagcaaaagacaguuugcaccauaaagcauuucuguuccuacagagacuuuauuugcaaagcaacacuugauuauuacuacacaccagaucucagauucaggauaguuuaauaaauggaaaacauuugagguuuguuuuuuuuuaaugaauuaugauauuaaaaauauagcugucagggaacacuugaaaagguguaaaucaaaucugugucuuaaacaaacagcacucagagaaugaaaagcuaaugcuuucaaguguguccuuaggggccacacacauccagagcacuggcuucucuagacacguacugucacuagccgaugucuguaaacuaggagggagcgaugcuuuaauuuucuauuaaucaaguauucucaaacaagcagaaauccccuaaaaugaaaaaccaaguauuuguagauugcaggcuguugcuacugacacugacacucguggggaaacaaggcgugcauggaauaccaaagauuuaauuuacaugacagaaggaaaaacugaaacagccgcaaagcgaacugcagagaacagcucaucuguggaagugugugcuuccuuuucaggcuuucugagcaccuggaacgccuugaagggccucagacacuuagaacaagagugagaggugggaaugggauguccaaagucagccggacuucagacuuucucuucuacagcuuuugugauucacacucaccaaaguucagucuguguuugacauuuuuaaguucagacauaucaaaaccuagaaguacagaaggcuugugaguuuuuauugcuuucaugcaaauauaccuucucuucccaaagaaugaagccacgucaauuuuccacacccacaagagugaagacagcagcuccacuucuuuucuacuaggauauggucuccugugaaaauaaucucuaaggaacuguuucuuuuccucguaggaacgcccuucguacuugcugggguccaaggcuagcgccugcagugagucuucacugggccccgaccccuccguccugauuucacucuucugucucuucaaaggcacagcgcccagaccuuucucugaacccgaacuugcaucagcaucuagggugagcuggggcuccuccccaucccucuggucuuccggcccuaaauggccuucaggcagcuuucucuuuacaggaaagguggacucagggaucacguccccauugaccaucagcaguucacugcucucaauaaauccgggcuggacuugcaggucugagcugcuguccuugggagcacuucuacaacggagcaaauggacagcgauggcgccuaaggucauguuuccaguguagaccccgcaacaguggaugcacuuaaaggccggagaccugagcauuguauggacugugggcaugacauggugccucuccuucaaguguagcucauaggcauccgcggucauaaaugugcucaaacaaaaugggcaggucagcuucuguuuguuagguaucuuuggugcaaccucaggcugaggccucaccuuaacauacacagguaccagcgacuuggaguguauuccagcaaggauagccagguacacuucucgcucuccaaguuucucucguggcaguauggugaugaaaucgagaugagggaagagcagguucccauuagcauccagguccaguuggaagccucuguuacuguaauccauagacagucucuucuugcccaggugcuuaguccugcugugcuccacaaggccccggacaucaugaaaagugcacggacaaaacaggcagcccaggccaugcaugagcaaauggugcaucagcuccuccugcgagaccaggcacuuacaagacaggcagcgcacugucuucucucgcauccacuucagaaauggggcacaugcagcaagcuuuucaggcucaaguuucucacuagacuuggacucgcucugcuugugagccacuuccaugugaaccugguagacauuggcaggaaagaguucauugcaaaccuggcagagcugagccucacucugcuugugagccacuuccaugugaaccugauagacauuggaagggaagagcucguugcaaaccgggcauguuuuccacugcuucgccuguuugagugccugauuugcaucugccagcggcgggguagccugcacaaacacacuaggggcagggcucaccaacaccuguggagagggcaggcugggcaaggagcugcccaucugugugcccgagccugagggcaagaacugcacuggcaccugggguggcgguccaacagcugcaaggccuccaccagagggcaccggcagagugacagacacgggggccaguguauacguggggauuccauucaccuguuucccaguaggaaugagcugucugagaauagagccugaaguaaagaaaguaguguuuugugacguuccagcucucaccggcuggcucauaggcaggaugcuggugcugacagacgggcugagcugcaguaccccaggccucacuggggggcccacaggaagcacuccugguguuacuggcuggccgagcugaagaacgccagaguuuacacccugauucacagggacaacucccgaggggacagucugguuugaggaaagcagcccagauggcaccaccuggccugcagggagaacccucaagggcacugucuggccaggaggaagaccucgagaaggagcugucuggccaacaggaagaguugaugacugaaccaccuggccaguggguaagaccccagaaguggcugucugaccagggaucacuccagcaggggucaccugaccugcaggaaggacuccugauggaacugcucgaccuacagaaaucacuccaggagauguagccuggagaacccccgaguuaacagagggacccauaggcaagacagcaggccccacaggucuguucaugggccccaugggcuuagugagggguaaaaguccagggcggacagcuugguucacggagcacauggcuugguucacaggaaggaugcuuguuccaacagacuuauucacaggcccaacuggcugagucaggggcagcacagcaguauucacaggcugauuaagugcaacacugugagagagaaagacaggcgggggagcugacugcugcaggcugaggcuacucuggcacacaggcaaagagcuggagaccaaagcuacgugagacugggcagugguagguggggaguguguaaggcucccagaagugccuggggucacagucacugacugcacagugccagagcuuugacuguucuguggcaaagcaagcuggaagcaggguggaggggccgcaaugcucggagcacugcuguugggcgguaaagccaagugggucacugguuuuggagcaauaugcaucugcuucagaaacccaguccucuugauguguucugagaucacagaccucagcuuauucuccaagucccuaugugcaucugaugucaaaaugugauacaucagggcguccugacuacuggcgauggcacugcauuuuuuacaguaguacuugucaaauggcaggauuuuauccacagaaacaggaucgcuugcuuuugguugcucuccuguuuccucaguucgcaaaccaaaguaggaguuaauuaaguaauugaaaugggccaccagcacgugcuucuucaugcuguaguacagaguguuggaaaaguuacacuuuagacacgugaagcuuaucacgucacuccuggaugucuucgucucacccagaauguucacuguguagcucuggacuuugcgugcaggcgcguggaacauucugaagugcuugcccaccacccugggcugggaggagaacgggcaguuggggcaggggaucaucagcuccuggucagccucaucuucaugauaucgaugcaggugauuuuugagggaagugagcaccuuuguugaguaccuacagagacuacagcaguaugguuuuguccgguaucucugccaaaagagaagagagucuuagacagaggaacaagucaccaggccucccuuaaacucuccaucugugugcuucacugccaagaucccagcucggaggacagugcgcucucccagcugacgcuuccgacuggaaggccauguugcagugcccugcuaacucaucaacuccuauuaacuuaagggcuauagaaacaauggauuuaguccaaacuccucacuugcugacucuaagcaaucaccuaaacccacuucucucagaaguucaaucuguacuccauccuguccuuuaaauaaaacacaucaacagaaauaaacuuagugaauuuucugccauuaaguucuuucccuccgccuucccaucacuuuccccuuugcuccaaauugucaaacuuggaauucagcuacaauuggccuggcuuccaacuuguaagaccgucuuaauuguauuuuccccauuccgugagacaaguaagaucuaggguacauggaugcacuaagaagacaggcuuguuaucccaacuacucaagaagaaaucagagggcagaaugcauaaggccaaccugggcaacaugguaaaacccugucugugauggacaaauaaauaaaugaaugaauaaaaacacagauuagagacacagaucaauaguggagagcuuccuaaacacguaaaacagaugacacccacacaccacuaaagggggggggggguuacauauaguuagaaggguguccuagucaggguuauugcugugaugaaaacaccaugaccaaaaagcaaacuggagagggagagguuuauuucagcuuaaacuucaagguaacauuccaucacugagagaagucagggcaggaacuguugcagaggccauggggccguacuagguucaucacaaauugcucagccugcuuucuuacagaacccauaaugggcugggcccucccccaucaaucacuaauuaacaagaugccucacagccagaacuuguggaaggaagcauuuucuccauugaaguucuuuccuuguagaggaaagcugacaaaaaaaacuagccagcacagaggcagucaugguagaaaggucugggggaguaggaauaggaagcagaguguaugguaucaaaauauguugauauugauguguguguguguguguguguguguguguguguauucaggacccaagaaucacuugcauuaaggaaagcugucacuuuuacaacagugacucauguucucuaaaauagcuaggagaguauauggaagccuccagucucacucaaguccagagacccagagcauagaaaccacacaacuccuuccccggugucaagaugaaagcagacuauaucuacuuuggaggcccacaguagacuguggcaccagcaacccagaggggcccauccuugcugaaacuguggucucauaaucucucuaguaaagauauacuucuuccacucucuucuaauaucaucccucuccucaggccucguaagguauaugauaugauacacaauuuaacaucauauuaaugacuuucaguagacaguagaacuguguucuaggauuuuugaggaccuacaauaaccucaggcaguagucacaaacugaagagaaagcagaaagaaaacuuacuuccaauguuucuaagagacacacuuuuccauaguuaacacagcugaaacccagacuuacuuuagaacuaaaggcaacaguaauuaaggucacaguuucaauagaagggcagaccuucugauggucaagcaaagagugaagggaacugguacugagugccuacuacauuaccaauguugaauaaaucuucaaggguggccaagguucugaaaggcccauuagcagggucaccaaaaggaaaagaugacaacauuuacuucauaggagcaagaagcugcaacuccuagaagacucugcuaaagguuucaguucuaaaguagccaugugaagagcugagcaggcucuguaaacaucugauaaagaucacacgccaggacauaaggaacagguucaaaucucauacaauacaauacaacacaauacaacucaauacaauacaauacacaacagacuuucacaagcucaucagagagcaucucugaacgccaaggcagcaguggacagcagcucacaccgcccagcagcagcaagauggacacggacccgaaggcagugcucccucacacgcaugcuccuaacggaggagccaaacagccuggccaugccagcuggagacagcuacccagggaucagaaaggcauauauccuuaaguccuacacgagcaggccaaaaagaacacaaagcauacaagccaucagaaagcugaaagcaucauccaccugacaguacucucggaacucagggcugccaaaguguccgagcauggugucaucuccaaucaagugcacacuccacgucuccacagccuaaggucuguccucugaaaccaaucagcugcgacuguucucuuccccaaagagccucaugugacuggauuccccaaccugguuuaguauaagccacaucggccggccgaccggccagcauguuggcgauauuccuguggccaugccaacccucuuccuaaauccuauuuccccaaaggaggaaacaacauggggauaucagaucaguauuacacuuggugcacacucuguuuucccagagcacagaagcugucuaauacauaaaucucuauuaucucaagcuauuauuauaacuuauuuaaaaauuguuuuaauuuguuuaauguguauguauauacgugauuacagaggucaaaaggggguauuagauuccuuggagcuggauuuaaagacaguugugagccaccaugaagguccgaggauucaaaccuggguccuuuguaagagcaacaagugcuuuuaaccacuaaggcaucucucuggcucccuguuauuaauauuuauaucaaggccuuaaacacuccaacaaagacaaacucccugacuaaagaaacuugaacuuuuauaguucccuucagucuguaauccaguguuaucuuucuauagcaggcuuucaacugaccacgcagcagcagaaaucaacacaguauuucccaauucaaaaccucuacucagauacaaaggugcaguuaauagagguuugcaaacaauauuugauauguuuugcaagcuaauuguuugaggacuaaauguauaaaauucagguuagcaagauagcucaguggguagguacuucuugccaagcuugaccaccuguauccccaggacccauaugguagggagaccugccagaguaucaugcaugugcguacacaaauauaaccaaaaauacaauguaugcuauuguguauaaguggauauucaaaacuuuuaagugagaaaauucaguggggccugagauccaaaacuucaagacaccgccacacacacauacacacacacacacacacacacacacacacacacugacucccaaaaagacguacuggaagccacaagcuagauuaagcacaauugucucaagggaucuuucuauauaacuaaugagcaaaauuuugaaguauuagaaauguuccuuuuuuuaaaaaaaggaaauguuucuuuuuuaaaaaucuauuuucauuauuuguguguguccauauguacaugagagaggcagagagacuggauuauuaaaauaaacaugucagcaaacauugucaauaagcuaaauuagagauaguuuauucauucuccagacaacacaucuccauuugcuggcccaacaauuuaggaggcaucucagaaaaagagcagggucaggccuuccuucuuaccucccugcucugacacaccagaaagcccuguguuuccagugucagaucaaguaugguuaaguucuacucaguacuguugcuuccaagacagcuuugaccccacacuguauauauguauguauguguucugugugcaugcauguguauggugcauacaccagugugaguguguguguguguguguguguguguguguguguguguguguguguguguagggauggccuugaagccacacugguagucagcaaagcccuuuuguuuucucuuuguuccuccacagcaccgagguuacaaaccacagccacacuaggacaaggaucccaacuugggucuugcuuucauagcaaacacuuucccacuaagccaccucccaagccuuguccuccaacacuuugaacccgacacuaacuugaccagaaaguccguauagaccucugucucacuagaagaagucucuuuuuauuuuacuuuauuugguuuaguuuucaggauagggcuucacugugagaagucuuucuuaaaggcaaugggaccacacaguauuuauagaucucaaacaauucacaggacuaccaucuaaaugaaacacuauuuauaaguuacuuuaaaauacucaauggaaaucaaucauucuauuacuauacuaacuugcagcucuuuacccaggaucagugagaggucauuucauggagacuauucucggccugcaaggugucuccguggauagacaaccccgaguucauuccuugggacacauggucaaaggaaagagcucauccccacaaguuguccccuggccuccauaucacaugcgugccccccccacacacacauaaacaaauaaauguuaaaaacaagaagacaacccucacucgugaagagauaagucugugguuuucuggagggcaagacaaaacgucuaccugucuaggaugcauggagauagugcaggauauccauacucccgaauauucaaaucucugcuuucaaccaacacuggucccaagcuguggauucccaugcaaaaggagccuuguacucuuaucagcggaagcccaguuuggaucagaucuguaaacugaauccacaccccaaggaacuacagcccucagauaaaugauuuuacacaacacuccaaacguuuauucuccauggaagucaccccagaucaugauaaccugugugccccucaggcaaccagaggaagccugcucccuuucuggguggcuucagucuguaacagugagacagaucuucuacauucuaugagaaccugguucuauguucuguguguaagagaagaaacugguaaacuagauggucauuccgcggugacccagaggaagguguuccuguaucagaagagacggcuccucacacugcugccccaaagacccuucaaagggauacugggaugaaguacgagaugucacuccugaccacaagcucaacaggccaggguggaagaaugugugugugugugugugugugugugugcgugcgcgcgcacaauauuacaaaaaauuaaaaguagguaaagcauaugaaauaaagguauaaagagagaauauuuucaugcagauguacaauacuuguauuuuaagcuaauuguauuuucuuacaaaagucaaacggauaaaaggucaaaauuauaaaguaaaaauaugaaaaguuagcuauuaagaauguauaaaauuauaaacauaguguagucuaaauguccaacauucagaaagcuggcaauagucauuaccccugccuuacccacaaaacuuccaggaggaccugcaagcucaggcccuacacagauaggcacuuuuaagaaaucguuuauacacaguacuuucucaguacaucuucucuaaagagauguguuaauuaccacuguguuacuagcuguucccaauguucaguacagcaacgugccauacauguccaccgcugggaucucugugugcuauccuguacaucuaauguggcuuauugcacaacaaugaaaucacuugaugacacauuucuaagaacaauccccaccccguagcagucaccauuaccaagugcuauuuacuauacuuaacugcaugcauucuacuuuuauauggccagccacauagacuuguuaaguuagcaucagucagcagugguggugcacaccuuuaaucccaggaggcagaggccaguggaucucugugaguuccagaccagccugguauacagagcuaguuccaggacagccagggcuacacagagaaacccugucuucaaacaccccuccucacccaaaagaucagcauuccuacaaacaaugcaguacaucacacugugacccacaucccuagacaaguauuuuuaguuccacuauaaucaccuuugcaccugcagucccccacugacuggaacgccguuacugauguguaagcuuggcacuuaaagaauuacuaacaaagguucuuccuacagucaguucucauuacaagccuuggcuguguaccacacugugcauggacagcugucagcagcagcaguccugccacgcacagugacucuagugccacuuccucccaccucagggacacaaccucccaauuaaccagccgcccuaguagccauggugugcccagccgcgguucacuugccccuaaugaaaagaaauuuaaaaauacauaccgcuuucuuuccagaagguucccaaggagaaacaucuccccacgauguauuauaaaaguacuucucuccuggaucaaagcuuuuaagauccuuaaggggagaaaagaaaaaaaaauaagacaggaagaaaaauauuauguaucaauuuaugagaaauauuucaagcuagaaaugaaggugaaggccuuuaauaccagacugaagcaagaggaucccaaaguccaaaggcaaccugggcaacuuagcaccuuguuguuaucaccuuguugcaaaaauaaaaagguggaaacauuagaccaugaggcucagcgguagagcacggaccacaggagccaaggcccugaguacauaauccccuccuacaagcauuaaauccaugaccaagcaaccugccaccucguaauuuauauggcaaagaauggaagcacagucaugaacuaacuuugacauuuaaaguaugcauuucaagaaaaagauuuaaauuauccacauuaaaauuuauaagaaauacaauuuuauaagaaauaaacagagaucucucucccaaaagaaaauguucccuauacuucauacacagaagcagggcuccaguguccauaaacucauguagcacacacacacacacauacacacacacacacacacacacacacacacacacaaacucacugucagucaagagaagaacuggcauagcacucagcaguccauuuccagccgcgucaccaggaugcacucugcuuagccuuccuuugcucacccugcagggcugaccuuccuuccaggcaggcucugaacacagccagugcuuucuuuuucuccuaaaacagaggucacuuuucuuuucuuuuugcucuaguuuuguguacguguugccuacacacaucuguguacaugugugggugccuggcguccucaggagccaggaccagggcaucggauccccugcaaugggggcugcagaagauugagagccacuaucuggaugcugggaaccaaaccugaguccucuagaacggucgguguucucacugcugagucaucucucuaaccccagaaguuacuuuccacaccacacacaaaaaaccaaaaccuugcuucacugagaaggcaggagaaauggcgcaaugaaagugcacugcugcugaccagagccagggagcuaaguggcagcugucugacaagagggacggugaagugaagagccacuugugggcuggacaacagguccagcacaccaaagaaacaacagaaaaagggagugggucccauccauggacaacugacaggauaagaacgggugagaggcagacagaacuuccaucaucaacacuaagucucugacagucacuguuaagacucugaggacccaaucaaugagagcgauuccaagcccgguuucacaguuggcaaagacagguauugggaaagggauaacauuggaaauauaaauaaauaaaguauccaauuuaaaaaaaaaaaagcacaggauuucuuugugccucauuuggcaaaggggaagugauauacauauuuaaugugcuuauuuaccuaguaauugacagagcugggacuacaaugagcugggacucguuuguagagucaaauucuaccagaaugccucacucccucuguuuuguaauaaccucuuuuauuuucucccacgugcuuacccugaauaaaauagaugagagagagagagacagagagagagaaagguauuagaaaacuuuucacaagcaaccacugucuccccuuggagucaaaugcugugaugagcgcuuucaggauguagaggagcagcaaucagggaacccaagucaaguccgccuggccugagcacaggcaggagagacaggcagccaacacugccacugggauaagcaagcaaggcccgagcagagugcaaaacuacaaaaugcuaaaggagaagaggcuuggaauaaaacuguuccacaggcuggaccgcagcugcugagggagaugugccagcguauuccacaucucuaaguccacguggcccaggacacuuuucuaaguggaaaauaaaaagcuauucuugcugucucugugugugugcagcagagcacucaggaaaaauguccaagugugucaagaagcggguacaaccucgaggcaugcagugcccucagagucauggaaugcagaacaagagccaaugaagggcacaaaugagacauguucaaggacaggccauccucacagaacuggaccuagcauaguuccaguagaagcaacagaaccaccugcaugcuguaaccuucuggcaucaaaacagacaacagaaaaauacuacaacucagaaggucaaagaagggcucagaaaagcucgaagaaaagggcugucaagaggcaucacaccuggagaguuuacuacuuugaaaggugacacuucaaaaggaugaagggccugcuucuguggucacuaaggaaugccugcuauuggcuagguaaaugacaggaccagaugagccuguugucaucagcaacacucccaaguccugacugugggccagucaguagacuacauacuuuauaacaagacaaaggugacuaaaaagccagcaaaguuaccacccaguacaaaaauggggaaauaaaccccguaaacaaacaccauaugcaaggaaacuggaggcucaacagcagaguaacagcagaguacuauaggucaaccucucuaaauguggcaauuaaauuucacucucuagcuaacaauuagcuacauuuuauaacauucacaguuuauaguacugucuuuauaaucaaggauuaccuuuaauaaucaagaaggaauuagcugagccaguuaauuccaauuaacaguuaaugaccaaugguaauuaauauacuaccuuuaccuauaccaaugcuaauacucugccuuauggcuugaucugccugcuuucuuauaaaacccaggaccaccagaccagcauuggcaccacccacaaugggcuaggcccuccccuaucaaucacuaauuaagaaaaugcccuacagcuggaucucauggacacauuuucucagucuucuuucagaugacucuagcuugcgucaggcugacauaaaacuacccaccacaguaggagaccacacaaaauccagcaauuauaaaaaaauaauguucaguauccaaucaaaaccuucagcgaucuaaucagaaguaaacuauaaugccaaaccaggagcacaagcaguguuagguaugugucagagagauggcuaagcaggaaagauggaaggagagggguuugagagaguuccagaggaccagguucaguucucagcaaaggcagcuggcaacugccuguaccuccaguaccaaggaauccaacacauccuucuguugguacacagacauacaugcaaaauacacauauacauaaaauaaaaauaaagauuuaaaauaaaaaaaagagggguagaggagaugauucaacagccaagaucaggugcugcucuuauaaaaagccagaguucaauucccagaacucauaugacgccuucaguuccaggggauccaaugcccucuucugaucucugcagggacaaggcacacacaugguauacauacauacacauaaccaaagcauccaaacacauaaagcguaauuuaaaaaaucuaaaaaacaggggcuggugagaugguuagccauuaagagcagacuacucuuccagagguccugaguucaauccacagccaccacaugguggcucacaacaucuguaaugggaucugaugcccuuauauggcaugcaggugcacauaauacacauagagcacccauauacaugaguaaaucuuuucuuaaaauagaaaaggauguuagauuuucauaacaaaaaugccaaucuagccaggcacaguaaugcacgccuuuuauccuggcacuccagacagaaacaggcagauuucugugaguucaaagcaagccugguucucguaauaacacugagaccaucucaaagucuacgaccauagauaaaaccuuacuugagggagaaaggacagacagcuaauggagcggagcugacggacaccaaggcuuaaaggaaguccuucagacagaaggacauuaaccaagagggguuucaaguuccuuggggcaagucugauccucacugacaggguaucuaauuucuucuucuuuauguacaacuacuuaacaaaccauaaccaaaaaaccuaccaaagcccccaacucucagggccauuuauacacccucugagaaguccccagaauuccaaacaucacucaaucacagaaacuaucugccaccagcaaaaucaugucccugcuagauggagcacgaggcaagucacaguugcuguggacagucugcagcagccccaugucccacaccugggacuaagacaaaaaucauauucccauaauaauucuuuuauuucuggguuuuucgaagaaaccaaacuucucacuacaacgcugucauuggauuguuguaugacacaacaugcacauuuauagcaacaggucaagggugaauuaaggucagacacacccuuuuggucagcucauugucaugacacugagaugauguugauggcauggacagcucaagaaauauuaaacaaagcugcugucuacucaugaccacgggucacucugugcuuacuucaucccuggcuguggaaacccagaagguauccauuugaauuuuuacauuuuguagaaaauuugguucagagaacuaugcaaacuaaauaaguguucugccucugagcuggaauuccuggccaguuucuuaaucuuauuaagaauauuucaggcuuugaauuaggcuuuauuuguaacugaaaucuaguagugaacaacuaaguuaccaggauucuuaacaauaaguagguaaguauaaauauuguugaagagcccccgauaguuucuaucccuucucagagagccccgugggaugccgguaccuuagugaucugucauuaccuuacaucucuuagauuucauccuacugucuuucaaagcuuuaggaaaucccauuuuuuugaggaauuuuauccauucucaacucuccaaucuccacuccaaaggccugcucugugacuucuaacacuggacuccucauuaccuggccacucucuggccucgcuguccccugucacucaccuucaucagcuccuugcagcugucaaggccaauauccacaaggaugccuuucacccucuuccgcaccuuccugauguugucaagauucugcacaggaauuugaaacauuuuggagauuuuccuuaaaaaagaagaaagaacuguaacuaacaugcacacauacaaauaugguuucagcagagcuaguuaacacauuacagcaucauuuguagcagguggugcugaggaaacuacaaccaugcaagacagaagcaugacucuucccuccagcaucagaacuuagcauuaaaacagaagcuaaacugcagacucuuagaugaaaaccuaggaauacauuuugauggcuuuggaucugccaacagagccucacuauggcaccaaaaaguacacaaaacaaaagaaaaagucuacuaggcagacuucaacaaaguuaaugccuccaggggcaccaucaaaaaagcaaaaauuccacaaaaagaggggaauuuuuuuaaauuacauuucugauauauccagaauaaagaacucauaacugaacaggacuggagagauggcucagcaguucagagcacuuguugcucuugcagguucaguucucagaacucauauggaagcugucuauucugcacacacauaauacacaagcauacaugcagacagaauacucauacacauaaaauaugcuguaucuuuaaaaaugaaaaauaauucaauuuaaaugagcaaaugaucuagacacacuuuuacaaaauacacgaaaggaugcuccacaucuuacucacuuuaaaaagcaaaaguacuggccuggcaaagcacagggaaaccagaacugguacacugugccaacgguaagguacacaggccagccaauucagaaggcagccugaauuccucaaggaaacaaguguguagaugccaccuaagcuagcagcuucacccaagagaaaaaguuaggcaagaauguucagagaauuauucaacuacaccuccaacauccaucacauuaagaaagcugugcacaacaugguggcucacaaccaacuguaaagggauccgaugcccucuucugauauguuugaagacagccacgguguacucauauacauaaauaagucagagagagagagagagagagagagagagagagagagagagagagagcgagagagcuaugcauacccauauuuuggaccacaaagacaaguaccaauauaugcuauagccuugaaaagucugcugagaagucagacacaaagaaccaaauuuauacagaauuauaauuccauuuauacauaaaguggcagaccuaucuagagauagcaguggccgccuucggccagagaacuggucagugacagugaagggaacagggcuugucuuuuguuuugcuggaaaggacaaugacaaccuucaaacaucaugugauacgccugccauccuaaaacuugggaggaugaagcaagaggaucucaaguuggaggcuagguuaaauuauuuaauaaaauucugccucaaaagagagaggugcaacuuagcaaagucuacuuaacucugugaacaugccagcagccaucuucucaaugauggacuuuacaguacaugcaguaccucccaauaacaccaaccugaaaguaucuggagagguauaaauuacgaugaacccugcaguucuuaacuaaguaggaggcacuagugugaccuuacuguuugcaacaugcaaacauaaaucauuaaagcgaaugcaucgaggacacggaugugcaugcauacuucaguccacaucucugcccugcucaggagaacacaugcccagacaacagcagagguacacgaggccccacucuuguuucuaaaugccaccuucuacaaacagucaaggcguuaggacagcgauggcaaaugucuuuagcccuagcacuugggaagaaaggcagggggagcucuugaguuugaagcccguguggucaacaacaaguuggcaacaaguuucaggacaaaaaaauaaaauaaacuaguacuugaaagguggugugagagucaagcauucacaagcauucuccucuacagagcaagcucaagggcaagcuguaccaugugagcccuugucucacagacugaacaaaaggaaggaguggggggaaaggagagagagagaaaagagagaaacaauacccuagggaaagaauucuacagcuaaagcaagguaaagacaagacggacaaaaagcucuaguaccagucaugucaacaggagcaggaaggaagcuuagaagacgucuccacaagccaaagccaacaaaaucuaggcaccagaaaaauggcagcaauagauuccaaccuguggcaguuucccuaaguuccucuuaugacagacagaaccugaaacagcuaccagaaaugcuggacagaacuaaccaacugaucgaguauggcagaagcaaugccauauaaacuccaagacuagauggcaaaaacagcgccuuucauuccuaagaacugggguggaguuacagcuacauuuauacacacacccaagaccacgugggaauuccacacccucaacauggaguaaagggacuucugcaaaguguggccccagcucccaagucaccacugguucucagucucccaacacagcagggagugaguuaucuccacuuuauauuccguauaaauuucuaauucagacuugugaaucuguuaacaaaauguucugcucuacaaagugaucucaaggugauccagaacaauaaaagcuaaaaaaugugauaaagaaugggacacagacuucacauuaagucuauuaauaagcaugaauagcaucauagcacggguauaaucccaggaugcuaaagcagaaagaucauaguucaauaccaacacugaccauauaguaagguccugucuccaaaaacuaaaugaagacacagacuggcacagucagggucaggagaaagcaagaguagcagcuaaccugguaacaugggacacaaccgaguguccaucaaaugguacaggauauaagcgaauguucuggguacagagaaagcaacgcuggcugacaauaaaagggagcugauccaaacauauuaugcucugugaaaagcuguuggauggagaguucuucugccaucucaucacaugaacugucuuaacuagaucaagucuauaggugaacgacagauuaggagauggcuguuggaggccagugagugaacagacugacuuucuagaggugcuggaauguucuccuauguaagacugguuggugacaauugguugcacauaccaauucucuuuacagcucaacaaguuuuacauuuuaagaaauguccuuaggcaagccuaccuuugccaccacaaacacagaaguaugagaggagcccauggcuuggacugggaaggggguugaaacucaggcuugcaagguuagagagagaacaggacacacaaaaugaccacacaggaagagaccacuugaauauacuuuuauucugcuuagaaauaagauccugagaaaugucaucccuuucugcauuuucaugguugcaccuuugagugaaacugcaauuuuugucuuuugguugaaauaugaauugcgauguccaaacauaaagggguaacuauuugaccuuuauauauauaaaaucuugauugagggccagugagauaccugccgccaagcaaagcaaccugaguuguccuuguagaagagaaccaacucaugcaaacugcccucuaacuucuacacacacucccauacuuguuuauauauacaaacacacaaaagcaaaauuauuuuaauuugaaaauacuuuaauaucaugaaaggaaaaaaaaacaaaacuaagaaacuauuccaaaaugaaggauaaacuaaacaaugcaacucuuaucugaaucuucuccuacaaaugacauuccuggagugacucccaaauuuucaaaggagucuaagauuaaacaguauaauauacuacuuucuugguucugacgaaggcauugcugucuguaagaauacuuugggggaugauuaccauaucuuguuggacaaucugaucucaaaugauugaaggcagggggaccucucuguauuacauuugugacucuucugcaaaucuguaacuauuucaagaaauauuuuagggacagagaaaugacucaguaaguaaaugugcuggcugccaagucagacagauccaagacccacaugguaaagaaaacacugccuucucuaaaaagcccucugaccuccucuaugaaacugagagacacuuauauacuccucccucucucucucucucucucucucucucucucacacacacacacacacacacacacacacacacauuuuuaguaucuuuaacuguauaaacuauaaaagcuuuaaaaaguauuaaaguaggaaauauuuuagcuacuaacuucacaacuaaaaagagucauuuagcgcuuuugacuaacuuuuuuaaaagauugguaguugcauuagagcguuaacuuaugucuguuuaaauggaauuugguaccaacuuccaaaacccaacaggaguuugugggccaucagcccucugacagccuuguaaucucgaucuaaggagagaacggcagucucggggacucugggacucaacaggacaacggggacaccgccuucaguagcuccccuucugugcugcaaccaccgacggcuguuucccuaauggacuuaacauucuucaaggaaagaaugucacaaaacuccacaaaugcuaaguaaacaaaaauuuuacauuuuaaauggucagauggcuggaugcagacugagguccaacacauucuagacaaacagaucacaucaaacaccagugaggcaaaggagacagugaguacccaaccuaacaacuguuaaaaccucaaagcucaaagaauccaaucagggaggaggcggcagaggauuaacaggaacagcaucuuuagagagaacaaggaaaacuguuuauggagugggccaacuguacguuaaguuucuugugaggucauuuaccuaggaaaggcugucuuaaagggaccauuaguggugcaaaacagaggacuuuagaaaaaauaaucccacagaacaugaaguaaaaauaaaauuguugaauaaugcccuugcaaauauuauacugucagaagaagcuguuggaaaccccgacgaagcauuuccaacaccacacacgugcagggcggggcagacugagcacauuagcuagaacaaggcaggacaagaccacagccaauucuggucccuuggucucucaaaugcacugcuauuuccucuuccuagcuccacuguuaucuucuaaggcuuuucauucuccaaaugcuggugguucuguacccauaaccucagcucaaacaagaaugucaaauuuaccauuugcagcgucaagucacacaagcaaggucgacucuauucuggaucugggaaaaaagacccagguccuggcauacuuucagaaacagcagcacuugcagaccagguggcucucugaagcauuggggucacagaaugaggaugugugugaccccaccagcuuuaaguggauucuguagauacuugcucauggcuugggaacagggccaagaacugucaggguuuuuuucuuucauuucaauuacaagugcccccccccccauuccuucauuguuaugggggggcgggggggggggcacugaggaaacaagaaaugaaacaggcaguuacugaagcuuuauaauguccaagcugcccuuccagcaucccuggucuauuguagacaaucacucugggaaggacaugauagauauucuaaguauagguuuuauccauccuaagauacaagauuacacacagaaugcuggacuaucugggaggagcggacccuauuuucacaucugcauauccucuucaccuugggaagaguaacugauggccccugagcuuccuccccaccuauguaaaggcgccuaacuuguuuguuccagaaacugaaagaccucaaauuacccaacuccugcauaaauuagcauuuccuaaggagauccuuucauugcuuugguaucacgcccguguaaggauaguucugauaacuauguccuuuauuacuuuaucguuuauauaauuacaucacucccuuucccauccuccccaaacccucccauaguccacuccuugcucuuccaaacucauagcacuuuucauaaacuguuguauguauauauauuccuaaauacaacgugaucgguuugcauguugccuuauguauguuuucaggacugaccacuuguuaugaauaaccaaucaguaugcucuucccugaggagaacuaugucucccacccccucaguagccuguggaggccuuaccuccccagccccgcaccaauccacuuuagcauguccaguguuguccuugcucaguucauguuuagguagucaggaagaaacguaaaggacuggggacauggcucaguguuuaaguucauguacugacugcccuuggagagaacccaagucugguucccagcagcaaugauuguuggcuaacagccauuauuuccaggggacccagccuggccuucuccccucuccaagcaccugcacucaugcgcacauaccaauacacaggcacacauauacauuuuuuuuaaaugaccagauaaucccuuuaagacacaaaacauuuuuguuccuauacaaucuggguuuugcuuuaguuuuuguuuguuuguuguuuuagguuuuuguuuguuguucuggguuuuuguuugguugguuuuugguuuuuccagacagcacuggugacccuagaacucacucugcagaccaggcuggccucaaacuccgggauccaccugccucugccuccugagugcugggauuaaaggcaugugccaccaugcccagcaagaucugauuuuuaaaauggucaaucuccaguggcaacacagcaagggucacagcacagguccuggggcuuuuucguggaugaaaccaacucaagcacuuuauaguugaguaaaccuagccaaccacugaaucucucugggccucaguugccugcaucugugaaacaaugcaaggaauuuacuucaugagcaguugucgagaugacaacacuggaaaagcacuacacguaucaucaggaguuuagaauaauguaaaucaaaaacucagcgagaugccccaacuacuaggacuuucuuuuagcaacuuccaaacacuguaauccagaaagucugcuucaacccacaggaaaaccccuuucuagccaccugaccuucaucaaucugcuuucucuaaauagcaggucagcaaggauuugggugcaguauggaaaagcuaagcccuaccuuucaaccaccaauggagcaacaguacacugaaaaccugauuucaaaugaaaacgguaucggcaaaucccaagcuaaaaacuguauuaacuguuauccccucaggccaaugacccagaccucucuuccucccauuucucaacgagaugccuaaaauagccugaaaugacuucauuuccugccuauccuaaguacaaauuugugcuuaaggaccuuuaccuaaggaccacugugucaacgcuuuuuuucugagcagggccuccaucuacccaagacaucgcuauguggccaauaucaccaccaccugugauagcccuaggcaauacgccuaacuaucaaccagagcuuaacaucgcacuuuccauaacuucuuacacaugcuguccccuauuuccacagcagacuggaccaguccaagccccgaacuagcaaaacacuucagguaaagguucugucgguacuaauguacacuaauguaccagguugguuacuucuucgggagugaucgcucuuccuaaucgcauuaacuuuaagcaccacacucacacgaguuuugguucaaagucaagcauacuuaaaaauuuauaucuuguuuuacaacacuacaccaacucaaaccuuuguagaaauugugcgaauagaaccuauuuugaucccucuaaaauggcagaugcaaaguuaaauuucacguucagcaucugcgcaucggucacgaucgccgcaguaucagggaugaagaggcagggguuugcccucggcagugcuugaaaccaagccucuccuucggaagaaaacucggcgcuucagaagcggccacaagcuugcccugcaucccgccauccuccacaacgggaugaucuucaggcuucagcuucauucccgggacgccgcagaggggcgcccugcccgcgaccgcagagccuccccgcgccucccgguaguguccgcucccacccucccucggcucccaaccacucucucucgccacgcccggcgucccgucccugccccgcccccucuccccauccauccccgcucuguuccccgugcccggacuccacgggucccccuucccugcuccguccuccccuccguccuccccguccccuguccccgcccuucccccccccccagaacggccccacucccacgugacccgcgagcgggcgcggaggggacccgagccgcgcacuagaagguccgggauuccgaaggcgcggagguagcgacggcgcgacaggccacaguggggacagcgcagcggacagcgcuagggacgucggggcggacccaggaguggacggcgggugggucgcggggagggucggggggucggcgcaggccuggcgggcguaccuaccgcggggcgcgaggagcgccgcgucccgccgccgucgcaacaccgccgcguccuccgccuacgcggcgggacccccgccccgcgcccgucccuccucccgcgcgccagaaagagaaga

SEQ ID NO: 9001 - RNA, 7333 nt, Mus musculus
caguuauguaauucagcccguguuuauuuuccucagagacuugucuaauguugcaaacucagggagccucaguugucgucagggaacuugggacaagauaauggaacagggagggggguggaucgcagcauugagaaggcgcccgcccgcaguggugcuagcugaagccaggugacuugugcuggacugcgugcgaggcccugacucuguacccugcaagcagagggcguggccuaccauauccuccccccacccccuacuuuccuuucagguagaucgguugcuggcagaggcugacuuuggacccccagaugaaagggacgacuuggacgguuugaggugagccacguggacaucucucuguuaccugaggcagauguuuuagccacagcggcugcucuacuagucugugcuucugcuagcacacauggcccccuuggugccugccccuggacccagcacaggucuguauguucuggguggcugucuauauaccaccacgcucaggugcacacacuggucccccgagccacuguccaggaucaccuugcuacaucccugucacccucagauacggucagagaugggaagauguagcacggguccuaugcagaugguuugcuccuuacacagugcuuuggagugugguuugggcucugugugaaggcuugcuucucuucucucacaggaacgccgaugcccagguaccacaugacuccccagaaccagccgcacacccaaaucugugugggauugaccacgaggcgcugaauaagcaaauaauggaguacaaacgcaagaaggagcgagggcuucagugucagagucuggcgccaccaucagggcgggagcaggcaccugaaccgacccgucugcuccggaagagagagaaggugcgaucccgguggcagcaccgggacgcuucccccagaagcuuccuuuugggcgaggaggacgaggacgaggacagcagcacagagugggaaugccacgcccacgaggcagaggaugaugaugaucaucaggaagaggagcucggagcugacagaggcgcacagcggggccucuguggcaagagagagcagggguagggcuggggccuccgagcugccgccccugccugugggucagacugcaggacagagccucugguguaccuucugucguagucacucacggaggcggccugaccucagcggcaggagaacugcacccaucggacugcaccugcagaccuccgcagccaguccucagcgauugguaccuaccuggucccggauaaauaaacgauuuuguauuuacucugagaauuuuguguauacgcacaauguauuuuaaacauaucugccucucuugucucccuucuaacguaggacuccuguucccugagucucccucccagcuuugugccucacugaagcuaauuggugcuacccuauguaacaugggaauugggccgucauuggagcacaggcaaccaugaggguuacacccaugcuguccuuaaagcuaacucuuccuuccccggcauccuuaacugccagcagcuccuuaccuagagcugaggccugugugcccauucuugguccacgcugaaauggcgaccggcuggaucuugugcagguggccagcagcucuuagcucgugagugcgauggacgaucugucacguccaggagacggcauuguacagcagugcuuccugaccucuggaucuuagagucuuuccaccccucucuugaaaacucccugagguuugagggagagaggguaugauguagauacaccccauuuagggcugcagugacuugcguacuucucggcacuuuagccagucgugcgucuccaagcccugccgaccacaucacugaugaauuucacugcgcuaaacuguggguauaaagagaaguauuuagaagacaguuugauucuauguccaucuagcaagaugauaguagcagguucuccagggccuaugaccucccagcuucaguuucucgaucgagguuacaguacuaggcgugaguucccuucuguagaauggaccuuaaguccguaacugcucauuacugugacacucaugccucuguugcauaucuugccaggguggccauuauucuacagcucacagguucuagcuaggaaagggguuugauuacuucuuguuugcagcagccugcgugacaucuucuaguacuaaaagcuagccagcagggacagaguuuccagguuagcacccacuugaauacucuguguccuaugaucaguaauagggugcuaccaucaaacauuguuggacaauuaagagaguauuuuuguggggaagugucuccaggggcccccuugaccaacaacuugaagucuuucuuuuaaauccucauauaauacaacagcaguaucucuccucucuccuccucccagccccucccccacaucgcuccuguacuccagauccaugccuccuaccuuucccuucagaaaaaggcaggccugccagggauuugaaacaaacauggcauaucaguuuguaauacagcuagccaaccccgccucgcccaccaugaaagcuggaugaggcaacccaacaggaagaguaggguccccaaagcaggaaaaacagcuuuguguggagguuguaauggagcagaaagcauaucacagggugaaggggugcccaagugacccugccugugaccuagauaugauuacucuauggugacagaagcuuugugcuucugacacccucucccauguguaaauuuccuaaaaugcauccuugugccagccgaccuggucuuuaccccccauggagucuguggcucuuggacacaagcucugcacagcucuaucaugcugaguuguuugugugagcuccaagguggaggcucaauuuacuguuuacucugcaugucguaaauuaucuucugguuuguuuuaaacagcagcagaacaucagcggaaggcugaaaaaacgugaaaaacaugguagguaccuggacugcagaaaggauacugauuuccagugagccgaaacaagauuacaggccacguguggagcacuguugagugggacucaaauugcucccucugcuugcguucagacggcuccaggugccagagugacaucugaucacucccaauaauaaguagccagugacauccagccaccagcagucagagccagcaggcugcugucuuccaggacaaaugucuuuucucaaguucuaucaagucagcaucuguaaacaucgcuuagguugacagcagcacaacagauccuuguuaccuucagauucugugcucaggaagucagcuacucgucagucagcuauuccaggauccacacagagcaugugacucauaacucgacguggacuccagcugaggugcaguaagccaacauucugcauccaucugccguuagccuuaaauaagugucuuucuccuggacuuuuaccuuagucucauauuggcacaucuugaugguaguuuucccguuuaugacagcuccaagcuggcccugggagcacagaccuacagucuucacgugugggaggcaaaagcaggagaauggaguuggcagccuggguuauacaguaagacugucucaagaacaaaaacaaaaagaagaaaacacaaaagcuccaggcugugaggaggaguggaucugucggguccacucaggauagucucaccuagaugcuaguuauacacgguagccggcgaguugcgacaugcagccucaggaacgugcauacauguguguuccuggugugucucaugcauucacaguuugacucaugcauauaugugggcaugugugugucuagaaguacaugccuaagugccugcaugcacugguaugcguggacgugccuaggaguaaccacauguuacgaguacagacugaauggcuguauaugcgugugugugaguacccauguaggaauguucauguguauaugugugaauaugaguauguguggugguguggaugccugugugcaaggauguuugcauguuaggcauauggguaacuucugugugcuuaugugaaugccagugugugaagaccuggauguguugugugugcauagacuguaagggcccggggucgggggcuggagaaauggcucugcucuuccagagguccugaguucaauucccagcaaccccaugguggcucacaacugucuguaaugggaucagauguucucuuuuggugugucugaagacagcgacaguguaauuacauaaauaaaauaaauacaucuuacagaaaaaaagagcuggggauucuguggcccaacagugcugggcuccacuggacuugaacacaugcuacacuuuguuguuguugcuggaaaccuugucuuaggaugugauuguuuugccaggcuacugaagguuuaaguccgggcaguugaagaguguuguagguagcgguugucagcacaagggucauuuuguggcugggaagggacagcccucgcccaaggugauggugguuagcaagaugaacaaagaugcagagaugagagccaugguuaaccaaaaguuaauagaagcuggagaacgagaacgccucaaagaguugcugagagcugaguuaacugagugcagcuggaaggaucaguugaaggcacacucuaaagagguaauuaaagagaaaggacuaggauacauuaccauugaugacaugguggcugaacucacuccaaaaggcagagagcccugguacuugacaguguaaaagaaggaacuccuacagagaaugagaacauuucuuguucagcaugccaguggauuuauuucugaaaguaaaauuugccauaguuagaaauugauuucccaaaauaaaguccuuuuuuguaugaugguuuaaaaaaaaaugugauugguuccaugggaggaaaaaaaagaucugaauaccaaguugucaaaagggcuuuugcuguuuuguugccucuuuucuggaaaucagaagguuuaaagaauguccuacugggcuggagagauggcuuagugguuaagaaaacuggcugcucuuccagaggcccugaguucaauucccagcaaccacauggggguucacaaccaucuguaaugggaugcccuuuucaugugugucugaagacagcuauaguguacucucuacauaaaauaaauaaaucuuaaaaaaaaauguccuacugugguuucagaggucacagcagguccuccuucuagggagucuuuagccucugauuugugacaggaauucugagacgguuagagucauggggacacaggucuuguuccuaaaacaucugguagaagggaucucaagugaugauuuauaaaugcauguccacagccauucuggaagaugagucaagacgaccacagguaaaaacuagcgugggcuguaaagccagcccugaaagaccuuguucaaagucagccagacagaagcaggauuuauccucuacuagagugauuucagguuacaaggcuuucauacuugacccugucggcucuacaggaaacaucaaaauggacagcaauuuugcaggcauaaugcagaucuggucugggagaaagacuggcuuggugaagaugcaggguacuaugccagacauguaagaucuuaaaagcgccgucaguagagugguagcccccgcacucaccugagaagagagccuacauuuaguuagccaucacccacuuaggguugucaccuguacgauuuaccccucauccucccugcccugccacagcuugcccuggccuucuggaacccaggaaguucaguuuugaggagugacaagcuccuguugcauuugagugaugucuacucaaagcuugguaagagugucaugucagccagacacguccucagcguuggcuauugucagugaaguccaugcugcuggucccacaauggucauaucuagcgaccucuccucuaucugugaaggucaccuucuccugugccuggccaggggaguuucucagcuugaaugaggauuccuguuuugcucacuaguuauguuacauuaucaugcucauauaccccaaggccacauuguccccagcuggccuuugggagcuuguguuagugucuuguggcuguccuaaugaaguaccacacuaacuugaucuuagccuugguucuggcugcuccaggaaggguccuuuuguuucuccagcucaaaaauccuagagcaccugcagacuuuucuaggucccuaccugcacccgccuaccgucuucccauaaccaagccucucucauugguucucccaugaagaugcuuguuuuauuagcgcccgcccaccagcucaggaugacagugguuugaaauuagcuaauucauccgugaggacugguucuaaaugagcucuccacuguucccugaauauugcuucuuucugcccauccuagagugagccauuugacuuccuucaguggagaaggaaggguaguaaccgggacaaggacagaagguguccacugccguuggugcuauggaagagcugggcaucucuggguacacuaugcauaacuugguggcuguaguuuuggcuagaugcugggaagaauucugggcaagguccaagaugagcaccagcaucuaggcagcaagugaggaagaugggggacagaagggccuugggcuaccuagcuagagucaucugucugggcagaaaauucaguuuaaaauuaugauguuaagauuuaccuugcugggcagugguggcacacaccuuuaaucccagcacuugggaagcagaggcaggcagauuucugaguucgaggccagccuggucuacagagugaaaccgagugaguuccuggacagucagggcuauacagagaaacccugucucaaaaaaaaaaaaaaaaaaaagauucaccuuggugggccuggagagauggcucagcggucaagagcacuggcugcucuuccaggaguccugaguucaaaucccagcaaccagaugauggcucacaaacaucuguaaagggaucugauguccucuucuggugugucugcagcaucagcguacucauauacauuaaauaaauaaauaaauaaaucuuaaaaaaaaaagauucaccuugguggcugccaagggccagccuuggcguggagagggcucugaggcaggggugucuggaagcagugcuggaagcuggcggccuaugcucugcuggagacagcuuugcagccugccuucucuguguucugcuuucuuucucucugaucggcuuccucuggagaucuccagaagcucucuccacauucugcucuagacaguucuccaagcaguucucucugagccguucua

SEQ ID NO: 9002 - RNA, 39436 nt, Mus musculus
ugcuucucuggucucuugcuuugcuuguuuaagcuuugcagcuccguccccucacuugguccucugggguaauaaaucuuuguacugagaaucugguguccagguaaguccuguacugauucgggccagagaagggcugacuucccuuucaaacacugaugaaaguuggaugcuguaacacucuugucguuauagcauagcaccagugugcgugucuggccuugcagguguuuaucauagcuugcaagguucauaacacuaugagugcuagccaguagggacgaagcuuccaacagcuagauucuuuauguccuaugacacgaguaugugguaucuuaguguuagguucuggaggguaaccaauaguguuggcaauagccuuuaauguugggggagggugucuacaggaccacauuggccaacaacucaaaaagaaauaccaacuuccuggcaauuagaguuuuauuuuguaguguauaaugucuaguugggauauugaaccaccauuauccauuuaaguuuuuauacaucuauacauuuuaggaagcuucuauacuccaguaagucuccacaugacuuuucuuuucuuuucuucuuuuaaaaaaagauuuauuuauuuauuguauuaguacucuguuccugucuucagacacacuagaagagggcaucagaucucauuacagaugguugugagccaccaugugguugcugggaauugaauucaggaccucuggaagagcaguggguacucuuagcugcugagccaccucuccagcccucuauaugacuuuucaaaaggccuuuagcguuaguuacccuuccccauguuuccucuuccacccugcccucccauccucuccugcuaucucucucucuguguauuauuggaaauuaucacucaaagguucuggaagagaacucuuuuggggggcaaauauuugagaguguagauuuaagcaauuuuuguuucuuuucacuuaucuuaaaacaguugaaauaucuucauaauguaugccuguuuuauuuuuuuuuauuuuuuuauuuuucaagacagggcuucucaggcuggagagauggcucagcgguuaagagcacugacugcucuuccagagguccugaguucaauucccagcaaccacaugguggcucacaaccaucuguaaugggauccgauacacucuccuggugugugucugaagacagcuacaguguacucauauaaaugaaaauaaauaaaucuuuuuuuuuuuuuuaaagaaaaauccuuaaaaucuguucucucuggugaagacucuugcgauuguucuuaaaggcucccuggaugguacccaaucuugagugggcccaguucaagaugcuuaaugcaaucgcaucugcaaaaacaagacuucuucccuccacauacgauaccaugcacaacuaacugucagaaauuagggagaagcaccaucucuugcacagcucuguuggcuuccuugggaacacagggauucuggugcuaguggaguauccgugaagguccuugcacaacagguacucuagagccuagaccaaggcucagaacccagaucgggugauguuaaaaagcacccacagcucuacagacgguagcucucgccuuaccagagaguaccauagugugcaguacuggacgggaaaauguaagauugugugcacuugucugggcuccuggaggcgccucuggcuuaugcugugcagcaaaagcuccuauuuguguauccacagcccauggaauauucagggcaaguggggcggccauauguaacuccuaacaugcaucaugagagccaggagaggcaaugagauccuggaaacucuggagccuugggcagggguguggguguggguguggguguggguggggugggguguguaagagggugggggugugugcuaaaugggaacaccuacuuccccuucacccgguccugccauagcucccuugaguuuauucaucuuccuguuccuuccugguguagaguauugaguguguugauucaggaaguggcuaggggggcugugggccccgcuggaggauaaucgcuuccugucuuuuccaggccccuggacaaucaagcuuuguuuggaauucaucuuaggugagucuuaaaaugauuuccccgcaaaaccacccagguggggaacaggaccagaucuggugaaaagggagauaccuggugggaugggugggggucaguuguguucugggggcggggcggggguugcucugcucaaguacugcgccgaaggagaaugccaggcagaguucgauguguuuccuauuguugucaccgggucuggcaccucacugccuagguccccuacugacagguagggcagcucguucuucugguucaacuugcucagcccaccagggucuaucggagguuagaaguguacucgggaauuccuacgcucuuuuccuguaaaugagcacccagaggaugacugaccucacauauggaggaggaggcucagcaauuguggcgugcugacgccagccuuguagucgccuagggcagacagugaguaguucagcgaacucccaagcuccaguccuugguaaggguugccagcuccucauaggcuuguucagagacuuucaaagaccccuggaaucccggggaggauggcgucccaggccuagagcuggccgcugugacagcuuuuuccaacacccaguauuucaucuucagcugcuaguggcuccguaaggcaucuacccugugcccagcgcgcggcgcuagcuagagaccguucacguggucacuuggccugaaagcgccuccccguagguuuuuccuaaucugggacacgcagcagagcagagugcccgccaccucuucugucccacccggucgcgagcgcgcgugcgcgcgcgcguuaggacccagcgggguagccgcgggacccuggagugggcgugaccuccauugugacgccacggggcggggcuuccucuggcugggacugagggacagaaagaccgacuggcgcggcguggcugguaagggacgcggauucagcucacuuugguugcucuucgcugucgggcggagccucccugaggaacgugaagacuugggguccagguugcucugcuucccucugggccacgcguccaccccucccccacuagcugaacccguuuuggggcggugucaccccccgcggcuaucgcgcccgggcggugcaccccuuccuucccucuaacccggcggggugcacuccuaccugcaccugggcggcccgcagagggccaggcgcgcgucgccagcuccuuagccuuccuggaagcaggacggguccuggcucugcugggaacccucgccgcgcgccccggggagccugggcuuccgaagcugugggugcggagcgcugcgcucccaggcccugcuagacuccaggucgggcacaggugcgcccugguccagcuccugucagugcuuuaucuuuguuuccccuuccaggucgggaugguggcugacugcgcaggauagcggcggccauguggaggugacagucagcuugcggacucagagagcccaaaggagcuuggcccagguggauaucgcugguuggcagcgcggccucggugcuggcgauggaagcggaaggcuugggauggcuucuggucccgcugcaccagcugguuuccuggguggccgcuggggccauggucuucggagggguaguaccguacauaccccaauacagggacauccggaggacucagaaugccgacgguuucuccacccaugugugccuggugcuauugguggccaauauuuuacggauacucuuuugguaaguucagacuuuccuaccugggagugcugcuggagagauggcuuuguucucacgguuuucaaguggcagcgacuggaacuaucuacuucccccgaaagaucucuggaagagcaggcucuuauucuucaacggugguugaguagccugagccgaauuuacuaggacgcgcggcauuuccaagauuggcagggcuggagcagagagccaaauauaaucucucgaucugcucguucauuuacugugucguuaccuuugucugauacauccuggagccucacuguaggcucaguuucuggaucccugccuuuucuuucuaguguguggaguggggugacaggaugagaaguaauaaagcuaguuagcaacaggaaggcucccuugacuugcuuguggggaaagccuucuguuacauuuuucuccgccucuuuuuguuuguuucaacaucagguuuuucuagguagcucugguuguccuggaacuugcuuuguagaccaggcuggccucgaacucacagagauccacuugucuuugccugcugagcacuggcauuaaauguguacggcaccacugcuagauucuucuggacuucuuaggugggaagucagacuuuucccuguaaacucagguggagccuguuuuucuaacccugagccagcuuccucuuuuucauuugcauucuguugaggaaguugaacaauuuugaacaauuguuuauuuauuuuaacaauuguugaagcccugcuuacuugaggguuuugguauugcuuugagacuggguuucacucuguagcucuggcuguccuggagcucacuauguagaccaaguuggcuuuccaagagcucaggcgccaucauggucagaugacuuuucaaaggaaauuacaaaaagguuuccuugcugcaugcuaagauaaacaugucuguaguuuuccuucugggccuauccuaagcccuccaugcacauagaaaggcuguugaugcauucuccugaagguagccagcugccugcagaagccagggagaagggauccaagagagcuggugucagaguucuuugcuuuugacuuuuuguuuacuguuggaaauggcccgaguuucuacuaacuaguguuauaaagucaauuugauugaugggucagcagggugacucaauggguagaggagcuugcugcuaacccugaguuccuucucaugguagaaggagagacucaacuccugcugguuugccucugaccuccacucaugcaccacaacacaugcgcauauacacguaaggaaagaaaugccguaaaucuacauuaaauaaauaaaacacacccacuuuguauaguuuagugagcugugccaaagguguccacccugaauuuaugaguagggaauucgcucugcacuuuugcauucugucccagcacugggcccccuuuaucucaugaguggguucuugccugcgucaguuaggagguuggcuagugagcugacucggaagugaaguaaguuggcagcaaugaacgaugccaccuugcucuuugccuggggucaggugacuucugaggaaugggucauugaggucucgauuaaaaaaaaaagcuggagacuugcauuucaaagauuccaccccuuugcuuuccccugagaggaggguggaggucccgagcugggcugugacuguggcugggcuccgagaaguagccuuaguuacaucuaagcagcuccuucauuauaacugugcucauacuaucgguagcuccgggugcccaggauggaccuuugauuucaggcaggcugcccaguguagcccaguuuaacucacuguuuaacuuacguaggggcaggauauuuacuuucaggauugaggaauacauuuucuccaaguccugaaguaggacuacugacaugguuuggagauaaccagaagugaggccauuuucuuugugugcacugguggagagggaaacuaagacugguccgcucgccuguugugcuggggccucugagaagaccucaaauacuuuucacugugggggcugggcugucuucuaugcaugccaaacaugguccacaaauuguguuuucaguacaacccaugucccuaaguguucugugcuacccagggcuccugugggcacuguacacaggggcucaguuucucaguauauucuagaagaccgaggaagagaggagccgagggucauggccuuccugagcguuucauuuugcaaaguaucuuugcagacuuucacaggaugaaagucagagguuuggaccgugucuggaacauggcugcccaucuguagagacccugcugcuccaaaaccaugugcuggcccugcugugcuucuccacagugccuucugcagcgccgucuagacaucccuguccagauuccacagcucggcauccuguuagauuucacauagccgaaggcuguagugucgggugcuucguugggagcaaugacuggagcgauacaccccuuccccauuuacacaacgccucccacaguguggagagcagguccugaaugugauagauuccaggugagaugggagccuuccaaacuaugaaagggggaaaguagaauucucagcaguuuucccgugcuaacugggacacagaccuccaaacucauuuagagguuuguggaaggguuuuucuucucuuccuucucccucccucccucccucccucccucccucccuccuucccucccucccucccucccucccucccucucucuuucuuucuuucuccuacaguccugcaggaagagacugauuucacugcaaaccuagggauucugaagccugugaaacucuaaugugagccccuuacuucuuauaauccucacgauguuacagaacucaccuuuagcaggcugcucucaauggaauguggguuacaggauuuugcaauuuugauguuggaagcuggggccaagugacccuuuaucuaauguuuacaggccuuuuuuuaucuaagaggugccagaguggggcugcaagacuggugcccagguucuccuugagcaaaguucuccacccaguccuggagaucugaggauggagagucucagucucugccagcgcuggcagcaggucuuggcugugaucuugaaacacuguauccgaggcgugguaacauucugcuacuguggcgauaaguuuucuuugcuauguagggaguagcuauagagguguguacccucccccauaagagcuuuucuguuacuuugggacuuggagaaguuguucauagaaccagcuacaggacuuggugaaccuuggguaccccacucuugcucaggucucucuugaugagcucuggcguucauuccuaugagaauccuuggacccaccacccauagcugugugguggcaauugccacuucuccuuagaagaauucuacuaaccuccagucuugagcagaagaggaaccauauacucaauagcagacugccccgaggaaaucgaauuucuucuucuuugagcaugacuauuuaacaaaccgugaccaacagcaaguaaccaacaaccuaucucaguucucggggccuucguauugauauacccucugaaaaguccccagaauucuaaaugucacagaaucacagaaaauguucugcugcuggcaaagucacgcugcugugaacagucugaagcagcgccauaacccacaccugggauuaaaacaacacguucuuagaguaguucuguuuuucuuuuuuuuuuuaagaaaccaaaauuucaaaauugucacuacagcagacuguuggcauuaauuugcaaagaaauggcacuuuuuaaaaauagcuguaaaaauugauuauguuagacauuguuuccuuuuuuuuugccccuuaugccauuuggaguugggcuuuuugaaaguuugugaccuguuauggcuuccuauaaauaaagccagccagauucucagcucugcucacuggaacacuauuauugccuuccuuauuguggcccucgagcucauuaggauugauuuugaugugguguaugggaacuuaaaccuugacuuuuuuuuuuuuuuucuccguagucuuaauaguaacaggagucagucaguuuguuugggaagcuacgccuucagucuccuagcuucauggcgcugagguggcccuuucccauguuaaccuccccguguaaucucugugagcaaauugccagcuagauagccagggaggaaguuucuaggagcagagcagcuaagggcuugguucugucuaccaggagcucugccaucaugauuugaaagaaaaacuuuuugcaagaaaacacugagguuccaagacggugguggcucaugaucugggguuaaugugguaaccacaggauccagggacauauccuaggaacagagcuugucuugccagugccagcuccuguguccacucggugccuaggcgacccuuuccuuuguuuuucccacuuccuaagcuuccucacgcagcugcguagucuguggagcuuaugaacucacaggggacauuugagccuugaaagcugcacagagggcuuauccugcacuuggaauuuccagucuuggcuugccaccccacaggaagcugagacuugcccugauugcggaggggagccuggccugcagcacgcccuuccuuguggaaggccuuaaacuguuggcucugcuuaucugggcggaggcaugccccaugggcaucuguguagaaaauguccagagcucucugaaggcccucaagcugguuaggauucuuucugaucgugaauugcuuguagacauaacuuucaggaacugaaggggguuuucagguucguuaaaggguugggugcucuacacggugguacagcuauuccucacagaacgggcaggccugacagacacacucuuuagagacacaggcaaggugguuugccugucuccaacuggucuuuuaccaauugcucucaccguagaguucugugaaaugcuuuucucuuaaaacguuauugacagaccuggcuuggaacuuacuauguagcccaagcuggccaugaccuuaugcuccucccacuucagucucccaaguguggguguauaggagugcacuguacacccggcaugugaaauacugcuugcuuuucauuuguggguugauuuuuagcaaguuucuacuguaguaguaacuacaugaaugcuagaaugugucucugagcaggcuuggugcuggguaugaaucaguacuaccauuuccuccugugucccuccugccuauaggcucaggagcuacauguuguacuggcugcccucuucagcccuggagguaacuuuugucccaggagaccaguguaguaaggggccacagacaugggagagaaggcugggccuguuauuucacuuucaggagguagagcugcuguguagaaucuuuugaauuucaagugcuaaccaccaguuaacggucuuggaaauaacuuucagaucaaauaaacucuggccaaugccagccugcauuugugcuucaccaggcuguguugggaccugccuuugaggaugagcugugucagcuugucuguguguugcacucuggugguauucugaucugccaaggauguuauccacagacccuguuaguugcugaauugcacuucugcccuccaaagcuggcccagcugaugaaauauucaacacuagugggagcuacuggaguggcuggggggagggguugccccgggagggaaagcagcccugggcuaggaggccaggaguggaggaaggaucuuugguggugcuagcucuggcugcucuuucuuguuaguggaagauguauauaaaaauuuagcaccaggcuauaugucuuccacauaauacuugcucauggggcaggaagcagagcuaccgugguguggaaagagucucuugucugguuaagauuagacuuugccaggaugguagguauguaggguccuuucauaccaauauguggcccugaguggggcaucugugacuaggucacagaguccaucgaggacagacaugagcuuugggaaagccucaggugagcucaauguuccaggguccuugcugagucugaccugggugggucccuuggcccuuccucauucuagguuggucccacacaaacccuggaagucuaggcaagcagguaccgggacugugaugcuugcacaagacccucgccucggcuccuuucuguuaugcagcucaggcccugguugaggagagacuggaaguccuggcaggggcuggcggcaucugcuuccuuccugacgcgggcucucccucucucucucccucccuuagguucggaaggcacuucgaguccccgcuccuguggcagagcauagucaugauccuuacgauguugcucaugcugaagcucugcaccgagguccgcguggccaaugagcugaacaucaagcgccgcuccuuugcaggugggugugacaucuucuagaaaagucgugcucagcccucgggcaaagcuuagcucuugggaagcugaagccacuucaguguuuuuaaccugggcagcuuucauuuucacggaauggccauuaucugcaguugauuuuguauauuguaauuguaucuuuuccauauuguaacagacuaaacauuucacagccucaaacaauuaaggacuucuuuccuggaauaugggugagguuuuaauuuaucuucugggcucucuuugcucacauccugacugcguguugucacaagaaccagagaaggcagagucauugcugugugcccugccaggugacucaagccccagucgugugcccuuuagcuaugcuucacacccaucuaagguguaacacacccacccacgucuguguauucugugggccgaggaccccgggcaguauccaucacauccuuaccccuggaccauccuggauuaaccucuugcugucucuggccucuccuucacagaagcuucauaugauacgcuggucaguguaggcuggcaggcuugcgggagaguuaacuuccaccuccuccggauucuaauuuaauucucuuccucuucuuccuccuccuccccucucucuuuuccuuccuuucuuuuuuuuuuggggggggggguaaguuguuuguuuugagacaggguuucucuguauagcccuggcuguccuggaacucacuuuguagaccaggcuggccuugaacucagaaauccgcccgccucugccucccgagugcugggauuaaaggcgugcgccaccacgcccgaccucuuuuccuuucugugauacuaauucucucuccauaacucaugcuggccuuuaaacucucaauccuccugcauucacuuccuuggugcuaaguaggcacacaccuccauacccagcaaaagccuuucuuuuuuuuuucuuuuuuucucuuuauucuucucucauaaauuauaucccaaccacaguauccauccuuccacuucgcccagcaccccuaaaaccuuucuuuuuuuuuuuuuuuuaaagauuuauuuauuuauuauauguaaguacacuguagcugucuucagacacuccagaagagggagucagaucuuguuacggaugguugugagccaccaugugguugcugggauuugaacuccugaccuucggaagagcagucgggugcucuuacccacugagccauuucaccagcccccaaaccuuucuuuuuaucuuuccauuaaugagcuaguagcucucucucuggauuugucugaagugcgugcgugcgugcgugcgugcgugcgugcgugcgugcgugcguacgugcuuuuugaaucuugcuuuuagaaguauuuagugcuaguuugggagcugcuuggaaggaggcuuuaacucugucuuugaucauuuauuuuuaccccauuaacaggaugcuucuguguuucuguuuccaccugguuuuuguuaaacaggugaugccacccccggucguccuagagaguggccacaccugguuuaggggaaaagccgauaugggugguagcucacuuguuucuccuggaguguucucauccauucuucccauugguaucaucauuccuauuccucccugaguaucuauuccccgcccuccuggcgugaacucaaacgacaccaguguuagugcggauaauacugagaauccuaucaggauggguaucauagaggagcugagcuuuacggcucuacuuggugccgugggcuugccuccuagaagcacggccuguccucugugcuccaagcuuccacagagggagcucugagucccucugagccucagccugcccugggaacagaaugucauccugccuacaggauggugggucccucaccacccucacacacugcaauaccgaaaggcuaaggagacuguuguacacaggaugccagaggcucccugcagguuugugcugcuccugugcuguaaauaugaggacagguuugugacuuucgcugccauggguguuggcucugacggcggcccaugucagcugucagguagagagcguuugcacacggugcagcguuagagcacaguguucauuuugagagccacuuuguacaugucccuucaccucaggugacggugacuucagggagcuguacaaucauaccuaagugccauauggaaacauggucuagaccagagagugugugggucauggagucccaacuguucucuugugcggugguggucuguguagauuuccaaggcacuacuuauauguugguaacuaggauugagcuaaauggugaaucaaacaguuugcaggguuaggacugggauaugaauuuuuauugggggcuccagaagggcauaguagugaccccggaauggccucugcuuuaggaagggccucugcaaaugugauuacgauuggugaucuugagagagagcaucauccuugguccccuguggcugauuuaacuucaagggcuagagcaggacucaccccuggccccaagaguugcugggccuuaaaccucucuaccuaucauggggcagugguguuuguuggagaauuauuuauuuuugcuguucuuguuguuguuauuauuguucuuguuguuuuuuagauagguucuuggaugucuuagaacucaccauguagaccaggcuagccuagaacucacagagauccuccagccucugccucccaaaugcugcaacuaaaggcaugugcuaccacacacuccugagaauucuugauauuuuacaucuuuagcacuuuuaguuuugaguccaguucauauuuucagggcuucgggccugcuuuguuuaagacacugaucuuaguguauuccuaagaauaguuuuaaugaaauguguggguccauucccaaccaucugucggaaggcugacaagggugguguguguggaaaaaaaaaaaacaacagaaaugcacucuggugccagcccacagccacccauuccugcagcugccaaggucccagggcccaggagacacuucacuuucuugccagcagcuauauuuuaacacagaagguuggugacuucuaacagaccuuuuccaguuuuccuaauauuauacuuucaauuuuagugguaacuaauucaauuuaccaguuaaaauuaaaaucaaaacaaagaaaaaaaaaaagaaagaaacuggacaugccuuaaacaugcacgugggaggccaagucaggugaauuugaguucaaggucagcuuggucuacacugcaaauucugaucagccagggcugcacaguaaacuccuuuaucaaaacaugaaaggaaggaaggaaggaaggaagaaaggaaagggaaagaaagaaaaggaagagagagaaagaaagaaagggaaaggaaaggaaaggaaaggaagaaaaagcgaaaaggaaaagggagcaaucucaaacaucaaauaugggcacuguugucuugcuauaaagaacaugcacugggaagacucacaguagacuuugaggaagacugagguaaaugaaguaaaaccgacccccgugacuaucuuggauauuuuugguacacuuuccaaggucuuuuuuuuuuuuuacugucaguggcuuuucacaaaaaucugugaaacuuccaaaaguagaaucaaacuuaagaauucugcacauuccaugagacucuuuccagccuccucugcucacuagaaugagggcuuuaaguacuggcucugggggaggcagggagcaaggguggucccgugggacagugugaagucccuucccgccaggcaugugcucugugggcguguccugggggugcugggggugcuuugguuuucaguuucagcuuuuaguauguaaaaucacuaacauuuauaaagugaagagaaagucugaggacgcccauuuugugauugaacccacacugugaacccacccugaccccuccugagccuauacccugacccccaaacccacugggguuggggcccagguuugucugugcuagacagguccucuaucacuaaguggcuucccagcucaguccagcaugucucaaggcaaaccccagacgucacugcauuuauaaaugacucaaauauaucucuagaacagcaguucugaaccuguggcuuguggcccccuuggggacccuuucacaggaguugucuaagaccaugggaaaacacagauauuuacauuaccauuauuuuauuuuuuuuaaagauuuauuuauuuauuauaucuaaguauacuguagcugucuucagaugccccagaaaggugggggggucagaucucauuacagaugguugugagccaccaugugguugcugggauuugaacucaggaccuuugaaagagcagucagugcucuuuacugcugagccaucuccccagccuucuacaucaccauuuauaacaguaacaaaauuacaguuaugaaguaacaacaaacauaacuuuauaaugcgggggucaccucgauaugaggaacuguauuuaaggaccccugcauuagaagguugagaaccaccgcugcagaagguaacgugggaaacagccagaauacccaugccacccauacaaaugcacaauuccguauaaccagacauuuagaauuccauuagacauuggaaguuucuggugguugguucugacuuuuggcuacuuggcuuccuugaaucagggucugagcacaggcauucugugagggcuggucgccuguguugcucaguagcuggacugauguguuugucuuucucuucuuuuuaacauuaauuacucuugauuuagaaccccuccccagccuccuuucucccugcaccguccaccaugaacugugguuuaucuguugguaucuuaacuccauguggaccuccagcacucugcagcaacuucaggccggagcuggagacuccggaggaccuccaggaggcucugagguagauacuucaguaggcauccauagcaauugaugccucucuugucuuuuuugaccuggaaaagaaucuuaaaagugacuggauugguuccaggaagucuuuuugggcuuucaggacaccgaugucaggguuguuggcacccgaggagacccuuuaucauugaggacugcacaguguuugugcacguguuugguagagcaccucugggcagaggugacuccauguccagugacugaguguccagggguuugguguguggcggaaacgaaagucuccaucagugugcaccugacuugcuaggagcugcaaugaugccuuuacguuaaguugauguauacauuccaacaugguugcuggcaugauauguuccaccuggcugcuggugcucacuuguucaaugggagcccuuggguggaagggcuaggucuuuggacuacaagacuacugcucuggacuacagugaauugugucuuagcagagcucuaguauuagauaucacaggucauggauauugucuuagucaggguuucuauuccugcacaaacgucauggccaaguagcaaauuggggaggaaaggguuuauucaguuuacucuuucacauugcuguucaucaccaaaggaugucaggacuggaacucaagcaggucaggaagcaggagcugaugcagaggccauggaaggauguugcuuacuggcuugcuuccccuggcuugcucagcuugcuuucuuaccgaucccaagacuaccagcccagggauggcaccaccuacaauggguccucccacccugaaucacuaauugagaaaaugccuuacagcuggaucucauggaggcauuuccucaagggaggcuccuuucucugugauaacuccagcaugugucaaguugacacacaaaaccagccaggacaggugucaucuggcuuuuucagugggacgaggugggaggucuuuuuuggacucggagccccuuguuucuguacacauucuuccugcugagccuuuguggcucugagagcaucugggcuucagacguggcucuguucuuccaccaccugugucucaggaacccagaguauuaugggaugugugccaucgcccacgccacuuucacaagugagaauaacaaugccagcaauguguuugcuagaacaguggguagcuugggggauuacacacucguguucuggcggagaagagccccagaguccccaugagcggugcccuuucccagaugcucuaccgacuggauucguguguucauuugagugauuuuguuucuaauuuacuucuucuuuuuuaauuuaaguuuuguuuuauaguguauuuccguuuuaaauuucucuuacuaguuauuugacagaaugugccucagagucagguugaauuuaucugacaugugucucaucucuuagugcccagagcuccagauugggacuuucugggguagguggcuaguaucuauuuauggguagagguuucuuucacugugaugaaaauguucuaaauugguggucauggugaaugccccugugcgugaguaagagccauugagccgugaaccuuaugagguaaauuguuacggaguguugugugugagaaguugccuuugccaaggcuuugcucuugugaggccuguuacagcaagaacuugugugucaggccugcaucucacccuaguucuaagcuuggcuuaccucaguuuucucuccugaguggcccucucuaucccuuccaccugcagccauugucuacagccugucgugcggccaacuuggguggucuuggggaaacagggcacacugggaucagcucuucagaauucccacccgagggcuagguuaaccuucagguuacccuaaaucugaaguagguaaaaaacaaccuggccuguguuuuucuugcaaucuggccuuagaagucacauagccaucugaggaucugggagagagagagaaagacagacagacagacagacagacagacagacacacacacacacacacacacacacacacacacacacacacacuguaguggcuauuccugguugucaacuugacuauauuuggaaugaacuacaauccagaauuggaaggcucaccagugacccuuaucuggaggcuuggagauccuuaucuugaucuugguuuggagaucuugagccauaguggcuauggauuccagaagauugaaucuccgaguuuaaggaacacaccuuuaaucugggcuacgccuuucaucugggauuaaagguguggcggaacacaccuuuaaucugggcuacaccuucugcuggagacaauauaaggacauuggaagaagggagucuagcucuugcucuugcucuugcuccuucgccugcuugcugugugagacugaguaacugcuagauccuuggacuuccauucacagcugugacugaacaauuguugggaauugggcugccgacuguaagucaucaauaaauuccuuuacuaucuagagacuauccauaaguucugugacucuagagaacccugacuaauaaacacacacacacaaacauaaaagcccagaaacaacacaguuucucaaguuacacuccacacaacuagggcccaaguuacacuccugaugcauagcauccagccauuucugggaccacacccagacccccgguucuucuggagaguggaacagaucuguggggaugggugaugguugcaaaugcccugugcuuuccucagugugagacuuucucccgucucccugcucucuacacagcaguuuucagcgcuaagccuggcugaccguggagaccggagacuguaggagcuucggugcccgcugccaugacaggucuuacacagcuccguccggggucaccguugguccuuugcucugcccacacuuuguguccaaguguuccagcauguucucccucucuuucugcauucgugggucuugaucuuuaaaagagacguggguaaaauuggccaagucacagugggcgccaggaggcauggugccuguggccugcagaucacagauucaaugauagguccccacuccuccucagcagcgccucacgugaagagauccucugcuuucagcucugagcuguuuacuuccacacagugcugguagggacgcaaccuaugaccucagaucugcuucaacaauuuaaaccccagaaagggagagcugccagcuggcccgaggcacccuggcauggagugcugugugcuguugacccggugcagggcuagcugggagguuaaaguauaaccuguugaugguuucugauguccugccuguuccaggugagaugucugcccaggcaggcugugugucuucaucacaaugucucugcuacacaccugucacauucacuguuaaacuggcugcccuuuggcaguggagcuguugcugugugaacucuagaacuacugugccaugcagcccgagagaacauuucagccccggauuaacuguucucaaccacgggcucccugagcuucuagggacaugagaaauggggccuguccuacagcccuuguuaaugucccuuguuugcaggaaaggagugagaaugugcaggcuuaaauuugguggcguuucuccccuccccuccccuccccuccccuccccuccccuccccuccccuccccuccccuucccuccccuccacucccccagucucucccccuuccccuuccaccccauacuccuguucacugucccaggauauuauuagaagaggguagauuggagaacaguucagaaaguggauuuuugaacacaaagaaacaaaaaucguucucccugcucugauguuguuuuaauguuguccuuuguuugcuuguuuguuuuuagaaacucaacaauccuaggaaauccccgcuugccaguguuaaaaccagucuguuuuugucuccuuucucuuuguuuguuuguuuuucucucucucucuuuaaauguagccacagacaguaaggaugaagaacucagagugccccccaggcggcccuaccuggguauguacuacugagacccugacuccauuucacccugcggccugucccucugucagcacguccaccucgagucgcuucaccacgcauggccuguucacggcaggacacacuuauuagcccacagcccgcugcucucggccuggacuauuuagaaccugccgauuucaagggagggguggaccaaagggaagaagaguggacguggagaauucaagauuacaagcuuggugcuugucacaagccgucccuacugauggugugcuaguggaguuacuaccccucaugcccucuucaagugcucacugcuaguaugcagagggagcacuggcuuugucagugugggcucugcugcagccuuacugagcucuguuggcuccggcaccgguuccuguacuucuagacuucuagagauugcccaccugaaaagucaccucaccugcgagaagggacagcauuuugcuucuuccuuccagucuuccagauccccugacuggacagaggcgagacaagacgugcgaguucugcucuuggcuuuacugaggacuucuggguuuugcaguugucuuuaaugcucauaugguuuugcuuugcugucaugaaugacgcugacccuggcucggcacugugcugugucuguggacaugacagccuuuuauucugcuuucauggggcuuugcgugugugugugugugggggggggucaaccuuuguguguugagcuaaguuccguuugaugauggugucuaguuaccucuuaacugccgggugcuguuugcugauauuaugcugagggcuuuuaaugucccuacucaugaaaaguuuuggucugcaguccuuuuuucuugauggcuuugguuuuauuuugguuaaauauaagccaguguuauucugaauacuggguaaugagguaaguuccugagugucugugaaaggccgccgucaauccucuugaaaguuuugguugguuuccuuguauggcugguuucaccugggcuucuucucuaacaguggcagcccuaccuuguucugcacccagcuagauucucugucacuuucgucaccuaucuuggcucaucuguauuguggcuugguuucagauucaucccaacaaacgucuccaguugugguguagucacucuucuucguguucuuuuuaaaucccuuuuccuggcccugggugccagggcuuuuauucuuuauucuggucauuucagucccuucucuuuccuuugcuucucuccuuacggacuugucaguuucgcugaucuuuucaaagagcuaacuuuuccuuuuguugauuuuuuuucuuuaucuaguuugcuucauuccacuuuaacccccccuccccauuauuugucuucuccugcuuuugccuuagcacuuucuucugagucccuugcauggaggaguauugauuucaggguuuuuuccuauuguacuaugaaacauguuuacagccaugagacuacuccgagaugguggacugaccuccuguguguuuuggucugcuaugcuuuuuuuuuuucuccuaucuuaaaguguuuucucaucuucuucaaaauuucucugacccacucacaguugaagaauaucuggcaaccuucucguuugugaaucccucaaaucucucugucaacuucuguuaucaucuauaguaacuguagagaaaugcguccauucagauccuccagagugaagcuuguucugggaccucuccuaaggagucucuccaggagauagaugguccuuguugcuauaggagcgucucagaugguccuuguugcuauaggaacgucucagaugguccuuguugcuauaggaacgucucagaugguccuuguugcuauaggagcgucucauuguugagggaagcgggugucuguuggguugagguuuacagcagugccguggucuucucuuaucuccuguuuuaucugcucaguuguaucuauuuugaaagcuggcaucgaaacuuccaaauacuuguuaauucuuucacuucugucagguguggcuuucuugauuucagagcaguuguuaggugcguauguaguuguuagagacuggcccuuuuguuauuacaaaugccuucuacgacauuuuuguuguuugaaggcccccuuccugcccaguauugaacccagggccucaugcacaggacacacuaccaccaaguuaccuccccagccuucucccuuuuucucuugaggcuggguucacuaauguugcuuaagccuugaauugacucugcagcccaagcaggccuugaagguuugacccucugccucagccucccaaggugcugaguaacuggccuaccccacagcugugcuugcaacuuacuccaauauuagcauagccucugugaaucccugugguuaugcuccgaagagcggcaggcagauagcaaguucaaggccacccugggcugcauuguaagaucuugucucagaacauaauuaaaaaaccacagggccagcgggccgguuaagcugggauugggugcuugcuguugagccuggcucagaacccaugggauggaaggaaagaaccaacucuuacaaacugauugcugauccucaccggggcaccaaugcacucacaaguagauaaauaaacguuggcucaaacaaagcaaucucugcccucuuaucugacucguguuugcugguuuugaucucugccugucauucauuugugguuuguguauaccugcucuuuuacagcuuuuauaguaagugaucaauuccuuuagugacuuguaacuauauagugauaacuuuuuucuuaguggguuuucugaggcuaacaguacagauuuuuaacuuaccagaaucuuuuaaauuuguaugaacuucauuuuggugagacacagaaauccuuguggaauuccucccuccuucuucugguggugugaggacuauguaugcauuuuguuuacggguguuacaagucuaaccgugugccuuugaauuguuacuuuguauagauuuugcuccuuucagagagaaguuaccgugucaaccuucuuucuguguguuggcuauccuguuuucugucuguggaacuuaguuaccaccgccaggccuuacugucuuccuguguugcuuugguggcuguauuauggaaggcguguuaaaacaccccauauagcaccguaacauauugguuuuugguacuuucuuuguaagccaguuaagaaaggugugugugugugugugugugugugugugugugugugugcucgcgcacauagggaauguuuuuucuuaaaacauuguuuuccaaugcagcucugacuguccucagcauucuacccugucuucagugcuagaauuauaggugggacccaccaugcccggcucccucguauguuuuuggagcaagguacaucauuuccuuuaugcauacuucauucuuguuaugagcauucacaugaccucuaggucacuugauuuccacauggaaagccacaguugcccaguucuuguuuaucuggggacauugguuucuucuccuguggaaagcuuccuccaggcugacgguugauuuuccuuucagcccuuugaaugccaucccucugccuucugaacuccauuguguccgaugagaagugguuggcucaucuuccuggggguccccuguaagugacaucucuguucuccugccgcuucuaagauuuuguccuugucucugacauucagccgcaccuuggugagguauugggaucuguguuucuguacuuggagguaacggagcuucucggguaggcgggaacccguggucacagugugagucccuugcccguuccuuccucuccuccucuucaggaugcccgcuaugccuguguugcugcacuuggugcugugucuguuucucagaagcacuguucauuuucuguccuuaggcagcagcaucuccguggaaguaucuugaaguuggcugacccuuccauuggcucagaucucuuguugagcaccaguaauggcucuuauuucagacacagccugcagcuggcuccagguucuccugguucucacugauugaucucccuuuagaaacauucuuaugccaagugagaugacguccucauaccucuguugguucuuuauauucuuuggauuccuuuaguucucacuguauaguuacaagguuauuuugaaguuuuguuuuaguuuguguuuccggaguggucuaacaucucuucacaaacagcuucuugcuucugguuguuguuacccccuccguguuuguuugcauacuggacauugaaaaguaacacugacagccguggcacuacucucaucccugggggaggcggucuugugugcuggucuccagguuugguugagugggcccggcggaguccaccgucucgcaggccugaugguacuagcugcugugcuucuccuuggucagcucgagcucugagcucugagcugccugcuccuuuccccucagcugcccacacagccacuagcugacacuucuuucuuuugcuuccccucgccuucaaaacagggucugguuauguagcccaggcuagccugguauccacugucuuccugucucaguuccccaaguguaagaaccguggguguccagacauaucugacucaacuuccuccaggucucaggucuuccuucuuuuguuaggacuaugugucuaggcuugccuaugcucugucucuuagggagggcuuugaacucucugcuccuaucucugucccuggggcagaaccacaggugcugcucugaggacagcucugcccugcucagccuucucccucugguauggaguccccuacucuguguacagugccauagggccacccaggauucucagccuuagcccauugaggagccccagcccugagugggcuggcugggguggagcccagggcagaggagcucagcaggugaggggcaugcugacuguggcagguuagcccucauccugccccugugcggggagcaucucccgccuccccagcuuucugcuccaguuuuucaagacuuccugccgcuuucuacaagugcuuaccugacuguucuguuuuacuucaaccccugaggcuagaauuagggaaggcaguucauaaaggccggccaugugcaucaguguuguucucugacagaggcguugaucaguguuuucaugguggcuuaguguuggaacugagaacuguguaccuaagacugcugggaaagcaggaaccuuaaaaccacuuucaaaugaaggcaccauuucgaaugauaaaacccuuuauucuggugcuagcugggccagagccuugcugggcccuuucuguuauuuuugagcugugcugucaagaacuugaaugggacucuucagaacagagauugcuauccuaccugcuacaaugauggugacacugaagagugcucugcaaggugacauggcaggugugggccacgguaccccccucucugcuggcucaucucuccacugaaggggaacccugcuaaggaaaaauguuucaggccaggcugaccacaugguucaguguugucuguccacaucauugacggagaaacuuggaguugaguuuuccaguccuuuguugcuauguugguaggauagagucagaaaggacuccugaaaugagacacagagaaucaccagcaccaauagcccauauauaacaaacacuacucacccuaguuucccugccucucagaguggcugccacagcaaugugguaccacacuagcagcagcacuaugagaaccuuauuuguguaaccucaaaucugagugggaugcuggccucgguggguugcuuguuuuggccaagcagugggugcucccagccaguuuccuggagcaccuggaguuugcggaagcugggagagggggcacugaacaugggcagcaccaggacugcuggccagcuuccuuagugggcuagggcuguguucccagaacauugauucugggucuccgagccagccucuggccgagcugcagccuauccuaucccuugucuguugugggugagggcagggcuggguugaguagggaccaccagucugaucuggaaggccaggaagaucauuucagcaguugcaggaggccuuggcuguucuccugaagacuugguguaucugaccuucagucagagagaaagaugaugcugugugggucaugugacuccugucaucucuccaggugagcugccaugcccuggaggcuuccugcagguuuccugggacuugggguucuaccuugaugucaguuccugugugcauuggcaggaaggaaggcugugcuugaaucugaaccaggcuggccaggacuagacccguguauuuguuuucucacgcgggguugguuuuuuuguauagauaucaucaccaaguuaaauuuggaccaugaugaaucuuuuccuugagccaugugaggcugaguguuucuucuguaacuacccagaauguugcucucagcaggccucaguaucuuccagacaaagagcucagauaaguugcagagcacguuuauugucuuaccuccaggagcacccuggucugcucuuaacuuugccaaacaugugcuggggagugcuuagauaacugucucagaaucucaggugaucugggcagagaguccugcuaggcuguagugaaagucagacguugcuguugaagagacaaugcagcuggcgugugagccaugcagagaaguguggguucauccaagaagaugaaaaagccaggugcaggaggcaauaccuggagugccacucuucaggagucccaggagucugagagcagccuggaucaaagccccaucucucggguaaaugaaaugaaugaaauuacccuuuauguuuauuuuauaaaacauccuuucaguacagucaacacagacauuguagaccucuuuuuuuuuuuuuuuuuuuuuguacugagccuuuggagucaggcaugugccgaguucugugccuguugggaugugugguguagugggcuggugggacccugggagaaggcggaggaagcagcugugucauagcucucugagaagggccuuuggguuugaaaaugaacaugcuuaucuaacucauagggaaagggcuugggagguggcucugccagacugauucuccaugaguuucugugcaugcagagcccuccucuguccagugacuugcccagcugagggcaggguacuguguucccuguuuguucugauugguuuaaggaaaucacccuugaugcugguguccccaggauggugagagcuguuguagauuacugacccagaggucugaugacuucaggcucauuucguggccgcccuguguggccuugcccaggggugcucagggaaagaguggucgguguuaguugcauccggugugaacucucugcucuccuagcuucacagaccaaggaguucguucuggguggccagcuggguuccugccauuuucaguccacaauccugacuugugucucugccacaagggcacauggagcagcaugugggccacaagagaccuuucuggagcuuggaagcugaguacuuuagggagcuggagagaagcauuccguagucccacucgccggguggagcugugaaguguuacccguccugcuguacugucacugggguggucucuucuuaccuagcucaccgguucuaacagcucagucuccugagccccuacuucauguuagugccaagcaucagcugccucuuucugcgcaucuucucacaggugagcccuacugccgggcggggcaggaccugaccuggagcagagcugucacuuccaaguagagagcccuguaccuuguuccucacucguucugagguucgugcugccuuuucaguggccagaugucaguucaguggcuugaacucuagguggggagcuaagagaacccaggcccuaacugccaggguuccugacacugcagagcacacccgcugcucucaggagagaaugcgaucucuucuucccuugcuucuaagggagugggaaggcuucgccugaauuggcacagacaagccacacgggggugcuggcgggcugccguaggaacacagauuguacaccacaggcgucaaagcugccccagguaaacucaagguggugguauccaccacugccccagagaugggcuguuaaggggaaacaaaaacuaaaaccaaacccuggccuggacuugguuucuuugugcucuugaugcugugauggccccggggucuuuuccuccucacaguagcauuagggcugcucugaccucaggggguccaggacgacuugaucuuaaggcuuaaggauguuggguuuucuuccguguguuuuuugaccacuuucugucuauucccuuugccuauuuauguauugggccauccaucuuguuguauaccauagacucagaaggacaggagggcuuucagaugcguccaucuuagguuauuaaugugucgguguccugcagagcucuuuaccuuucugucuucuggaggaaacauggggugcugugucauccccauuaucucuccauaucuucucaccgccuuucagggaccagguaucccgggagccaggcuugucccucaugugacccuugcuaccugcuguugaagggcugccccuggccuccaggucccggucaccacaugccacagugaugauguugcguugggcugcugaccucuuuccugcgcucuguuaggaaucucugaggguggaacacggagugucugugggguccuguagugcaggcuagcccugcuugccccugccuccccagagaaggcuccuuucgggacugggcuucuccucugaggggccagugcuugcuccuuaggccaugaucagggcacauuggagcugugagugaguccaggcugggcuggcauccagaaggcucuagaacggaccaacacuggaggccuuggcugcagauggcgaagguaacacuuccguuuccucucacauggcuuuagcccuguaguuggcccugucagauuucacugauguguugauaacacauuuaggcuuugggggcacuugccuguugcugaggcuggggaugggggauaccccagagacccaaacucaggaaggcagcucuuuguuguagaguuucuccuggguccaggcuuuaaugagacuuguaaucucugacagggugacuccucugugucucugagccuaguaaguggggugggcguggggcaacauccugccagguuagguaguaugugacacaaugagaugucauugauggugaccuggccucugcucucuugggguuuguccaggcuacuccuuuuuguccuggccuacuccccagaaacaaaaauuagcuuccuuagauaagcgaaccccuuagguaguauuaggaauggccuuuguguguguguguguuguuugaguaauuggaaguuagguguuccgccuccccacuuuuuagugugugccacaccaccaugccccgauuucuucuggaacagagggagauggcagucugcucauuccgacggcgacgaugcacaguucagaugcagaaaugcugaugcaggggaggcugaaacccugaaaaccccagggcugcagauuuccugcgauuugcaugugaaagucuauccaguuuucauuucagacagggauaccaggcuaaggaugcuggcuagcucuuuuccuuacuacagaguguauucagugggcugugguguagcucauugguagagcacuugccuagccugugugaggacuuuuucuuucccagcccccaaaguaaaauaacaaaaauagaaaaggaaagaaaaauccuaccucucccuaaaagcaggcaggcuuagcagaguuuagcaucucuggcaucucuuggcccugcccaccuacaccugcuggaauuuccugucuuggacuugggaucuaagagccaggucaggcacagccaugcugcauccucuccuacggcggguucccuucucuucggaagcuuccccacagcagcucccacggucuccggugaugcugucauuuaauucccucacggcaucgcuugugaauauuccagacucugucaucaggcaacacgggcucuugugccggugaccaaguacguagugacaguacugugugcugaccgagucccucucauggggggaaaacaguuaagacuuguagacugauccauuaaccguuagucccaggagguggguucauuaacccgagugaauggagacacaucguuaaccagaguuacagaggacagagcugucccucuaacccaggcaucagaucccagaggcuaugguacagucucuguguucuuuccuagaauauuggaauuaaccuaaaggacuuaacauugguaccaagagucccuagaauugcuucuguuggauugcucucaucagcccacacugaccugcuagcgucuccuccacacugacuggcuugcucccacugcuccucccuggauuugaaccauccacaucucccacacugacuuugagccacucaauuccccccucacuggccuugcccuggccgugucuccucucacuggccuugccccguuuguaccucgucaccacacuaaccuuggcugaccccacccacaucucucacaaugaccuugccuugucccaugguucaacucccugugcugacuggaccugcccaugccuuguugguaucucucucgccaggaaccccgaugugcucacccgacugaggcaccucucucucccucucuccuucccucuagacuuugauccucaccacuucuggcacuggagcagcuucucagacuaugugcaguguguccuggccuucacgggcguggcgggcuacaucaccuaccuguccaucgacucggcucuguuuguggagacgcugggcuuccuggcugugcugacugaagccaugcugggggugccacagcuguaccgaaacuacugccaccgcuccacggagggcaugagguaggggugcuccuguggagguucccacagcacucacuggggggaaucacacugcuuaaacacaaugggccuuugacucuugucuaagaagauauauuuagagggggacagggagggaggcagaaaccuucuguggaggccacagcccaucaggagcugcagagcuuuucaugcaggaccagauaccuauacaacuggaugugguaaggcauauaugaccuugccaaagguaccccaacuauggcuuuuucacagcgggacucgccaugaccuaccaaagcuacaaugucuggcagacgaggauagacugugucuggagacaucugucuagcacaggacgguucccauagaccauuggaaagucuugaagaaaacagcguuuauucagcgcaggucagcuggugaggaagagggaagaacacagccaugcauuuaaucuggcgccauccuuaaggaagccauuugacuccacacugagagcuucucagaaaccccgugcacuucugagacuccauccuccuucucccagagaccuuguccaguucucccuacccaccccucacuaaaguccauuccaccucuggcggccccccuuucucugaagguucauggcacccugugcacccuugugugucuuggugauacucugucgucaguggaaucacaggguccuguuuuguugagaaagccaaguccugguaagaagggacaggcaguggauagugcagagguuggggucaugccagauaccagguuuuaacaucccucuguagcucuucuuauuggauguaggguuggagggugaugcucgcaugcacuccuagaguguugguacaaguguaaagcguagaaguuaguacaggguaggcucgaacgugaugcuuacacaggaggggcagagauaggcuggcaguuaugaccacagugggucacgcuucccucgugaggauggguggagcccugaauugggucuggauuuauuuuuucuuaacaucuggugaagcugaagccaagacaaucccacaacucugguuuggggcugguggauagaugugcaggagagcaguagcucugggucugugucagugcaggucacagaggaaagccacaggaugaucucuggaggccauuaacuugugguuccaaaacucaaguguuaggugagccauuuucagcugacaguagagauguuuuagucagugaugcggagccaaggagaggagauauuagggcucccugcuggggcauuuucuagggccaggugcuagaaucucucaugggcacagaggcauuuguugaccaagcucccaauacugcagggauggugcccucauuauuaggauugcccacuaggaaucguaguuggguaugucucagguccuacuguguccccaccuacuggauggagugcuggacuaccacagcucuaugggauuguggcucuugaagucacacaacgugccauuucagauaaguuugauagagugcagauacuuugugggauugauugaaaauggguuuaagaccuguaugugcacacgcacagacacuucaaugcacagaaaacccagaggcugcagagagacagaaagaagaccguauagguuuuaucacuugucucuaaggaccugcucacgccauugcaccauagcggggaggaaucuacacugggacuucaguccaccuguacuuuauaucuggcuuccuggggcugugaguaggggaugggaggugaguggugggggagugauuaagaauugagaggaacuugcauucguuccuuucugacuaauuuuaguagcuucagagcauauuuccuggaacgucuuacucuauguacacauguguauagauaagugugcacacacacacacaucuacacauacacacacgcacacacacacaucucccaucuuggagcuauuuugaauaguuuucccucuugaaaaauauuaaccggcuguggcauuggagccggugaugaacgaugacgcuuuuggaaugacuuuacuaauuaaugcagcagaccucugcaaggcggauccugcguguguagggguguuugcauucuucuuccuccagguuuuacuagaauugaagacuguucccuaacaaguaauuacuggaggguugggguggguguaaacgagggaggaugccaagcguucggcagccgucaacagcacggaacaggagggaguagccgcggaaggcgcuggaagugcagaacagggagggagaggcagggcagagucugaagaaucuagcaaggaagggcuagcaaggaaggcagggcccuggggaguaaggauggaagccaugugagaacaggaugacaaagaggcaggcaagcuuagcccauggaaggaggcugagcuucaggccacuuugcaggacccaguugggacucugggcucucuugccaucgugagaugcucccagagacugggcuuugcuuauccuguggucaugccggucuagcugcagucccuugagcaggccgucgcauucauagccucuugggaaauccugcaccugggagaugucuugaucacugccagaccucuauagucaaccuacgcuguuugcucugugagaagaaaacaugcugcucauagugcccagaguggaaaggcagaguggaaaggccagguaccacccuggcuagguacucugcuugcaggauaaccugccugcagaguacccacuagagcauguucgugcgugcacaagcucugugaguagcguugugcucuaauuuuagcaucaucucuccacagaggugagaagcuugaacuuauuagcagcuuugcccaucugacccagccuucuccacaccaauuacuugcuuucugucuucccugauuugccuguucuggucauuacaugucuguggaaucauccacuguguagccuucugugucuggccugagccucgcuccuuucuacgacuucacgaugugggugcucgagauguuugucugucuucaguggacucgugcugucccgauuucauagauaaguucuucuagacaugccguguuuuccuuaauagagaaagcauguaggcagagaauggccaggucacgugauggcuuggggcgggucacgugauggccggggcggggcuaucuucuguggaauugcaggccuguauuccagggagcacauuuucacguucuacuaguuguacaggguggggggguuggaagguaggaugggagggguggggguagguguguguguggucuugauuccccauaguugcucuuauuugcuguuuaguuccaacgcccuggugggugugaagugcuuggcucagggugguuugguuugcauuucacugacaauuaaaugacagcgaaaaccuccuguggcccuagcucuguccuugaagcaguaucuuuucaagaucucugcucauuuuagcauguguauuuguagugucuuauuacugaauuacgguaagaauuuaaaagaggacagggaauuuaaaaucuguucagggguauuagaaucauaucaaauaugugauuuguuaauauuucucauguaucacacucuggcuuaccuuccuacucuuccaguguuuucuauccagcaccuaagcuuccacuccaggggugggaauggcucaguggguagaguguguuugccuagaaggcucugaagguuugauccucagcaccacauaaacuaggcauggagguucacagcuguaaccccagcauguaggagguagagaugggagccuuauaaauucaaggucacccccagcuauaguggggauguaauacuugggaggcugucucaaacaaacaaagaacuuucagcucugaagacacuguguguaucugcuuuuccuucuuuguuuaguuuuugguaucucaucuaagagaacuuugccuaacgcaaguuaccaaggggacacgauuugggugggccuugagagcagggccuuuggccuuggggcggggcuuuuugccuuggggcggagcuuugccuuggggcagagcuuugccuugggggcggggcuuuugugggcgguaguggugacuugguccugggcugaggucagcguggucagcgugccagugggcugaaguggaaggcaagcugagcaggugcagcaguuggcuuuucagucuugggugccagagagagccauuccugucggcugcccaggacaaggaugaggugaggggguauuuuaagagcagugaucuggcagccugguugacgcuggagccaagagugagguaaugggagccuagauuaaaacaguggggaggacaggaagggucaggccaggaggcccgcugaagaaacagcagucagcaccaggcagaggcagaggagagggacggaagcgggaacugcagccaugccugggccaccagcuauagugugaucuuagagcaggaaaucuaggucucugugaugacagucuugcucuacacccacacugauuccacugcaaggcugucccuacaggagagcggauauccuguacugugggagucucuugcuuagagaccuuagaccagcuguuuccuccuuccaaggacaagagaagaacuucuugggaugugguauauuucuaccacacucccacacccccagaaugcccuucaacucuucuuuuguuccuucuuuuuuuuuuugagacaggaucucucuaugaaguccuacaacuugauaauguagaccaggcuagcccuaaacucacagagauccacuugccucagccucccaguauugggauuaaaugcauauaccaucaugccuggcccagugaacauuugauccuucugccucagccuccugaguacugggauuucagggguggugccaugaaaauggcgcugacuaggaacauccugguguggaggagacccagcagccauugccucagagcaaacaaaccaguaagagucccaggauuguguacagcagcccuguguccugugauaugugugugugacacuguggucuccuuucccucuguuaacucucugaacaauucagagcacgucaggaccucagcacgguuagauuccugucccgggaacagaguggcguugacguuaccagggagcuaucuuucccggauagaggccaucugaaggaagaacggagguggcuaagaauaucccccagcacuggggagugccaugcuccagcaguuacuucaugucuccguuugcuguuacagacacaacuauguacuuggggccaacaggauguuaagagugaggacccugggcagguggccuggauagggacagguggccugggacacagggcuacagcuguauguccggugcuacggaccugucugugccagacuuuggagucaaacccaaggaaucccacacucacuuaguguaacacuggaugaauuauugaacacccucucccugugucuaacugagucgcguaggucaccucugcauguuuugucccauucagugcucaccagacaucuguaacuuugaggggcaaguuggucaccuuugccuccgggucuuucuugguuucuguugguuuguuucaaaucuacaugagucacagcuagaucugguuucuucuuaggccauggcauguccuuguacagcucaccugcugucugaccagggcuuugugccccugacuguaaggcuggaaccugagugcagcaccugcuuucugucugcaauaaguguauaggcaugacugucccggcauuuccugagggccuggacaggugugacugucacagaggccuucuggaaguuuggcggcuaugacugucuguccuaggagaauccugggcucugucugagagguaauggauuggaugcagcgccccuccccccaggcaguggagggaccccagcccucccuacauacucugcuccucuauugagggacugaagcucaggugugagguuguugcacaggugacccaacaagacccauauuuuguccccaccucccucuucuaucacccuagguguucugagcccagcaguguggcuuuaccugauuuuaaaaugcgaacuaaaagccgccuuucugggcuucacucucuuagaagaccguauggaaguucuuucuuguuaacuuaguauuguuggauuaugagggacacugucgccugagaggugagccucugggauuccugacccuagaugugucaugccauacagacugguucuauccaccugcagccgcagaccuguccgaccacuuguggaacaccagccaguggugaccuccacaggaccccauguuugcauacccuucagagguccuuuaccuggguuguguuugugcguggugucuucucaaaaucugcuuuuccaguaaugugauugguucguuuugagcuaagccuuguagcugaggcugguuuugaauucccuauccuucugccuccaccgccccaagugccaccacaccuggcuacaguaaggugacacugacguuaaaugacaacuuagccauugcuuaagucacaguucaagauaagagcagaccauuuuccuaagugucagagagaaccuuaggaggacccggagcuggaguggagggucagagugcagcauucugugguacuucuguagccagaucacuagaaccuuggcugugaugguuguuaacacggucagcucgacagggucuagaaucaccuaggagacagacuucuuggcauuucuacaagggaguuucucauugguuaauuggaguagagagauccacauucacuguggacagccgggguucuggucaggaugaaagagaagaaggaaaccgaggacagacauuucucgacagguauuucuccccugcuuucugaauauggacagggucaggaacagggacuagccgucucauccucuugcugcugugcccucuccaaacuguaagccaagcaaaccauuccauguauugcuugucaggcacuuuaucacaguacagugucuaacguaagccacugaggaugcuaacccaguucuuccccaucacuagaguuuccucagagcacacucagaucccugucuccaggaaggcccagggcagccacuucucacaaccccagguuugcaggugcaggaccacgagauuagggugugcuuccuccuguguucuggggugucugagccucagcacuggguugggcauaaagugagaaccauuucaggaaggagaaagcuggggcccgcagaggacaggaagcuuggauacugcagagagguggccaaagaaaguggcugugucuucagcgugagggaauuauccucugcauugugccaucagcugucugucuggggccaucagcugcaguccccacccuugaguugcuuuagugccacaggcuuauucugccaagaaagcuaggcuuuuuugcaccuaugauuuaggaaguuuguggcccccuaaugccaugugagcacaagggauguguggggacaagaggaaugauucugcuucucuuagaacucucuuuuuguuuuuguuuuuggagacaggguuucucugcauagcccuggcuguccuggaacucacuuuguagaccaggcuggccuugaacucagaaaucugccugccucugccucccgagugcuggaauuaaaggagugggccaccacacccagcuuagaaacucuugaagggaggccccaggacaguugcuuucugauuuguguguugucucugccuucucuauuccccucccacaucugcagaacccaguguuggggaccuacuaggccaggcugaagaacccugggguccuggcuucgccggauaccaacccuuguggcuggcuguaaucagaccauucucggggccuuguuagaguuauggucugacccauggcagucagaacucccagguccuggcaugugauagacugccuuuucucucuaggaccagaggaaggcgcaaggcuguagguuggacaggccugggucaggguguuccaucucuguggccuccaucucugaaugcgcccgcuaauccuuugggucacacuacugaccucuauacauaucccuguccuuggguuaacacugacugccccuuucuuuucuugcagccucaagauggugcucauguggacaaguggugacaccuucaagacggccuacuucuugcucaacggcgcaccucugcaguucucagucugcggucuacuacaggucaugguggaccuggucauccuggggcaggccuaugccuuugcucaccacccccagaagccagcggcccaugcagugcacccugccaguaccaaggcucucugaggaaucuagggagaacaaggacaugugaccgaccagccgugggugcugcgucccagucugugcuucugcacuggggagacuggcccugugcacuccacagaugggccagguguaggcagagauuaaguugagugccgcguccccaucagccuucagguggggggacucggggucaguggagcuagggcuggcucugugguguuuuugaggugauagaaaaggcaggcgucuggccuuaccuccuccagaaaaacacuggccugauccugaaauaggguugugccacugagcaagauggcagguacaggaagcagcugaguuccuuccucucagccagcuucccacagugagccacugucuccuagcagagcugguggcacuuuagggaguguguagucauggcugcagguggcuugucuguccucaagcucugcccugucuugcccuuguaugccauagcuaugucugcugcaccugugggugauggaagcugcuggccugacacuggucacuguauuuugcuccucucugagcucaucuugagaucauguuacacuugccagccuugugcugaccuggcuggcuccuggguccagaauguucuagaugcuucuauauaacagucucuucccuucugcugggcagaagaacuucuugugcacacgacgaggacgaugccauccaguuagcacaauagcucugacggucaugguggcucgccagauggccgaagaguccacacugugccaccuuuuggcuucccucggauauucuaaguugugugagcgagauucuugcuuacucuuuggccuguaagaugcuugugagauguuuauuuuuaaaaaaaaaaaaaacgaaggaagaugucuguaguggugauuaccuccaaaauaaaugccauugaaggcagcccuggcugcugaauaaacugaacaugcuucau

SEQ ID NO: 9003 - RNA, 2662 nt, Mus musculus
aagaaaaauccuuaaaaucuguucucucuggugaagacucuugcgauuguucuuaaaggcucccuggaugguacccaaucuugagugggcccaguucaagaugcuuaaugcaaucgcaucugcaaaaacaagacuucuucccuccacauacgauaccaugcacaacuaacugucagaaauuagggagaagcaccaucucuugcacagcucuguuggcuuccuugggaacacagggauucuggugcuaguggaguauccgugaagguccuugcacaacagguacucuagagccuagaccaaggcucagaacccagaucgggugauguuaaaaagcacccacagcucuacagacgguagcucucgccuuaccagagaguaccauagugugcaguacuggacgggaaaauguaagauugugugcacuugucugggcuccuggaggcgccucuggcuuaugcugugcagcaaaagcuccuauuuguguauccacagcccauggaauauucagggcaaguggggcggccauauguaacuccuaacaugcaucaugagagccaggagaggcaaugagauccuggaaacucuggagccuugggcagggguguggguguggguguggguguggguggggugggguguguaagagggugggggugugugcuaaaugggaacaccuacuuccccuucacccgguccugccauagcucccuugaguuuauucaucuuccuguuccuuccugguguagaguauugaguguguugauucaggaaguggcuaggggggcugugggccccgcuggaggauaaucgcuuccugucuuuuccaggccccuggacaaucaagcuuuguuuggaauucaucuuaggugagucuuaaaaugauuuccccgcaaaaccacccagguggggaacaggaccagaucuggugaaaagggagauaccuggugggaugggugggggucaguuguguucugggggcggggcggggguugcucugcucaaguacugcgccgaaggagaaugccaggcagaguucgauguguuuccuauuguugucaccgggucuggcaccucacugccuagguccccuacugacagguagggcagcucguucuucugguucaacuugcucagcccaccagggucuaucggagguuagaaguguacucgggaauuccuacgcucuuuuccuguaaaugagcacccagaggaugacugaccucacauauggaggaggaggcucagcaauuguggcgugcugacgccagccuuguagucgccuagggcagacagugaguaguucagcgaacucccaagcuccaguccuugguaaggguugccagcuccucauaggcuuguucagagacuuucaaagaccccuggaaucccggggaggauggcgucccaggccuagagcuggccgcugugacagcuuuuuccaacacccaguauuucaucuucagcugcuaguggcuccguaaggcaucuacccugugcccagcgcgcggcgcuagcuagagaccguucacguggucacuuggccugaaagcgccuccccguagguuuuuccuaaucugggacacgcagcagagcagagugcccgccaccucuucugucccacccggucgcgagcgcgcgugcgcgcgcgcguuaggacccagcgggguagccgcgggacccuggagugggcgugaccuccauugugacgccacggggcggggcuuccucuggcugggacugagggacagaaagaccgacuggcgcggcguggcugguaagggacgcggauucagcucacuuugguugcucuucgcugucgggcggagccucccugaggaacgugaagacuugggguccagguugcucugcuucccucugggccacgcguccaccccucccccacuagcugaacccguuuuggggcggugucaccccccgcggcuaucgcgcccgggcggugcaccccuuccuucccucuaacccggcggggugcacuccuaccugcaccugggcggcccgcagagggccaggcgcgcgucgccagcuccuuagccuuccuggaagcaggacggguccuggcucugcugggaacccucgccgcgcgccccggggagccugggcuuccgaagcugugggugcggagcgcugcgcucccaggcccugcuagacuccaggucgggcacaggugcgcccugguccagcuccugucagugcuuuaucuuuguuuccccuuccaggucgggaugguggcugacugcgcaggauagcggcggccauguggaggugacagucagcuugcggacucagagagcccaaaggagcuuggcccagguggauaucgcugguuggcagcgcggccucggugcuggcgauggaagcggaaggcuugggauggcuucuggucccgcugcaccagcugguuuccuggguggccgcuggggccauggucuucggagggguaguaccguacauaccccaauacagggacauccggaggacucagaaugccgacgguuucuccacccaugugugccuggugcuauugguggccaauauuuuacggauacucuuuugguaaguucagacuuuccuaccugggagugcugcuggagagauggcuuuguucucacgguuuucaaguggcagcgacuggaacuaucua

SEQ ID NO: 9004 - RNA, 3291 nt, Mus musculus
augaucuccgggguccaggagcaggagaauuugaacuugaccaaaaggaucccgaggacagcacaugagcccagagcuuccuugcggagcaggagcagcgcuucaagggacagaagucuuggaaucaaggggcuucccaacucuaaaaccauucgauggcaaacaugcgugggaucccccaagaaucgcgagguuggacaaccaucucggacguauaagaggcagcucaccuuccgcacacgcuagcccaggcucagaccccccucggcuuccagcacucucacucccggcggugccacuguacugaccagauguugcuguccgagccgggaggacagagaguuugcagaauuuggaacgcgggagccaggacccacacccgagucacaccggcgcccuaggagguuagagaaggcaagguggcaggacacccgcguguacaaagcgcgugagcgcgcgacugcgcguguaaaagguggguggggggcauucaccaucucggaccagaaagggaaccagagccuuggacucgccccagucaccuguccaccaaagcuggugcgcacagccuucaagccuggucccguccgauccgggagagccaugaucgcuucccggggacccugggccccgccgccggaugagaaccucuuucacccuccucucuccuucuuacccgggcuccgguagaaccgacgcgggcagacggggcggcagcaagacccagccuccagcggccgccagaagcgccaugaaagcgcagcacgcggccaagcccgauccuccggcuuccagcgcggggagcgcgggcggccccacuccgcuugccccagcccugcccgaccccucgagcgccccuccgugggcugcggcgcccgcagcgcagccaggcauccgagccaagcugccuucccgccgguggccguccgcggacagguguccagcuccgcucggacccgggcccggcugcacagaccucuuucacagcuacgccccugucccggaacggucccagggacucucggugcagacuccgguuacacacuguaaauucaacuuuaccuccugcccgggcucccagcugcucgcucugcgugccgggccguggcucuccuccggguggagcgcagcguccccagagcccacagcucagaguccggcaccgccccgugagccgcccccaggccgcccuggccagcgaguccccgcuacgguagcgcggcgcccccucgugcccagcgggucccagggcgaggcccccacuguggcuugggaagcuccaggcugggcucuuugggcacugugugggaccauggagggacaaaggcauggcuuccgcacccaggcacccaaacacaugggcuucuacacucacauucagccgcacucaaaaaggcacacaggugcacucacaugaauucacaagcucaccagaacucacguucaccacccauacacaccugagggucgucauacaaucacauaggcacacgcacaugguuuaugcauaagcgcuugaucacacauacaugggagcuaauagugcauacaugagacacacuggugcacacccucacacacagcuauuuguauagcucaagccaaguaaggaacccacucaccugaauucagagcccaugccauuugagacgcguggacuggccccuccgaagccgugcuccaggggaaggaaacaagcucuuucaaacaaacuccagagacauuuaggaugggaauguaguuuuccagucuacggacaaguuccaacugugagaucuggagauccagcaagcagaggcucugcgauccuuccuaugacagggguauuuuauggauccgguggcgggaggccucugguggcuacugugucacuguuugcauggagagggcgauauucuuucccagccucuguccuggauuaggccuggaagagaggcguuuucuccuuggaaaccguucauuggauuuagagcccaggcucuacuaacuacccagagcccaagucaccaaguuccuuccacaggaaauggcugcuucugggaucugugaccuuugaggcaguucuguuugucaacacaaucugucgggggcggagggggggcagaugcuccuggccagcccuguggauacucagugacagagguagaacgaacugggaacgccucugaugcauugauaagcagauugauaagcgagguaacucagcggaagcucucagcuagcgcccagcugcacacguucucauaggcacagacaauccaggugguuccuggaccgcuuauugucuggcccuauacuguucgucuugggaggaaauggccagguccaacugcacccuagccacccuuuuagacccucacuuugugccaagucucugggucacagugaccacgcaguggaacuagccugucucccucccccacuuuugaagauugucauuauccauuccugacacccugcacauuugcagacaacuugacucccagucuccaggucuuuacaucccaccuaggcaguuguugggauucauuucccugauccgauauucaggugguuuuuuucuuuguuuguuuguuuuggguuuuuucuuuuugauucuuugaaauguagauuauuacaauuuguuccuauuaaauuucaccuuguucauuuuuauuucauauuuauuuucgugagcuugucgggugcuuuaggaucuuagauuuacccuguucccuugucuccuuggacagauacaaacuugacugguugccuggcucauccucaguaugggucuugugcugcaacaaggccccgcacgggagugcagucgguguuucugacaagaaccaacuucugugggcccagauaucagugucggugcugguccccacuuggcuauccuaucgguccagcauuucccauguguuuuagaaggaugccagcauugauuuacuguccuccgaaacugaaauauaauugguggcacaauuaaaccuucgagucuacuaccaguauugcacacauaccaaaacaggaaagcgacccuagugugauuucaucaucgguguccaccacucugauuugguguuuuggagaucagcgcaaguaagcuccucugccuggguugcauaggagucuguguguccuugaucucucucugaguguccuuguguguacaccgaaaacaauggcaagaauuccauguugucuccuuugguaaucuaguuuguuauugggaaugccagacucacuguaagcaggaaaaaaaaaaagcuugcaaaacacuaaaauaaaaaguuacauauuuca

SEQ ID NO: 9005 - RNA, 1355 nt, Mus musculus
aaacagguuuuuccgagcauguguuuuucagguugccaugcucgcccuucaacgucuagauucuagaagggcugaccugauagauuugccagcacuauugaugcuuuggggacuacugacauccugagguccccaccccucccuuguuucggaacuuccacuuucuuucaucgcuugccagcuaccagaguaccucagggaaccagaaggaauucucuggugaagaaagcaguacauagcaggccccuccauagcuuccccaggccagcucacgccagagaucuaucugcuugcaugucucagcguagggggacauuccaugguggagacaagccuuagggaggcaguauucuggaguccccggaucugccacacacgacugucaaaugacaucucuugaagcuucaguugccuuuugugcccagggaggugaauaauggcaucuuuuucugcucacgggaaggggccggugugaggaguugucccaccugcuucacagugcucacccauugcugccauuggguuucuugugugucagcaucagguguuaaacugggccgaagguaauauuuucggcauugaugggagaguccucacuaugauuccagacaccagaguuuuucuccaccuggguaaauguucaucucuccuggauccucuggaucccagaagcaucuagaagguuccucagacaagugcuguugcuccaggagcaggaaugccuagcgccggguggguaaggggcccugccagucuccaggaacaauuccgacagagaucccagagggcgucagccacacuccugauggccaccagccacugaacuccuggaaugcgauggauauacuucuaaaugccacccggacuugaugguuuugugcuccacagccaacacaguggcacauuguucacuggcucacagaucugcagaaucaucagaaugcgugggaaagaugcugcguggaucacagcucuuugcucuguaaacuggcagauggggaaacaccccuaggaauuuucuggaaggauuuuaaccuaucuggaggaggacagcggcguuucuacacaggaaggacaaccaugcaugaacaugucgcugcuguugugucugccgugagaaaaagaagugccacaaacgcacggcccacacggccaccucaaggagggcuccuagcauccuccuggccuuggauuucuucaaggucuuuggcacuaacuagcauaaucuuuaggcucacagaaucucucuagcucuggccuuuagcuuuuucuguucuacccuauugacuuacuucaaaugaauaaugucacaacuuuuucauuuaaaggaggagaacaagcuuggcagaugauua

SEQ ID NO: 9006 - RNA, 199920 nt, Mus musculus
gauggcgccgcgcgggggcggggcgccgcccuggggugcgcuucggcccugacuggaaacugaguagacucggcugggagauuccgccgagcugaggcuguggggcaggcaggccggagcauggcggaccagauuccccuguaccccgugcgcagcgcgggcgccgcagccagccacagacgugcggccuacuacagcuccgccgggcccgggcccggugccgaccggcgcggcagguaacggcgggcccgacccuucccggcuccaaggggcuuccccgccggcccacggucugcacggagcccuugagccgggcgcgggcgggccgcggauuccagagcccggggccacgggccgagccgcacccagggauucggagacgccgcccgccucucccgucgcuucgggagccccaaaacuuagugugugggcgagcaggccggugacaggugccacucgccauagcgagggugacaaacacgccuggcagaucagcacugagucuuccagacguggagcgcuuguuaggcccacuuuauacuuagccacaaguguacacagggcuuucuguugacaggagguguucuggaagaguagagugaagguuuagagaggcuagaugguuuaguggggccauaguauagcaaugcagugaaauguccagaccuuguguuaacuggaagucucauacucacauaguuucuuacccaagggggcgggggggggggcgcgaaauacugugcuuuaugaaagaaacuuuaaaaugaagaguuaccuuguaguuguuaaauuuuaaauuuuguuguagacacacugaagaaccacccuaauauauagaagaagaaaaaaaaauaccgagcucacuugaguaguuucuuccgacucagagcuuuuaaauacuuuuuuuuuggggggggggguugaacauuuauuuagagacgggcucacuguguauccuuggcuggccuggaacuugcucuguggaccaagcugacgccgacgucauuagagauccuccugcuuuugccucccccagugcuuggauuaaagggggugcgucaccacacccagccuuauucuuuuugugaaaaccagguauugaguaugcuuuaagggccaccaggaugggcagcaacagaacuguuggaagucugguucuuagcuguucugagagacuuuacagggcaaguguucgaauguguuagagaacugaauuggaucuugguccugguaguuugaauugggcccauuucuuucucuauacccucauuuccucaucuuuacacuggugauucauaguuguuucucaugggacauuggcugaggauuacagaaccucuguacggugccccuuuuuccgagugcuugccuggagguggauacuccccagcuacccuuuuccuguucucgaugguaccagaugaguaauugccuaguagcuguguaagugauuaaucuuaggagcuuauuuggaaauuucauuuugucauauuuuggaucuucuugcuuuauauauucugaagcucugcugcuugauggcuauguauucaggauccauaucuuaaguguugggucgcugcuuuuauuacuuaauuuucuucauugcugauuguuuucuuuguacagaaaucuauguuagauauuaggacagucacuccugcuuuuuuggguuaagguuuauauacuguuagcuuccucuuguucauuuguuuuuguuucuggacaagguuucacugugcagccuuggcuguccuggaauuugcucuguagaccuggcuggccgugaauuuacagagauccaccugccccugccuccugagugcuggaauuaaagauuuguacuaccaccacuuggcuuaguguuaccuuucaauuuaucagcgucauccccaccccuauccugccagcccccuuuccuccuccucccuccccucuacucgucagggucugacaguguaggucaugauggccuagaaugccuuaaccuccuguguucacauccugaguguuggaauuacagguauacaccacuauaccuuaguuaauguuuuaugccuugcuuaguuuuucuuuuaaauugguauauuaagaccauuuauauucaagcugauuuuccauaaucagaaccuguuugugacauuuuauuuucuguuucuuuugauuuuuuucuugaguucuuuuggguuauugaacaauuuuuuuaaacaauuuuuuauuagauauuuucuucauuuauauuucaaaugcuauccugaaaguccccuauauccucccccccaccccgcccugcuccccaacccacccauuccugcuucauggcccugguguuccccuguacuggggcaagaccaaggggccucuccucccaaugauggcugacuaggccaucgucugcuacauaugcaucuagaagacacgagcucuggggauacugguuaguucauauuguuccuccuauaggguugcagaccuccuugguuuucucuagcccuccguugggggcccuguguuccauccaauagaugacuaugagcauccacuccuguauuugccaggcacuggcauagccucacaagagaaaucuauaucaggguccugucagcaaaaucuugcuggcauaugcaauagugucugcauuugguggcugauuaugggauggaucucuggguggggcagucucuggauggaccagccuuccaucugaccuccaaacuuugucucuauaacuccuuccauggauauuuuguucccuguucuaaggaggaaugaaguauccacacuuuggucuuccuucuucuugaguuucauguguuuugcaaauucuaucuuggguauucuaaguuucugggcuaauauccacuuaucagugagugcauaucaugugaauucuuuugugauugggcuaccucacuaaggaugauaauccuccagauacauccauuugccuaagaauuucauaaauucuguauccauuccucuguugagggacaucuggguucuuuccagcuucuggcuauuauaaauaaggcuacuaugaacauaguggagcauguguccuuauuaccaguuggaacaucuucuggguauaugcccaggagagguauugcuggaucuucuaguaauacuauguccaauuuucugaagaacugccagacugacugagugguuguacaagcuugcaaucccaccagcaauguaugaguguucuucuuucuccacauccucgccagcaucugcugucacuugaauuuuugaucucagccauucugacuggugugagguggaaucucaggguuguuuugauuugcauuucccugaugauuaaguauguugaacauuuuuucaggugcuucucagccauuccguauuccucaguugaaaauucuuuguuuagcucuguaccccauuuuuuaaugugguuauuugaauuucuggaguccagcuucuugaguucuuuguauauagaacaauuuuuuuaaaaagauaguuucacuuuguagcucaggcuagccaggaacucaauacauagcccagacuagucuuuagcacucacaguccuauuuuugacucauguauagugguuuucagugcauuucuauguauagcuauuacuuaggauagcucugggcauuguuauaguguauauauguauaaugcaucccaguauacuguuacaguguauauauguauauauguuauaguguauauauguauaaugcaucccaguauacuguugauauuuuaaggguaagauuugccucuuuauguucuuuuauccauuuucggguaauagacuuguaauguuauauguaaguuucacauuuuaaaaguauauaaauguuucauuuauguauuuuuggaagcccacaucugacaguuauaauuucuacuuuuucucucaauucagaaaccucaugaagaggaagucuuggauuauuaguuauugccuuuccucuugccugcuuauuuucugauauccuagaauuccuuauuuuugcuccauuuaaacauuguguagccauucuuuuccuuuuccuucaacugaggauguuuucccaucauuucugaagguuaauuuuacaggcauagcaacugucuccuucacaguuucacuuucugugcuuucagguuuauggguuauagacauccaugguuugaaaauauuaaauggaaauuuacagaaacaauuuagauguuuaaaauuaugcucugcucugaauauuuaugaagucuaguggucuuacuccuuccuucugagaugugaagcaccuccucugugcuuucucuaucuuacccaaugaucaaccacugggacguuuucucugcucuugugcuguuggcuuuucuggaaguucagugcuuaaaugauccccauuuuaccugauaauauuuccaaguacaaaagacaugaaucuggcaucuccuuagacauauauuguuacacacuguguuacaggaguguauguuaaaaauaucauuaccguguauauuguuuaguaauguaugguuucagacacccaccagcagacauucuuggaggaaaagaauaaagaacuguauugcgaccggaaugacaguccauccagcauuugaaaaguguuagaccacuuccuugagcugucgugauuucuggugagaaaucugcugucagcugaauuguuucccucaucacuacagccuuuaaagaaaaacucagggguuugaugauugcaguuuugcauggguuucuuuugacuuaauuuuuuuuucccuaguaagacuucagacuucuuuucuugagguuuuguuuuguuuuguuuuucccccagauccugacugagucauuugcuugugguccauguccuguucagauugggcaguuccuguuccaucuuguuagccagaucuuccuucuguucugcucugagccugccuuuuccauuuugaauuuucaguugguucuucuuccuguuagcucucuucauuggauuagcuuucccauucuuuacucaaguguucgugauugccccccccccccccaccuuucuucuuuuugagacagggucucuauuauguagcucuggcuguucuggacucuacauguagaccuaguugccuuacacucagagaugccccuggcucugcagcugcuuccucagugcugugcuuagucucucccuuguuucuccagacagggucccuugcugaaucuggucgcacuagcuggcuaggauggcuggauaaugagcucaaaugcccugcauuucuuuguguccucaucucagguuauagacagugcuauguaccugauauggaauucaggcaguuuaucaucggcagagcauuuuuuuuuuaaaugauagcuuucuaaaacucaugucagaguauuuuguuaucuguaauuuugauguuaacaucucugauucucuuuuucuaauucaaguugagauuuuccuuuuauucuguuuucauugcauccugaacauucugaguuuuaagugaugagauuuaauucuucauuuuaccagacuuccugugauaccauguuaguaguagguggggaauguggaagacacugucuugaagggccagguuucuugcauagcuuuggcaccugagaggagaaguguguccuguuugcucccauuugagaugcccacuagucuuugucuggugacugaagccugaaggccccagggaucugaccucaaaagauuucucauaucguauucuuuccuucccucuucucacccccuuuccacugugugugugugugugugugugugugugugugagagagagagggggggggagagggagagggaggggguggggggagauaucaggguguuguuuguccauguuuguuagugcuuuuucuucuuugaguuuucuaaacucaaaguggugaguuacuggcuuugcguagaggcacuugccauaacauaacagcuaaacuucauuguuuaaaaagagacucaugcugagaacagauggauguugucugauuaucugcaaaaauuaguguuucuugguagauguaacacagauuuuuauaaugcuggcuuucuuauuuugaggaucuauacauaauuucauuugaaucuuaaaaguuuuauaguuaugaucuaauauaggaauuauaaagauuuuuuucuuugauaacuacagcugaagggucuggcuuguuugugguguuggggauugagccuagaacuuuguguuaguggugcucagucucaacaaugagugcuaagauaaugcuauucuacuuguuucaggcccagaguuuucuuuggaguuucagaaguguuuauagaaauuaauaaagauuuucauuggaaagggauccauagaucaccuugaaaauaaguaauuuuuuacacuugucagaauaggcguguuucauuuauuuucacauaucucaaaguauuagugugaagauagaauugauaauaggguccauaacaauuauagacgacuagaauuuaugucccgagguaacaggccuuaaaaguuuuuauauuauguuuaauauuggauauuauauuauuaauucuaguucacaacauucuuucuauguauagugaugguauaauuucuuauuccagaauauuuuuagguuucuuauacaacuuuauagaaaucauugauuuauuggggcuggagagaugacuuaguggugaggaacacuggcuucuuuggcagaggcucuggguucuauuccccgcaucccauggcaguuuauaaucaucuguuacuacagucgcagggaauccagugcccucagguggccuuuaugagcacuaaguauacaugugguacagaggcaugcauggcagacaaacuacccauagacauaagaaauaaauauuuaaaagaugagagaggagggagggagaggaaggaagaggaggagagaggagagagaacuaguucaagauuguagucgcuuuucaccuuaagggacuggcuagucuuccuuauuguuccuuauuuuuccaaccaagacuguggcauguuuuccgauaccaucuccuuaauuacuuugaugaugauaguacuggucauuacugcuuuaguuguaguuuuagucuauuuugugcuacaaagcagacuguuucgagucuagguaauguaugaagggcagaaacugcuuucuuucuuaacaguucuaaaggcugugugggucaguguuaaggcagaucaauccaagcaugucuucuugcuguucuuucugugugucagaagagcaugaaagagccacucccauuucuguuggcauucacucuuugucuuuucaugcauuugguaaguucuuuguaccgacugugccucuaccuuccauaagccauuuucauggcaggggacagagcauuccagcccuagcacccuuuuugcuuuucccuguuagaggcaggggaggccggguuucuuauuagccucuuaggaaugccuccuggcugacagacacugcugcacugugcagcucuaguugauggaggacaucugcacaguuccugcacagcgcucacuggcugaguuguuuccuucucuguugguaugcaggcauccgaaaguuuugaacgucagauacauuuuagauuaauguacuuuaauauaaauucucaguauuuuuauugggauagaaacaguagagcugucagaugcuuaagguacuguguaagcguaagcugcccacuccuugaccucccucacaguccuggaaacucuauggucugcaguacuugagcagucuguugaaagcccguggcagcggcugagguggcauguccuccuugaaugaacaguacacuuggguccaugucauugcuucuguuuucuuuguucacauuguuuuuacucauuuaaaaaaaauguuccaagaauuauacuuaauuacugggaacgcugauuucucuugagugacaaaccaauuaaguguguaugacaccaggcaacaaagacacuuaggauucuaugcuuauccugccucugggggggaaaaauacauuauucaucaucucauuguuuuuaaauacuaaaguaaaauuuucaauacaauaggaaaauugcuuuggagggggaauaaauugccugccaguucagaggcuacauuucugaagucuaggguacuaaacuugguguugcucauuuucucaaccuccugaacuacugcugcuuuucuagagauaaaguugguacgacugugacuuucucaacaggaucacugagagaaacucaguggaaaaaacaaaaacgaaacucaaaucauauauauauauauguguauguguauguguauauguauauguauauauacauacacacacacacacacacacacugguguucugaaguuugauuguauuuggauaaauagucauuuuucuacuuuauguagaaacuuuguucaaagacauaaucuuaugcaggaaaagaaaaaggaccuuuucagggaaaauacuuucuucaggcucuuucauggauuuccccccuaaaucaccuaaaauguaauacacuguugccuguagccucaggagcuccuugcagagacucacucuguagaagucaggaugcuugacuuaggcugcagaagagaacuucaggccaagucagugugaaguagaaauacagauuuaagcuagguguuuguaaggaaagacaggccuaaaacagcuuacguagugacagacaauuaucuuuaaucccaagacaaaagaaguggaggcugacugaucuccgaguuccaggucagccuggccuacauaguuagacacugucacacacagacagaugcacgcaugcaagcacaaauaaguaaguaaguaaauaaauaaaaacauaaaacaguauugggcuccucaggucaaggcacuugcucugcaagcccaaggagauggaaggacagaaccaauuccuaaaaguugcccucugaccucuacauguauauggacaugucuauacauauauaccaagaaauuaaagaaaaggguagguaguauuacaugcccuuaaaugggcaugggcuucuugaaacaggcucauuuaaguuucuccauaaaaacuacuacauaauuuuuguggcuuuugaaauuauugugagaaauuaaaagauuuaauaaaaagcaaguuuuaguaaacuuuaucuaaggauucuuuuuuuaggaaaugagaucauagguugggauguguuuuagcugguagagugcuuaccuagcucugugaaacugaagcugggguuucuauccccauacagcuaaaaccauggugggcuuagaauauggagacaaggaguuuaagaccauacccaucuacauagugagucugaggcucacuaauuugggguacaugagauccugucuuaaaacuaccacccucccccauccaaaaucccaacaaauaaaagaaugagaucauaaggcgguuucugagguacauuaauaguuuauaggcucauaagauaagugcauggcuuacaagguucaaaggacugccuuacuauauaagcagaucagaccaagacauguuucuacugaaaacaaggucuugugagccuuucuugauucuccaucagcaggguuuaggagcuuuuccuuuccuaugauuaguaucccguuuuccuggcacggaccaacccaucauauguguguguguuuuauguguaugagugcuuugccugcauguauguauguauguauguauguauguauguauguauguuuguauguacucugugucauggugccuauagaagccaggagagggugucaggaucccuggaaauggaguuauggacaguugugagccccacgugagugcugggaacugaaccucgguccucuucaagagccauaagugcccuuaaccacugagccaucacuucaucccucccugauacauuuagccaggucuuuggucauggguaucauaaccuuuuccauuucuuugguuccucuuuuaaacagcucaguguaguuacaguugucuuuuuagguaaacuuguacacauguuuaacuccauggguaaaguucugcucuuuaguagcuguauaucauuguaugguaacaagaaggcuuguaauaaaucuucacaaauuguucacuauuuccaccagcaugaagaauguccauccaagacuacugagcauguuaaauguuaagaaucacuuuuuaaaaugguagauagugaugcaugucuguuauuccaccacuaaggaggcuggggcuaaggucucaagcuuuauuuaggccagccugagcuguauagugagcuccuaucucagacaauaacaggggaauuacuuuauccacuugaaaaacaaggcaaagcacauuuacauccuuuuuagaaacaauuauucucagguuuagaacuucuaaggaacaguaauaauuugaaaugagacuaaaacucuuuucugaugcuucccugguacugugugucuuguccaugauggccucuucauccccagcacuugaaacuaugaaagcucaacuaugaaagccucugcucucugccccuucuagaaccuucacuaguugacugcuuucuaguauauagggaaguacaacauuacugcugugaugauaccugauaaaaacaaagaaguguuuauuuugguccugaacaguauguauggauuauccucauugggagagagaggaaugugaggcuccuggccacauuguauccacagucaggaagcagagaggccauguugguacccaguauauuucauguaggaucucagucuauggaaugaauccacauacacugagaauggguuuucccucuucagccaaaccucucuugaggcauucuucucauggauauaggcagacaauaaagauuacccugacaggaaggcuuccuggauuuauuuucuuucuagaucucuuuuugugaguuguuaguuuacuuguuuuuauccuuuguguuugugagcuucauaugagcaaggcaugugugcugguuuaauguguagcacacgcgggcacugaagugucuagugcuaacguacuaaugugcuucagcauacuuuugugaauuugccuguauuucuuugugaauugccuuugcucauuugucaucugaagugugcuauauuuuuuguaagaacuguuauaaagaugacccccauccccaugcccacuucagugcugcagagcauagacaucugcagugccugccuggugcccgguagaagucagcacuuaguuuagucauugucaucaggucuccuagucucuagagcucuuaauugaagaaucaggagguccuuugcauucugcuuuuuaguaugugacauguucucuaggggagugguucucuagcuuccuaauccugugacccuuuacuacaguuccucacacugugacccccaaccguaaaacuaauuucauugcuacuucauaacuguaguuuugcuacuguuaagaauuauaauguaaauaucuguguuuucucauuggugaccccugugaaagggucauuggacacucaggggucaugaccuacacagguugacagccacagucuauaugauucucucucuuuuuuuuuuuuuuuguuccgagacaggguuucucugcauagcccuggcuguccuggaacucacucuguagaccaggcuggccuagaacucagaaauccgccugccucugccucccgagugcugggauuaaaggcgugcgccaccacgcccagcucuauaugauucuugaaugaaguugcucuuuugguuuuuguguaaggaguuacauuuuccuuuuuaucucauugaugauugguuuuggccuccacaacguguggguagauuuuaaagauaucuuucuguuauuguuuaaaaaaauaccuucugacaagagaauauaugugguaugauuuuacuuacuuuaaagcugacaaguuggguuuggguaaauaguauugaggucacagugguugauaguauuguguguuuuuagagcuucuuugauucacuuuucuauaaacagaagaguugugguauagagugggcuugacaauuucacauuugauuucuaucaguuuuguugcaugugcuuucaagaucuggugcuaggugcaugcuuguuuaagauuauuauauuuuauuggugaauuacgucuuuuaaauuacauuagucccagcugauuaaaaaaaugcuuuugggggcugaagagagaugucucaccugaauucaguucacagcagacauguuaggcagcuaacagucuuguguaacuccagcuccuagcaaucugaggcgccccauggcuuccuacacuaauuggcaugcgcacacauacauauacacuuaaauaaaaauauacgucuaaaaaugucuuaauugucuuaguuaauacagccauguagcuuucuuuugaggagucuucacacuaugucauuuccauucuuuuauuuuuaauuuuucuauccuaccuauuccuuuacuuaaggcaucuccuugagguguggugauuuuuguacuccagagacugucugacacugugaaagacacuguuggaagacuuuuccugucccaacaagggcugaugcuguugguauuuaguaccuagaacugcgguccuuuugaaguuagggugugcacaggacaacaguccacaguaaggaauggucaagauauagauugugcucugugaggcaccucagugaagguuacaauuccaaagcuaguuuagcagugcaccuugagcauuguuaucuucccacgucaugaaaaagcagagggcccaccacgucuuacgcuccuguccuagugggcuucacaguguugcagugagacucaccccacacagcugucauuuuacauugcauggcccugcacauguguaaagaacuuuuguuguuguuguucuuggcucuuaaaauucugaauuuccuccugauguuguuauuaucuugaaacuuugcuuagcauucuuuagggcagagcugcugacaaaaaaaaaaaaaugucuucuugguuuuccuucaucugagaauauuuuggguuguuggauauaacagucuuucugguauaaaccaaaguuuccagaaaaaaaaagaaguuacaucuguguaaagauguuacaaaacucagugacugaccaggacuuaaugauuauggaggguuaugaaggcuauuauggagggugucaacacaacacaggaggcccagagccaugucaucugugccuguuucaguuccuuuauaaacauuuauuucccauugugcgucugacccaacagucuuuaacauuuuuacauuuuuuaaauuagcauuuucaaacaauuuggaagguuguucuugcucccaugucucccucuguguccuucuacuuaucucccuucccaucccccaugcccuggccugccacauaauccucuucccacuuugaugucaccuguugccuucuuauuaaauacccuucuuuucuucucauggucugcuuucuaguauugaagccuccaugcuuguccccuuguaaauaagaguuuacaugggagagagaacaugugguuuuucugcauuagcucaggugauacucuacauuucuguuggcugcauuuuccugcaaaguuccuuuucuuuuaccgcuguacuaaucccauugugguauauauucauugugcguucuguaauggcugaaguaguuuccacucuucccagccgugaguauaacuuccauuuuccuauauucaacauuuguuguaucuuuucuuggugccauucugauugggcaucuugaaguaauuuugaauggcuaacaauguugaacacuucuaaacacacucauaggccauuugcacuucuguguuugaggacuaucuguucauucauuagcucuuuuguccauuagcagauaucucucucucucacuuugcaguauaauauauauauauauauauauauauauguauauguauauguauauguauauguauauguauguauguauguauauauguauguauucauauucuggauaauccugucuguaguacauguggcucaacuuuugcuggcaaaauuaauucucauaccauagggcaucugcuaacucuguugacaguuuucccuucgugaacagaaacuuuuaaaauuucauauugucucauuuguaauucuuagggcuauuuccuguaucauuaaagucuggcucagagaguacuugccugucuccauauugaauuauauucacuaucaccucccuugcuuuguaucaggguaaaccuuuaaaauguacacuuugcagaucacuaucuucugcugacguaaaagcuaaguaaacaucacagggcaucugauccuacagcagacucuuucuccugcuuugcuguaaccugccaaccugugguuuccaccaguguuugguaaaugacguagugaugacuuucuuugauucauaagaagaugaucuuaguguaucagccucugugguagaacguguuuuuaugggcaaccgaaauccauguuccuggacuuuagucccauuggacucacaacaaaccaucucuggacggucucuggaguaagugcuguguuuugggucauuccaguucuuuuccuuuggcuuuuuaaaaauuaaguuccucugucccagagcuuccauuuucuucuggagacgcuugcaguguuugaauacauguuccucuauauucugccagccauguuaguuuggaauacuucucucuuuauguggagaguaaauuuaagugcucucucccucuuucuuguuauacuugugggcucuaacugguucuguuuaccuuuuguaugaaucugggaugaaggaguugggguucagcuugaaccacuuggcugcagaaacucagaggugugguucauuauuuuucaaucugagaugaugccuuccauagaaacccauuguaaaauuaaaugaaauagcaauugaugaaucaucauaguaguuucugaaaaacuguuaucaaaagguaagucuuuugugucagauuguguuugugauugaagaccguguugaugguaggcugcuguuucuuuaauguaagagucauaguuaagugauagagcacuuucuagcaugugugaggcucuagguucagccccuuguaacacacacauguguguacauguaugcacacaugucuacacacaaacacaugcacacauacauacaaauacauagacuguugagcuugcaaagguaugccaguugaguuuuuuuuuuuuucauugaguauaauuuuaguauagguauggcagagaugcugaauaaaugggacgaccaugauugucaucucuaacaacaaacccaggaucgugcucagaacuuucacuauguagacaacugugcuuucucaaaagucaccuucuagaacuuuggugacuguacaguugugcaauacagaaucauagagauguagauuuuuggccacgaggauugcuccagguuauuuucuuaccaagcugaaugcagugaguggguuuuagacagccguggucacgaggucucccaacugcgucucucagaggucagucugagauuauagcauaaggauugucagcuccuucagcuagcacaggcucucuugcacaaccuuuuucuuaccuguuuacuauugagaauuaauccuccaccccaaagggaaguaauuucauuauguaguagguuucuguuuuuaaacaaugguuugccucaguugaaggcagcuuaguuugagaaaaacaaaaaaugaugucuuaguuacauuucuguugcugugaagagacagcauggccaaggcaacuuauaaaagaaagcauuuaauugggggcuagauuaguuucagagagugaguccacuaccauuguggcugggagcuugcuacuaggcaggcaggcaggcaggcaggcaguauaguaguagcugaaagauuauaucugaucuguagguuggaggcagagagcgggggugggggggguggggggggcugguaugggcuuuugaaaccuccaagcccacuuucagugacacaccuucuccaaggccauacuuccuaauccuuccuaaaacaguuccgccaacaagggaccaagcauucaaacaugagauuuuggaggccauucucaauucaaagcacuacaggugauuaguaaaauuuggccugauguuauuccagaugaaauguacuguaacagaagacugcuuagcucucuggucuuacuuuaacuagguaccagcuggaggaugagucugcccauuuggaugaaaugccacugaugaugucugaagaaggcuuugagaaugaugaaagugauuaccacacauuaccucgagcuaggauaacacggagaaagagaggacuggagugguuugucuguggaggauggaaguuccucuguaccagguuugucgucuguugcuaccugauuauuacauauguaacuuuagcagcuagcuuagguguuagguguuaugucuguuauguugguaugaagacuaaggaaaaugcugucauuguggaggauacuagcaacaucaguccacaucagaggaugcuguucugaaagggaaaaauacgauugauuauuuuaugagacauuuuaaugauuaaaaccuggggaaauuaggaacuuuguacugaugcauaguaaaaugucauguggaaugucgguguaaauggcauucuuucuuugucaaaaggguuaauaugaacuuuaaaaguauaauuuaaugacaguguaauuaugugcauuauucagcuuuaaugauuugacuuggaauagaauucuucuguuuaaucaaguuauuaaguuaaaaauucuucagauuucaaggcauuuccaugguauuaaguuaacacggucugauugccuuugacuggauaaagugcagcuguuugccucgcaugccaucccacggagucacguguccauuagacugaaucuuuuuuuuuuucuuuuuugguuuuucgagacaggguuucucuguguagcccuggcuguccuggaacucacucuguagaccaggcuggccucgaacucagaaauccaccugccucugccucccaagugcugggauuaaaggcgugcgccaccacgcccggcuagacugaaucuuuuuuuuuuuuuuuuuuuucauuuuuuauuagguauuuagcucauuuacauuuccaaugcuauaccaaaagucccccauacccacccacccccaauccccuacccacccacucccccuuuuuggcccuggcguuccccuguacuggggcauauaaaguuugcguguccaaugggccucucuuuccagugauggccgacuaggccaucuuuugauacauaugcagcuagagucaagagcuccgggguacugguuaguucauaauguuguuccgccuauaggguugcagaucccuuuagcuccuuggcuacuuucucuagcuccuccauugggagcccugugauccauccauuagcugacugugagcauccacuucuguguuugcuaggccccggcauagucucacaagagacagcuacaucuggguacuuucgauaaaaucuugcuaguguaugcaauggugucagcguuuggaugcugauuaugggguggaucccuggauauggaagucucuacauggaccauccuuucaucucagcuccaaacuuugucucuguaacuccuuccaaggguguuuuguucccacuucuaaggaggggcauaguguccacacuucagucuucauuuuucuugaguuucauguguuuagcaaauuguaucuuauaucuuggguauccuagguuuugggcuaauauccacuuaucagugaguacauauugugugaguuccuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguccuucuuaccaguuggggcaucuucuggauauaugcccaggagagguauugcuggauccuccgguaguacuauauccaauuuccugaggaaccgccagacugauuuccagaaugguuguacaagccugcaaucccaccaacaauggaggaguguuccucuuucuccacauccaugccagcaucugcugucaccugaauuuuugaucuuagccauucugacuggugugagguggaaucucaggguuguuuugauuugcauuucccugaugauuaaggauguugaacauuuuuucaggugcuucucagccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaagugaaguucuuugauccacuuagauuugaccuuaguacaaggagauaaguauggaucgauuugcauucuucuacaugauaacaaccaguugugccagcaccauuuguugaagaugcugucuuucuuccacuggaugguuuuagcucccuugucgaagaucaagugaccauagguguguggguucauuucugguagacugaaucuuuuaaacgaugaguugagaccauuugcacuuaagguucucauagaaagggguuugguauugucuguaaguuuuuggugauuuucuguuuuguuggauuauuaggauuucuuuccuuuuccugaguuaguuuugagggcauggggaagugcucaucuuguaagaugacaugaauauuauauuguuuuggucauggcaaucaaagauacuugcuauuagauacaauagucuaacuuuuaggagauaauaagaaagauaacccauauuuugggaauuauuuaauuauaaauuuuagaagauagauucuugacauguaaguauauuuuauuuaaugcuagaacacugcuuugauuguacaaacauuuaugaaaagcugauccuaaaacaugucaagggaaaguguaauuuguguauuauuggauuuauuuauuagaguugacagcauaaaguauuguguaugucuaaaaguguucucuguauaaucaguaauauacauagaaauguuauuaaggaacuauccaguuauucuucuagagacuuuuguuccuuuuauuuuuuuaguguuaucugauguuuuacuuacauaacuuuguccuuaaaaaaauccccauaguuuuugguucuuugcuuuuuuaucuuagcucuacaagucaguaagguucaaacauacauuuuuuggugagacuuaggguuucacauuguagcacaggcuggccuggaacucacuauguuguacagucuggccucugcuuuggugccagucuuccugucucagcuuccaaagugcuaggauuccaaaguguaacucaccauacccagcucuuagaguauuuuuaauuuuuuauuuauuuuuaguuuaugugcauugguguuuugccagcaugugugucuaugugagaugucagauccucuggaacuggaauuacagacaguuguaagcugccaugugggugcaggaauugaacugggguccucuggaagaacauccauugcucuuaacugcuaggccaucucuccagcccuaucagaguacuuuuuaaaaauauuuuugagguuuaugccuuuuucucugagcauuggaaucaccuaacuucuucugguggaauuuaugguugauaugaacaagugggauuugaggaggcuucagucuuugcacaccuccagccuauuaugagcauauuuguucaguucuauucaguacugugggacuugauacuuguucucuaacaccuauuuaauuucguuugugcacaaugacauaauuagcaauaacacauuuccuaaauuuacaacguauuuuuuaaaugcguagcuuuguauauuuaacauagaucugucuuuguauauuuauauaucagauuaauuauuuguagcagaucaaaauuuuguaauacaauguauuccugauacauuucuguugaauuuugaaaguggaaaagaagucuuuuuauaaguagcuguauucacuuugagguaucugacccauaguuuguccugaggugguguucgauuauaggagcuucuagaucucuuaugucccauggaagcuaguugaagaucugaguugucaguuuuaauuaaaauuaacaagucugugccgacuggauuguguauuggauagugucagugugaggucuuguuguaccaguucaguauucaagaaugaugacuuuucaaggacaccaccagaagaccuacagagucaacuaaccugggccaccagccagggaacaugcaggagcugggccuaggccccuaagacguuuguagcagaugugcagcuuggucuucaugugggcucucuaacaaguggauugcaugguugggccucaguaggagaggcuaugccuacuccugcugggacuagaugucccagggugggaugguaccuaagugaggggguggggugggggcggugcucccccuucugugagaagggaggggggugugggaggagggauuucuaaggcuggaccugggaggaagaggacuguggggcuguugugauggagauguaaagugaauaaaaaauaaauuauugggaaaagaagaauggugacuuuguaauagaauguucaaaggcauaggguaaugauagguuagcauuagacagaaagauuaauguccaaggaauauagacaaucaauguugauugcuaacuauguagacuuagguuagaccuuuuaaaaagccuauacaaccuauacaauauauguuuaucuuuuguuuuaugcaguugcugugauuggcuaauaaauguuugucaaaggaagaaagagcuaaaagcucgaacaguauggcuuggauguccagagaagugugaagagaaacauccuaggaauucuaucaaaaaucagaaauacaauguauuuaccuuuauaccugggguaagaugaucgcaucuucaaugucaguugauguccccagcguuugccuucugaugacacauguagaaacucugcuuguugauaacacuguuugguaguuucaucccaccccauuucaaauacuuuauauuuucuugguucugucuacuuaagaaaaugcauacuuuuauuauugcuuucaguucaugauaaacauucauguuauaagaacauaaaaguauggaaauaguaaagaacagguaaacauauuuuaguucuggggacauuugauauuuguuuggagggaaaauuagaauaaauguugaagccugccaaggaauuucacaaaggaaguauacgauuuguuggucuucaugugggcucucuaacaaguggauugcauggcugggccucaguaggagaggcuaugccuacuccugcugggacuagaugucccagggugggaugguaccuaagggggguggggugggggcggugcucccccuucugugagaaggggaggggggcgugggaggagggauuucuaaggcuggaacaagauauaucucuguauuuauuuauagacaccuuuuuauaucaagcuguuaaucucaugccuugucacauuguuaacucauuaguuacuuggaauacucaaguuuaaauauauuaauuaauuauuguuuuuacuacuuuaaauuauauuauaaaacuagguuuaucauuauuuggaauauuagauuaauuuuugcuuucuacauauuacuuccuauuuuaauaaguucauguuucuuuaugagaguaaagguagcugaugaggauuauaugucuuuuuauuuuacaguaauuuguuuucuuuccaaucauugauucuuagaaauuaagauggcuaucuguagaaaaaaauuauguaucuuauauuucuguaacaaaaauguuggcaaaguuuagcuguuaauucuuacucuauuuuguaagaaaagcucuuuauuauguaggauaaaagcugcuuuaucuuuuauguuugauaagguaauuacgaugaauuucuuuuggaccauaaugguccucccaacuccagguucccaaccauucacuaauaggcuugaucuccauaaucaaaagagcaaucuuuuauuaguagaauaaaauguaagcugucuuucagcagauaaauauucucaucuuuuuuugaacaaagcuacuauuucuccuuaagugugaauuauugaguacaaagugucuaagaaugaugcguuguccuaauguuacucaggucauugaguauuuuguaaaguauuggucauaguuaaagccaguaguguaacucaacuuugaugagugugcguacccacagccauuggcugcauucugagaauaccuguugauggcucugcacaaugccugguuacugugugugauuuccuuccuuaucaagucucugaaauuagucuuuucaucuaaaauguaguauuucagaaacauuuaauaauuacacaguaggaauucuaugccauuuuuagcacaaauggcaauuucugaauugcuaauagauauaauuugugcugagauuuuauagaaauugcugaagaaaaagagcuuucuuuccugcugagauuaauuuaugaaauaauucaaaacauuuuuagacagcaauugagcaugauuauggauauaaacauauugagugugacuguuucuguuacacagaguuguaugaugaugcagguacuucaauauguauaaacugguucuagcucucuaagccaacagaaaccauuuaacccacugauuucugcugaaauugcugugucuuucacccagcauaggagugccuuucaaggagauuugauuuacaguuuacaacugugcaagcucaacugaaaguagacugccuuuugaauuacuucuuccuuccuuccuuccuuccuuccuuccuuccuuccuuccuuccuuccuuccuuccuuucuuuccucccucccucccucccucccucccucccuuccucucucucucucuuucccucccucccucccucccucucucucucucucucucucucucucucucucucucucucuuucccucccucccucccucccucccucccucccucccucccucccucccucucucccucccuuccuuccuccauuuuuuugauagaauuucuuuauauaguccugucuguccucgaacucacucuguagaccaggcuggccuugagauccuccuggcucugccuccccaguacugggauuaaagucacaugcuagauauuauuauguguucuuaacuauaacuacaauagauucuuuuuaaaauagucuuuucuuuucuuugucucuuuucuuuucuuuucuuucuuuuuuucuuuuuuucuuuuugcaaugcugugaugaaaccuaggccucccucguguaugcuggcccaguucugccccugagcuggucucuuuagcugguacuuucuggagaagacucuauuugaguaaacaggcaaauaaaccuuucuaguuuuagcaguuuuaaaguuguuaaaugaugaaaauuauuucauauuugaaaauaaugugaaaaaucaaguacaaaaagaccuaaagaguauaugcuuauccucuuuauguguuaaagagccuguuuuuuuuuuuuucuccugaaaacucgucuguuguuuacuggguucuauuuugaaucagucaaguaucauguagucacuuggauccauuggcuuguuuacuauauauuuguaaagcucagugucugugccaaaaagcacacuaguaucuuauguguaugugugugcauguauguauauauauauguauguauguauguauguauauguauguauguauauacacacauucacacacacacacauguauauguauguacauauauauacacacacgcacacacauacacauaagauauauguguauauauuacauauaugcacauacacauauauauguauacaugucaaaauuaauuaauuuacucugaacaucauauuuuuacaguuggaaauguguuugcaugcuaauugauugaaguuuuaauacauuuuucuuaaagggguuauacuauuuucuuuauuuuuuuuuagguuuuguaugaacaauucaaguuuuucuugaaucucuauuuucugguaguguccugcucacaguuuguaccagcauugaaaauuggcuaccucuacaccuacugggcuccucugguaaaauacuucuauaguuauguuucuuuuuguuuguuugucuguuuuuuguuuguuuguuuuuauguguauuuguugaaauaacuuuuaauauauugcaugagguuuccuguagcagaauauauuuuauuuuuuaauauuuagcauauacuuuuaauauugaggugacuggaauaaaucuacuguauuugaacauuuguuaaagaacaugccgaguuuagugacuuaacucccaaguccuauauuguguugucagugucccugucagcauagcugcagcuguguauguccuuccuucugccuggguccugugcacccggacugggguagcaguagccuaccugcuccuguuuucuccugugcucugcagcuacagagcuauaagagguaaugguaauaccucuuauacauauauucugucuuuguaguuuuauaauuuguugauuauuuugguugcucuuuuuucuguuagaucagugguucucaacuugugggucaugaccuuuuuuuucuuaggggucaccuaagaccauuggaaaacacagauauuuacauucugauucucaacaguagcaaaauuacaguuaugaaguaguaaacacaaacaauuuuauggcugggggucaucacagcuuaaggaauguauuaaaggguugcagcauuaggaaggcugagaaccacuggguuagauaacuagaggcaauacaacagauacaauuauucccccuguucaaguguucacuucuccccaacaugugaccuuuaaacuugaagguccaaguagccuguucuugagcagguccaugcuggcuguguaugucccuuucuuaaccagagacuuccuagugaggccauaggccuuuguuccacgucaggcuuaguccucaucauucguaaagucauaugagguguuguuagugacugccugccuaccaagccauaagaguaggguaaauuugaggagcgccagcaacuuuccauaacuguauggaauauagacacaaaguucugaguaaacgaaugaaaucagauuucacuugauagaaguuaggcucaaggagacauuggcacugaucugggagcaaaagugacauacggcagucugucuaucugggccaccguugcaggguugucaguguauauggaagaccuuuaaagugaacuuacuguuuugaaaggauuuauucuuuagagguguggugauugguaagacaaaagaaugcuuaguauuauuuuugaguaaguuuuaaaauagaacugcaaagacuaugaaaccaggaaggaucccacaagugggacagagauguguuggggaaugucgggagaccaguggggcacuaaggcaugagagcagaaaggaagcaguagggaguggguagagguguauaggguaggggaggaccauagaggauaagagccugacaagguuuguuugaaaaugcuguaaugaaaccgaacacuaugcaugcuaauaaaaaaauuuaguguguguguagggugaauauacaguucuuuugaccagguuuuuuguauacaguacuaguauggacaauguugauacaucagugaacaaagcuagacaaaagcuuauccuaauagaccuucaauugucagggagaacacagcccagaaacagcuacauagugcuagguuucuuagucauggcugaaaagaagaaaauagaaaacagaagaaaggguaaaagaagauagaaguagguuugguaagauugggucaggggagguauuuuggagugaguggcaauugaaugacaagauaguuggccuuguacagaguaggacaagaguuucaugcagaaggaagagcaguugugugugugccaugcuuccagggcaugagcuggcuguccugcaggagagugugggugggaggauacagaggucggguaggcuaagagagguaauggcuuaguuucuccagggcaugaacauguggcuuacuauagcagaacacuaugaauaaggagacaguaccugagacuggagagaacaucugugaauggaacagggugggauuuuucucuggaugaauguaaaccagugugcauguuuacacagaaaguagagaguaguuucagauaagugacuguggugguugaauauugauuggcaacuugccuggauugcuguaugcccuggagguuaggaaagcacauguauuugugagauaauuagauguacaccauggggccucugguccagagcugcucugcucucugcugugaugggcugacacaugagcuaaaauauaaaaacaaccaucucuucccucaguugucucucugcgcguguucucacagaggugugacgagagggguagggauuguauucuuccaccucuagagguaucuuuugaacugaauaugagguuguaauuuucugcauuucuuaguaacuuuuaugacucaggaauauaucauuaaaauaacgugcacuauugucuugcaugcuuuaaaauuauuuuaugaaagcuaccuuacuuugcaacauguuuuucuggcuaaacauaaacuuauaaaguuaggccauguuugcacauauauauguauccauuuuguuuuucauuucucuauuuuucuaaaaaauaagauuauaucuuauuugccuagucucuugauagguuguuucuaaauuuugugaguagagauugcuguaacuaauaauuuguuuauucauaacucauguacauuuggaaaacaauauuuuaaauguuuuauugauuuauuuuugacacauuucucacuauguaggccuauguguccuauaacucauuauauagacuggccucaaauucccaaugaucugcuugccccucucucccagugcuaagauuaaaggcacauugccacguuggacuuauuuugauuacuuucugaugaaggcaguauaacauuaaagaaaacuuuacaacaggaaaaguauuugauaauaauacuuuauaauguuuauaauuuuaauguguuuauuucuugccucuuuuucuauaguuuugcuuaccauuuaaauauuauuuguaguuuagguuaaaauuuauuuuaacguaagcaaugauaaucugaaaaugcaaauucuuaaaaaucugaagcaagguauauucagucauuuugcuuuugcucuuugauuuuauuauuaacucugguuucacuauuuuuuuaaaacauuaaauuuuuguuguuguuguggaucaaguuucaguuuguauccuuggcuggucuaggacuuggcugauauguagaucuugcuggucucaacucauagagaucugucugcaucugucuuccaaugcuuuccuccaggcuuaaguaaaaaggagauaaccuuuuauuugaauacuuaauaaagaauuuuauuugauauuuucauaaaguugguuauuuagccauguuuggaauggguguauguauuugugugcgcacgcgcgugcccguguacauucuuacgccugcccagagcauauuguacaccacggcagcuuuccuuguuucguguuuguacucauuuccaacucugguuccauuuaagucaguuagcuugaauuuucagguauggguuuguuuuugaagugcuuuuuaaucuuuuggcauguaagauuuaacauuaauuguauuuagauaaguauuuuaauuaauauggaaccaucucauuauucauguaaggaguagaagugaaaagcccuuuugugugucacuucugacaggccuuuaauucuggugucauaguuagaucugagaacugagcuauuuuuaugauguuuucuuuuguuucuugguuuugcaguagcaaaauuuguaucugagggauaagaagaaugacucugaugaauauuugugcugcuugcauguaucuuauccuuugauuuagcagaaaucuaaacgagugaacacauagguucaucuucgaauucaagagacaggcuucugguauguuggcuuugaaauacaaacuuaccaaagaaauucuaaaaacaaccaugugggauuuauuauagaauuauaagauaggcucgguauuuuuauuauuaaauauuguuacuguaauaaauucacaaauaaagacaucacacagcuagauuaaggaagucagucacccuaacaugugcccagucucgaacucuacaucucagugaaauagagaauagacauucuaaaaccaugggcuuuguuuaguguuuuguauuuuauuuagaauuuuaugcacuuacuuauuguucuagaccaaaaaguuuauuccuuaguaacagcuaagggggacagcuaggagaugagauaaaaagaguagaaaaccugggguuaggaggucuuacacaagauaugucuuauacaaaacaaguuuauuaagaaucacauguacaauuugcaagggagaaauggaacacaguaagaagaaagcugucauacaaugagaugagguuugcaggaaacuaaucaggcaacguugcacaaagguuacacagguuaccucaagaccaucuaauaaccagaguuagguucucaggauuuagagccuccauucucccaaaacuuuaacuccagugcaguauugguucugccaaguauauuccugguuuuagagaacagucuguucuuuuucaguacccagggccucagggaaagccuagugcucaauagcauuaaaaaacaacuccuccccccuccaaaaaaaaaaaaaaaaaaaaagguaugacaaaguugaaacuaggaaaacuauaagcuuuaugacuucuugugcaauuccuguaucguuugucucuauucugucuuuucucaucaccugauuuuaccucauuuugguuuucuuucuaaguguucugcucuacccacacucaauucuguuuauguauguacauauauacauuacagguuuggaucuacauauaagggaaaacauuuuuuuuucugaugugggugaccuuucuuaauacuauauaagucuguccauuuucuguuaauuucaugguuucauuuuuuuuucuuauagcugaauaacuauuuuuuuaaguguccaucaucccuauuugcuagggaaaugcucuuaaaacuaccuugauauaccaccucuccugagaaaggaugcuuaucaucaagaacuuugucaacaaauguuagagaggaugccacucuuaugccacuauuauggaaauuauuugagagguuccuaaaauaaugauaaauagaacuaucaugugacccagcuauuucacucuugggcguauagucauagaauuccauagccuagcauagagauauuugcacauccauguuuauugcuguuuuauuuaugauggcaaugaaauggaaccagucaugguguuugucaacaggugaauggauaaugaaaauauggaacauagaaaauggaguaauaaucagcuguaaaacuuaauuaaaaaaagauuaaguucacagauauuuguaaaucccuuuuuuuauuaaaauaaaauuuaaaaaucuuaaccagaaaacuaagaauauagauucuauaaucuguauauacaucuuuuuaaaaaauguccagggcacauuuucuuuauauacauuuuuauauuuuaaaaucuuuucucugcuugcucucauguuuggucaggucacauugcucagagaaugauguuaauuagcauuucuagauuucucuuaucugaaagccacuaaaacauaaaaucaucuuuuaucuggugcucagaaaacugagagucuacuguccauuacuuuauaguaaauaaauuacuucaagcaucgcauauucccucuacuuuguaacuaauuuggaaauuuuaaauuuuauuuaugaauacggguguuuugcuugcaugugugucagaagaggacauuggaucccuuuugccauguaugugcugugaauuaaacccauguccucugaaagagcaacuggugcucuuaauugcuugaugcaucucucucauaccccccaaacugcaauacucuaaaaauuaguuuuacucucauugaugguacuaauuagcuuuauuucugaacugcuuucucuugcgcuuucccauaugcccagaaacauaaaacgaaaguaaaguguuguuguuuuuuuaacauugugggucagaauaaaaauuauuuuuaguuagugagggugacccgagcuauacuuggagaagacucuuguauuuguauacauauguuuauguguaucuguuguauguacuugugugcauguauguggaaaccagagaucagguuugggugucuuucuccucugauuuugauccucauggacucuggugagcaaaguaugucugccaugcucgacuugauauccuuggaguagauacacaggagcccaguagcugggcacaugguagcugucuuucagaugcccuugugcugucuuugcgguagcuggacucguuaugugagcaguguauggggaucccuuuguccacauccguaccagccuuuguguuuguucuguguucuccccuuuaacugauugagaguagauguuuuuuuccccuuacaaaguguaaacuauguaaacugauuauaguuuccuuuccuucuacugcacccagcucuuucccaccugcccucccauccagauccacccacuuuccuccucucauuagaaaacaggcaccaggagauuguggggcacaccuuuaaucccagcacucaggagacagaggcaggaggaucucugaguucaaggcuagccuggucuacagagcacauucuaggacagccagaguuacaaagagaaacacuauuucaaaaaaaaaaaaaaaaaugagagaggaagggagaccagaaggaaaguaggcaggcaggaaggaaacagguuucuaugggaugguaauaaaauauaauaagauaaaucaaaaacuaacaugcaaguuuggaccaaagaaagagcccaggaggaggcacaagaaacucagacccauuucuucauaugcuugggaaucacauaaaaacaguaacuagaaugcuaucaucgguaagguuaaaaaaaaaggguguguauguguguguguauacauaaacauacauacauaaugaaaauaaaaauaguggauaagauuuuaaaaagaagauuccugauaugacauuaugagacagggaacccccaaagaugcucuugaguuaauuuuuauuuuggccaccuacugcugggcaugcagcuaccuguaagaguaguuuguuuccccagugagacucacuuggagggaacuaaaucuucauuuguaaacaauuaucaacugcagcuagaucuggguuagggaugggggcauguguccacuucuccuuucagcucuagaaccacaucuggugcaggcccaguggauggcgcuucagugucucagugucucaaguguguugugccuguucaugcagagggccuuguuuccuuugcuguccuccauccccucuggugcucacacucuuucugucuuuucaucuuugguauucccagagcccuuggggagaggagagguuggggauuugguggagacauccuguuuagggcugaguguuccaagaccuuucacuacauaaaugucugcuugugagucucugcuuugugcuucucugaugaugacuuuggaaggugcugaucuaugaguguagcagaauaacauuagggguuacuuuauugcuacaauuuuguuugguuguucauuuagaacaauaguauuugguuucaccuuaggucucugggcuauagacucuggguuuuggucauccaagcaguguuggauauggauuccaucuuguggagugggccucaagacaaagcagaaauuguuugguuacucuaacgagcuuugugccacccguugugcuagcauaccuuguaggcagaacacuaucauugaucaaagggguuguagcucuguuccucucuucuuuucuaguuuuguuaauuuggauauucucuuucugcuguuuuagguuaauuuggauaaagguuugucaguuuuacugguuuuucucaaccaguuauuuguuucauugauucuuaguuucucguuuuuuuuaauguuucuuuuuuauggauuuuuguuccuaaguuugauuauuucuugcugucuucucuuuuuaggugugauuucuucuuuuuguucuagaguguucauguguuguuugcuaguaugagauugcuccauuuuuuuuuuuuuuuuuuuuuuuuuuugguagacauuuaguguuaugaacuugccugcuagaacuuccuuccuucuuugugucccauaaauuaggguaugaucuggguuuucauucaauucuagaaagucuuucuucuuuuuuuucuugauccauuuuucauucaagaguuguucauuuuccuugaacuuaaaagcuuucuauuuuucugauagaaaaaaaauagucuuguugauuuaguuuauuuacuuuauguccccccaccccaauacccuucccaaccccuccccuccccuccuccuucucuacucuccuuuuuccucugaagaggagacaccuucccccuacccccaccaacccacccuagcccaucaaguuacugcaggacuaggcucauccucuccuacugagucuagacaaggaagcccaguuaggggaauaggauucauaggcaggaaacagagucagagacagcccuagcuccaauuguugggggauccuaacaaagacuaagcugcucaucugcuauauauauacacauacacauacacauacacacacacacacacacacacacacacacacacacacacacauacacauacagggaggucuagguccagccugugaaugcuccuugguuggugguucagucucugagagcccccaaggguccaucuuguggagucucuauccccucuggaucccuugauccuuuucccaauucuuucacaagacuccuugagcucugucuaauguuuggcugugggucucugcgucuguucccaucaguugcuggguagaacucucagaggacaguuaugugaggcuccugccugcaagcauacuagagcauauaaaauaccuuuuuuuuuuuuuuuuugucaagcaggucgucaauguggauaagaaaucagcuuaagaaguaucauuuuuuucuuuccucagucucuuuuucucuucuuuuauauucuguguguaugaacauuuagaacuggaguuacagggugcuguaagaugcuauauaagaauugaaccuugguccuggaauaguaaccugugcucuuagcuccuguguccucucaagccuccaauuuuucuuuagaugauguuuuuuuauaaaauuuaauucauugugccuuucauuuggauaguuuucaacuucuuguauuugaaaguuuaaauguacgcaaugagaacuaacaaaagaugaaagguaucaagaucaaaauaaaaaugaaacucacaggaaauuguuaaauauguagaaauuugcaaaaacagcaguuucaguagaauuacuaaucaagaggaaguauaccuggaagugaauucaaguuauuucuaagagaacauaauuuaaaauauugucauauuuugaucugauguuaauagaaucaaucaugacauuuuagguuuuaaauauagcguagauaacauuuacugugauuuaauuauaggguaauuuucuguugaaaguaauuuuucccugucacaggccccuuuucuagcuuccuggcauuuacccucccucccucccacauaguuucgcuuauauaaaacccgaaaagcucagcuacacacaugagaaaaacacaugcucuuugucugucuaagccuggguuaccucacuuaaugcaauguuuuccaguucugugaauuauccagcaaguugcauaauuuuauuuuucucuagcugaaaaaaaugcacuggguguguguguagcacauuuuccuugugcuuucaucuguugguggacauauaggcugaaucaauuucuggcuauuuugaauagagcaguguucagcauggauguggaguggauacaggaccuuuggaggaugcuugggaguuguguagcugggcuucauugaaguuguguuucuagcuuauugagaaaccauggcuugacaguuuacauccccaacagugguaaggaaguguuuuuuccucacaucuucaccagcaucuguugccuugugauagcuauuuugacugggauaagauagaauauuggaguaguuuuaauuaguauuuuucugauguauaaggauguugaacauuuuaaaacuauauuuuggcuauuuuaguuuuuuuucuuuugagagcucucgguuuagcucauccuauuuuuuaauuggguuguuuuauuguuuaguuuucugaguucuuccuguguugucauugauaagaaacccuacccccccccccccauguguuggugccucuucaugugauuagccguuuauuuugcuguacagagcauuuuaauuucaagaggucccauuuguuaauauuggccuuauuuacuacaacuggaguucugugaacgucucgccuguacccauaucuugaaauguuuuucuuguauuaguuucagagauucagauugaauguuaaaguuuuugauccauuugaagucaauguuuggcagagcgaaaaauacaggucuacauucagucuucuacaugucuauccaguuuuccagugagcauuuuuggcaucuuuuuugaaaaucagguagcuguagcugcaugaguuuaugucuaugcuaugcccuugaucucuaugucugcuuuuuuuccagcacuaugauguuuuugucacguuuucucuauaguacaacuuuaaaucagguguaguaauaucuucaguuuuacuggggugugugugugugugcuuauguauguguguguguauuguaugcaugaguccauaugccauguguaugcauggagaccagagaaguauggugucugugcuuagugcuguugcacugagacacguucucugaaccaggagcaugucuuugcagugaggguggucagccagcaagcucacagaaugugccaauuucugcuccccagugcugggguuauagggaccaauagccaugccugacauuuuacaugaaugcugggcauuccaacccaggcucucaugcuugcagaaguagugcugauacccacugagccgccucuacccacugagcccccucuacccacugagcccccucuacccacugagccgccucuacccacugagcccccucuacccacugagccaugucuacccacugagucgccucuacccacugagcccccucuacccacugagcccccucuacccacugagcccccucuacccacugagcccccucuacccacugagccaugucuaccuacugagccaccucuaccuacugagccccucuacccacugugcccccucuacccauugagccaccucuaccuaaagagcugucucuaaccacuaagccaccucuacuuaacugagcaaucucuacucacugagccagggcucagguuggguuugcuaugugaugccuuuuugugugaaagcugaauuuuugugcggaagugaauuuugagaucauuuucucuugucuacggagaauaauguucauugcgcuguaucuguagauugcuuuugguaaggugaucauuuuuacaaaacugauuuucucgagucagauuuuaaaacucacuuuuugugaguguccacauugaaaauauuggugaaaaauguacaaggaacccuaccauccagacauaccaauaccauauacauuguuagugaggggcgugagcuuauucuuaacugauuuugauuucagauaccuuuaucuguuauggcaugugauccucaggaguuucuuuauaagaaagaccauaggcaaaaaaaaaaaaaaaaaaaaaaaaaaaaaaaaaaaaaaauuaaauaaauaaaaaauaaaaauaagaaaagaaaagaaagaaaaagacaaaaggacaaaagaaagaacaaaaggaaggaaggaaggaaggaagaaagugaaaagcagcaggcagggcguugugcccuaccuuguguccaggcuugcuggcaagcucaugcugcuguuucagggugacacuguuuccugauagcuauugagugugugcuuuaggcuuucauagaauauaguaucaaagccugcaucucugccuggucucaguagacagugggaaagagggaagacccagcuacuucucuguugacuugguucucuagaucuuccauccuugguuagucuguaaugaucaaccaaggacucagaacagacuguuaauguagaggcccauugauuggaaacucucugggagucaagaaggagacgguggcaucugcucacuuucuugcaguaucuuuucugcccuuggcaagccaugagguguuuguaggcuccuuggccaaccucacugguagauaugauagcacugauguuguugguuuuugcugguccaacccauauguuacucaguucacccuucuuuuggaacuguguuauguuccaggauuuuuugccuaugacagguucacuuucuuccugagaguguuugauucuuguuuucagaauuagggcuucccccuccuaauuccacuccuucaccaauccuccauuagaagcccaggcucuuuuucacugacuucaguuuuuaaaaacacugggaaguagcaaguuuuguuucucuuguuuuuuuuuuuuuuuguuguuguuguuguuuuuguuuuuguuuuuuugguuuuuucaagacaggguuucucuguauagcccuggcuguccuggcgcucacuuuguagaccaagcuggccucgaacuuagaaauccgccugccucugccucccaagugcugggauuaaaggugugcgccaccacgcccggcuaguuuuguuuuucuuauaguuuauaauuaugauucacuugcuaaaguuagaguaaauuuuguugucuuuaagacagagguuuagaaauaugaaagguagagucaccuggggaauucagaaaaauacacaucugggaaccugcuccguggagaucagaaguagcagagugcucuucggguaggaccugagcaagucuaugcugcaaaaucuuuucaggugauuuugauguguccuguuccuuuaaaauacugucuacaguguguagauaugugcuuucauccugcugccuuuccgagaaagccagcugugaauagaaaucaccuguacaucauaaacuaugcaaucacuaucacagcuaugugauagugaguuuuguccuaccugggauuagcugcacaagcugcccagaaaugcauucucuggauucagagauguauacauuucauguuauacaaauguaacugacugaagagagaucaccauccauaaugugauaaaauaauacugguauguguuaacuauuggugucauugaauuuaggaaauucauuuucauauauauuaggauuccugauugagacaaaaaucucauaccuuaucccauaccagaaucacaugauaaaacucauuguguagcccaggcaggccucagguuuguggcgauuguccuaccucaacauccugagaauugagagugcaagcgugagcuggcaguucuuuagcaauuuucuaacaguuauuuuuucuucuuuuguuggggaggagcagguguauucuguugcuuuggugcuucauaguuuuuguugcuguaggucuacuaaaauuauacacccaagcuucuuguuucugauaggcucauuaguauuuucuuuccuuucucugcuauggagguguauaaugauagcaugcaaauugaccuuguuucuaaaauuuugcauuucacauaauucacacaauuuguuccugaucaggaacaaagucaucuguccuaugcccuuccuucauaaauaugagaucacaccuuuacaagugcggggguaaaggaacaggacagguagacaagcaaccaaaggcauuuagauuucauuauuuuuuauguuacccagacaaaaaauaucccuggacaaaacagucuaaggaaggcaggguuuguguggcugacaguuugagggcucagacgucauggcggggaagucauguagcaggaacucagaggguuguucucuucacuuccauaaucaggaaucagaaauggaugcuggaccuugaauauggcccacagaagcauagccuccuuccgauccaugcccagagggcuuuucauucuagagccugucauuuuaccugccaucauuaaccauugcagcuaucuaauuccauauacagauagcaucauuguguauaaaggaagaaucuaaggaguucauacacagagguauguuggaauagaaaaguuagcaagguuauagaauacaagauaugaaaaccauuuguauuuuuauauauuagcuuuaaccaucugaaaugaaauuaggauaacaacuccaucuguaauaguaucaaaaggaaagauacuuaggacaaacgucagcaaaagagugagagcacauacugaaaaguacagaacauggagauuugauuaaaugauagacuaguauuaugguggcagcauccuucaaguggacuauggguauaauccacacucuaucaacaucccaugugacuuccuuccucuugucuccuuccccuacgcuccucuagaaaauuaauaacugauuguaagaauuauuuugaaaauguuauggacccauaguagccaguauauccuaaaagguaaauacaaaugggaaacugacaugcccguauuggaaacuaucauaucugauagacacgagguacugauauaaagguaagcguguagacaagagaaguaugauugacaguccaaaacuaaaccuuugcaucuauggcuaguugauuuccaauagaaguacuaauguagcugauggugaaagaguagucuuauaagaauuaguaguagaacagcuggauagccacacaaagagccaagaugaauucucaugacaggcuaagcaggcugggaaggugagucgagugcaggcagcagcuggagcaaacugcagcucugcuuuugggacuagcagugggauuugugggcagcugugccagcgugacucaagacaugcagaagcggaagcuccagcggggccacagacagugcugcuaagaaggccagcggggacagugggcaacggccagugcacgggagucugugcggugugcauucagaagcuguguauucgucccagacuggauucuaacaugauaugugggcacuguauuaacugauguacuguaaagaaugcuccccauaauuuccugauuggucaaugaauggcugggacuuaugacuggacagaaagguuaggaaggcugggcauagaaucaagugaggggucuggagagagaucacagcggaggaaagagaaaugagagagauugccgacagacaggauagacccagagcacauagccaaaagaucacccugaagacaggcugauggagcagaagcagucugagagacacccgauuggcgagggacugacauugguguggguuuuaacagguagaaggacuagaauaauagcucaaaaccugcccagaauagugcuuacagcuuauuaauaaauuguaguguuucugugucauuuacucaggaucuacaaaaccaaacaugggguagaaacucucagcagacaucuaggaguaaguaaagggugggggguggagggggacuuguagcaacccuccaagaaaaauaaugucauaccauaggucugguuaguucacacauuguuuuaaggcaguuugaguugagcuguggagagucaagugguaguaggaugugagaaaguuucugugauauauaguaaacagauuacucauuguuuuuaugguuaggcaguuguggagccuagaugguguagggccauugaaauguagcauguuuauaauuaggaagaacacauggguuuauugcuaaagugagguaauggaaugaaggacauaggauugucagauuaauuuggaaugagaacuguaccuaauuacuguaugacacucauucaaauucauauucucucucucucucuuucucucugguguguguguguguguguuccagaggacaaacuugguugucauuugucaggugcuauauaccuuccauaugggucuuucuuuggccuggaauuccccaagcagguuaggugaacuagaaagcaagcccuagggaucucagugcugggauuacaagcacgggccuuguuuuaaaaugcggguuacagagaucaaauucacauucuugggauaggaaguauaguaagcacuuuaccugcugagucuaucuuccuagccugucucugacagcaguacuguaggaguauuguacuugcauguguauuuguucaccaauugcauggcuggugccuguggaggccagaagagggcaucgcauccccugugacuggaguuacaagugguugugagcugcccuguggggggaaaaaaaucuaaggaauccauacacagaagaauguuggaauggaaaagugaguuauagguuacaagauaacaaaaccauuuguauucucauauaguagucauaaccuccucuggaggaguagccagcacucuuaacugcugggccaucucuagcccaucuacuccuugcccugauauuuaaguuguguuuauauacaguucuuuuuagcaggguauuuaaagaaaugcugugucaauggguaaaggaccuguucuuuccagcaaccuauuuaauagagcccuuugguuuuacaggggaaaggcuggaacaaaggauuaccaaccucugagugcaguucauucaguguucuguuguuuauagugugccuaaucuaagucaucagaacaagacugugacuguuuaagaaggguuuuucuuuaucaugggcaaagugaccugaauagcacucuguuuccauuuauuuguuuguuuguuuguuuaauuuuugagucagaaucucacuguguaguuuaggcuggccuugaacucacuguguagcuagccuauuuguguuggccucacacuccugauaugaucccagcuucccuggugcuagaauuagaggguaugcccguaugcccaucuuagaagaauuucccuguagcguaucaggagauacauauguagcuuuuaaacaugacauauuaucuguaucagauuucacaauugauuauaaacguguugaaacuucauuuagauaucaugcaagcuaccaguugguaguuuacuucaaaagcaaaauaaaauuuuaccucuacucuauaguccaguugguuauguaaggcauggagugagaaaauggggguaucuuguguucucgugugauuugauucuaccugagagagacccguagaaggugggacuuuuacgcagucauugcuaguguccgagugucucccuguaguaagugcacucacuguuuugcuggagagcuuuuccuuuucccugcucugaguaguuguggguguuugugcauguccuuaugacagacagggucuccuuagucugaauguugucgguuuuuuaauauauauuauaugcauuuuuguaguuuuuuauuuuuauucauuuuguguuuuagggaguaauacaaauugaaggggaaaaaguaaaacuaaauauuaaagaauuuuucucugcuuuuuuuguucugcuuucuaaaauacuuuuuguuuuauagggauuuguuuuggccguuacgauugcacgugaagcgauugaugaauuucgacguuuucagcgagacaaggaaaugaauucacaguuauauagcaagcuuacaguaagagguuagcaaggacuuaauuuucccagcauuugcuuaguauuagcagguuagaguuaaaauagagcaggaagcauguccacucuguucuugaaagcauucauguuuguauagagaucugauuuucucacaguauguaaugcuagaauuucaguuagaguuuuauucauuuucgugauauguauguguguauguguauguauauguauauuuccacaguuacacauaaacacauguauguauacacugacacaaagcuguaugaagugcucuguuaaaaugcuguuauagaucggaaagcacccagcugcaugugccaugugaugcacaguagcacugugaagugugucauauguucaacacacacagaaaggucagggugcauagcauggcauugagcaucugaaaugggugcagucauucgacauggccccaggugcauacauauauccugcuccuuaccccauccaggccauuagcucccacuuaacaaauacuuacagagcucauuuccccacuuuuuagucuguaguugaaaauggagcaguuuaugaggaagagaaugggucagacuguuacaggcccugacaguagaagaaccugaagauugaauaggaugggacacacugaacucuuaauugugaguuuccugaaagaaacgaaaaauuaacugggucccuucauuuuuuuucucuuuuuuuuccacugaaguccaggguggccucuggccucuguuuuacuuuuucugucucugguuuugccuccuggggacauuucccgugaguggacucaugcacuauggccaucuucugucacuggugucaucccuuuggcauguuuucaggcucauacacguuacagcaucaagugguauuuucuuuguugacaaguaaauucugcagcacuacacagcacauguuuaucugcucagcacugggugggcauuaggguuguugugacuaacauucccaugaauacuuguauaccagccuuuucauaaacguaguuucauuucucuuggauauuguccagugggaaggaugugaggcuaggagaugagucuguugagcacucugcaggaagcaccaugcugggguucuugauuggcugcaucguuggucauuguugccagcagugcacaaggcuucugauuuugcugagucuuccuuccgcaguguuugucagugucuuccaugccuguuguaugccguguguuuuauuugcauuugcuagugauuguugagaucggguguguugugugcucuuuggccauuugcacauuuccuuugaaggcuguauauucagauccuucggcuacuuuuuagcugagcccuugacugucuguugcugaguucuaaguguccguuaucuaucuuagggaaguccuuugucagauuuaugauugcacauaguuucucucauuuugagggcucacauuuucacuuucuuaaugcauaagcauuuguuuggucuaauucauucacuauuucuucuuguuugugcuuuugguguuguaguaaagaaauaauuggccaacuccaauaauuuuucuuuucuucuagcagcuauaguuuauacucugaauuuaagucggauccauuuuccuguauaauguguuacauagguccacauuuguuuguauaaauaucaaguugcuugguaccauucucugaaaagacugcucuccuuacuguacuuuuaaauuauuaaacguagguggggagauggcucagucaauaaaguucucgcugcauaaacacgaggaucugaguuaggauucucagcacccuuguagaaagcugggugccauguuuaaccucugguaaggccaguauuuggccaggguguauauuugggggcagagacagauuccuggugcucacuggccacagucuaaccucauaagugagcuccaaguuuaguuagagauccugccucaaaaauaagauggagagcgacagaggaagaugccugacguugaccucugaccuccaccucugugcgugcacaugugaacacauggggaguagaagggaaggcaagauuuacuuuuaagaaaaagaaugcucaaaggccaggugaauuagguuugacguuguuauuuugagaagaguuucgagauucuagcuaauuuugaauuuagguuuacuuugguguuugugcuuaagcagagauugauguuuugugcauuggagacuggaguggugauaucaguggaaauuaauaagcaugcuaaucagucagcacagcaugcagagcaagcagcuaccugugucuguccuuuagcagaaaguuuuauuugcuaggcaaugguggcacacaccagagucagagacaggcagaucucuguguuugaggucagcuugcucuccaaauugaguuucuagacagccagucuacguauagaagcccugucuugaaaaaugauggauggauggauagauaauaaugugugagaguguauguauguauguuuguauauauaugcaucacacaugcacauguguucacuaguggaggccagaagaaggcauugaguucccuggagucauaggagguuguaagccaucuauuuugagugcugaaaacugaaccuuugcaaaaguagcaagugaucugaauggcugagcugccccccucaaacugcaauuuuuaaaauacuuacaacacgauucaaauaucuauuacuuugauacaugcuaagaaauaacagcaggaagacauuuaaagccugcuuucuauggcuaaagcauuguaauucuguaagagcagagagcuugagaggcuuaguaaacauacugggcucagaauguccaggagccucucucaccugagccuagguguuugcagcagagugugaguguuguguaugucagacccaggcugcaguucacuaaaggaagcagcuugagcaugggcuggcuggcugggagggcuuugagucccuacccuggugagcuugaacuuuggguauuguucauccacaauccuuuagucuugccaguuuucuugugaagccuacguucagaggugauccacuguuugaaaaggccugacaugcuugauuuccguaaucaagccaguaggcugcuuauuuuguaaucugugacugcugguguguucucugugguuuacucuucgcuguucucucuaggcacuuacuucacaugcguccaggcauuaacauuuauucucucauucauauauauauauauucucucucucucacgcacacacacauucacucauuuauucauucauauccucuuuccuuuccuucccuuucucucuuccuguccucucucuuucuucauuucucuuccucucucccugucuuccugucucccuuucucuuccacccucucucccugucuuccuucccguccccuccuuccuuccuuccuccucucucuuucuuccacccugcuucuucaaauuauaguuuacuuaaggugaugaagcaugcaaggggaagccucucagagaauugaauuaaaugguauuuaugaaauaaagaaggguacuuaaaguacacuuuaagugguauuaguguggucuacgguguuguuuuggguccucuauauuaaaagggcauucaucagagaucucuguagcucaaagucaaaugguuuaacaaaaaaacagucuugaggcuccagaaauuaaccugggcagcuguuagugaccuagcccauaugucagaagugcugccucuaguaaagcuagugggaagaauucuggacuuccggaacuaaugauuucuuaucuaguuauaaucaggucaccaagaauaauauaucaucccacaaucagagaaauaaaagacaccaaggauugguuaggguaaaugagauuggccagcuguguguaguuuguaauuaucaaauuggaauucugcccucccuuggauaauugaaaacacaaaucuucauuuuuguuuguuuguugugaaacagaguuuuauuauguagacuuagauggucuggaacuugcuguguagacaauacuggccuugaacucacagagauaagccuuccucugccucccaaguauuauaauuguagaaaugugccaccacauggggccagaagucuucauuuuuugauaguaacauucucagguuguucacuucacuucaccagcuaugagacuuuucuguaacucagcauguuaguuuuuaagacauaugugcuguccuuugcuuuggcuuaggcaucuggucuuuucugguguuuuauugcuacugucuugguaauauagggauuggacccaggagcuuguguauaggcuuuaccacugagccacacugaaccacaccaccaguccauuuuaaacuuagacgcagggucugcccuaacucucccuacaugcucucuucuacuagcaucucagacccuuguguucugcugaugucauggcuuccugucacacuaaccaccuuccaauaucacauacgaccuuuuaacuuuuugauguuugucauaguauaagauaggccagggcugggacagggaagugcugcauuaugucuccauaucccacuugggguuuuuguacuucucacuuaacaacugauaaaagccaacugcgcugcacccacacaagaggaugcuucuuggccaaaacaccaaaacaaucauugaugaucuaugccaaaacugugugaaguccagggauccaggugcagaggugagccauggccaugacuuuaacagacgugugugugcucuguuguguuugcuuauuucaggcugcuuuugagaucuaggacuugaugguauauugaccagucucucuauuacccuguaagguuccaguacacaguugucaucucucucaaagaugguaccugacucuucccagauuuuggccauuaaaacuucuauggacagccggccaccauccuggugagagcacgggggucugcccggccugagagguuuguggcacaggcgccggcgggagccuucuuggcuccgggacuccgcggagggcaggcugcacaggugaccguguggaauacagagucccagccguuucugggacgggcgagagucgcagagcuucugggcggcgccaucuucagcuccagauagccggccaccuuccuggugagagcacgggggucugccaggccugagagguuuguggcacaggcgccggcgggagccuucuuggcuccgggacuccgcggagggcaggcugcacgggugaccguguggaauacagagugccagccguuucugggacgggcgagagucgcagagcuucugggcggcgccaucuucagcuccagauagccggccaccuuccuggugagagcacgggggucugccaggccugagagguuuguggcacaggcgccggcgggagccuucuuggcuccgggacuccgcggagggcaggcugcacgggugaccguguggaauacagagugccagccguuucugggacgggcaagagucgcagagcuucuggguggcgccaucuucagcuccagacaaccagccaccuucccggcaagagccacagagcuucugaggcagcgccauccucagcuccagacggcuggccuccuuccggacaagagccacagagcuucucaggcggcgacaucuucgacuccagacaacuggccaccuaccuggccaaagcaacacagcuucugggaaagauccuguuuugggccuucaccuucagccaggaggagguccaaacaccagauaacuguacaccuucucugaaagaggagagcuugccuacagagacugcucugaccacugaaacucagagaagagagcuugucucccacgccugcugauagaggguaacaaaaucaacagaggaacaaucucuuaacaaagacaacuauaacaacuaacuccagagauugccagauggcgaaagguaaacguaagaauccuacuaacaggagccaggaccacucaccaucaucagaacccagaacgcccacuucgcccaauccaggacacccuaacacaccugaaaagguagaccuggauuuaaaagcauaucucaugaugaugguagaggacauaaagaaggaauucaauaacucacuuaaagaaauacaggagaacacugcuaaagaguuacaaguccuuaaagaaaaacaggaaaacacugcuaaagaguuacaaguccuuaaagaaaaacaggaaaacacaaccaaacagguagaaguccuuauagaaaaacaggaaaacacauccaaacaggugauggaaaugaacaaaaccauacuagaccuaaaaagggaaguagacacaauaaagaaaacccaaagugaggcgacgcuggagauagaaacccuaggaaagaaaucuggaaccauagaugccagcaucagcaacagaauacaagagauggaagagagaaucucaggugcagaagacuccauagagaacaucggcacaacaaucaaagaaaauggaaaaugcaaaaagauccuaacucaaaacauccaggaaauccaggacacaaugagaagaccaaaccuacggauaauaggaguggaugagaaugaagauuuucaacucaaaggaccagcaaacaucuucaacaaaauuauugaagaaaacuucccaaaucuaaagaaagagaugcccaugaacauacaagaagccuacagaacuccaaauagacuggaccagaaaagaaauuccucccgacacauaauaaucagaacaccaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaaugccagcccaggcuacuauacccagccaaacucucaauuaccauagauggagaaaccaaaguauuccacgacaaaacuaaauucacccauuaucucuccacgaauccagcccuucaaaggauaauaacagaaaaaaaccuauacaaggacgggaaccacgcccuagaaaaaacaagaagauaaucccucaacaaaccuaaaagaagacagccacaagaacagaaugccaacuuuaacaacaaaaauaacaggaagcaacaauuaccuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggucugaagaaacaggcuggaguagccauucuaauaucggauaaaaucgacuuccaacccaaaguuaucaaaaaagacaaggagggacacuucauacucaucaaagguaaaauccuccaagaggaacucucaauucugaauaucuacacuccaaaugcaagggcagccacauucauuaaagacacuuuaguaaagcucaaagcacacauugcaccucacacaauaauagugggagaccucaacacaccacuuucaucaauggacagaucguggaaacagaaacuaaacagggacacagugaaacuaacagaaguuaugaaacaaauggaccugacagauaucuacagaauauuuaauccuaaaacaaaaggauauaccuucuucucagcaccucacgggaccuucuccaaaauugaccauauaauuggucacaaaauaggccucaacagauacaaaaauauugaaauugucccauguauccuaucagaccaccauggccuaagacugaucuucaauaacaacauuaagaauggaaagccaacauucacguggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugaguaccuccaagaagaaacgggagagagcacauacuagcagcuugacaacacaucuaaaagcucuagaaaaaaaggaagcaaauucacccaagaggaguagacggcaggaaauaaucaaacucaggggugaaauuaaccaaguggaaacaagaagaacuauucaaagaauuaaccaaacgaggaguugguucuuugagaaaaucaacaagauagauaagcccuuagcuagacucacuagagggcaaagggacaaaauccuaaucaacaaaaucagaacugaaaagggagacauaacaacagauccugaagaaauccaaaacaccaucagauccuucuacaaaagcuuauacucaacaaaacuggaaaaccuggacgaaauggacaaauuucuggacagauaccagguaccaaaguugaaucaggaucaaguugaccuucuaaacagucccauauccccuaaagaaauagaagcaguuauuaauagucucccagccaaaaaaagcccaggaccagauggguuuagugcagaguucuaucagaccuucaaagaagaucuaauuccaguucugcacaaacuauuucacaagauagaaguagaagguacucuacccaacucauuuuaugaagccacuauuacucugauaccuaaaccacagaaagauccaacaaagauagagaacuucagaccaauuucucuuaugaauaucgaugcaaaaauccuuaauaaaauucucgcuaaccgaauccaagaacacauuaaagaaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacauaauaaaagcaaucuacagcaaaccaguagccaacaucaaaguaaauggagagaagcuggaagcaaucccacuaaaaucagggacuagacaagguugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauuccaccagagaacuccuaaaccugauaaacagcuuuggugaaguagcuggauauaaaauuaacucaaacaagucaauggccuuucucuacacaaagaauaaacaggcugagaaagaaauuagggaaacaacacccuucucaauagucacaaauaauauaaaauaucucggcgugacucuaacuaaggaaguaaaagaucuguaugauaaaaacuucaagucucugaagaaagaaauuaaagaagaucucagaagauggaaagaucucccaugcucauggauuggcaggaucaacauuguaaaaauggcuaucuugccaaaagcaaucuacagauucaaugcaauccccaucaaaauuccaacucaauucuucaacgaauuagaaggagcaauuugcaaauucaucuggaauaacaaaaaaccuaggauagcaaaaacucuucucaaggauaaaagaaccucugguggaaucaccaugccugaccuaaagcuuuacuacagggcaauugugauaaaaacugcaugguacugguauagagacagacaaguagaccaauggaauagaauugaagacccagaauugaacccacacaccuauggucacuugaucuucgacaagggagcuaaaaccauccaguggaagaaagacagcauuuucaacaauuggugcuggcacaacugguuguuaucauguagaagaaugcgaaucgauccauacuuaucuccuuguacuaaggucaaaucuaaguggaucaaggaacuucacauaaaaccagagacacugaaacuuauagaggagaaaguggggaaaagccuugaagauauggguacaggggaaaaauuccugaacagaacagcaauggcuugcucuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaaugcucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaacuggauauaguacuaccggaggauccagcaauaccucuccugggcauauauccagaagaugccccaacugguaagaaggacacaugcuccacuauguucauagcagccuuauuuauaauagccagaagcuggaaggaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaagauacccaagauauaagauacaauuuccuaaacacaugaaacucaagaaaaaugaagacugaagugugaacacuaugccccuccuuagaagugggaacaaaacacccuuggaaggaguuacagagacaaaguuuggagcugagauaaaaggauggaccauguagacacuagcauauccggggauccaucccauaaucagcuuccaaaugcugacaccauugcauacacuagcaagauuaugcugaaaggacccugauauagcugucucuugucaaaguaugccugggccuagcaaacauagaaguggaugcucacagucggcuauuggauggaucacauggcccccaaugaaggagcuagagaaaguaccaaagaagcuaaagggaucugcaacccuauagguggaacaacauuaugaacuaaccaguaccccggagcucuugacucuagcugcauaugcaucaaaagauggccuagucggccaucacucgaaagagaggcccauuggacacgcaaacuuuauaugccccaguacaggggaacgccagggccauaaaaggggaguggguggguaggggagaggggguggguggcuaugggggacuuuugguauagcauugcaaauguaaaugagcuaaauaccuaauaaaaaauggaaaaaaaaacuucuauggauguuuuuucauuuaaauuuuaguuucuguuggagaaacaguaaaggagaaauuccuugucacuggauggauaaauacuuagguuuuuuuuuuuuuuguuguuguugucguuuuuuuuuuuaagugaagcagggcaugucacaauauaccgucuuauucugaaguuuaauagccauucagauacuaaauauucauagcauuuuaaaguuaagccuuuaaacguuagaaguguguguguguguaugacugguguugauugagcuacuacaaguuuauagagacuauguugcuuugugcuuaagaguucuggaauagaggggcucugcuaaugggacaaguaccagaagugaaucagaguaagcagggcuaccgugcaguugucagauggauaccagguagacacagggcaagcacagugaaaggaggaguaugcauuaaggaaaggcagaaaaucgauuugagguugucauaaagaacuuguaugucauuauacaaauuuuaauuaucuucuguguaauugucaaauauuggaaguauuggaauagagauaaaaaagcuaaucuuuagguuucucagugaguuccuuugaguucaaguugaaguagaaaaauuacagugcagucuauuuugugcuuuguucugcauauagaauuuaaaaacaaggacuaccauacugagagacugggugugcuugcaaggaacaucagaggaguauaaauucuugguuccuagggauaagccacagugauguuuuccuucuggcagggcccacuuagccauucugccuucccaggacagugacaggggucaaagguuaauuccucaguagauaagcugugcagagcaccuccuaacuucugcucaggcccucaggguucucugccagcgacuggaaggaagcuauugagguucuguagugacagaguuaccacauaaagugcagucagccucgugagugugaggugaaacugcuaggucuuauucagcaaugugccgagucuucaggaugugaacuuuuaacuaaagagcuuuuaggcagaugcugcauggaccgaugcuuagaccucucuagucugguuuucaaaagauagccuuuccauuaucacacauuuaccucaagcaucuauaguccagugguccuccugccucagaguccugcaaggugaugggcacaacagauauaugccacugugaucagcuuagccuucugauucauaguauagaauuauuaaugucugaggaauguugacacuuuacuguaaauuacccuuaaacauguaauuacugauucuauagaaaugcagagcagucacuauagcaugucugaauaggaaaguccauuucaugcgaccuuuaccaugucuguuacaguaaauuaaccaacccuuuggggauuuaagggcauuauaaaagaauaaaaaugggugugucuccuguauucuaaaauguuuuugacauuuuacuguauuacaucauuugauuacaguuuuuuuuaaugcauguauuaauccaaauacaaaaaggcagaagaaggcaagugaauuguuggcuaggagagacaauggaauugaaagacagcauagggauucuguagagagcggccacaaagucaauggcagucuuuacugucucauacuuagcugugagaagagcauugaguggaagcuuagcgugaccuugccugcagugauuacgagacuaacucuucugcacuuuuugccuguuauuagacuuacacaugcuaacugagaagcuaugauaaaauuguuucacauaauucuaaagaauauugcugucuuaugaauaaaaauuaguuguagaccuucuugguuguagagugugccagagaaagcaucucuuccgacacuguggugcagggacacucagcuucuuuggaggcgggcguggaaauaaggcuuugugagacguugagaggugugaaguuugguauuauguuuuugguaaagcucugacccugguauagucagaggaaaguaaauguaaaaguugcaaacaaaccuguuaguuugauacagcugucaauauagaaacagacccacuggguugucacuuguccuaaaaggaagagggacgcugagacaggaagaaggagugauuugcuugaguuuucagauuauuugcuuaauaaucauaucguagauauuauuuaguagaaaccuaaguauaauauauacauuuuuauaaauaacuuuccuaugguauguagauguuacggauuuaaucaauauguacauagaaaaauuacuuggaguaggaaaacuauugguuuuuaguucuguccuguauuggcaacaauacaaaugggugaugauuuuauauauaauuuccuuuacuuuuucuguguguuuucugucaaucagugcaauuugcaauauaaagguugcauauuucuccauagcucucaguuucaggcaccaaauuauuuuauuuugcaacgucccuaaucauugcuaacuucauuuagaacugaaacacuaaagaacugcaauacuuccacaaguaauacuuucuaaauuaccacaagaaaaccccuuguuccguuguuauuaucauuagaggguaguuguuuaugcauguuugguauuuuacuaauaagaguaauuauguaugauggugucuauccaaaauguaacuugaaaguaugaggagagauuucugcuuuuaauuuuuaaauuuuuauuuguuuguuuguuuuugcccuagauauauuuuuaaacuguuacuuauuaaaaguuacucucugguacacuuugauuucccuggguugauuguacuucuuuuuuuuuuuuuuuuuaagguaaaguucaaguuaagagcucagacauacaaguuggagaccucaucauaguggaaaagguugauacauuuuuuuaauauauuuuaaaucuguauguucaacagucauuaacauuagcuuaauuacaaguaacguuaacuucaaaugaacuauugagauagguauuuuauuucuuaaugugcuuguguaagauuugauguauuuuaacuacacuuagacauguauauauucuuaucuauuuuguuacugcauauuucagcgucuuuagguaaagccauacuuuuaaaagugagccuuauguuaauugcuuaguguaucucauuugaccucggaauuguguucaaaauguuaauaauucuacaacaguuuucagaauuuacuuguccagauggcuauauuauacacagucauugacucuaacucuuauaguuuaaaauuuuaaagagauaaugagugaaaguuaagaagcacuaaaauaauaguuuaggccaugaugagaagaagcccuguucuaaaaagagcagauaaggcauugagacagucagguuugcuguggucuugagagugaauggaugggcaauaugcacuugagggcuuuccucuggagugcugucccugucucaucccgugacauguaagggccuguacauacaugugucucucucaguagagauucuucuggugugcuguuucugccucauucugugcuguauaagugcuugcacaccacccaggcgcaccugugaugucaaugcuguggacauaucuucugggaauauucuuacuuuaugaucuguauucuccagaaauuccuuguugacuuuuaaaugucucagggguagauucccacuuggcuuccuccagagcuuucuucaaucugcuguugucuggcaacuugucugccugggacucaguuucuucuucccauagaaaugaucuuuuugguacuuuauucuguauacagggaugugguuugauuuuacaaagugcagcaugcacaggguauugaaacagacaucuguaguguucauuguauaaauggcaggaauuacuagcuuguagccauucauuuuuuagaaguuuucuccuuugcuuguuuauuauguuguuaguuuuguagugauccucuuuauaucuuugcacauuucugaaggauagauucugacaaagugcauaacuuaguagaucuuaagcauacaaauuuuguuaagguguuuucuuucugucauagguauuccuucuguauugauuaauaugcauuuucauauuuugccuuauuguugauuauagguagugaacuaugggccuccuuggugccaagaaugcauuccacugcugaacuuuuguuauacuuuacauuauguuguaaacaggaaggaagcuguuacaguaagggaaacagcugagauguuagugacuacaaaguguaggccuuguaagcuauuuuauguuuuaugaguagaguugcuauguuugaagucagauuagauuaauuacaguauuuuuaugucacucuggaaucuggaagagcuucaugcauuuuguuaaauauuguaucuuaggacuggggguguggcacuaguauacaacgcuuugccuaggacuccucggacuacacacgaccgccaccaccaccaccaccacccaccacccaccacccaccacccaccacccaccaccaccaaaaaaaaaacaaaacaaaacaaaacaguuuaaggcuuaguccauacaagaauuuaaggugguagugugaauucacuuugcugucuaauucuaguuacuugauuuaaguaccuuuucuuauacuaacggcuugacaguccuuuuuuuuguaaaucagaaugucugggugcuguuacuaaucaugaaaucugcuucuuuauguacccacuuguagaauucauuaguuugguacugcagaccuugugcaugcuggguauagcauucugccacggauuuaccuuagacuucaucugaguauuguggucuguguugcuuugcugauagcauacagccaucccuacagugaguuaguucacaagccugacaugcuguagugugugucucaggugggaauuagaaguucuagcuuuucuucuacguuaggcccuaauauuaaagguguaacuuucugaagauagcauuugcaagaguuuucugguuuucuuuuuucuaacccccccccaauuuuguuuuaaucuuuguuaaaacaaacaugauaugaaagcaacuauauaaacaugugcagaaugcuucagugcuuuggauuauuuuagagcuuaauauaaaugagauaaagacuccuaaauuauuuguguaaacaaaaaaaugcaccuacccagagucagaaauaccuuuaugacuguauuuaaaugaagaaaaaaaaagccauaguuugucugcugucuuuacacaugucaaguuagucaccuguguagagcuagaguccuucagaaguuaugugcauguaugugacauuuauuaggucagucuggggguuagcaagaaaccuggaaacacucccagcagucaggacuaagaggaguguugucaaagacuaguuaguuccuuaacuagucuucagagccagcuuggggaagaacaauugcuuuuuccagaagcaaggagaaaaaaaucccuuuuucucuauauucuauuauaauucaguuugaugaguuaguauaugguguauaucauggugcucagaacagaacuguauaggauagaaagucuaugaguagaagcauucugggauacuuuaaggaagcaaagauggauuccugaaaaggacccagcugacaugcuuugaaagacagaaugagaaccacagacacuagugagaauaaaugagucaugcugacuaaucacuuucacugugaauucucuaaacacagcagucaaggcauguacuuauaucauugacaagcaagguagcacaacuucacuacuugagcagggugaagaaaauguauagagaaguguaccgcugccaggcgugguggcucacgccuuuaaucccagcacucgggaggcagaggcagguggauuucuuaguucgaggccagccuggucuacaaagugaguuccaggacagccagggcuguacagagaaacccuaucucgaaaaaaaccaaagcggggggaaaaguaccauauaaaaguaauuaaacagagauauguagaauagggggcuacauuguuggugucaaagaaaauguccaguagaauaaugaaaaagagaacaaaaccaacaaaguugcauuaguaauguagaacccuugaaaaggaaauauccagguauagauuuauuccuugggccuuuaaagagcauguggcauccauuuuauauaguaauagucagaaaguaagguagagccuacccuuguuuuauaaguccagacuuagugguguacuaacaccagaagggggauagucacaacagaagacaacuaaacaagacaaucuugaaaaaacauuuaccaauugcagccuauauauaauacaggccuugucaaagccacaggaagauuccuucccuuccucccuccaucuuuccacucuuucuucucuucuucuuucucccuccuuccucccuccccuuuuccuauccuguccuuuuccuccuuuuucucccuccauccuuuucuucucucaguuuaaaaaaauggcacagucaguuuuacuuaaaaccaguuuggaaagguuuuguaauagcuaaggugguccugacaagcaaaaacacagugggaagacuccaugccaaggccgccucuuccauugccacauuauucaguauagugcaaguaggaggaagguggagacguaagcucaugacaccuuaggaagaacccagaagucagcccgccccgauauacacaaguaacuuuucagaagguguagaagcaauuagaaauaaaagaaaacaaaauuaaauuaaugcauccauaggcuaaaacgaagauucugggcuuaauguaaaauguaaccuuuugaggaaaaaauaucacaggaaaaaauguucugaaucuagacauauaaauacaauuuuuagauuauauacuaaaagaauaaugcauacuacaaaaauauaauuucaucuuauuaaaauucaaguguuuuuugaaagaaauuauacguaucaauaauaaaggagguuaugcauuugagagggauuaaaagaaaaacuaaaggcagaaauuaaagagagaggauuauacaaauuauguaaauuauguaaauacaguacuuacaugugaaauccuaaaaaaaaaaaaaaaaguuuaaaugaaauagaagaggccagcaagauggcucaguaggcaaagguaguuguugacaagccugaaguccugaguuugauccaugggacccacaugguggaagaagagaaccuacuaucacauauaaauguuaacagaaaaagaaacugcagagucauuuauggugcaaacaucugaguacuauaaaccuaauauagauuguuuguaaaauuuccuaaaucugagaaguaagauuuucaccugaaagaauagauggaagacuuaagaaaacauuuaccaagaaguuucagaugaaaauaaacacgaaaaaaaaaacccuuuucaauauuauuuggaagacuuaugaauuggaagagauacuuucuaaaaauaccaaugucacuaaauauugacaacgucaaaaugauacaguuauucuggaaaaucacuugacaguuucuaaaacaaagaccaaaccaaccaauccaaaccauuuaaugagcaguuuaaccauuuaaugacccagcaguuuaauccguaccuaggggcuacugagauggugcagcagacaaaagaugccuguugccaagccugaugccuugaguuugaucccuggaccuacgugguuaaacucuggccuuuacaugggcacuauggcucauguaugcauaugcacauaugugcacauacacaauaaauaaauauaguuccugugucucagccacaagaaauauuaauuuauguugauacagaauccucuacaagaauguuuauaucagcauucaaaauagccauaagucagaaauaguucagcuauccugaauggacaacuguuccaggaaaagcacuauguguaagcauaucauggcacagcaugggaagaagauacaagacugguuuuaggaagugaauaaucugagaauuccauccacauuagcauccaauggauaaaagacuuaacauagaucugacagaggagcuccuaaacuuguaacuugcaauuuuaaauguuauuuaaacauguuaaagaagugacucccauggauauauauguuccuuuuggcaaguuggcaguacuuguggaaaugaccuguaguuccaugcuaggucaucuuaaagacuucagcugacuuccugguagaaauggacacacagcuuuagagaauuggcguagcagcuggggacccagaagagcugaagcacuuuuggggaaaugguuuacaaauuuugcguacucacacuucucuacagaguacaguacaaaucuacaggagucuuuacacuguagaacuaauagaaguguagcgaugagacuauuuaaaaauaaagucuggacuuuaugguuucuuggucccuguuagguucaguguacuagcaacaucuuuggacaggccccuuucauguauucuaccauuggugucuauuuagguugcuucuuauacuucugugacauuugacauugucaauugugcacacaugcugcuacauaaauaccugggaggaaaauggguuuuaagcaugaauauguuuccuaugguagaucauacaaacaacugggaaaugcuguguccacuguacuuuaagaaguaggcaguguuuuuauauuugccaaccuuggcguucuuagcauuuucaaugggccuuucugauaugugugcuuuaagugcgguuuuaauauaaguaaauuucucuaauaccuaauaacuugguaacuucuguuauggcuuaugugucuuucuguaguguuuggguaagaaagagcuugagaaaaucucucguguuuucuucugaguggaccuuucuuugcuugugaguuuucaggccuuucugucuuguggucagcacccacugauguauaugcugcaggcuucagcuuccuuccaggugggcauacuugaauagaaauucuuuguuuuagggaugucuaauuuaguaaucuuuucauuuaaaguuagagguuuuuuuguuuucaaauuaauuaguaguggugucagugaagaagcccuuccugauaaaaguccuaauguuauuugcuaaugugaaucaguucuuguguacuuacuggggaggcgaggcaucacuccacucaugcccagucagugccuccucuccuuaggacuguaacuuggcaagacgguuuuccuuauugcccacagugcuaauguucucaugagucugguguccucgugugagugggucuccuugugcauuuucucguuuggcauuggcaugcuugguuguccugguaugucaccguggucugauguucauuuccuaggcuaaaguuagucuauguguaugucuuguucaauucuuggccuucacauuuccccauaugcuugagaagaccuuguugacauaaagcaaaagcauuguuuauuuuagcaacccacccccacccccguuucuugcucuguuggaguugcaguguguuccaugugcucauauauuuccccuaaugguuuccuggcugugcuugcuccacucauuuucuugucagauaguuauuacuuuccuuuaaaaauacuauagaauuuucacucaguuuuucuuggaccugaggaucuguagcucuucuguaaucaucuuuauucuuagugugagaaagauacagcuguaucucaugucuuauuuuaggccuacuuacuuguauuuguuucauucaugaacuggaaaguaagcugcugcuuuaugguauaugugcaaauuugugaaauuauaugaaguauuauuuuaaugguauacuuuuccuuuagguugauuuuuuuuucuuuagcauuuaauucauagaauuauuaauaauaagugcuugacuagugacuugaaaaaguuuaaauauaucauaguauuuuuacuuacauccuauucagugucauuagagaauaaauaguuccucaacuugugggcauauccuguauuugcuuauucucauuuauuuauccaagguaaugcaugaucuuauugauggugugcuccgugguguugaccauggaucaacauggucuguuucccagggcauuuucaauucuuaugugacaguauuacuaugaugugugcaugguuaggaugcuguggaaauaauaauauuuaaucuuccccagacaagaucuguguaagugccauguauauggcuuguuguuguuuuaaaaauaccuaaauuggaaauuaaaauguuaguuuuuauaugaaaauuagaaauaauagcuauuucaguacaauuuuacuuuaaacauucuaauugucuguguuaacuauuucuacuauauaauggcauuaugauaauauauauaucuuuaauuagcauauuacuuuuuuuuucagaaccaaagaauuccaucagauaugguauuucuuagaacuucagagaaagcagguaauuuuuaauuauuucuuuuacauugcuguaguuuuuuuuuuuuuuuuuuuaaguaugguguuuauuuggcugauuggccuguuuuuguuuuggauagaguauuucuguuuaacugugucugacauggagaccagaaauaugcuugccuuugcucuccguguucuaggauuaaagacagauaccaaccugcuuagcuagguuuuuuucacuuuaaugagugaaagcaaauucucugccuauaauuuuucuuaauaguuuaaaaucauuucuaaauuauaguuaacuauugauaauuuaaaagauguguuuaguuuuuauaacuacuugaaaaguuaugaguggaauuucauucauaaaaauuuugagaauuauuucaauaacaguguuacuuaauacucgauugcuauuuuacauuuucaguuuuauuuauuuagcaaagcguuauuuuucacugguuuuauacacaggaauauaucaaggaaugcacauagcucauuucugaauuacacuuaggauuuguaaaacuagcugucauuuuuuucuuucuuauccuuagcauacaucuuacuggugaaggguggggugggguuagaguugaaugguuguuuugccuaugaguaagcagcauguuuuaagaauaagacuuuaguuauguguacccgucuguguggguuugugcacgugagugcagugccuguggaggcugcaguuaaaggcagccaugagcugucccaugugaaugccacaacugcaccucagaagcucuccaggagcaaggaugugcuccugacccuucacuggucucccagcccaaagcagcacacaauuaagagaaguguuuuuaagucaugcuaaagagagauucugucuguagcacugcggcgagcugugguugguuaccuugccaggugaguugcccucaggaaagaaauuguccaugguaaccgaaggacuugugaguuauuauuuauuuuguguuauuuagugugaauuucuguuuuacuuaauaauaauaauaauuauuauuauuaguauuauauucuuuacucuuuuuuuacaguccagucauuauccccccucccugucagcuguccaacaguuccucauuccauuucuccuccccugucugccauccccgacccucacuccaccaggccuccgcacuccaugggcuuucaagucucuugaggguuaggugcaucuucucucacugaggccaggccaggcaguccucuacuguauaugugucaguggccuuguaccagcuaguguaugcugccugguugguggcucagugucugagggaucucggggguggggggugaggggguggggaggcaggggucuggguuaguugagacuccuggucuucccaugaggucacucucuuucucagcuucuuccagccuuucccuaauuuaaccauaggggucccugacuucaguucacugguuggguguaaguaccuagucuuuuagcuguuguagagacugguagguacccuccuaguguucaucaccaaaugacaaguuuucccuuuauuguggcuggagauccuccaacaguuaccuacucccaguuucuuaccacuacaagguguagugcugguguuuaucaagagagcuuuccuuuuagaugcuucuaccucuguuuuggaaggauauuuggcaauauuaggauaguuucccaagcauuucuaucuaacauguccuguggccuucugugcagcaguccaguagugggcuuuguuccugacuuagcaccuuugcaguggcagugcugugcagugugggaguccgggagacacugucuccugagaggcggaguugcuuaaguugcuuagcuguuggcauguaugaggauggagcccuuuggcuucagcauauggucuucauccugcuaggcuucauuucccauguuuuugcaggauuuuuaccucucuaaccauaaaggguacacuuggaauuauguaaugcuuuuuguguuuuuuggugagaccuuuauuuugauaucagaguaguauugaccuuagcauccauuagggauuauucggucccauccuauuuuuuuggaagaaucuuugaagaguuuuuauucuuuaaauguuuggugcaauucaucugugaagugauuugggucuggccuuugaaggucuuuguuuugguuuuuaauuucuaauucuguccuaaaggcuuacucuuaagggucuuuuucuugaaucaauuuuuauaguuugugugcuuuuuuuuuuuuuuucaacuugucuacuuuagguuuucuaauuugugggcuugcuauaguuauucccuccucaugaucaucucagaucauuucuguaacaauaguaguaaugucccguccuuuguucucuuuuuucuuuuguuacucuggcuaaaagguugucaaugucauugaucucuugaaagaacuaacuuuggguuuuaaugauuuuucucaauuguuuugcuuguucuuuauuucauuuauuggcauauaucauuuuuuuuuccuuuucucugcuuuugguuaauguugauccugugccuguagcuuccuaaggaagaaagauuguugauuuuuggaucuguuuuaaugugguauauuuacagucauaaauuuucaccugcacucuuauggguuguccucauaagguuuacaaugugagauuuauuuucauaccucuaaaaguauucucuaauccuuugucauuucaccauugaucucuuguucugugauuaguauguugcuucauuuccacauuugugaauuucccagauuugcuuuugucaugguuucuaggugauucugcuguggucuaauucugacucacagcaaucuagguuaugcuuuggccugugaguaucguagacugcgcuuuacagcaggagucucuucugcuccuuugcuguuuguuagcucucgucaaucugcagcauuggccuucugucuaacuagacuguguaguugaaggugaagugguagaguuuguagcuaucuuugcaagauccauagcaaguguauccccgguguaaugacugucacccuccucacaugcucccuguccugcugucauacuugcuugucccuaggguucuucugcauucacuuuucccguugaagagcugugcagaggagacacauagcugcugcucuuugaccuaaugugccugucagaagcagcuuugucaggugcuugcauggaaccugucuucaccuccuguccauucauucccagucagagacucaauccccauaaugaggacacagaagcccucauucagacaguuccaucuguguuucccuuuuguugagacccagucucuucuuuacuuugggaccugucuauugacaagaccucccucacagaugcucaaguuuguuucuuugcacucuccaguuccauuucuuucuugcucuaggugguguuugugucccugucuuacuccugcccucacuuguaccccacuguguacuuaguuacucuuccauuguccugaggggauuucucaguuacuuuucuagugcugggauaaaguaccauggccaaggaaacuuucagcaggaagaguuuauuuggguuuauaauuuucaaaaaauugacaaauaauguaucaugguggaggcaugguagccaacagagggcgugguggcugucacagaagcuaagggcuuguaucuuucacaaaagugggaagcaaaggaagagaaaugccuacccuagugacauauguccaccaguaaggccacacuuucaaaacaucagugucaacuagggaccaagugcuuaaauacaugagccuauaggguccauucaagugccuagggaauaacaagaagguugucuuuguggccuccugcaugaauuuuucacaaggcucuguugcagaugcaccuacuaugugcucuguauuuuuguaggggguagaggaaugaugcccacauaugucucuaauaaucauuguucacugguuauucuuugggccugguaaaaauaccauagcugauaacuuaaagaauauaaugaaauagaauuugguuagucucuguauuuuguuagggucuuuaauccauuucuauauaguauaauuagugaaaagguaauauuuacaucugucucuuauaacuagcauuuuuauugucaguauagagaaagagguuuucaaagguuuguuuuuccaucaucccucuuugagagguccaaaaaccuuggggauaaaauuucaauuccuugggaagcauacuggacuccucagaaggagccacugacaguggaccuuuagucagugacagcccugacuuagggaggccaagucuagagcugagucagcuccugggacaccuacuggaggaaauaacaaggccagaacugagcuguuuuccaaaauucuuuaaggccuuaucaaauguagauaaacuaacauagcaaccaauaaaaauuguacuaaugucauagcuuuuccccccuaccaaucauauuaggcuuuaccuaacccuucuggagaauuccccuagcccuccauaaaaugggccuaugagccccucaagucaucuccauuuugacaacugguuuaccccugcaugcuugcaauuucugcagaauuaucuuugccuuugcauacucuuugagucuggggucuucccucagaaauucuuggacccuaacacuguugacauuaccuguuaggaucuauggcuaguagcauauucaguauaauagguuaagugggguaguuugaaugaaaauauacaccccacccccauuggcucauguguuugaaugcuuguucuacacuugauagaacuguuuaggagagaucaggaggcauugccuuguugaagaagguaugucacugggaaugggcuuuuggauuuuaaaaaugccaccugucccugguagguguugaccuuuaaucccaguacuguggaggaagaggcaggcagagagauugagggaagcaucaacuacagaacuaguuacaggaugggcauggcuacacaaagaaaccccgucucaaaaaacaaaacagacaaacaaaaagccuaugccacuccaguuagcccccuuccccgcugcuuccuggcuaauaucucaacauguaagcucucagcuacuucuccagcaccaugccucccuacuguuggaacauuuccugccaugauggucacagacuuacccucuaaaacuguaagcaagcuucuauuuaacucuuuguuuuauaagaugcuuuggucaugguauuuuaucauggcaguagaaaaguaaacaaaauauuugcauuugagaggugcuuuuuauacauuauaaaugauuguauuugaaauauauguaagauaauagcauucuaccugggacugguggcucacaccauuaaucucaucacuuaggaggcugaagcaaagauauugcaaugaguuaaagaccaacuaaggcuguguauugaguuccaggcuacugcuauaacagaguaagaugcugucauaacaaacaagcaagauagacaaaaauaauauuccaaauauaaaaguuggucugggcaauuaacuuuaaaagaaaaauauuauauagauuuuguuaagggguaaauugugaacagcaugcaguacuuaaaguuuagagaugguuacaaacacuagguuuuauuuauuuauuuauuuuugguuugguuuuuguuuguuugaggaggaggaaucuaagggcuaaagacugagaauaccauuuuuaaaaugaugcaguugcuaauuguuuuggaaauuugccaguuuccuccucaucuuucacugcaccuuugcauggccuugggaguaaacagaagacgaguggagcaccagaguauuagcagaugagcugugcaguguucaccucagauaggggacagcccagucagugacuacuucuccaguuuugcccugugucccacgugcugugaaugugcucuauguggacaagugggacugaguauucugaugguccugaauccacuugagaaucuuaguuccuuugccuuagaaaaauaugcacaguguauaugguuacuaaauuuguauuauuuauauaaauaauuuucuuucucucuauauauauuuguagcaugaguacuaguggauuuggcuuuaggaccucuguguaguuguacuuugacuuaaccuaugauggucuuacuacagucuucuguuugugaacgucaaaugaagaagucaugugcuuucugcuucuccuguucuaagcuucuggcuggauauuaccuggucagcuuccagcuccaguuccaguuccagcuggauauuaccuccagacggucagcuuccagcuccaggucuucuuuaucagcgaccacaacuauucuuucucuuugguuuccaauaguccugcuuuugauugcuggucuucauuuugagauggccacuggguuucuauacuaucccaggucuuaugcaaugauaacauucuuggccaccucuucuuccucugcauuaguucugacucagguaacuauauuucauacuaucuuguagcucuucucucugggugcagagggacauuuuacaugaaggucagcaaaacuuuuuugugugaucuuaaguaauuuacucaagauucacuguugucuaguuauuuucagaaaauaaacauucugauuuuugguuuguuuguuuuuuacuaacaguuuguuguguuucaaguuuaguuaaggaaucuuuguggcauauuauuuuuuaucauaaaauucuaaacuuuugucagugugaguccuaaguauaacacugugguuaagaccuuagcaaugccaucugggugcuugucaauacagcacgguaagucaauccauggcauucuauugacuaaguauuaguaagagcauucucuugagccaggacuggauuguuuagaauguaaauggagcuguugauggaucuggugacugaugacuuacauuccaauuaaucaauuguuccauccguuucuuaaucagaucaaauauuuccuaagugcacacagcucuuuuagugguauuagcagaaaugaaugcuuuagaaccaauuuucaucaaucucuuauaaaugccaauagccuuuucacuuguaucuaagugauaacauuauaguguaaguguuuggaacacaguacaguaccucacugucccuuauaguggaaagaggguagguaagugacacuguucucauccacuuuauuucuauagaaagauuuaucuugccaucaguuuaaaauuuucaugcacucauuaagucauauaaaugauuuaaaaaucaaguuuaaugaccaaagaucugauauuauaaauucacagucaaggucuauuuuucuuuucuaggacauacaccguagcucaucucuuucagagcuauuggauaugugagcuguugcagguugccugcuggugcuacagggugacuuguuaggcugugacagccucagcuuccucagaguccccucacuuuaucaucccuugaugugguucucaaugugucacauacacuagcugaucuuaauuugaggucauuaaaucuguucuuuccugucaacucuugucaauuauacaaaauagaaucaaguauucauaagaagucugauauaggauauaagcagaccaauuuaauuauucauuuuuacugaggcuuaacuaguaucaguuauagcuagugcuuucuguuuaaaaaauaaaaaugcuggcuuggucuuuguaagacaggccacccugucuacacuucagccuuugcuguagcccuuuccucuagcacaucaguuacuggaagucagugauguugauccaucuuagucuguacuuaucuaagacgacacgcaccuuuuaucuccagaggacuuagaguucugugugaguugugcuuauaauguucaguguguuggcuucacuuucauguuagagaucaaagacacuucagagcaucucaccuguucuuauuugcagaaacuagaaucuaguacauugaguuuuauuuacauuuucaucagauuucaucacauuuaagacagaaaaaaaaaaaaaaagaaccugaggaaacauuugacuuuagaguuaccugaugcacauuuuuccuuuuccuuaucuuuaguuuuucuagucaguacauggggaguguucuccuugacguaauccuuuugacagcggacaacacaacaguuuguuuccuugauugugcaucuagucuuucaaagugcguauacucuggugaaggucccuuaauguaacaucagcugauggaagauugucucauagcuccugauguauagccaugcuucagaguugauucugaucucagauuuccagaguuguuugaccaugaugaugcucaugcuaagcuaaugaaagggauuaaagaaaaaguagugcugugcucuuuaccugaagacuuuggggaaaagccaggcaaaguucauaucuaauagggacauugugggaaauacuagagagccugauagccagcuuuguaaagguggcaacagcccagccagaaacucuaagaaaguuccuggaucaggcuccuccuguggugagaagcaugugugugugcuagguucuuagcaaccgcgagaagggauugagacucauuccgaaguauuuucccagaaacaacccuucagcagggccagagucaaauuaaacgaccuugagauuuuauaguaacaaugaugacauucugcuggaaccugccagugcaguagcucauccccucucccccauaagcaagcuucuugucuugaaacauuguaaguaaaguacaagccacccuuucuuagggcgccacuucaacgucauuugaauccuaaggaaagaacucuccacuuggguuucauugcaacugcaagugagcuggaaagguaggccucacugucuauauccucuguugcugcagcaccaggcaucgacugagugaguggcugcagccucagggcagagcagaagcuaucuuggugccucuggacaaaaggcuggcauguuuggaguguaaggugggcucaggaucuagugaaugagauuagcaggguagagaccaaagccuuuuggcagaaagauuagaagagaugggguaagaggauccugaaaauuaguaaugacuuugagaacaugcugagcaggcaucugggaggugguggugucuauuguauuccuuaaggagggagggaagggcacugugggcaggaggcggauggagggcuucugugggacuugggaguuguguuugucauuuuauaauuaauucauagaguauaauaagguuuguggguuuguaacuauuuuauaguuauagucuaaaaguaccgugaaagaauucugugauuaacuguaacugacgauuauuuguuuucacuuugccuugccuucugugguguuggggaucgagugaaggccuaaaggccuuugcacauacuuggcaagggcagugccauaggcugcaucuccauaucugaauuuguuauguuuuucguguuuuauggacuucuuuccuuuuauuguuuaagaauugcuucaucauaugcuuguuguaguuuuuauuuaaauuauggggagaauguaugauuucuacaugaacauuguaagguucuaguuccuuccucuguucccuuuuucccuguauaggugcauuuuaugcaucucugcuuguacguguguguagcaaugcauauggauaaauguguauguauguguguauauauauagguaugcuuguacauagaguacagaaacacaugcgugaacacauggaugcccaggacugcauugcauagccaugaaagauacaugcacacagaaacagguauacaaguuugcaaauauggauauuuguaguucucuaaccuaacagauaggugaccaugcaggucacuuccuuuuccucucccuucuuucacucccugucccuucaugucagugguuaucaucuccccuuucaagccagaaguugugcugcaagaauaccacacuguacaaugcugauugcaaaugcauugcccucuccuauucuuaaacaucaucuuuuaauccaccacccuuaacaaggccuccuguagcccugaguguccuagcacucucuguaguggaggaaguccuugaauuccagauccucugccucggccucccaauugcuaacauugccagugugugcccacugugccucagacaucaacuucucucucccucuucauugcccucuuccucccucaguguguuuguaccccauuuucuccauuugacaauaucuccuagggaucuuuucauaauguugaggucuuuucuccuuuguccuuuuaaaauugcugccucugcuguuuuaucuugcuaucucucuaguccccguacgaaccuuucauuauuauagacugcugcaaugagugguucugugugugucacuuagugcauuuuguguuugcuguugucucuaggaucaguucucagaagagggaugagggauggucuggguaauuagauugcugugguucagguuuuuccccuucugaaauuugauggguuuguuauuaugcaauagcacuuaccuggguauuagcauuuuagcugugcuuauauuacugagcauuuuaugauggucaauuaacauuuuauuagcaagguaaugucagacucugagauauuuuuguauguaucuuauuaucuugucaucaucaaaacauagauuaaaaguagaaaugaucuagauagcuuucaguaguugauauuaaaccuuaauagacaugggcuaggguuguagcucagugguaggacacuugucuaguguguucaaggcccugguuuugagucauaguaucaugcaaaacauacagagauacugucgcaccauuaugacuaaaacaaaagcaaggguaccaaacaggacauaagugauuaaaaaauagauuagugacuaucuuuuuacagguuuauucucugagccaaaugacgucaucuaaaaccaaggcuuuuuaaagcuguuuguucuuggcacuguuucgaugaaucauuuuccagguccuaaugugccuacaucugcuuugaaaauacuuauaacucaggagaaacuuccuucagugcaguuacagauggugacauuuucuccucuaccuccaagguucauguuuuauccgcacggaccagcuagauggugagacugacuggaagcugaagguggcggugagcugcacacaacggcugccagcccucggggugagcuccacugugacacuguacuuguuuuuagcaauagcgauggggugguaaggaaguuucuguugauccgagcugacuaauuugaacacauuuaagcuugcaauuugucauuuucuuauuccucaaggccauuaaaaaugaugugguuuucuagugcacagccuauuuuagguaguuuugaauguuccuacugaccugacacuuaggcugucuauauuuuuaucugucuuaaaauuucucaguuaaguagucugucaagcugugauggacaggagagucuggugcugggaguuguugauuacgugguagcagguugaagugcucugggagaauagaacucaggccaugaccgagccuaguccuugagcuaagucuuuugcugcagcuuuuccugcugaggacaggagacuuugauuuggaggaagugaaugcugcuauguuucuuaggcugagggaagggggagagauaguuucagaccacacuuaacaguugcugagugaguccccuaucacuuacuacccaggaaagcugcagggagagauuagaaacaacagggucauagaaguuugcggauuccaugauuucuaaagcagauuucauagauaucaagaaucgcuucugcuaguacaccugacuuucccucucccuucucuucccuccucccuucuuaaaaaaaauacccuacaguuagaauaguuguuguuuauguggcguuaauauuuuuguuuuuauauauaacaccaaucugaacacaagcagcuuugucuucuuacauaaucugcuguccuucugugaccaggagaaggauugagauuaucacgagaagaaaggcuucugggggaagaguaucugcuuacugcagggcaguaagagucuucacaguaaaccgugucuuugguggcaggcgcuuuugccucuguguguugaacuauggaaguuaaauggcugagacuugggcaaauuuugcuuuuuuggguauuuuaguauugccuauauuuaagguaauuucuaaauuaggauucauuccuuauauauuucuuuuguaucuuugcuagaaccaguuggacccuagccagguguucuuaguccuuccuguaugcuauauuguccuguagucacuggcuuggucucuuccuccaugauuuugcuccagcauuuuaaaacuggaaaacacauuuuuaccucuggugccagaaaaaugagcuggggcccaugugagacacauguaguuucugaucuugaguuggagucacccugugcaguucaccagcuagcuucugcugaucuguuguagugacaaaaagggaaaucuugcauuuuuaacuuaguugugaaauguagacauugagagaaggcauguaaaucacguguuccuccuuuaaacaaagucuuagcauuauggggugauauaaucuuaacgauuuuauauuuaucaucuuaaaccuucagagaguucugccaaacauaaucagacacauauaaucaguggaaauuuucuuuuagaagaucuaccuaucauaaaauacagaugaaaauaccucggcuggguagagaauauagauaguucauuguuuuaaccuugauuaugucacaaucagacuucuauccuuuguguacuagaaauauguauuucuuucuuaguuauuuaucuucauccccuuugccacuucucgcuggugugugucauugaaagguaugugacgauugaggggaggguacagcacccucuacacggauagagcagaugaacacaaugugcuuccuuuucuuaaggaggugggaauacuacuucugcuuuaucuuuauguagcacacagucauccuucauucccgaaaguuuauguuacguguuuuagacaauauauugugauuuuccccuuuucuuaacuccuuguagaugcucccaaccucucuacccucucaacuguauuuuuccucuucucucuuucucucucaaaauaaaaacaaacucaaaaaugaaaauuaagcaaaaaacuaauaagggaaaaaaaaaaaaagaaaaacaaccaccaaaacuaaaaccaaaccacaacaaaaaacacaaacaaaccaugcaguauauuuuguuugccaacuacugaauaaaacugauuuuucccuuucuacuauugugaugaaaacaucucauuuaagauugagugcucccaaguuucauauucucugcacauuguccaguugugguucuuuguguucugcacacaaagaagaaacuuuccugauaugaauucagcaagccacugaucuguggguauaucauuaugucauuaggagucuuuacuacuauauugcuuuagcguaguaguaguaguaguaguaguaguaguaguaguaguaguaguaguagcagcagcagcagcagcagcagcagcagcagcagcagcagcagcagcagcagcagcagcagcagcagcagcaguuuuuccccauggccugucuagucucacauuuuugaccacuuucacagugucagguaugaguuuauguuauggaguaggccccaaauucaauagaaaaugugggugguuacucccauaacacuuaggucacuauuguaucaguguaucuuacugugagguugcuguuuuguuaggguuuaagagucaccaaagaagcugguggugguggcgucggcggcgcacgccuuuaaucccagcacuugggaggcagaggcagaggcaggcagauuucugaguucgaggccaaccuggucuaccaagugaguuccaggacagccagggcuauccagagaaacccugucucgaccacccccccccccaaaaaaaaggagucaccaaagaaugauaccccagacucaaaucgaauacagaagcaaagagcgguuauucaacugaacuuccugcaugcagggguuuccccauuugggaauggaggccccuaguagcucccaggcccaaauuuuacuguuaggggaauuccaggaaggggugugugcccuuuuaccuugaucguucagcucuaucucuaggagucugacugauucuacaauuggucaggcucuggagaccuccuuggagucccuuacucauucuacuaccuauucuuacuucaggucagauggcaagguaucuucagauuggcugccuauagcugugguuggcucaccacagguuccuggauccagguucucauuuaugggaaacagaaacuuaggccuagucucccaaacugcucuuugcagccugucauggacucagccuggcucuggcuagcucaguccucucaguuucaggucacggggucuguagaugauugauuuucaucugcgguagcgugcggaguaccuugcacagccccaugaaugucagcaggagugaaguuucuagcuggacauuaacucaguuccuccauguuugaugacauagauaagugguguguucagaaggugggccucacuaucaggauguagagaguaguuauagccagugguguucaaccuguuugugacccuuggcacccaugcaagagccaaaccugcacuuauuaucgugugccagaaagagaggcaggcagaacccuggucucaguuuagagacacucuuuccaaagacaggagacagcuacuaaggaacacuauuaaaucuugacuucuaaccuccaaauguguguccucuccccaccuuauucagaaccaaacauguaaugugacacuggguccugagcugcgguugaggacuggaaaugcauuuuacuuucuaucugguguaaauguaucuuuuuuuuuucuuucuaauuuuguaguuauauuuagguacagagaacuuaguguacauuuaacccaguguaguggcgaguucuuuagccuuugcuuuuuccagcuuggcaaugcgagccacagacuuaggacccaggauguugccuccccaguggcgacggaucucgucauaucugucauuauaauugguccuaauagcuuccaccagcuuagccagagcacccuugucuuccaaauuaaccugugugaaggcaacaguggugcaugucuuccuguggaccaggugccccagcuugaccauucccuugaugaugcaguagggcaccuccaucuuucgacacagggcagguaggaaaaccaccagcucaauauggucuacgucaugggcaaucaccaccagcugagcgagccuucuuguucuccaccaagauggugacuguauugacuccugcucggaggacuggcgucgccuuugccagcagcuuucuucucagcacgggccaauagccuuugcuucuucucuugcuuugucucuggccuguacuugugggcaagcuuaagcagcugaguagccgucugccuguccagcaccugggugagcugguuaauggcaggagggacuuugagucgcuuguagaggauggcucuuugccggugcagccugauguaguggggccauuugaugaagcgcguuaaaucucuuuugggcuggauguccuguccaaugcugaaguucuugggccucuucucgaacagaggguugaccaccuucuuggccuccugcuucuugacgacggcgggccgaggccaccuucuuccccuuggccuucuucccuuugggcgucuugcucccuccgcugcuggagagagguagauguaccuuuuauucuccugauugucauuucccaggcucacugcuaugucugcuaaccuauccuaguccuggcagcuucuagccucuguacaguccuaucuaggccuagaaugaucucgcccucugagguuacugcuuaauaagcucaccccuucuuaguuccuucugagcucuggcuggcuggcuuaacccagcuguucuguuucaaacuccucuccaagaugacugauucaaucuggcuuuucucuuuaggccucuccugaauuggucucauacuaacuuuggcaguauguuuuaauuuucuggcuccuccuuauucucuggcuuguuccgucuucauccuaucucuguaaaacucuugguaaaacugccucugucuuugugcgugggcuuccucaaauagcuucccuuuccucuguguucucaugagaguugggcacauccuauccugucaaaccuuucacuuugucugccgcucaauuagauaacauucagacacgggggcuuccgucucuaaacuaacuuuaccuucauuguuugggauuaaagguguguacuaaggguguguuugcaucccagccaaagggauuaaagauguguguuaaggcugggccauaccacaacuagaaacuguacuuuucaguaaauaacacaaucucaggauucacaguaugaccaaauaucuugcaacagucugcuguaguauccaguuauucaugaauguuguugaucaggguaagaaaguuuuuuccuagucuauuuugcucagagacuugagaaacugcugacaaguccacuccauauaugaguaaagccagaugcaucuagcagagucaggagcagagagagaaaguaacagaauagauauggccagaaucagggaaguaggagagaguagaacagugggcauggcaagauagcaagagauagaaaguagagcauagcaggagaaaauaagagaguaguacuuggaaaugacagagaccaguuagaacugccagauucuagaaggaugaguagcugcgagaagagaagcccaggcacuggaaugaguguaagguaagggagaaggagagaagggcugggaugcuagcauggacucugagaugucugacaguugcuugugauacugagggagucuggaggccagcaugagcuuugauaugcaacagcaggugacuacugugucccuucugacagagguaagggaacugacuucuuuuugcagcuaggaacuuguuuuacaaguuccugaggaaugcugcuuuuaucuucaguccauaaauccuccaagaguuucaguuuuagcuccuuucuaaagaguuggacauccugaggccuaguaguaacaaaugggucuucucuucucuucucuucucuucucuucucuucucuucucuucucuucucuucucuucucuucucucucucucucucucucugucuuuuuuuuuggaggcuuuucuguauccuuauaugauccugugcuuuuucuuuuauuagcauauuaauacauaauguugccugcccuuacacuggcuuuguugucgugccacggauaaaaugcuauaaaucccauuuucuccuguuggauaucuuuuucauauauuguauagcauuugacuucuguguauuuuccugggaguagggggagacuauguguguauguacaaauauaucaaaggauauugauuuguacugguuuuacuuaaugucuuuuauuugauaauaagggauaugcugcccauaaaauauuuuauggagucuuuuugccucuuguauuuuuaaaauaguugacaucagauaaaugcuacuguuuuuuauguguuuggacagauucaccuuugaaauuaucugguccuagaguuuagcuuucugcaaaguuuuuaauuaggaauugaauuucuuuacuggguagagaguugauuggaucuuucaucagugcaugauaauucuaaaguuaguaauuucauuaucuuugucauuuuuagguaugucuguauuugaaacacuuaguccuugucacacuuaacugauucacauaucuagugggauuuauuuauuuguaaugcuggauauuauaaaaguuauaaucaauauugagaaauuuuuuccuuccuucagugccucuuaucaacauucuuaguuaaaaaacuuguagaucagcaucgucuugucaaggcuuauucuuaaauguuuuagggugggcuccauugugcugucaugaggguuuagucccaagacaagacaagcuccuucugggaacuacuaaacuccuuugccuaaugguaccucucucaaaaccugaccacuucugaacucugcagcuucuaaagaggccaguuuggggguuagcaaguaccuggucagcugguuucuaccuugugugccuagugucacuguggccaacagacucuaguggagaccucugcagacuuguacaguucuuugucuuucccucaccucuccagcaacugcaggcccccuuaucacagcuuuccugagcucagucugugauucagagcccugccucuccugcuuggcaucuucccuguccagugacucgcugcuucaugucaaaggagugggcccacagcuauaugucuauccacccccaggucauugugucccuuucugaauauggcugcuuccuguuuuuaacccguuuuuacaauuuuuccacugagaaagcaggucucauauuaguccguuuuccccuuacuuuaauagcaauauauccauugaacaugccaugaguaauaaaauaggagaaucucccucauagguuauccuccaccccuuguauuuaggagaguauauuguguauacuguuuucccagaaggaaauuuaaguaacuguguguuuggggucauuuuuuaauguaagauuuuacaaauguuucugaauuuuuauugucuguuuuugaaauacucucacccuaggccuccaagugcuaggauuacagaaugcacuaucaugccugguauauguuaggcuuacauagauaaucuuaaaacguguagccacaucuguaaucucagacauuuggagacugaggcaguaggacugcaaauucaugucccaccccagcuacagaguaaauucaaggccagcuaggcuaggcaauaugaguucuuuuuuuuuuuaaagauuuauuuauuauuauauguaaguacacuguagcugucuucagacacaccagaagagggagucagaucuuguuacggaugguugugagccaccaugugguugcuggaauuugaacccuggaccuucggaagagcagucgggugcucuuacccacugagccaucucaccagccccaugaguucugucuaaaaauaaaacgugaaagaagccaggcuauauagcccaguauugcgugcugaaagugcuaccuagcaccuuggaugcccugcucucagguaguccccaguacuuacaacauccaauuacaauauauguuuuugacguuuauauagauauuuauguuuguauauauagugcuuauauugguaguuuguuguaugaccuaccaguauccuaaaguuuuucuuuuucuuucuuucuuucuuuuuuuuuuuaaaguggauacgguucuuuguucccugccuagacuguuccuacuuuuauagucuacguuauuuugggguaauuucuaucuuccauacuaaaccucuacucuaucuagugucuguacaaaacacagcucucaccucaguguuaauaagagauagguuauuuucuggagcugaaauugagugaccauaaauuuuaugggccagagggagugccuuagggggcccaugcugaggcaaacucccugugguacuagcuauacaacagguauaaaaggaaguuuauuuuggggcaugagaagggaguagaggcagagaaagagaaggagagagggagaggaaggagagagaggaagggcagggaacauauggagagacagagggggagggggagaagaaagagaaggagaaaggggggaagagagggggggggagagagagagguggggagggucagagagagcuagcuagaggccagucuuuuuauagcaaaccaggcucuuacugggcuguugcuagguaacuguugggcggagccuagaagaaaugcuaacacagaccuuguaaauucugugcucaacugugguaagagauucaugaauuuuaaaaaccuuuuacauuuauuucaugugugucuguguuugugugcacagugcacaugugaggggucagaggacaccuugagguacuaguucucucucuagccuguaggucccagaaaucaaagggagaucauuaagaaaguguguuuucccacugagccaucuuacuaacccucaugaaaaauguuuuccuuucuuuucccuuuuccuuuucuuuuucuuccuuucuuuuucuuuuucuuccuuucuuucucuuuaauuuuuuuuugucauaaaugaaggcacauuuaauacauugaugggaugucagauagguuacagaaacaugaggcuaccucugugauaguacagaugacaucucagucugagcugguggaagcugaugucuguuaauccauuuauagaugauuuacccagugaucauaagaugucuacaggccaguguuaguuaggugggcagugaauggcuacuaaaggggggcucaaagguaacucaagauaauuugucauuggaccugcaacauuaguuggaaacuccauaaucauagauguucuaauuagucagcauuaauuuucggugaauuucugagugagaaaucaaaaucaaacaaucaaaccauguuacucacccucaccaguacuguuuccugaacaaaguaauuuuuuucuacaaauuuaaaguuguucucaauugguucuaucguuuccagucuuccucauucacaggcagaugugccuguucccugguccuugacccagugcacugcacacugcaaagcagaccuucagucuguccuuuuaccgcuagcuucaugguuuccauugcuauauguaaaugugugggauugugucggggucagcacuagcauguucuccuccguguuguuugguuuccuggugugcccuaaugcuacuuuucugacagcucuuguuugucauuuuaaucacuucaagugucugucaguaggugaagucagaagggucacuagcaauuauaaagcugcaguuacugaaauacucuagacugguccuuaauguccagggccccacagaugaugaagccaccaugcaguugagucuucagccaccugugcucagagugagcguagccaaucagcuccuucaccaccucccacuuugacugggugguucuuuuacuccuuuuaugaauaaugugcuaguaagauagcuuaaaaauuaguauacuauuugcugucuaacuuagacugauuucucucuuuaucaccauaggaagucaugcuuuauuauaagaggauguucucuucauuuuuauuaauggaaaauauauaugauaauuuauauuuaaaaguguuuacagauacauauuacauauaaugaaguauuuaaagagguauacuuuucauauaaugcuacuuucaaauuuuaugucuaauaugguuugauaggaaguaugaauaaauuugagugaaacaauuguggaauucaugaaauuacuguaauuuuuuuauuugguuauguaugcacuaacaagaauauuuucuacaaaagaacggaccuuccuaugcaugggcaaugauaaagcugaacacguuuugcuauuccauagaaaagaaaguucugcucucacuguagacaggcaguuuaguuugucaucauuucauagcuuacaaugacauaggugucacuuguuuuaccuccugugacuuagugauggauuuggaguacuuugugucacaucaccaguaaugucccccucgcuccuggaaguguggugcagggcagguggaccacuugugcuacagcucuuuuuuuuuguuuuuuguuuucuccugaccuguuaauguggucauagcauggggcuugggagucuugugacugagcuugcacugcucuacugcagucccagaugugguuucugccgaacaguuuccagacacuguagacauuugggaaauaugcuucuggcuuuugugaucaagcaaauuuauuaacaaccaugaggccccagcaauuuucaauaaaucaugacuugcugauuuauuucaaaagaucuauauagcaguaaacaauaccauuuacauuuaauuaguuuuauugaacaagaggcaauuuuauuuguaaugaaacacauguuaugauuaaggauguauuuuaaugaccuuuaaguaaugcgaacaaauguugcccuugaccuaauagcagaggcuuuccuacauuauugaaaacuucagaaugauuuuuaaauuaucaugaaacgcuucgaaugacacucucauuacugugucauuauucagucauuugaugucugauauaguaaaugaaacacacucuuguaaauucucauaugcauguggaaauagggaucguugcuagcuuguucuucaacucccuggaucagaagguggugugugguauggaagcuucaugugcugacaguuauuugaccguguuuguucaguuaacagauugauggucauuuuuauuuucuauguuucaggaccuuuuuucuaucagugccuauguuuaugcucagaagccacaacuggauauucauagcuuugaaggaacauuuaccaggguaagguaaauaguugguuaauaugaagauuuucauuauuuguagaaguuaaagguaauggaccuuuguuuagagacaacaguucagucuagaguacauucaugcagagacucuaaagcuuguagcaaaggcuguaccaugugucagguucuucuuagaucuucucagcagcaucuguguuggugggucacauucagugcaggcucucuuguguguagcagauguccuguugauaagauccugcucccauaggaugggagccagaaaaauagcacucuguagcuaauuuaaucuucagauuauaguugauaacugugaugugcucagcguuucuagcucuuauuaccuggaagaauaaauauacauuuauuuauuuuuauuuuuuccuuuguauucguucuuuuuuuuucuuuuuuuuuuauuacguauuuucuucaauuacauuuccaaugcuaucccaaaagccccccccccuccccuacccacccauucccauuuuuuggcccuggcauuccccuguacuggggcauauaacguuugccugaccaaugggccucucuuuccagugauggccgacuaggucaucuuuugauacaucuuuugcagcuagagucaagagcucugggguacugguuaguucauaauguuguuccuccgauaggguugcagaucucuuuagcuccuuggauacuuucucuagcuccuccauugggggcccugugauccauccaauaguugacugugagcauccacuuguguguuugcuaggccccggccuagucucacaagggacagcuauaucaccguccuugcaacaaaggcuugcuaguguaugcaauggugucauugcuuggaggcuaauuaugggauggaucccuggauauggcagucucuagauaaauauacauuuauauguauauguaugcauuuacacauuucuuuacuucuauguguauauuuugaugcaugaauuuguuauuacaaaaacuugguaaaguaaaccuugaagcuccccccacucuuccauuugcucaugauuauugggaauagaagaacugaauacuuauuuuagcagcuuauaacuuuuauuucuuaauaagaaguuuuaugacuauaguuuauuuauacuagagcaugguuggacauguuauuugucauauacaagauuagcuagugaucauuaucacuuacaaauccaucugcagauaccgaguuauuugacaguuaaucuacaaguguggcagugcaaguugagaacaccuuggagacauucagcacccaugggagauggcuaucauguugcagcuguguuuugacaugugugcugcagagcuacaugccaagguguccuuggaaacaugggagaagcaugugcucaucaugcuccauggccuuucugugcuuuuucaaaauaauuauggagaauucacauucuuguaaaaaacauuuuagcauaauaaaacuaucauuuuaggugucacuucauacaaaaauuauucaaaccuucauuauagaguuuagagacuauuugcauucuucuucuucuucuuuuuuuccccccaucucucucugucuucccucgucugcauugcuuauggcuucuuaaauguugggaauaucugcuagaccucaaggucagagaguaagaaugggcuguucagaaccuggggguggggggugagugugcaguuuguggauagacauguuggagugguaauguagccagucccaguggaagaagcugugugagaacacucagcuuagaagagaagugguguugguggugaguuuuagcaguuacuuuauuuuuccuguugauuagagguggguagagguuacucuucuuaucccaugaguaaacuugguuugauaauuccucagguuucucucucuuaaagugguguaaaauucaaaguagcagagccauugucaggauaugggguguaggggugugccaucuugggacacugauguuagagagucuuugcucccugaagagggcccuuuuucagauaggaucacuuguccucuggauggauuuggugaguguagcucuuuaaucaucaagggucuuuuggaaacuuuggaaaacugugaagcaauaauuuccuacuuaaaggcaugguaucucuaggaagcguagcgaagaaggaaaauugacuguucugaagccacacuguagcccucuggagagucagccucauaccagccuccaacagagccgacagagcugcucuaguucauagaguguuggaguguuaagaggguaccuugugaauugagaacagauuccagcucccaucaugacaguggaauucccucuguguaucugguucaaagaaacaacacccaacaguuauuaugaacagaaagaccuauacugcauaugaaagaagaaauggaauuauaauuuuagguuuuuauauucacccuugaaauuuguauguauuaucaguuggguacauaaagacagacguguuucuuuuguaaugauguagauaccuggaauuuaaauggaacaugacugauuuuccaguuuuguuuuauuuuguguuuucucucucaacaggaagacagugauccucccauucaugagagucucagcauagagaacacucugugggcaagcacuauuguugcaucagguaagaacaaagaaguccccuucaagaaucagccucacauacaaaggauguuagccuuguuuagguucucuaaagcagcuuuccuaaacuucccugagguauuuagcaauaguugauugagaagccaggggauagucuugagaguuugugaggaggccuaggcuacacuguucacccauggcaaagccagaccagaagcaugaggguguggaacaagggccauuuuucugggugugacauuuguugcaugauacacaacagagugcuuuacugggagaugucacaggagugcuggggaggcuaguaauaauuuuugaugguucuuaccuacuuuuuugucuagcugacaagaucuagaagagacugucugggguagcuauaggagaggaaaggguuaaauggagacagacaagccagaaagagagagagauggccaggacuucagaagcacagaagauucugauuguuuuuugagggaaauuagaagaagguggaauauuccuugugguuaaagaggaaguuacuuaacuucacaguucugcaaauaaauuucucugggguguaugacaagugcagaguuugcuaccaggucagaagcaggcuaacaucaaugauaaccuuaggagggaaucgcagaagaagcuaucagccaucuuucagauugucuccugaucauggcacaguggcacugccccuucuuuccuagagacugcuucuucacucagcaguuuugaauagugucaguuucuccauaugcugagacagucuggaaggaggugguaauggaaccuaucaauuggaggcuaagguggguagaaaagacuuuaagaaaaugguccagauaauuuuagcuacacuuaaguaccacaaaaaguuccauguccuaugaaaguaugugagccaagaaccuuacagacaugggguaggaaaggcuucuauguagaagagaugucuaaaguagauuaaagaaauauauaugcagcagggcaauugugucucacaccuuuaaucacagcaccugggaggcagcucucugugaguuugaggccagccucaccuacagagcaagcuccaggacagcuggggcccuguuacacaggaaagaaacccuauccugaaauaucaaaaaguccugaaauaucaaaaaggaaggaagggagggagagagacauuacacagacacacacacacacacacacacacacacacacacacacacacacacacacacacacacacagagagagagggcagggcggggagagagauugagaaugagauugauugauuccagaugugauggcugacaggacaguugggggaauauucccaccaaaacauagcuaggagaaggccuaguacugagaggacauggugcccuaaagaacgcuuagguaccugugugccugaccccguguguguguguguguguugggggaggaggauguuuggcaguucuguuauccguuguuuaaauggaaccuguuuauacuacaguacuagaaaacuacagauauucauccacccuuuagggauaagauaugaaacuuuuauuacuauguuucacacuuuaaaaacuaggcacuuaaauguuuccuagugcagaugcucucuuauaaacugagggugagcucagagaccacacccauaccaagccugguguggaugcuauacagcuccaugccugggcacacagggcauucaggugcacccuucacuugagggacauggcucguggaugggucuguagggguagauuguaagaaucuugaagugcucauuucugugagguguuucaugguuugauaugcacauauauuuauaaaauuguagguagagaagcaaagauguuuguccaugaagauauuucagaggugggaauacuggauccucugcuguggggaccaaaggcucagggacuuugaauucagcuuaggaauggugaaguguccuuguaagaccucaccugcccuuacacguuccugaccccuacagaccuauccacgagccaugucccucaagugaagggugcaccugaaugcccugugugcccaggcauggagcuguauagcauccacaccaggcuugguauggguguggucucugagcucacccucaguuuauaagagagcaucugcacuaggaaacauuuaagugccuauuuuuguagaauuuuaauuuuuguguuauugagcauuuuauuuacaauguuaaaaauuauuaagggauuaaaauauugucugucucucucucucucucuuuuuuuuuuuuuuuuuggcuuuuagagucaggguuucucuguauagcccuggcuguccuggaacucacucuguagaccaggcuggccucgaacucagaaauccgccugccucugccucccaagugcugggauuaaaggugugcuccaccacugcccuggaaaagacugucuuuaaauacaauuuuuacuacauguuuuguuccuuguuucuguuuuaaauacauauuagacuguugcuacuaaaccccaguacuauugauuuguggcuuucuccccagagccagaagcagcuugagcuuaaggcuucugagacgucccaagaacuuccuggacauaguuuuccugcuugacuuuagguuucaggaugaccuuggcauguaguagcuaaguacuuuaaggacuugugcugcagagguacugacacgcgcauccuaugucuguccccuguagcacugguuuugauggguacuggauccucuuaggagauguucuagauagugguucucagccuucccaacauggaaucccuuguaacacagcaacccugcauaugcaguggcucccaaccauaaaaucauuuucaucgcuacuucacagguguaauuuugcuacugauacgaaucauaauguaaauauuuuugaagauagagguuuaccaaagggguuguaaaccaugggcugagaacugcuguuuuaggcaguccacuuagaaaagaauaucacuaugccuuucagguucacauauuucuggacauuuaaaaauauaagcauuuucuuucauuuuauauauuuuaaaggauguuuuauuuuuauuuaaaagcuuaaggccuuaggagcauugcagucuaaaacggcaggaauaaccugaguguucuuacccuuccguaacuaauuacaagcuuagaagucuuuuuaacuaauaugaggauggcaccuuuuaaaaaauagauuaaaauuacauacuucccccuucuuucucuuuuuuccauuuacacccuuccauguguuuaucccucuucaucuuucacauccaugucuuccuuucuuucauuguuguugcacauacauguuuuuguguauaaauauauguauguuccucaauauaaauacgaccugcuuaugugaucuauauacuauugcuugcauguauguguuugcagggcugaccuuuggugcuggauaaauaagugguggacucuuuccugaguagcacucacuuccucugugcacagcccuccuuaacugccugcgguucuuuguccaggguuuaggccuugcaaaccuugcugucaauguguguuuuguggugccauccuuguuuacucgugguuaggcagccguguuguguuggugagauuccauggcauguauuuaagcugugcugccuuucuugucucacguggacuaacacauaguaggaguggugccacugugccguuuccaggucaagaguagcucuuagaaugaaauuauuucugaccuucuuuucugccaucagguuuuaaaagugugggacucagugucagugugcaaacuccauucaaaaguaggucagguccucacauggaguuguccuaacccuaaaagcaaacuucugaagcacuguaugagaauguaugugcacagauuggauugcccaugaucucuguccuccagagcaugcuguagcauguaugcaggagugggugaagcauuaugugagaugcauaaacugacaacaaauauuuggaaacauuuagagguauuugauacaguuuacuaagacuuuuuuugaaaauggggguauauuuucuuuugcuuguccuuuaguuuguuuuucuauuaccacauuuuuuauuguguaaguagcaguuauguaaacaaauuuucaaaauaacgucuggcuauuuucuaugcaugguuugauauauuccuauucuagccaugcauaggucauuaguaauuagcauucguuuaaaaagagacuacaguccagugggaaaucaaucaaauaccaaccacagaaggcugugguugaagguguuagcugccuaauaauguuuacagguaugagaaguagccagggagaagcugcaacccaagauccaguacaugguuggauacuacugcagaauuccuaucuccugcuggguuuuguguaaacagcagaggugaacaucagaauuugguccagaacuugcuguaagccuaguuauugcuaaaggccgcaauuugagugccucugaccuagcagguguaggucuccuguaucaguuccuacagcuuuaaccucauggacuguuccuggugcagaucuucugugucucucucccuuuuucucuggccacauggagucuucacacagacgggcccuuucuuauguguucuccgaguuccugagcuguaguguugucugccccagucagugugcaucugguacuuuccuguuuggccugguggcaaagcuucuuacuggggagcaucuguaaagauuggaccagagaaccucugucagcuguaguuggguucugacugguucuaaugacuugucuguauacuguuucccaggcucaggaagcauuaccaauauuugauauauauuuugcuugacagaucuuuuauacauacacagaauauacacuacgucuuuuacuuuauuucuggguuuuucuuuuguuuuauuugaauaagcaucccacugucugguaguuuaaaaucaguaaucagucuguuuaagggucuaggcuuauuauuuugcaucuauauguaauuuucucuagaucaucuaaaauguuucucaauuuauaaguauugguuauugauuaaauuccacaugcuguuaucucugauuaaaagguggcaacuaaaguuuucuaagagucugauuauuuaauaaaaagaguaaucaguucgguuugcuggauuacauuuuauaaucauacaucugaaauauuuacaugaagaauaccuuuccccuaagguugaugcuguuagcauuauuagauuuuauagaaaaguuauuugccuuaaaauauaacucaacuauuaauuugaaucgguagaauauuuuaugaaauuuagauauauggauagcagggaggcuacaguauagccagaguguuaauaacugaucaccucaaaugcagguguaauggaucugaaauuugaaguuauauagauggaccacacagugaucguuauacuuaccccaagaggccaguguagggccugggcgccuauucaguagcaucagugugucauucuuacgcuagcacagcuugggaaaguuagcaucugaaucuuuuuauaauauuuuuuaaugauuuuagucaaaucaaagguguagauuucaaccagaugaguauaacagcauuggcuuucaggacuaagugcucaugagacuuuuaaaauacuuucuugcugaaaacugaacuaaaaauuugguuuacuucuagauauuaugucucauugcucuuagggauuuuguuaugcaguauauaccugguuuguuaugcaguauauaccugguaggaauuucuuuguggcucuggguuuaacaugcaaauauauuuaagaauuugcagaagugucucaguuuggagcaagaaugaaagguuaauuuuaaacuaaaaauauggauuaaaagaucugaaauucuugcauguaaaugcccucacccgugggaacuuuggcacauucugcaucuguccuguuuuaucugcugcucuacccaagaguauguccugccuuguccuagaggcuuguuguaaagacucauccuuucccuuugcucugugucuuucuauaggggccuacaucuuucuauaaauauaaaucguuuguccaagagagugaagagucgugcauaguacucaacuaauucaagcaauuuaaaguaauuaaaaagcacgggacucagaacaacaaugcauuuaaacuaauuacacugaguagucauuuuuagcaaccaucaaaugugagaauacaaugagagccuuuaacaaauguuaauacaucacacaacuguaacaucaggaaucgugucaguacacuguguuucuuguuagucuuguguuucgcucguugagugcuauaaauaccagcccagaguccacagucuucagaaccugccuuggcuuuuaggauggagacuuuaaguuugacgagucauccugaaggcuuccuggcacuuguuuggucugcuaaucuuaaaauaaauaaauaaauaaauaaauaaauaaauaaauaaauaaauaaauaaauaaauaaauccagucggaaguugaauuuguugugagaauauggucauuucaacauuaaugauaauaaauuaaauugacaaaauaggaagaaaauguugaugagguucuauuuaacauguaaccuuguucuuuuaauagugaaacaauucuguggugugagcuccugugugagaaaguuucugaucguaucaccccaucaaguauuaaagucuacacuaaacacaggcaucuuguguaggaaguuuaaauggauaguaauacagagagacaacacuuggggagcugggugagcuucaugccccuuguuggccagucacaccuuccuagaacuugguucaauucuagauaguggugcucagaacuacaagaucugcagccucuguaagcugcgugcagccucugugagccacaggccacugcuaaggaccacaggggucuaccccccauagcuugauggagcagagacuugggcuacagggugugcagcauguggcccuuucugcucagauggagcaaauaggacuucauauuuaucucauggauccugucuuacgguuugcaaaauuucacauguuaaugccacaucuaggguuauaugucuuuuggaguuuuuauuuuguugcaguuuuuacuguguauaccaggcuggcuuugaacuuuagcagaauaguuuuuauauaauuucuauaguuaaauuuguuaggauuguuaguuucaguacuuuauaugccugcauacauaaugucuuucuacguuguaauuuuaauaucagaauuuuucauuuuaaggacaaaaauaggucuguaagagaugcagguguuauaugcagguuccauggcuuuuaguuuugcagucaagagaaaugcucaagccuccagguuaguuaucauuuccuuaaguuuaaaaagcacugcacauuccuacccugucaacuuagaaaacuacauuuguagagacauccacuaaggaaaugaguagugucuaaauguaaaguauuuuaaaauuauguucaugguggguuuuugguugcucaacuacaugauuuuuguggcgcuaagggugggccccagguccuaacacaugcuggccaaguguuccacugaggcaugccuuguccucuggugugguuuuccugauaggcgugugaaacagccacaaaggcuuuccuggucucucaugcagagcaacacugucaagcagaagaacugacuccccugucccuguuccggucuggagagccagcagugcaguuucagucaggaauacagccuuuugaugccguuguaauagugagcgucuuacuguagacagcgggaaaagcccaugucucucucauugucaggaaaacguauauuaauucauauuuugcuguagauaacaggcaaauuuguauuguuuaaacaaauuaugucacuucuaaccccuuucuaaaaguuaagguuaaauuuuauugaacuaacuaaaucaaauagacuguuggauaaauguguaugagcucaaacaguauaauauauuuuccaucaagacaauuaauuagaaaguguuaucuaugcuuucaauuauugcuauaaggaccacuuucauguuuuugcagguacuguaauagguguugucauuuauacuggaaaagagacucgaaguguaaugaacacauccaauccaaaaaauaagguaggcuagauuaaggagcaacugcuuuaaugaacaugcuuuuuccuuucaguaggaaaguauauguagagcugaauagcugauuuauauagcauaauauauaacgugaaaagcagauuggguugcuggcaaauuguaaugagucccugugugugcaucauucucacagucaagaauccuuggccucaucuguguuuccuauaguccuuauuuuuggcaguuagugcuggguuucucaucuuaaguuuuuuuuuguaguuuguguucuuuauguugaugguuuauuuuuaaaacaaucuguuagugcuuuguauuauuuaucuugauaauauuguuauauacagguuauuucuuucauuuccaaaacauagugaaagcauaaagauuccugguaauaccccugaaauuaucauguaugcagucaaaauguguuuauaaguuaaaucacaaaaaaaaguuaguguggauucucaguauuugcuguguggcugauucauguucauaaugaacucagugugucaguguuugaaaguacaauuaaacgagaaacuuucuuauuguucagcuuacaguuauuugaaaauauauauauuuauauauauuuauauauuuaaauauauauacauauauauuuaaauagagcaaacaauucucacagauucaugccuuacucuauagcuuacuaauaguaaagguugcuuuuugcuggaaaacuuucuacuaagcaguagaaaggaaauaugcccuuaaaaauacauauauaugaugucugguaugguauaauccauuucuucagcuaagaacuauuuuuaaaauagccuuuuaaaaagugccaaauguagugacuuauguuguaaguucaaggccauccugggcuucauagagaggagucugucuacaaaacaaaacaaaacaaacuaaauaggaaaacaucaucagccucguauauggcccaacuccauuacaguggauuaacccucaugcuugcugaugugaauggggucugcuagagagucuccccccagcacagcuggucagcuguagauagacagauagauacauagauagauagauacauagauagauacacagauagauacacagauagauacauuggauggauggauggauggauggauggauggaagggagggagggaggaagacagacagacagcagacaauauccaacagggaaaugaauggugaagguuuguguaugugaugaaauugugucaaauguucagugucuguuucacuagauuaaaauucagacagugagauuagguuuguguguauuuauucuauuguaauuuuaauaugaaaucuaacugugaggaugagaaacgucccuuuagauuauuuagcaaacuccauucucgguaucaaauauaccguagucacuacuucaacaauagaacuaaagucacaguaaaacaguucaguagcucauauaucauagacugaugcucauauucauacaaaggagugugaugauugguuccucaagugagcagggagaauaaauaucccaaugcacaugcaacgucacgacuuuuucuuaguguuuucacuuuuguguuuauggugauauugaggagaccuuucuuuuuaagcaauaaguuuaacauuuuaaaagcgaccuuuuaaucagauuuuuuaaaucccuccuuauucuucaguugcacuuagauccaguuuuuuuuuauagucuccaacuuagcagcuuucgucucugcucauguuucauauuggcucauugugcuucagacgcguucaugucauagguaaggaucuucacacuugcuuugucacuggggacaaucuagauuuugccaucaaccagguagauuuugaacaaaugguuuaauucugcaucuucauuuucacaucuguaaaacugagaugauggugcccacaugcaguugggaauuagcuggugcauguguuguucuuaaaaaugaacuugcuaccuaacaagugcucaguagaugcugcaugguaauuauuaucauaauuauuauuuuacuguuguuguuguuguugcauagcuuugacuggccuggaacucacagguacucuccuaucucuccagaaauuugggaugugcaucagcacacucagcugcaucacaguuccuaauacuguuugcugacacgaaauacuuauugucaaucucaguucuuacuuccaauuugaaauuuaaaaauacuugcugauucauguguaaaaaucguaagcagcugggguugggaggagugcucaaugggugcucuucuggagguccccaguuuaguucccagcacucacaaucgccagucacucuagucccagggcaucugagagcgucuucuggucuccgagagcacaaugguuccccuaguuauggaagguuuuaagcuggcacgugggugcuggccagcaagucccagucuucccuaaaagcauccgaagggagccuucucuccagcaccgcuucucuugugcuauuugaaauauccuuguuuccuugguguuagugaggauaggauauuguuggaguuuuuacaggcuuacauuagaaccuuuguccuuccauuaauagacuucacagauggauauaaaagucucuuuaguuggccccacccugggccuuaauuggugcuuagucuucucccuguuuagccacacucauagaagugacaguugaggucuauagaguacuuauuacaccauggguacuucuuagaaucuuuucugaaaaucauuaaucuuaaaauuuuauaacuauacaaucauuaaucuuaaaauuuuauaacuaucuauaaucuaaucuuaaaauaauuuuuacauucuuuccccaaguuugucacuucucugugcacacuuccaccuuucuuccuccucugguccuucauugaccuguuucccuucaacugacacugagugcugaggaacauucugucugcagcugagccugcugacagucgggcuccuuaggagguauuucuccagguuugauauucagauacuguuuuguaacuugaggcuaacccaaaagaaaaauaaauuauauauguuuacauauauaagcagugacaucuuuccaaguggucagugcuaguuuuauauuaguaaaguucaggaaaggacuucagccaggcuguaguggaccaaacagcuaggauuuuacagaggagcuacuggcuuugauagaugcuaaaugaaaaagaaugugauguugacuguaacuacagaagagaagacagaaauggauguuugcuguuuguaugacauuuuccugaaagcuacaucccaguguucuauaacuucuagacuucagagaggacuagugcaaacaaaaccaaauauuucagaaggaaaucagauuauuuuucucagcucuacuggguuucaacuagcaaauauguuuugaccucuuaauucugacagugauccuaauuaggggaccuugauugacagagugguuaauugaaauuuaacuacagagcucacugcuggcagaguaaguauugcuugaaauaucuauaauucugaaugaaugaguagugguuaccagucaggaugagguaacccaugccagauaauauacuacacagaccaugguggccucugcagcagucucacacaaacuuugugccagacuccaucuggcuuguucaucaugaggccaugaugaccuaccuuggcaacccagucccaugaccacuaggauaaggacuggcauuucacauacugacucuuaauggcuuuuaccaaugaaccauauaggguuaguguuauuggccaaagcaauuaaguggcuucaucuaaauucaggguaucaggaaagcacaauccugcccugugauccaaugggagaauuggaaauaucuauugagcaguauuaguacacuuagcgugugcuuauaaaugauguucuccuggagucuucugucuaguaaggaaaaaaaaaguggaauuccaaagaauguuugguucaaaagauaagcagaggaaacaggaagauuaucaagaaaaagacagccgagugacgaggguguugaaucugcaagagagagcaauagccaugggugcagauugcagugguuacuggggaaagaaggagucacuagauguggagucugaaaaauacuaguguaauucaguaguugccguagguuuucaagacagaaauucagguuaauguucuuagugucagagaagcuuaaggggcaccgcaggauggaugugggugccaugcugcagggacugagcucaggguuaagggaaggggaaacgaacauauuuuaugaccaggaucccagagcagggagaagucauguuaauuaaaggagcuaaaggaagagggagaaaagggagagagaggaagguguagaggggggaaacaagagagaaggaauuaagaaagauuguaccauaagacaaaggguuuugugguuugauuguguuuuuccuggugagaaaauucaguaucacaauaauaacuucaggaaagaauaaaggacauugaucaucuuccacaagacaucuauuugucuuccacaagagcaagcuuagugcaggcauccaaaggccccugaaacacauuguugaguacuuagaaaaaaaucucauggugugaccuggccuuuacuuugauguacacaugugagaacugugcaaacuugcagaacucuuuuaggcuccuacgauuaaaaaaugguucaggaaaaccaaucuugacuuaaugauaaauaauaaauccuuuaacagcugguccgguagcggaguugacagagaacuuggucagagauuaacacaauucccaaaagggccaggaugaaagccuugccacucaccuuugacacugggauuguauggcagugauguaguuagugacaauccaaggccuuucaucauccauaugcaagaguguccgcucauaccaacagacgggcacuggguuuauccagaguugugagcaggugucagagaccagaacuacaaccuugaggaugaccagccagggcuggggccagggagcugugcagacauuagcccagaggccuccugugcuggaaagucuacaggcucuaaagaggaggggacacugaaaauggucauccagagacaugucugacaaaggaaguaaggcuguucuuggugacaagguggaguacagccaggaaaggaauugugguguggagguguggcagugucaggcuacaaacccauagguguuuugaggaaccaucuuguguuuucaucucagacuaaauguguguuuuccagccacacauuuggcaaacacgggcauaggacuaccauuguaugaguuuguaauaguccaguuugguuauucagggaggccuuuaaguccugcccuccucgcuggcuuagagauggccacagcacaugggacuuguugacuaacagagaugaggcucccuuccauaaaaacauugaauacuccaucuccacaucugccaccuccugcuccacuucugcuccugcuuuggcacuuaauuggccugcagcaucauucacuuuaucuucugcuguggguguggcucuccaucagcuuucugucugccguuacugugaguaaacuagaauccauccuaguuaaguuuuaguugcugugauaaaauacccuaacaaaggcaaccuaagguagaaggguguugacucuuaggucaucauggcagagaagugcuaguguagggagcuugaggcugcugauuaugucauaccacagucaaaaggcagagggagcugcuucucagaacccauucuuuacuuauacccauagugcucagcucucccaucucaguuaaaucagucaagauaaucccccacaagcaugcucaaaggccugucucucaggugguucuagauucuguuaaacucacaacucauaaucaugaccacaaaaaugguuuguagcagagacauaauggacacccaccaggacccagcaaaggucaucccuguugaccuuccuuggagcuuucacuauucagaccuccccgcccaccaucaauucccaaaggcaugucagucugccaggcaccaacucccaccaguccccuuucucucuggauccccgacagagugccaacuuucccacuuaggcuggagcauccauaaggaccuguuugugccuauuuuauuuuauuuuauuuuauuuuauuggcuuuuugagacaguguuucucuguguagcucuggcugugcuggaacucaauuuguagaccaggccggccucaaacuuguagauccaccugccucugcccacugaguacuggaauuaaaggugugcgccgccacaagcagggaacuauugugccuuuuaaaacacaugcagagcuaagcagaugaacaaaugaacauugaauauucacccaauuuuacugguagcuucauaaaucuacuuuuaauuuugcuguugccuuagcuaauagcucuuguuuugggcacacuucccuuuucucuuuguuucauuaccuugcuuuuuguuuauuuguuuguuuucuaguagauuaaaaaauaaaaagucaguccuucaaccugauaugacuugugagaacuagcgagaauaaucuggccucucuaacacccaggcuugaguccgauacuccccagcuccuuucucuucucugugauauggauaucaugcauuugggcccuagauacauauuuuauagguguuaaaauauaaauacagcaugucuagcugccagccuugcucccuccuccugugacaugagcuguacugcuucuuugugcuagcaacaauccugucugcaccaauccugucucccucugagacauggaaaugcaaacucuugcacuuucagacuucccagucagaaacagggccucaguucccugcaggcuuguagugcacucuggagacaaucucugcucugaugucuacccuagaaagaucccugggucaguuacagaaucugagcagagcagcugacuaaugcaacacucugcuucacauuugagauuucuuauuuaaguuguucuugcacucuaaugacaaugaaauauagcuguaugcuuauuuaugucaggggagcuacaaaguacagcauuguuauccacauggaaggacaguuuucuaacuuuucuagaugugaggaaaauuguuccuuaucaucugacuuacuugggagauggacucuacucauauuuggaaguuuuaaaacuuugaacaaauaaaaaguuuuuauuacuaagcaacuuuacaaugaaauuuggugaaaguuuaaauuacaaggacuacuacuucaguaauggacugcuuuauaaaaccuagccuuagauguauuuaauaagaugauacuugauuacauuuaagagggaaaaauucuuagagaagguuaaggaaaaucaaucgugacagguugccauuuucaugccgcucauaauaauaaguugcucagagcuggagcaucaaggaugaaaugauaauacaaauugcuucaaguaguuauuguaaucccucgggcauauugauuuguguuucuaauaaaaagaugcuuucagaugucucauugacagagagacaggugacaugugccauuaugggaauuagagcugccucucguuaucuggauuguugcaaggcauuuucagacaauagaacaaaauagagucaacugugguguacauucccaguugaaaucaaggcaguuuuggaaaauggcuuuuuuauuuuaaaaaggaccauuuauuaaaauuuuaagaguccuuuugaucuauaguaaaauauuacacuagaauagcuggcuuuugucuuuguguguguguagagggacuacaucccaucauaggaccauaggaccucuuuguuuuuccaauagcugccuucuugaguauucuuauuauauuuuucaauuuaauaugagcugcucuauuucaccaagagcuguguguggagaacaaaguguugugguuggccuccuggauagacacuuagaugccuuuuucacaacuguuauuacuauuaacaaaucauaguguuucuagaccucaucaggaaaacacuauccacugucaggccaacugugaagcuuucuaauagcacacagauaacauagugaacaucugcuugggcuacacugguacuuaggccaccgucacuguguccaguauccugauaucacagccccacagagcugugucugcacugugagcacacauggacuuaggacuuuagggaagcaggaaagaggcuauucugaugauaauugagaccugcuuuacaaacacagaaauaucuaaaguacaaaugucaguuuugucccugaauuccuuuaaaauugacuauuaaucaaaugccuugcauaggaaguaagcuauuuaaaugcuuaguucugcauuauguucugaauaagaaaugcuuguuguauauuuaucuauauaagugagaauauauuuggcaguguuuccuuacaccuuaguaaacugcuaaauucauagcggagauuuuauugaacuccuugauuccuuaccugaggccuugaaaacuguuaggaacuugugauaauaguuauuuccggaguaaguaaagucuucuccccaucaucacuugacagcauucugauggugcucugugaguaaggaggacaguuucucugccuugugugcagagugcagagcauugggcagagaggacaugauagagaacaguggagggaugacgcuuuucugagcagccauaugaugccaccucucucagaccagaggauuucuagcuacucaccccgaguugucccauucuguccauucuuacggacauggaaguccucuggagcccuccucuguuaucugcaggucacacagguccugcaaaaucagaagcagacuucacugcagauguugugagccagcagucaguuaaggugagcccuugggcugucaugguucccugccaaaguccacuagcguagagucuggcucuguggagcauguuugccucucuuccuucauucugcugccucccucauccauccaucccucguucccuuguguugcacagagccaggcucugggcaggccauagaguagacuucccacugaguuaguggacagccuuucuuuucuauugggucuaggagccuauagcucaugugcagagaacccuugacauauuuccacaacagcaaauacugugcucucuuagcaggaagugaagugugauaagguucgaucucuauugcacugaucuguucaaauguuuaccauugcucugaugauaaacaguagccucuccgauguugccaugagcccuucuucauccuuccuucccuccugucuucacucaaugccacucuaggaggguuugcuuuguuuuaagcuuguagggccaucuggcacacacugaguagaccagugauuauucugccuuauccaucacaguuucuugaguuggccuauccauuuaucuugguguuucuggcacucugcacaagcuaguuucucaguaagagucagcccaagauaacuaccuaguuaguuaucccugucuuccauaagauuuaaauggcauagaggcaggagcuguguuguguacauucuuauaucccaugcuccucacacagccaauagcucaggaaaaccaaacaaagaguuaaauaagaaauaaaaaugauucauguucacaugguuuauaaucguugugucaccuuaccucuaaggaggggacugccucuuguauuucuuguaaggaaugaaaacaguacuagugagaugauaauccaaagaguggcuuugucuuuaccucuuccacuaugcuuugcauuuaguaaauagucuaugcuaaucuguuugagguauggcuuacuaugauggcaucacauauacauaaccaaauuucuguuaccuuugucauuggcacggaugugaaauauauuuuuugcaucgcaguaauguugaugacuaguauuagcugugcaacacagccaugucauugcuaaacugcacuauaggcacuuuuccuuaacucccaaauacagacuugaaaagagaaaugaacacaaacacagcagagcuacagagaguucauuaaccuguagaaaugagcaaguuguguaugacacaauuuagggagagauuuguuuuguuuugguugaauauuuagucauucaagcaacaauuuucuuaacuuaaagucaauaauuuguuuuguuauuacaauuacaaaaauuguuucauagccuuaagauauagacauggucugaaucacacaauguagagaauagaauuuucauaaugggucaauuuaauacguuuuuaauuccaaacaauauaaagaaaaaugacuacucugaguuuaaucuuggucucagaugaugcauuugccucuuguaugggugaaggcagaucauggggugcucugccucuucccaacaggcugagcacacagcaucauccgcagggaaaucuccaccagggaaugaugcugaacagaaggcuagacucaagucucuuugcugucuuggaacagucgucacaccucuucugauguacauuccugaaugguggucuucuagauaguuaaucauaacaauucuagugguguuuuauauaucuaauuuacuuaaaaaaaaaaaaaaaaaaggaggccaggcauagugguguacaccuuuaauuccagauuucuggaggcuaaggcagacacaucucuauggguuuuagaccagccagggcugcugagauguauguauguaugucucucucucucucucucucucucucucucucucucucucucuaccuguguguguguguguguguguguugugugcacucacauguguuuugaggcagggucuuuugugacccacacugacuuccaauuugcuuucuuagcccaagcugaacaugaacccuugaucuuuaugcauucagcucccuaguugcugguauuacaagcacagagaaauuugauuuugagggacuggauacuauugagauccaagagacaguucuuaaggggaauuacuguggaguuuagugauuaagugagaggauguagaagcaagacccucagauguccucauguggccugccauagcuuggggagcgaguagagaaucaggucccgagggguuuaggcuccuuuccucuuucaggacuccugggacggagguguggaaaccguauaguggcaauguuugccugugucugcaugauggguaucccugugggagagucacaguccuugcaagccaaccucagcuggcugccuaagcccauggaaaaccccacagguucuaagaaucaugcaagcaagugugccaagcuucugugcccuggaagggaaccgacuggaggggaaagcucgcaguguuuaugguacugugucugugaggaagugaugaggccuaugacaggacuguagcacugacaguguugucacaugcaucuccuuagaugccacaggaguccccacaccaccuagaguuuagauguggaguaaagaagcagucacaaagaccugaacgugaguuaauauaaacugcuaauuuuaauauguuuguuuagacuguaagcccauccuguaagauaguguccacugcccuaaaacuucccuagcuuugacucaagacagagaauuccacaugccauuagagaugauccuggaccaccucacugaggugggggcuaaugauguugaagucuugggauagguacuuuuugcgaaggucgugcuaggccaaggacaaucaugucaggaaaccuugagaagcaucgcaccugucuagccugauguguugaacacaggcgcauuuaaggagcauggauucccaagugucaucuccuacagucugguuggagcuugaauuucaugggcuaaaaggauguggggcucacuguuggagggcuccacugaucuuagagcaguaggacuaaagccagaaguuaguugcauauugggagaugaaaagaugaauguucugaggucuggggccaagagagaacuguuuagacuuaccccagaaauaaagguguccauguugauagggaaugguaguaucagggaggaugugaaagaauccauaaagaaaaagaagauggcugauuagcuagacccaaaggauauaaguucauagucuucagaacauaugauugcugacugcaggaagaaauauuugcauggccuugaagugggaagcauauuugccucagugaaguaggugagaccuccuggggcuuuagggaaaucucaggaauuuggaggagaacacugggaaggaaagcugguagagggcaucugagaagacugaccacagugcuaagugcaggugaaggcuugucuuauguuacagugagacuuuugccagccacgucuuguucagauauggaggcauugauaaggaguugaguuugcuuuaaggggugucuggggagcacauuagaauaagcuaaaguccagaaacagauccugguauguucugcaucuggggucaggcauagcacuuguagaucucuucuaagcaaguggcccuauagugauccugggacuagagggacugcucuguagucaugcauccucuggaggcugggacugcuuuguacugagguaacaguguuuugagaaagauaagagaaaauaggcugaaacucaagacaagcaucagagccacaaugagguauggcagaguuuguauugugagcagaggagggguugaaaauucccuuggcuagcaaguaaggguucuauaaaaaaaucacuaacaugccuugguagaugguuagucugucuaggagguggaaagucagaaagggcaaggaugcuaagaaugcuguuuacaggcuucuuagauuaguaggcccuugugcaugcuaggaguguguuuaaccacugagcuaaacccacaaucuaaaacccaaaaguuaagcauauaugcuuggagguggugggggacuaggaagacagcucaguugguauaguguguaucucacaaaccugggaccugaguucuaucugcagaacucauguguuggcacguccuacagucucagcacuaggguaguagagaaaggcaagauccccaggagcucucaggucaaccagucuugccuaauaggaggugagccccaggacuaugccugaaaaacacagagacagcucuuaagaaagggugccugaggcugaccucugaccucugaagguacauguauauaaaacaccaaaauguuuuuaaaugucuguauuuuuaaauguuuuuuaucugcuuucucuguauguuugugcgcacuaccuuuaugccuggugccuacagaagccagaggaggggugagaguucuuagaacuggaguuacagaugguugugagcugauugcugagaaacaaacccaguuccuuuacaagaguggccagugcucuugaucacagagccaucucucuaucccccaggaucuauauuuuuuaagugggauaaaagcaaaaauauuuauaauuguacaucuaauaaucuuauuaacagaaguuauguucucugcaagugcucucagcuaugauuucccagccguauugaaguuguuggcaucacugaacuucuuucugagcuuccuauuuuuaguuauuuaaguuuuacagccaucuccaccauuacauagugagcugcucugcagcgugggcagaguguucuauaaacggagagugugcaguuuguugucauugguaaccauguagagcuauguguauaaaguguucauucagauucuguagaaauaucugauauaaccuuccauuucauaaguuauuuugucagcuuuacacuuuguaaaguuucagaacugaucuuuacuuugcagcuguuaggccguuaaguuuagccuugcccuuacuuaguauccucucacuuuccaccccacaucccaugacugacauucuacaccauuaugauguacguaagcuaugcuaggugccuuaauuaaggguuuuauugcuguaacaaaaugcuacaaccaaagagcaaguugggaaggaaaggguugauucagcuuacacuuccacaucgcuguucaucacugaaggaagucaagacaggaauugaaacagagcaggaaccuggaggcagcagcugaugcagaggccauggaggggugcugcuuaucaguuugcucuucauggcuugcugggucuaccuucuuaaagaauccaauaugaucagcccaggaauggcuccacccacaguagagcaggccuuucccuauugaccacuaauugcaaaaacguccuacagcuggaucucauggaggcaguuccucaccugaggcuucuuccucucugguaacucuagcuugugucagauugacacacaaaaccagcccguaugcuacgagucuucugacugacauuugaauguugcuagcaagaaagaucaauauaucuuggcuuaauuuuuuaauugacaacagagaaaugcaaaaauaccacuuaaaugcacuuaaaauagccaucaguucaguaacuacacaauaaggccgucugauaguccugcagacacucccucacuuaaaugacaagcucagugaggucucugcccaccuggcauuguuuuguauaugauaugaacaaggaccaggcuucuacuuuucagcauguugacacaauagagacccauauuaccaccguucaguggcugcugucucuaccucagugcauucccuagaucuuccaaaccuugaaaagcugugccuaguguguuuugucuuuaucuugucaucuccauaacaugacugugcauguuacucagggucuucucauauauuggucuguugauguauucuaaaacauuugagacuguaagcaggucaguuauaauugcauuucaucccugcagagcuuuucaagacaguugauuugaucauuuagucuuuaguuaguauuuuguaacccuuuaaauauuuuuguaauuuucuaaaaguuucauacaauuuuauuuuuacuugaaaauuuuuuugcugcuuuagccauuaucuuaaaauaacauaaaauucuaggcugaggguauagcuugguugguagagugcuugccuagcaugcacaaagcccaggguuuuaucugcagcaccacacaaaaccagacauaguagugcacuccuguaaccuuaguccucaacuauacauggaguuugagguuagccuagcuguguauguguguguguguguguguguguguguguguguguaauuucucuuuaauagcacauuuuauuucccaauugcuuuuucaguagauguuauaguuacagacuugacaguguucagacauugaauaccuucaggagcuguuuacuuuuuaagcaagaaagaagguaguugaucuuaagccugcucuuaggacgaaugcccaguaucuccaguguggagagguggauuuuccagcuguuguaauuagaauguguaugagcauuugauacccaguugguagcacuauuggggacacuguaaauauuugggacaugaagccugucuuagucaggguuucuauuccugcacaaacaucaugaccaugaagcaagcuggggaggaaaggauugauugagcuuacacuuccacauugcuguucaucagcaaggaagucaggacugggacuggagcaggucaggaagcaggagcugaugcagaggccauggagggauguuacuuacuggcuugcuuccccuggcuugcucagccugcuuagaacccaggauuaccagcccagggauggcacugcccacaaggggcccugcccccuugaucacuaauugagaaaaugccuuacagcuggaucucaugaaggcauuuccucaccugaagcuccauucucgugauaaaaaguuugugccaaugaagaaaauaucuaauaaaaaagauaguuuuauuuacuuaaaaaaaaaaaaaaccagccagcacagggccuaacuggucaucuuuaacaaauacgugccaaggaggaagaaacugaaggaggagaagaaggaguuaccaggccccaggcucuuugacacacaucucauuuaggagucaggcaggaaugauaaaauggguugaaaucaggaaggcuaaauaacagacuguacaaaggaguauucuaaacuggaaauggcugcuaacuuauaaauugcuugagaucauagaggauaaagaaauuaguuuuauuuaucaagcaaugugaacuaaaaauuaagcuuaugugucaguuauuaguuaucuauauggaguuaaucugucagagaaaauugguuaucuguuugauuuuuguuugacuuaagcaauuucaucuuuauuuuuugccauuaacaaaugaacaccaguagugaccuagcccaucugcacucccuguaggaaagccuugggcuuccuacuugcugauucuccucucuuguguuccaacuacuuaauguagcaauacauuuuucuucugagcaggaagccuuugccaacugccucuaggauuugaaggucuuccuagaucuuccaaaccuugaagagcuaugucuggucuggccuggucuguccuuuauucuggucaguguuuguugcuauucugacauuugcucucagcagaaauguugagggcucaggagauucuacuuagcacugggcgguuucagguucaggcaugaacaacauucauccagaauuagaaccuguugacucuauuuugccauaagacaauucacuaauuacuagaauuuuagcucuuuuaguuuagggcaaccuuuucgucauuauguggcaugcuuguuuuuaacagcuaauauguguaauuacauuuaaaauaagugcgcucugagugcuuuaacagcauuuucauauuggugcugugaccuagcaguugucuucugguaguugaauaauuaauuuguuccuaagagcuuuugaguuugaugguugccuaacacaaggguuuccuuguggaugguuugcuggcuuccagugacccuuugcugccaucugguauaaauucaaacugcuucugucaucugcugcuaauugcugucaccugcacauugcagucccucauaacugagacucuaggaacaagacacacugcuuuguggagggcgguuccuugugcauuugcagaugagucccuaaaagggacgauggacucggcccagcagaagcauuuuaggacaauuuauauuguaauaccuaaugugugagaaauggugacaauuuuaugaaagugauuaauucacucuguccaaguggucugucugcuuuaugauuuguuuuaaaugguucuggugcuuaggagccuauuuaggcugugagauuguuucugcgaauuuuucagaagacuuuaacccucuuugcacagcugauaagcuuuugcccaugcacuagccuguagcaccauauuauauuaauguauuuuacguguaauuuagagaacaagaagaauauccugauuugaagucuaaacuguccccuguggcacuggcacagcugauaaucgugaacgagaaagauguguauaucaaauaguuuacaaaaugaagccagcuguguuucccuacauacuguggcuuccugacaugcaucauuaaaccuuauuagcuacuuccuuuuacaaagauucuuguagucuugaacauugcauauuaacauuuucugccccuccaacuggaaauuauuugcuuuauuguagagugucaacuugcucuaguuucugaugcguucuaauugguacuuuagaguauaaucaucgugagauaccacgccaugcauuucuuuauuuggaaauuaauacagaccuuuucacuuuaucugucaaucugagcaacuuuucacacaauucccaacucuugagauugcuuacaagccauuaaguaugaaaugguucauaaaaugucuguaaagacagaaaguaacacaaaaauuuuagaugguuuaaaauaguguuaaauuugccaagauaccagcaauaaagcuuucuacaguuuuaauaauaaaagggugauuaaggaagaugaaaaguuuauuuaaucauauuaccauuaucauuuaaauguuucagcaaaucuuccgaauuauauuuuccuuucaaaacaaaacaaaaaaaaaugcuauggauuuugggagcuaaagaacugauuuagaguugaguguuagauaugauaacuucccuucauauucucucucucucucucucucucuuucucuuucucucgguuuuuuucuucuucugugacugccauucugcugugcuguccuaaaaauuaaaauguuuaccucuuauuaacuucuaguuaauagcuacuuaagcugaugugugggugggacaacaauggcagaaccuaguuguucaagaugauaguaauucugaggugcuucaaacacuggacagcauuuuaugucuucacauguguuuuuaguguuauuguaaauaggugauaugcaucugauuuucaguaagcuuagugaauagacugagcgugcgcuucuaggucuggucccaguaauaguucagcaguagacccuuugacucagcaaauggcucucaaguugaaagcacucuugcuuuuuguuguguuuuguuuguagugauaaaugucauggagaaugggaggaaacuuucagaauaggaagguuccuucuucauugguccauauaucaaauauauucagucauccacgaagcauuaagggagacucagacugagcuguggcacaguaacaacaguagagccuguccuuuccuuccaucccaagccuuuccuuucugagcuucgugucauagaaggcuccagcagagcugugugaagguucuuaagcugugcugcuuucguagugagacucugccacuugcaagguuaaacacucaggaguuuccugucauccucuuguuauuccuaagacgcugugacucagaauuagcaaccucacaugaccuagugaaguuccaccagagagaauagacagucugccggaaacucagugugcagacguucauuggacuagauacuuagugauuuccauaacaagaauugaauggagaccagaauuuuaguauuacuguccaaguauucaaaacuaaaagauuuuuuuaauugaguaauauauuuuauaagccaucaucuucaaaugaauguuuaggagcaacuuugaggaguguucuaacagacucucccucuacagguauuuaaaaugcuguacuugcuacauaaggaauuagacacacauuugcacauauaccuuccuuccagaauaaaaaugugucaaguaauaucuucucuucagcuugaacuguuaaauagugaaaggcaggcaggcagacagugguuugccugaugagcauagggccugccguugccagguauagucucauuucagugagagcauugcugacccaagcucagcucacugucuucacauaguaaagaucaggcuaguguucuaguucuuaaguaaauccaaaagauaaauaauaucuauuaaagcacauacaaaauugccaaaauaaauugaaguguccugcugcauggaugcagaccauugagacuuaguaguucauaucuuacaaugaaaaauaagauggaaaaaacccuaccauauuauuuaucucucucucucucacgcacgcacacacacaugcacacaggcacuugugagcauacaaaaggaagaggaggaagaggaggaucagguacuagccaagcaaaccgaagaaggcacugauucccagggauggcuucaugugaccaugaaacccuaaccagugaacagggcaccuauagugucccaggacagagccaucucauucggguaaagcuggguaucuucucaaggacauguagacacucauuuguauguuauauacgacacauuuuaaaguuaaaaaaguauuaauagaaaugcaugaugcuguucaucacaauuacucaccccauuuagucuuuaaaaagagggcuacacacuguccuuugacuccuggaaucugugaagggaauauagagcucugccucacugacuuggucagugagauaccagcaucgggaggugguuuugugguuuguauuuuuuuguuuguuuuguuuugccacugugcacauauucuuaaaggacugccaaagcacugacuccagaguaaacaguaauuuuuaccaaguaggugaauucauaacuacaaaaucuuugaauaauucaaaacuacucuagguauaguuugcaaguuuuauuuaguuaaacuaaacuacuaaccaauuaacuggccucagauaccauuuaugugacuggcacugagaacugaggugaguugggcagcauaaacuguugaaguaauuguugaaaauugguggaugauuuguucaaagcauuuaaaacggaaaguuuuuuguauuguuaccacaaaaaucagauaaaugcauucaguguauuccgagcacucugggaacucuaguugccauccacacggcuuacaccccuguaucacuagcauuuugaguguaugugggacggaggcuucagaucuguaauaggauuucuuccuuauacaguagauuuucauucaagaaccucccaguccuauacucuggaguguuaaagccuacugauucugcccuggauucugcaugauaagaagauauuuaggucaacucuguugucaaaaaucuaugugguuaaugaacugagcuguugauuuggagaagaagccauacuuugcugagaacagacuccagaaagacucugugccaaccuggagcacccucugcuggcaaagccuugccaugccauacacucgguuuugugugugugugucucccuagucuuaaaacaugggugugaagagguaaugagugaaauaccaacaggaucaugggcugaguauauucaaaauguagaccuuggaugagagugagaaguaacaauaaaauuuagucuccccuuaucaccaacuuuagaaagagcaucacuuucuaaagugguauaauaugauccuaaguaagauauguuaggaagugaugggcuucucuucacacccagugcuagauugcaaaguucuguguauauaugaaguaaaaauauaaaaauucuagauagaucuuuugccuauuucccucauuuauuuuuguuuuaaacacaauuuugaugcuucacaguugaaaaauuuuaaauaaucuauaauuauuuaaaauaaaaauguuaggacaucaacauguuaaaaccauugcauuauauuugcuggcuuuuaacauuuugauuauauuucaauaaagguuuuaaugucaguaagggcugcuagccagcaaucagcaggacaaagugaucccucuugaacauauagaaucagcacaagcauuucagaagcagaccugagauuugacgcaugcauggacacaugugcuuggcugcugugcuauuuucugguuuuacugcaaauuaugaagaaugccuuggugaguagaauaugucauaguaaaggccagagccacugugugaacagcagcauuuugagaagaugguaucacaguguucuucaaggcaguagugagugugccugcagauaccagcagguuguuuguucacuaugaugaagccauguaugucacagugugcaugggucuacauuaagaaagaaaugugugugauccacuugaaagccucugucuccugauuagcucccugaguguuguaaggagugucgaccaucuuuugucugguauaugauaauuguacugguacacacauauacacacacacacacacauaugugcauucucugcaguggauauacauguugaugccaaaguugaugcugaauguuguuucucaaucacuucuccaccuuuguauuuugagacaaguucucuucaaccuggaacacggugauucuacugcucugcuguccaacaaguuccauuuucuccugccucuuccuucucagcagggaaauuacacaagugugccggcacacccagcuuucacaugcaugccagagucugaauucagguauucauggcuauacuguaacaccguacuaacugcucagacuccucgaggcacccaccaucuucuuuuuaaaauauaaauaaccaagggaaaaaaaaacauauuguguaauaauuuuaguaagccaagcaagaacccuaaauucuaagggaaaaauggucaaaauuuauauguagauaagaacauguguuaugaauuauuguuucacuguagaccugaaugucucacauaaauacagaguuuauauuuuaagguaaauauacuauaauauucggcauugucaugcuguuacauacuuagagagcuuuuaaagcacagauuauugagccaauagacaauaauggcccaaagaagcccuucuuauuucgcagaucacuggggcggcaacaguaauggucagauauaucgucaucauguggccagcugcauggcugcaaacaguuaagacuuaguaguuuauaucccaaauaaauaaguaaacaaacuugaaguggcaaaaagcuaucucauuuuaucauuguuugaaguaguaacuucaaaaaauucugcuaauaauuuaagcucuuugauaggaaguuauuguuguaagauuuaggaauuagauauaauguacaucuuuauuuaaauacaaauacagaucuuaaaauugcuuuuuuaaaaauuauuggauuaaaugugguaguaccgacugaauucuuucaaaaauauugaaaugaaauaauccuuucauaggaauccaguuagguucauagcaggguuacaucagugugcgcuaaauccaaaugaagagacaauggcuguccacacauagcugguaagaagacauuaacacaguacugucuccuuccugugcaucuugucuaaagaugcacucauguacacgaagugucagaugaauuaggcauuucaucaggggcucuucucacuuucaaauagcacuguauucacaaggaaaacauagggcaauauaaauuguacuuuucuucacauuuugugauuccaaaauacuugcauguaaggaaugaguccauguaggccuuagaggguugguggaagugcugugaugguuccaguuuugaaucuaugggugacgugagcagcaguuacuuguacuucagagcuguguuucauggacuuuuaaaaacauucacagacuguaagguuuuguaacauacuguuguugcugugugcuggugugcacauugauuucuuaggaacuuagucugugcagguacuuuuaacuuugagauggaugggaguggcgcuguucuauagagauaagguccgauucucauucauccauguguucauuuaaaaaaaaaaccaaacugacugaucuuuucuugauuaagcaggagaacaccguauuuacccuuuauuguugguauaaaccauuauuuuacugagaaccauuagcuauuuaaaacuugguacauaaauuaaagaggagcuaaauggauuugugaucguugccauuaguagcauuuuagauuauacaggcaauuauuguguucauuauccuagaacagccccuuugcagagccauugugguugucuuaggcauuaugcacaaauuuucccguggagauuaaaauuuccaguagcguauuuaauuuuguuaucacaguuguuucaaauaaaacaaauauuaugacaaguagaagaaaauuugcuuuacuaauauaagaacuuaguaguaaauguugggaauuacuuccuagaauauuuaauuuaccuuuucucauacagucauaauuacuucaaauguuuaauaauauaucuuaagauuaaaaagauuuuacaaucauagcagaaaguucuggauuguucaaguguuuaagaaauucuuuuguaauacugagagacacaucgaagcugaagguaacauagaaucuaugacuuuguuguuuguuuuugggcuuuuuuuuuuuugcaguacuuuuuaaguuuuaaucuuagcuuuuagauaaaguacuuuaaaaaguuuugcagaaaauugaauauaaaaagauuauugguugaaauguuucaguuuuuaaaacaaacaaacuaguauuaaaaccuucuuuuuuuacugcuguccuuucuuggaauuaaccaaaguccggguugccauuccagucaaggaagggcagaaaaggcacccugaaauaacauagggacaacugucugcccacugguggagaggggaucugagcugcugagccuguccucagaacccuccucuccuggaagggagugugagaagggagcacucacuuggcuucacaguugauauccacuggucgguagucaacgacaucugucuuggccaauuagaaagguauuaaugucgugaauuaucugcauauccugugcaugggcaaccuuuaguguuuccaaccuguauguggcguuuguuccuuguggguuucuugcagcccuuuggucguucacugcucuugugcagggggacagugagacagugcuuaugcauuuugcaagacaguaauucuuuauuuuauuacaaaaaaaggccaacucuggaaggccagauuaaaucauuccuuucacuuuuuaaugggauuuggaugaauagaguaaaauaugcacuuugcauucauugauagcaucuuuagguugagguaauugagucuuuuuucccugacugaaugaauaaugacuucaucugauccucagugaggccugaaacuuagaccgccuuugucacaguagaaagaucugggcuuugaaacaugcucuacuucccuggcuuaauuuuucuucauuuuaauccaaaacccuauuuuucucaauaauucaagcauaaacuacguaguagugaaguagcggaaaucgcaugguauuuguccuccuugugcugcuuuuuaaauggagcugauaaaucagccacugagggcugagcugccucauucucaggaggaaagccaggcgggggacuugucaggacucuugaauacugguccuuucacacugcucacucuccagggaaguagucacuuuacuguucuggugcaagaccugaagaugggaaggacuaagccggguuggggguagccucccaugauuuagugggcuccgaggcaguccaucugcugcggagaacuagagcacaugugcuuagggggaacuuaaaccugagagucgucagucuccacagagacuguugacaugagcugcugugugcuguguagcaugccaugucugucccguuugucaccaucaaagugaggugaugcugugugagucagacguguaguuacuguuugagaguucuuguuuaggccucuugcauagucauggcaggguuggaagccccugagugagagagagcaugcugcagaugugcuaggcucugcucugcucacugcccugugcagccugggacacuggugugggugcacacuccagcucuccugggaacuaacuggucagugcugcuggucucuauagugcuuucaaagaucaugguggauuuaccagcauaguucagacacaaaccuggacagaaaagaacacuguguguggauguuucucuuucgugagacauguaguacuagcguucauuuguuuuucuugguagacucuuucuugcagguaaaaaggaauucucauaauuaacuuauuuucauaaccucagagucuagcacacagguguaggaggcauguaauuacuuguuuaguuuuccuuacaaugaauuuaaugaacuuucugagaaacuuguuucucuuucuuucuagcaauggcuucucauggucucauaagaguuugagacaaauuuuaaccaaaacuagauuuaaacuaauuaugagcuaugagaaaaagcuaauuuucugaguacuucagcuaauucucaauuuuuuacauuuaagagcuaguguuuuauuuucuuuuauuuuuuaauuaacauuuguugguuauuuucuccucccccuccccccccuccauuuuucucucccugccacaaccccuugcccugacucccuauauauauauuuuuuaaacuaugccagauucaggguggcagggagaugcuuagccugauagaauucagucugcuguucacaccaccugagucagguaucccaguggccaguggccaugaccucauuccaguauuguguauaugcccaauaaccaagcuccuccaaccaccauuacucaauggauagaguuuggugcugggccagaugcaaucacucauuccuggcuuuuaauauuuuggagguagaggcaggaggaucaaaguuaggggucacccugucuauguagggaguuccaggucaagcagggcuuguuaugcacagaaauugcauaacaagauccugaauuuuuuaaauuaauuaauuaauuaaaaaauuuuuugcgguuaguccccaaagucacacaucuucucugaagaguaguaacuggguccaaagugaaugucuaacagugaacacaaugugccugcuagacuuagaguugugugacacugugcacagcauugccucccucccugcuagacuuagagagcugugccauaugacacuguguacagacacaguguugcuuccuucucagagccuagccaagaagcugcugagagguccuuauuguacaguaagaagcugagggccggccugggcuauacccuucagagguagaguccaaauccaagugagcaggcuucauucaggucaguagccucggcugcuguguugugugccuucuguucucccucuccuguugcugcuucucgguguuaaccucaagcaggaccccuuccugcccacacauggaacuacacuuugcucuuuaggggugaagugggaaaccauccacagaaauugccagagcucaaaauugaaguugcgcauuucagagcagccagguuggguucucuuuacuuuuuagggcaaggguuauuuggguaucaaugcucccuguuuccaaaaucaaggagacaugauugcuugcuuugguguaauuuuccuuauauuuaugugcucagcuaguaaucaauccacaugaugaauuucaguguaguaugucacacuggaggaaucagaagugugggacuugcauaaauuaagcaauuuccaauucuaaacugacccccaugguugaucucuuucuuuguaagacuuugcagaaauuugcagaauggcugacacacacuauccuauaagugggggagucuggaucugaguggaggguauccaagggauacuugagagugacaacagggaagcucucacugcaugcuacagaagaugaacacuuugcucacggcguugcugugaugcagcccugcuuuugugauucuuggucuuguccugauggcaucuuccuguugcauacagcagaugaagcuguggggguugguuguucacucuggucuaccguuugccaucacuccucccugagaacucgguacaggauacaguacaguuuuagaaauccuaccuaaaucuaggagaggcgugagaagagaaaaucaagaguuuuguguugaauuauuauaaagacuauuacaaucuuaugucuucucaagucauuuucauguauucugaucacgacacuagagaugggugccaacuugagcauguauuaaugcuacacuuuuuuuguuuuuuguuuuuuuuagguugguuuauuggaccucgaacucaaucagcugacaaaggcgcuauuucuggcuuuaguuguucuuucuguuguuaugguaaccuuacagggauuugcaggcccaugguaccguaaucuuuuucgguuccuccuucucuuuuccuacaucauucccauaagguauguuuaaaauuagaagaacacaaaugucuuauuucauaauguaugauuuugcugaaauuguuuuaucauaguguggaagagguuacccagucaaaacuacagaggaaggggcugagaacccagaugaauagagcaaguuaucuguaaguggaauuuagaacaugauuaguuuugcuagaguuagagaaaaguaccccuuugugugcuuuuaacaguguugucucaacagcuggaaaaugccucucauucaaacacaaauaugaauucagaagaaaagguuagcaaguugcugguugcugucucauuuccagugcucgagggccuaugugcauuguugacauuugaaauuaucuacuuuuaaaagccagggcuaguaguguucgccuguaauccuuagccacagccaggaugcuaaggccugguacauaccaagacccugucucgggaaacaaacaaaaaggaagguccccacuguuuaaggaggaucugcuagaucguucagauuagaagaggugcuuagcaaggcagucuucaaaagaaacuauuuuuaaaaaugauaagcaauguaacuagagauugguguguaagcaguuaauauucaguaucuauuuaaagacucaaacagcuucaaaaaugauaucuuuagaaagagauccuuaguguguuuguguuaugcugacauguauaaaagacuuaguguguguguguuaugcugacauguauaaaagacuuaguguguguguguguguguguguguguuaugcugacauguauaaaagacuuaguguguguguguguguuaugcugacauguauaaaagacuuaguguguguguuaugcugacauguauaaaagacuuaguguguguguguguguguguguguguguguguguauguguuaugcugacauguauaaaagacuuaguguguguuaugcugacauguauaaaagacuuaguguguguguuaugcugacauguauaaaagacuuaguguguguguuaugcugacauguauaaaagacuuaguguguguguuaugcugacauguauaaaagacugagauuuuuccugaguaaaccugugacucaugaaugaagccugcaucuagacucacugucauuuguaaugucaguuaaggugacagggauccaggcaaaaaggcuccuguaugcaacugccauugcuguugccaccacacuugucaugugcauaguccucagcuuugauaacagccucaaagccagccaguuccccagcuuugucugugggaagccgugccucauacauaggcugggcuugccuucucucaccucuccaagaauaacaagacuauuuccacauuaagcccuucacaccuagcugugcugucugcugguacugacaguuaguucuuugucauucagacaucacccaaguacaccccuuaggccugaggaaagucccaccaauccaucccaaggcacuugcugccugucauuggcugccauucuguguggcucugugcugaggccugucuucuuuguuggccacuacucccuaccaccaaacucuguaaagggaugcagacuguuugaacaaauacuuuuguauccagugccagagccaggugacacagugggcaggaagggcuccuggacauacugcuuuggaaaguuacauauguacaaaccaucacagauaucauguaugcucguguugaauaccauaugugagcucaaggacagauguauguccccaaauagcguaacugugaagucacgugucuguuuuauucaacaguuaugacagaguuuacucagauaugcagauucuucagaaagcuauuuguugauacagcuucagccuguggaugcaugggcuugcagugauccuagccucugugucuuaucaccaucaacugccuucuuccuaccguccuucuucccacuguuucccugacguucuuauguauauaauacccacucucacuggacaucagccaaggaggaaacucacucacuuaguguaaaaagaagaaugugucuccugcuuaggaacuccagcuuaggccagucuuacauuacugcccaguuagccacuccugaaccaggcagcacaggucccaggcagagccuaggacuucucagugccugguaauagaauugcaggcucuuuccuauggaaaaaugaugccaacuucuagacuuguugauagacacugugaaauauaaucucucaaguuauauuaggcuauacauuuguuuuuauccgaguuuaaugacaaaauauuuuagggcuucuucuggaacuuaccucaagauuuucacugcacuuuauuuuugcaugauguagucagucaugaauguuccaugugugcuuagaaaguuuucuauguauucuguggagugaguuuuuguacaaaugucacuagauaagucuuacagguuuuuaaaaucaucuauuugcuuccuuuaagggaacucucccuaacucuauaagcagacgaucucucauaauaauuaugguuuuguucauuucccauggugcauuuguguuuuaagcuauguuacuuaauguuuaccggcuuagaauuguuguuugugugaaugagaagguuuuaucagcaguguguggcuggggaguuuuguuuuccaguccuuuaugaucuuuacauuuauuacaauuaaaugacuugacugcauuuauuuuuacuuaauuuguucuccgucuauauuuuguacccuuugaauguuuuaaaguccuuuuuauccuuguauuuuuuuguauucuguccuauuauucucguagaagaguuacccuccacauaauuuaaaaaaaaauucuuugauuuucuuuaaaaugauucaaggaccucaaaauauuuggacuguagcacccucugugucaugauuauaugccuacaaacacacacacacacacacacacacacacacacacacacacagugguauuuacuuguacuuaggcuucuguucuacacaucugacugucauccuuacucauacucaagauuugcaugcagcuucuauggcuugaccuucuccauaccauucuuuggcgcccaucaucacccuggccacagcuggauaguuaacaccuuacaagcuuaucccacuuauccuuuaagcugucucccacuuauccaagacagacagaaggauauccugcuuauccaggacagacagaaggaugggcucugaauaaugccagugucacuuacagacaccuuuagggauuauguuugaaauaagacuugcuuuguuuuuuuuuauuacuuauguccuuuuuuguuuuguuaauaauugaaacaauugagaaacaacuauaaguggugauguaggccacaaucgaugcaucaagcucauuugaacacuagaaaugcacaaacgaaucaguauccuaccacuuucauguccuuucucccuuuauuuuagcugacugcuggucaguuugauguuaccugacccaagacuagggucaccugggaaaggaggacuccagaugagaaaauguccucaucagauuggcuuguaggcaggucuguugggcauuuucuugauuaaugauuaauuaaugugugagggcucaaacacuuguggguggugccacccugagcagguggucguggacugaaugauuaaacaagcuaaaugagccaguuagcaguguuuuuccauggacagugcuauaguaacuaccuccagguuccugcuugaguuccugcccugacugcccuccuuggauugugauguggacauguaagccaaauaaacaaaagcuaaguugcuuuugcccaugguguuuaucagaaagcauaccagguaccaggacacuuguugacuaucagcuguggccagggugauggcaggcaccaaagcagacaaagaggaaggcaagucagugugguggcagaggaugggagggaggggggaggaagagccuaggagaguaccaccugccugccugcccgcccugcacuacccacagccugcuuucuccaaucugcuaaaggaauggcauuuucccaucuucuugaagggauuauaaagauuuucuuucuuguguucuuccuuugaguugauuuuuuaaagccugucugugauguuacauugaagacugcuucuguuugaaagugggagaaagguugaaggagccuuucuccuuagaucuggggcacuucugugagaucuggacuggaauuuauagacuaucuccauugucucugucuuuaggaaaauaaugacauaaauguucuugccccacuuuucuuuuauucauuuaauaaaauuaucuuaacaaaauuaugucuuaguagaauuguuggagcuaaaagugauuucuguugguuucauauuugaauaguaacuuggauuuauagugaaaauggaaaauaccuaauaagaaaauaaguacaaugucaacauauauauaacuguauauaaccuuucauguguuuagaacugggaaaaugaccuaguggguuaaggaagugaauuaggcaugguacuacacaccuauaaccccagcaauggacaguagagaaaggaagacuccucgggcuugcuagucagucaguuuucccaaacucacaagcuccaaguucaaugagaaaugucucagaaaauacaauggaaaguaauagaggaagacauucaguguugucccuuucccccuacaagcacauacacacauguguguccacaugcacacauauacaaacacucuuaccuuuuuauauguuuagauaaccauauaaauaugaauaugcacuuaugcuuaucuuuguguauauaucuuugcacauacauauaugcauaaaucaguguacacuucuauuuuagucucuauggucacugaaaauauuuacuaauaaaaggauaauacugccuacaaucuccuaugcucuagcuuuucagugaguauguuuagcacguucaucuaggugugcugaccugacgacacaguuuugcagccuuccuuugcuuuagcuuaccaugagcaugcucacuguaacccagcaacccuacagagcuuugcaugccugcuccugagugguaccaacuuacccgaaggaggaagagccauagaaguacaggaggcauuuagagaauugugcauuaucuuuaaugaaaacaaauuuguuuuccuguugacaaguuuccauaaaauauggauuacaauuuauuuaaguguuuaaaugugcuuuuggacuuuuaaauuauguuauuuugcaaaauaugcaacucuaggaaguaaaguaauuuuuuucucuaguguccuaagaaucagaauucaaguuuacaaaaauuaagaauuuuauuaaaauuacucaguacaaugaaauaauucuuaagcuacuugauaaaauuuacauuguguuuuuuguuuauuuugugguguuuuuuagaucauaauuuaauuaaacauuuuugucguccaaagagaaauaucauguauguagcuuuuauuguaauucuaaaaugaguauaugucccuuugcauguccccuaacaggaagauaccagcaaaauuguuaacacaucaacauauccagggucauguguuugcuguuccugucuguuuucuuaagaggcuuuagagugcccauuuuuaauugauaaccccaaaccaaguucucagugcugagucagagagacuuuugcuucuguauaacgcuuacauggucaagaggcaaaaaugcuguuagacagagagauaauuauaucccuucugaggcacacuuaagaaccucuuuuucaagcaaugccuuuccuagagcacugaaaugcgagggcugucuguagguuguggagacauaguuuuuguuucauuuugccugugucaccgucagagcaugugggaggcucaucagagaaauuccuagaacccguggacugaagacuggauggcaacaucugcacccugaaggcugccaucaaaggugccagguuguauuggugcagaguuguacgaggguuagcagugaacucuccccaaaagaaaguucuuagcaauuucugccaguuauugucaguucugaaugguuuuaugguuguuugguuugucuucuuauccaacaauucuucuaacugagaaggggugaguucucacauuggagucaguagcaacucuuagacucugaguaacucugauacaguaguagauucugauacauccacucccaucuccgguuugaaguguccucagccuuguuucaguagcuauguguuagcucuucucaucucugugaccaguacaugcaugcacauccacgaagaauguuuaucuccuguauguauguaucagcauacacuguuuuaguuuuuguagucguuuaaaauacuugcuuauaaaauaaugguaauaccauuauuauaugccauuaguauuauauguuacagcaaccuuuugaacauuaaacgcuugcauuuacuauauuuggaguauuuugguuuucuuuuuaauuucuaguaauucuguauacuuagggauacaguagaaugcuauauagcauauacuacaugggugaaugguuuugcaugguuaacuucuuguuuuucucaggaauguugcauguauauuugcuuaugaaaacauaauguguuuucuuguuucguugcuuuauacaguugaaaucauauugauuaccacuuuacaaccuugcaucuuauguuugacguggcuucauaggcucauccaucccuauaccuugcuauccuuacuuaugacuguaccacugagcuuguguccaguauuccauugacagacucuaggguguuccauuguuacucuacacauugaucaaugcgcaugugagcaucugguacugaagucuaggaauggaguuccuugacucuguacuugucugugacuuugcuguguuuguuaauauugccaguauuuaucugaguggugguacccaguuagcauaccauuaucaauauagaccagugugguucucagccuuccuaaugcuauaaacuuuuaauacgguuccucauguuguggugacucccaaccauaaaaaugguuuuuguugcugcuucauagcuauaauuuuucuauggaaaugaauuguaauuuccuauggucuuaggcuauccccucaaaagggucauucaaccuucccucccacaaggggucaugacccauacguugagaaccagugauuuacaauuucuuuugugaacauucguaguccuuuguuguugucuucugacaguuauguuuuucauuccuauuuugcugacaucuuucucuauagcuugacuuuuuuuuuuuuuuacccaggaaaaguuucuaauuuuaccuuguuaaauauaaaugaauucuuauaggauauugucaaacuguguaccuagaaaucuucuuccucugcucugagaccuuuguuguugucuucugacaguuauguuuuucauuccuauuuugcugacaucuuucucuauagcuugacuuuuuuuuuuuuaacccaggaaaaguuucuaauuuuaccuuguuaaauauaaaugaauucuuauaggauauugucaaacuguguaccuagaaaucuucuuccucugcucugagacccugcucuccucucacugucugcugcaucugaguauucuuccguuugaccacugaaagugauuucauucucuugaugaugggacuugaacucagacuuugacgcaugcauacauucuaccacagauagacuccagcucaaggagguugggguagggugugggggucguggcagaaagacaaagguuugaacccaaggccuugccuacgcgagacaacugauuuuuuuaaacuaguguuugauagaguuuucagaucuagaguuucaguuuauugucucagcauccuuuguaaaauaagaagaaagccucuuucccagagguuugguaacaucugugucaugugcaccugccuauaugggcacacuccuucugucuaccucagacgcaguagcaagcuaaugaacauucccucaaaacuuggcagucuucaacauaggccuuuucuccuccuaguccugagguuucgcuuugcuuguuuaugaaucggcuauaccucuugcuguuuucauuuuucuguugaauuuaauauuugacuaauugguaucucauguuugcaaauacauuuaguaccuuauuagacuuuugauucaauugugguacuucuaaaacguuuaaaauugcauguguguuuguuugggucaugcaugccauagucugaguauugaaguccuagaacaacucgugggaagugguuuccacuguccaccauguccuagggguccaucucaguuuccaagcuugcaguacaugcacuuugaucugauccaucuugcuuugcuuaaggucuacuuuuguguugaaaccuuagcugaccacuggagugugacgaacaagucagccuuuaguaagagauuacagaacuaccaugugcuaaaauuaggaacagauacacguuacaccuaacauuaagcauguuaacuugacuuccuucaccagagaauguagaaagaugaguugucaggagucuacuacgcuaacuagauuauacauccguaaguauguaagcagaaagguuggucuccguuggcauuugguggugcacuguuugcuggaaaaggugaagcuggauuuugguucuagaccuggacaaugcauuuaugugggcuugguggcacaggacugaacuucuaacauuuuggcuacaggaguucaaggaaggccuaccuaagcuacggaguaaauugaaagcuaacaggccauuuacagaccuugacuaaaaccagagaaauuguuagggacaauggguauagcacagugguagagcacuuugaguaggaaguggagaaguuggcauguugaccuguuguccuccuguucgcucacaguuguuuugauuuauuuaagguuagcagugcugauccaaagcucaagaggguucaacugguccuggagaugacagccuuagcuacaguauggugcacagacaguucagcagggaaagccuuugaugcuggcugcucugccugcaguauagcaucagaguaagagaugcaggaagacuucagauaaaacaccuguggccuucacacaucuaagggucuuuauagaaaugugcuuuguuguuguuguuguuguugcuuuuguugcuuuuggguuuuuuuguuuuguuuuguuuuguguauguguguugugguguuuuuuuuuuuuuuuccuuucuuucucagauuagaauuggcaugugaauuauuucagguaaauuuguuccccaaugagaauugugcauauuucccuggcuggcuagggacugggcucaccuggcagugauaagugcuaagguuuaauuguaacaaauuagaacuuaaauauagcaagcauccuggggccuaaaugcauuguauuguguauuuuggggaaaaugcacuugaaauuuauucagacucugaguuucuucuucaaguauuuguagcugugagauuagacuguacaaaaauaaaccaucaugaaggaaacaucuugaaauccaccucauguuugucaguauugcacaaggaaacauuuuuauauauauuccuauggcaacauccauaaaagacuuacucagacagucaguuuuucauagugaaugauaguagauaucauaccauguccuggcucacuggaccaucugggaacaagugcuucuaccugcaacgggccucuguguaagagugucccaggcgcuuagucagcagaagaguggccuugcuacuguguaacaugucucugagcucaugugauccguggaguaaagagcaugucagagcuggcaugccccuggguagaggccuguguuuagaaacuguucgggcagggcaucacuaagagguaaauucaguacaguguuacucugcagccauagaguuuggaugccuuuagagacuuagcacuuaaagcaaauuauccuuuagcauuugaccagacucacagcaucagucaugguacauguggagcuguaauuccuguguaggaguauuuucuuaguugccuuguauucagaugaauuucuguucuccguuccuuacaccuuucuguucuccucuuugccacgacaacuacugcuauguauguucuuugcaggcugugguauucaaccuaaaauggucccagaguauuuacuuauuuacaauauaauauucuaugaacuaauacauccuuguaauucguuaagagcacuaauugcucaugguuuggaaagagcugugcgaagcaaguuuggagaugcuucuuugguucuuccaccaaacuugugagggcuguaagcuggagcacagugcagcguaccauuuucccagaccacugaaccaaaauccaaaagaacccaauacacagcaagucaggagccaagugaucugaaguacagaaaaacuagacacaagucagaucucagugcugugugcuggauaugugugucgucccuucuuggcucaccucaccugcucaauucccucccaacuucuggguuuguuucaacaagggcuguggucuuaauuaucucucuuguucauaaggaauauguuuuuuucagccuaguucaaauaagaauccaaagggaauguuuugcauuuccucuuuuaaucuucccuucauccuaaacccccuagaaggcacugugaugucacaccuguugacagagauaucccucacacuucacacauacagauuuaccagcuucucacagauccuaguauauccauaggaccacuguggcacagagacuuggugaaaaugugucugcugguucugacuuguggacccacacaguggugaccugcacuguggccacugguccuuccuagaaugccaguuucugucccuccaguguaaggauuauugccauuuaguaguuugcuuuacucuuuuaacaaaagauguggagguacaggcuggagagauguacacaggugacugccaguuaacaguuuuccucccaauucccaugauucuuuuucuuucaaaaauauuuuaaaagucaguguaauauuaauacuaagaagcagcacaaaagauagucuguacauagccauugguaaaaauauuuuaugagcguugguuaaaaaaaaaaagaguagacuauuaggaauacagaauucaguaaaacauuuauuaaaaaaaaauccugaccaagaauucuaguucaagaauuguucaacacaagaaaguccuuuauuacaaugcauuacauuaacgaaaaggaagaauguuaugauaaucuuaccuuuuuuuauccuuucuuuuuuucuauuagguauuuucuucauuuacauuuccaaugcuaugccaaaagucccccaaaccccccccccacuccccgacccccccacucccacuucuuggcccuggcauuccccuguacugagacauaaaaaguuugcaagaccaagggaccucucuuuccaaugauggccaacuaggccaucuucugauacauaugcagcuagagacacgagcucuggggaauacugguuaguucacuuugccccuucuuagaauugggaacaaaacaccauggaaggaguuacagagacaaaguuugaagcugagacaaaaggauggaccaucuagagacugccauaccuggggauccaucccauaaucagccuccaaacacugacaccauugcauacacuagcaagauuuugcugaaaggacccagauauagcuaucucuugugaggcuaugccggggccuagcaaacacagaaguggaugcucagagucagcuauuggauggaucacagggcucccaauggaggagcuagagaaaguacccaaggagcuaaaggggucugcaacccuauaauuccuaugauuuuuaaggugugaacuuuaugcauagauuaaugaaguuaugcuuauuugauaauuccuaccuuagacacuugccacuggaugauuccucaagauuguuuauucaaaauuauauuuauuaaaagguuauguagcagaggacugccuugucuggccucagugggagaggauguacuuaauccuguagaaacuugaugcccccagggaagggggaugcugaugggugaggcaggugcggguggguggguggguagguggaggagcacagucucagaaacaaaggggugggggaccaggaagggggcaacauuuggaauguaaauaaauaaaauaauuuaguaaaaaaagguuggaucuugugaauuaccauguugcuaggacauaaaugguuggcaaauagcaguuucaucuccaugguuuucaccagcaguucucaaccuucccagguuugcagcucuuagugcacuuccccaugugugcugaauccaucauaacauuauuuuuguugcuacuucauaacugucacuuugcuacuguuauaaaugauaauguaaguaucugauaugcagaauaucugauacggggcccauuugaaagaguuguuaaaccccccaaaggggucucagccagcaagugggaaacuacugguuuacacagucuuguccacugagcuuccauagguucauuaggugaguugacccaaauaggugugcugugacuauuuccuucaguggacaguuuuacagugcuuucuuguguagccacuuuuuaauuaaagccuggaagacccuccagaguccauccauuauaguccuauacuguaagaugcaaucgaagcaaaguugucccaggaacaaugacccuuuacaugcguuaaccuuacagauuagaaaugugcaauacuaaaaccucacuaagaagcaccaugacuacuccggaggccucaagccccauuucacauauuuucacacaguauuccuuccaugauucccuaagcauaggcauuucccucuuuaggcccacaguucucuggguguuaauugggugcugagaaccaguugccugcuucucuucuagcucaugcuguaacucaugcagaaggaauuauccacccaacuaucaccugaaaacauuaucuagaguacaaaagcauauguugaguuaaauauacacagaucuguuaaagucuaaaaucuaauauuauuuauuccuauauaaauuaaaguuauauauaaguacauucagaugaaaccauggguguggacauguuauauagguguggaagcacugaccaucaugaugguuuuucuuggcagucugcgaguaaacuuggauaugggcaaagcagcauauggauggaugauuaugaaagaugagaauauuccugguacaguuguucggaccagcacaauaccagaagaacuuggacgccugguguacuuacugacagacaaaacagguauuguucauaucuguuugucuuucaauguaccagauaacaucacaaauauuucauuuuugcacaugaacacauguauaugugucauaacugcuugcuagaucuauaggugucuaggcucgacuuuugagaacuauuuauacgauugagucuccguccuuuggugugugaagacacugaacaguguccucacagucagcgacauguaacugugcuguagcuuuaaaucgcuuacuuuuguauuuugaaucuucuagaaucucauguuuuuuuuuucuugcugcaacuacaugucucuauaguggcuuaagaacaagacauguauuucuguacuguaggugacccuugagcuguuggaagcauuggaaacgcauuguagcacucuccugcguggaucaccacacaugacuaucccgcucuguagcucauuuuuauguuguucguauuuuaugauuuuauuuauuaagaguucuuaaucucuaauguacuaaauaaaagaugauuuaaauucuaguaauuguuagugaacuagaaauaaaagcuuauaugcauaacauauuacauauauagcauaauuacauacauagcauaaauaaaacauauuccaaacacaauucagcaucaccuuuaauuaauguuaguaguuagcuauaacaucacauuuaauuaauguuaguuguuaaacuacaaagaauacagaugugcuuacaacauaacuguacguuguuauaaaauucuuucgauuugcaaaaagguaagagauagaaguaggcguauaaaugggaaagaacacauauuuauagguguaagaaccaaggcagucaacuaaugacuuuaaaauauaggaaaccagcaaaauggcaaguuucaaguucaaauauucuacuuaaaaauauuccacuuacaaauauuccacuugcaagguguaagugaaaaugcaccagaaaauaaagucccuauaacaugcaguaaugaaacaugugguugcgaacuugaggaccuggguggaugggugugaaaaaagaacaacuggacauugcugaugaauguaacuuaagacuuugauaaauaugaauucaauauuuauuaugcuggugucaacucuccuggggaauuuggaaguuuaguguaacugaggguccaguuggggauuuuuauuuugauuucgguauaguaccgugaagaacuucagacaugggaugcucacaaguacgaguggcucauucagaaauaagaggacacugcuucaagaguagacugagggaguacaccuggaguuuccucucccaguuccagugagugacaggaaguuugccgaagacaacgacuacauagccaguaugccuguguaggcagguagccgucagaaccagccacugcacaugugugcucugcuguacuggcuaaaaguacccauugcugugagcugcuuucucugcugauagggacacaaagaccaaaaucuccagagucaaaucagaauaacagugugagcaaaagaacauagagcugagagacucuucuggagaauguuuaguccuuaagagaguuuaguuuaguguaauguguaagccuagcauccugugucccaaugucaguuaaggcacuuaaugaaaaaaaaaaaacaauuagaaugucacagauggcauaaaguagucuggauuaaguucaaacaaaguucacaagauccaaauuauauaauuuuuaaaaccugaaacccuuaaagaagaccuaauucgauuaauagguaugauaccuguaaccaggguuucucagguuaauaagcacaagauaaaauagaaguucuacuugcuuugaacugugaugguauauacaacauuaugaauggauuuuagcuguagcaucaaaauuauguguuguacuucucaguaguuauucuccuacuuuucccucccaaaagaaaugucugggugucuguaagcagucaggggaguguaauagaaugcugauaauguugcuucaguuaacaaaaggaaagcugucuaguuagaauacacagaaacuaaacuuuguuaaaguagaaucuagggccaccuggugcuguacuccuguaaccaagaggcaaccaggagagaccugaguugaaggcuagccuggacuacaaaaugaaaugcugucucaaaaauuaauuuuaaaaauaaauagagaagugugggguguucguacuguucagagcaccacccagcagugagaacaaaggauaaccgugugcauagaaagauuuuaaaucacagugaugaaggacuaagagacacagaaggaaaaacaaagucuguaauguuugucggucuuaagaguguuaaagcaaacaauuaauccacuuaacacuuaaagaaaaguaaccacucauguuuuuuuuaaaaaggaagggagggagggaggaaaggaaaggaaagaaaaggaaaggaaaggaaaggaaaggaaaggaaaggaaaggaaaggaaaggaaaggaaaaaggaaaggaaaaaggaaaggaaaaaggaaaggaaaaaggaaaggaaaaaggaaaggaaaggaaaaaaaaggaaaggaaaauaguaauggagguaacuggggauugaaagaagacuggcuucucccugaacaucaaagaagauagacucuaagaagcacuauuucagagagcaggacagguuccuaauagaagguugaauuuuagauacauauacacuuuaaaggccucauuauauaagcacaaagugauggaugcaggagaaaauuacaguaucugcugucgcagaaggaaauuuuagcaucacuuuaaguaguugaucauccaagcagauauccaaguggucaaccaaaugaaaguccaaauagcccugaucucaugggauagacuggcuucugugucugccauacagagaauacauguuuucauguagugugugggugggugggugggguggggggagcuuagacaaucucagugaacuccaggcaguggcuguacucacaguaaaacagcagaaauggugaaaguuaggaacacaguggagguagccaauagaaucaucagaaauaguaaaaaguuagaggaguacaauagaaaaaccaaacagaaucacaugcuguccucaccugcaggauguucaggaacuuguguuuuucaauaaaagaggagacugggcauuguaauauaugccuuuaguuccagcacucugaggcagagacagacaggucucugugaguuuggggccaugcugaucuucacagugaguuccagacaucuaggacuacauagaaaaacccugacucaaaaagaguagagaauaaagguuggccaaucuuaagagcagugaaaaucaaagacauagaaggagauccaauccaguauugcuccugucuagggggagcgcagggacaaggaguggagcagggucugagggaugggccguccaggggcugccccaccuggggguccaucucauguguagccaccaaacccagacacuugcuaugcugggaaaugcuugcugacaggaacccgauguagaucucucugagaggcuccgucagagccuuauggaugcagauggggaugcuugcagccaaauaucagacugagcacgggaacuccauuggaggaguugggggaaggacugaagcagcugaagggguuugcaaucccaugggaggaacaacaguaucaaccaaccagacccccaaagcucccgggaacaaaaccaccaaccaagcuguauauguggcagacgauggccuuaucuagcaucagugggaagggaagcccuaggucuugugaagucucgaugccccaaaguaggggaaugcuaaggcggugggugggugaaugggugagcacccuuguggaggcagggguuggggguagagugggggaguuuucagggggaaauugggaagggggauaacauuuaaaugugaauaaacaaaauaacuuuaaaaagcaaaaagaacagaaauuagaggcaugguauccaaaagccaauagaguaugcugcugcacaucuguaguuccagcuacuuggacagcuaaggagacucuugagucugaguucaaagccagccuaggcaacauagcaagaccccuucuuaaaacauaacuacaauuguaaagauaaaacacaauacacaauacagcuggccagucuuuugaaaagacuuuauaaaauaaauguaacuugaaaauaaaacugggaaaaaaacaaaaauagagauaaguauauagaguaaagcuauaaucaugauauuuaaaauaaaccauaagaaauauugaacuauacaauaauagaugaaucauaacagguagaagucauugccuagcuaugagcucauuauaaaacuugaauacauugaaaugcccuuaauugugcuguuugaagccccauaaucaaugaaaauauaauauaaaccucuagauagaugugguucagggccucaaggcuuguuuaaauucagaaacuuaucacugaaaauuacagcauuauuaugagaaaaacaaaaaacaaaaacucagggacuccuuccaguccaguaaagcauuuggugaguuucaauuuagaacccaucaauaugaaguucauuagcaaaguggaggugaagaugacauguuuucguucuggaaaaggacauucccaacauaugcucucucuuagcaguaagacauuuaaagccuuuccgcaacacuaggaaggaacacgcaaagauagcuagucaguaucguaucugaguuacagcucaugucagaaagcaagaaagcggucaagguuaagaaaagaauguaauccuagaggguuaguggaaggguggguguugaggcaggaggauugacugcaaauccaaggccucccuggacuacagaguggauacaaagccagccggagcaucuuaguaaggcucugccuuaagauaaaauuaaaacauggcuggagccauagcucagggggcaagggcuuucuagcauaggcaaggcccuagguucagucccuggaacuaccaagaagaagagggcuuugggagaggacagugaagugcuuauuagcaaguagcauacacagaaaaucuaguaaguuuauagauuaauaguagaaauuguaggucauuuuagcaaaaccaauauagaaaaaucuauugugcuuacaaauaacaaaaccaguuggugacaucaguccuccuuaaaaugcugauuuccuuuuuaaaaaaauaaagaugagauucuuaguuacagcuccucauuuucuaugaugaaauuucaagucaucaguguaaaauggcagggaaggaaggauccugaaacccaaagcucccuccacuugguacucuuuuaaagcuaaacaggguaucucacauacaagcagucucagugcugggcauaagauaauaaguccaaaagacuagagaacaggaagcaguuuugaauauauaauucugcagaacgggagccacacagagaaaaagcauugagcuggcaacagacaguggcuucagaugcaccaccaccaccccucaacucacacuggcucacagaggacacaaggccuccucacucagggaaugguuuggggccagagacuccuacuauccccuuuuuuccauccuuggcucggccaagugcagcucccagagcccugagacaaacaggcgccagccagggagggaggggauaaaugccuacaaacugacuucucguugaaaauggcccaugacaguguauuuuuacauuggcauaagauuaaggaucccagcagaauguauagaaugcacugaggggcuuaucguggcuucuagcuuauuugcuuguuuauuugugagaaagguucuuccucugcucccuaggcugaccugaaacucaguguaucagaggcugacuuugauucuucucccuccuccuccuccuccuccuccuccuuuuccuccucccccucccccuucccccaaguacaaaaacuacagauaagccaccaugccugcucaccucugcuucucaguguaagagcucccaaagaaaaugccaugauuggcugaguuuuucaauuguguggccauuuguuuagaacuguaauguucuggcugcaucuuuaccugcagucucucccugaagcugucucccaggaacucuggcucauuaccuguucucaggauuuugaccugucuugcugggagcugagaugguggugguaggcucugcaucccugcuuccugaguguuccagggguucuuggaggugguagauggucaugggcacacugacgaaaccauaggcugguggauaacagagaaccacuguucuuuucagcagcucagugguguuucaguucucccccacuauagucuuaagaaagcauacguguuucacacagucaggggaagagaguggagacugagugguggccaccccucuaauugugaucucagacacaucuuagcacugcugagugagaguugucagccucgccagcucagaggccgcuuguuggacagcccucaggacaaagacaguaggaaagcacaaguaaaaguugggguaagucuagcagggccuaccuugcccucuggcccccuuuguguccugugaagacagugcacacuuggcauugacuagcauuauguuccaggauguaaguuguuaguucuaucucaucuucucuauuuuauucacaaaagcaauggcuuugucuucuuuugcaaguguguguguucccuggugccugugcuggaagcuggugaggugugagcugcugacgcugccuguccucagcagugggugauuguuggcauagcagcucugguucuggagaggagaggcgcagcacuggggccaggcacuuuacagacaucuucuaggggcugacuccugcugcgaugcuccagugugagcuggcaucugaggaaccuugcauugcuaacauaaucgugaggugguccuucguaugauuguaaauuggguuugugcuucaucaauaagcuuuuugacaagaagcguccaucacaguggcucucucauuugccacagcagaacagaaaaugaagugucccaauaauugcauuauaguuuccuucuuguggacaagaaagcaaugugguauaauuagguuugauuggagugcacguuuccgguaagaucugaaauuaaugauguugcuauagugacacaucugcggccagcagcgcgugaaacauaaaguaauucauucgacaagagucgacaucuguuagcugcaaggaugcagagcauauugacacugaccaggaauacuagacacuaugugauaaaugaacaaaugaugcugaaacaggaggacggauaauuuguacuuaaucugccgggagaacuuuaaucuucucacugguugcaucugacaaugccauuguuuaaagaacaaugcugcagugaacucauaaauuuuaaaacuuaacucacgguacagccuauuaaagcaauacauuaauuccuuugguaggaaguuuuugucuucauguagaacaaaaccauuaauagaaauacccaguaaaacaagaggauuauuuuucuggaccuauauuuaauuauaguauccauuacccaacaugucauguuguucagauuugaauguugugcauuucauaggacagcaucaucaggagaauauguuauuuucauaauuuuuuaaaccagcaaaaacugugugcuaguuaguguuacaggguaggcagaucuugaaagucagauuuaaaauaaacuuuuaauguccuguaaaccugaaggccgugagaucuucccaucauggugauaguagcuaaaguauuccuuuacagcaaacaguugcugucuuacuaggacagucauucacuaaaguaaguacuuggauaugagugguguaauuuacauuucgguguuuagacugauugagacacuugacacaagugcuaggaaucagaaucuuuggaaaaggccugauuuacaggggaaauagacugacucugcacugaguagugugugugcuugauugauucuuauauacauguaugcauauaugcgcguggauguucauacagguaugugugguagccagagacaagcuuaggcgcuguguuguucuuccggugcuucccacuugguuuugugagccagggucucccuuaccuugaacuuccagauaagcuagccugguuggccaguggaccccagggaucugcaugucuccagcucuuuggcacugggauuacagguacaugugugccgccaugcccaauuugguuugguuugguuuggcuuuugagacagugucccacccuggcuggccugaaacucucuaugaagaccuagcugccuucaaacuuacagacaccugccugccucugcuacuaaguguuaggauuaaaggcaugcaccaccaugccuagccaauuauuuuuaaaaaaagcagguuuuagagguuagaccucaugucugugaguaacauacuuuaccagcugaguuauuucuuggguccuguaagcuuuugagacaacucccuacuuagcuuaggcuggcuuugaauucacauccccgcuucaaccugcugaguauugggauuauguauaugccaucacacccagcccaacaggaugucuuaaugaccagugcugacauuaaaguuuagugagucacucaucauuugagagcuuuguuuucauuugcucauuugauuugcuacagccagugaucgcucauggccaugccuuugccuugcuccaauuuucacaagaaauccuguaguccugggaugagcuuaucucugugcauugcagguggcuucuucuguuuguuaaaaccaccugucuguccauguauuauggcucagcacaaucuugauguguggacaacuugcagcccaguggcucgggucaggggcuucacaucugcuucccagcguggacugcaucugcugccaccaugaaaaugaugcccgcaggacauuuucccuaaaaaucaauuuccuccuugccugucuugcucacugcaguccagaaagccucugcuuuaucaaagacuacuauauuuuuuucuuagaaaucacaagaaaaucuggugucacaggaccugaguaucauaaacaacucaaugucacucucuuugaugugguggcucccuuaccgucugacuucaagccagcaccuccauguuaacaguuuccaguuuggagcccauuuguuucugucauauuaagaugacaaugugccuagaaaucaccaagugacugaguuaugaaaacuguagaggugagacaggaaggaugcauugcugcccuccgccugggacugacaguguagagagaaucuggaugaauaggagacaaagugcaauccugacagcuuuaacgaccauucucuggaucccacuugcugugugaagacugcauucaccugucuacaugcacaucccagauccuaggacccagccagguaugauguacuuaucuagaaugcuggauaucagggacacuuuaguuuuugaucuagugggcaaugcuagucagugauuuggauauaucaguuuugaacugauucaaacauuguuuauuacagcuuaaaaacuuuagauaugcaguuauuauauuguagcuugagauaaaugaaaaacucaggcuuuaucucucuugcacagcauuuuguuuaacuauuauauagcacuuaccacaguuucaguuuagaaauuucucauuacaccccaaggcaagugcuuacaagcucugacagucacuccucacucgguaccuucuccacuuauagucccaggaaacccuggcccuguggauuugccuggugggcaucguguggaugauguagaacacauggacucuuuguauugagcuucauuuaguagaguauuuucaagguuaaucuacauuguauagggaguacuucauucuuuuuuucugguaaauacuauuccauuguguguacaugcuacauuuuauuuauccaccuaugaauaaaugggcauuuggguuacuucuccaauuuugcuuauuauagauaauucugcuaaaaauauuuagacauuuagccaagguaaaauagacaugaaaaagaaaugguauccauccauacuguaggggcgaguaaaagugucugcugugugugacucggucuuccauagagggaauccucacggaucccuagaaaccuaacagccagaguguguaaaacaaagucaucaaaacgaguuggacuuuuauauacuagcaauaaacuaucccaaaguugaauuagaaagcaauuucauuuagaauaguaucaaaaauuaauuuacaaauucuaaauaccuauuuaaaucccagcuacuuaucuuuuucaguacuuggcaguucaucuaaaaaucuguauggauauauugggagggaccaguaaacuaaaauagucauaaagaaggaaguuagaaagccuggaacguccucauuucauaacugaccacagaacugcccucauagggccgaauggcagguuaaagaacugacgcacagugugccagguuaagcuauaagguggagucggcaaggguuucccgauggugcucuagagaaggagcagacugccccaacacuuggauaucuauaugcacgaauggaggugaacccugccucaucauguaugaaguuuacucacaagggaugcuauuccugagaguaauguaaucuuuuuaauuguccuguguuauaaacucgcucugacuucuucgagacauccucccugguuccaagucaacaacugagugaaagucuuuuacuaauaugaacacugagaucgaugugaugacacauaccuacacucaggaggcacaggcaggaagcuuacaagugaacguagcugggcuagugacaggaaaagaaaucuaaacacagagcuuugugauaucugggggaggggaucagagcugugaccuggguucucccuuacaucauuucaacugaacauacugugcaacaauauguuuaauaucuauugucuucuggguucucuuguuucacaggcuuuaugcaugucuagaauuacucuugagauuucuccaaagaugcucagaagcaauauacaauagauaacacuguagaacuuaagaaacuuagauuggaaaugcuauaucauaggcugacuaaagugauguauuaaaauaggagccacauucaaacccugaauuuacuauccagaaauagucuaaaugguaaugauaugucuuuguuuuggaaagcagcugauaucaucgugcaccuguugcauuugaaaugcuagggguuuuuugccagaaaucucugggagaaaaaaaaguaaaugauacaugauucauauauagagugucuucuaugccuucuuccaugcacugcuaguccuuagacuuuuguuuggucaauuuuguuuuguuuucagcuuuguuggguuuuuggauuuauuuuuugaggcagggucuuacuacauaucccuggcuggccuagaacucuguagacuaggcuagccuggaagucaaagagaucucuaccuggcucugcagcucgaaugcggagauuaaaguugugggccacagcauaccuaucaguucucaauuuuauuauugaacuguuaucuucaacagcagcaauuuucacucaggguaagaacugcgcuaugggggugacacugagauaaugcagagauuccaugcugggaguaauggagugauagauaccgugcuuccuuccaugcucaaggcccaagauuggauccccagcacuuggugggcaauacuuguaaucccagcauuccaaagcaaaaggaucaagaguugguguggcuuaaguggcguguuacuguggcagacaccuguguguguguguguguguguguguguguguguacacgcauguguacaugugugauuaguaaguguaauuuugguauacuccaaaagagaaaggagguagucuucucaauguagagaccauuagaggagagccuggucaggugaaucaggcucaacugggucacccugauggagaaugauuuguuuuccucuuuacaguguccuccacaccugacuuaaaaacccuaacaugacacagacucuccucuuuauaguguccucaugacagaacacagacuucccuccucacuguguccuccucuucgguguccucuuuacauggcacaccuuccccagccccucuuggccucucaugggcccugucccuucucucugccuucaaggagcaucagugugcccacaguuguagacacgccucagguucacccuuagggaguuccucuccacaucacacugguggucucucuggaccgcccacccucucggugugcuuucugccuugccuugccuucccugcauuuggggccucuggaaauacguuuguuuccugccucucucuuuagcuauaggauuuugaggaaagaaauccacacuaccaugcuuuguguuuuggugacuucauacauuauccuacaggaaguuucacacacacacacacacacacacacacacacacacacacacacccuccccucccacacuguuaaauacagagcuuuggaguguuggaaguagcuggcaugcagguuacaggcauuuggacccaugcugacuacuacaugaaccccuggguuugcugaugcuuuguaaugaauguuugccagauacacaauuccuaauuccuuugaaguuugugggaaugugggagaugaggggcuuuggccccuugcugaggaaggcaacaauuaggauugucaaacagugugaagaaaggagcucuagacugcaucaugaaaauucuguuucuauucugagcaguuuauauuuaaaaggguaaaccauaucaaguauugguuacuuuuaaucaugagagugaugugaagagauuuuuauuuuggaaauauaacagagguggaaaauguguuagaaaauauuagaccuugaguuuaagaaaacccucaagagguucucaaauuaggaugacagaugaagaaggcugugccaaggauuuccuaaauagagaucagagaaagaaguguuguacuguauguguccuugaguagaccugagagacuucaagguuauucaccacagagcaaagaagauggggugggcggggggggggggggggauauuuagagcacuguguagcgguaguguugucaaccgcuuauaccuguuuggaacuuucuccauccaugugccaccuuugguggcauuucacugugaggaggcaguggugagggucuuguuuaucagucaaggcuccaaagggugaccacuaugccccuauaauauaguuaacaagaaucuucuggaaagggaagggacagccuugucugugauaaaucaaccacauuccugaggaaggccacacauccaaaaauaguuggcuacuccaaauuggccuucuuguugccugggguauauaguaaaaagauauggcauuggaagggcagaaaaaggggcacaaaguugggugagaagggauguggagcuuguacuggaaagaguuggggaggaaggauggauauaaucaagauagauaauaaaauuaaggguuuuuuuaaacaaagaacucauuauuugauguauaucaaucauuguuguaguauucuuucaacuuuacauauaaaauuguucauaauaaaaguugaucuccuuggcccacuauaaguuaucaaggagaaaagucuauagaaaauuugucauuuauaucaaguaaucugaagcagaaagcauucauauauaauacauuuagaauacugcaaauuuugggaacacauacuuugugagcuuuguauuuaccaauuaguauauuauuucauugccuuuacauaauacuagaauucuaauuauccaucuuuguuaaaugccaccuacagagcuccucauucuauuuagaagcuggguugcugcugacuuugauauuuaauguagccacguauuuuaauuccacuuugagacuggcauagauuacaucucauauaacuggcuucauuuccacuucucugaaguuggagccauguacuuaagauguaugguacacauggucagugcacaggaugacaaccaauguugcuccugaggaguuuguaaagcucuaauaaaguauguucauuaugagagugcuugucaaaauagcaucuaaaaaaacaagaaaauacaaagcuggucuuuuguaaagaagaucucacguucuucuggaaagcuccaagucaauaacauauuuuacccaggaugcaaauccugacuagucauugauagguauugucauaucauguaugccaaagaaaauuaaaggcauacagauguggggaaagcccaacuuucacuggaaaggcuaugccauggcuugucacaccucucacuuaagugccuguuagugggaacccuccuaccugugcuuuaacuccagugcugaagccccaguggaggcuagacacaagcacguugauggcagcaccuuuguuccuacuaaaagggagcauucacuaugugcuggcaccgcgugagucuuugcauuaagcgagcuaugugugguucagcuuuaauggcaguccuggcauagucauuucaaagcuucugcucugguuugaggagugaguguuaaauagcacaucccauggcucucucagaaacucaccugcaaaaauugucucccauuucacaaauccucuugucauuucuggugacacaaauguauacggugccaucuaggaaaggcuaaggcuagcccaccguuuuuuuugcauggucugccauggugggugagcccgauggcaagacccaaagagacuccaucuaaggacuggcuguuguaucugauaugcucuuccugacauuaaauuaauauaauagccccugggcauuagcccacucuauggauccaauuuccugcagaucaacauaaagaugaacuuucaugaauuaaugcuaucuaaaugaauuaauaaaccaauagaaucccuaauuugauuuaaauaauuuuaggaagaaaguuuuaagagauggccuuaguugcuuugcuagaaagauguaauaaaguuagaaucaagaauagaaugugcccauuccucuuaauaguaaguaaaggcugcauaauaagaaaugcaaugagcuuucauaauuacauuaaaagauauacagacuugggacagauuugcauucaaggaaaacauuuaaguccaaugauaaagccacuauguaaaaacuguugcuuugaauuuauaaugagcguuuagagugaaacacuucuuugaacuuaauauacucugaacucccauuuuaucucugagguaauuuucuuaaaagagcuuuuuaucuaagaaggcauacaaaggccagagagaagaaauagaauuguugguaggaugguuuggcuugguggggggggagguucuauguauacauacauccauccaaaugcguauuuugucuguacauacccuguguagguaaauguguuuguauguaagcauucauggguacuugugacacacagucaggcccagccagaguguggauguauguuuguauauguaucugugcacaucuaccuauagaaaacauuuaauuauuuuucuuuccauccuuucucguucacaaagacuuagccagccuaguaagagagacuucuggcagccuggacagagaagggagcuauagcaauaaauauuuuacuuacuuccccacugccaggcaacagguguuauucauccaagccagcaguuuuuaacaacagaauaaguaacaaaguuuuuaagauuuuuuuaagaguuaccagcaaacauucaguauaguuuuuaaagcuacuuuaaaacaaucucuauguccaacacuguguccugcuuuaaucaaccauucuuagccaggcuggcuccuggcaguauagggagaguuaaacuucaggaguauuaccuuucuaccaauaaugauuacuuuucagaaguaggucauaaggcuacuaaaccaugcuaacguggggcuggguagcgucauucuccagcccagugcugugaccgagucaaugaugacuuagcuuccuaguuuaugccuuacuuagaggagcagaaguugcuauuacaccaacucacggaugugaaccaggcacagagacucagauuuucuuuuuucuagagccccuuccauugguuuagacuauuaacacgacaugcuuagagaaaaacuccuaagccucccugucagagugaccauucuguggagacuuugcaucuccuaacagaugucccagggcacagucagugugugaccagcccuccuuguggagcugcagcgcuuucucacccugccugugcucacugcuaaucuuccuacacagggacgcucacucagaaugaaaugguauuuaagcggcuccaucugggcacugucuccuacggaacggacacuauggacgaaauccaaagucacguccugaauuccuaccugcagguaugugaguguauuucugaaugccaucuucucucagugcacccaccguggugagcuaauaugcugauuggauuauuuuacuuuuuaucauuacccuccuaucagcucuaguaucucaaccaagaaacuaugacuagcauaucuguaucagcagauucgugggaaauaugaugagcuuuaaucauuuauuuguuuuuuaaugaauucuuucuaaaaauaguuuaguaaacaguauuuuaaaggguaauuaauagaauacuggcuuugcuguuuccuaauaaucccuuugucuuuauuuauacuuaaaaccuucucacauuaaaaaacaaauacguucuguuuuuuaucuuuucagugacuaagguagguaccucagcaccaugcucccuuggcagcucacaaaguacuuucugaacucacuauggaagcuacacugcaggaaggaagcuauccaacucaaaauuuuggagucuugugucuucaauauguagugucuucuguaauagagacucaccugcagccuccgggaggcaucugaaggccauaacaauagccugcauaauuuaaggaggcauuugauuucaugaugugauuauuauuauaacuauuuugucaggaucauauuaaagcagaagaguugaagaaucaucauauaaauauaacagauauuuaauguuuacuuguaucuaagagcauuuggagauuuuuuuucaccuaaagaugucugugggccuuucugguaagacuauguagaacucauguuagccccuauuuauguuguuauuguaaugaugguugucuguagcccacuuuaauguagcacagaucuuucuuaaccugauuaucuuugcccacuggaagcacuggcugggugagagcuuacucuuuaauggaauuugugugaaauuaaauuguacaagcaucagugagcauuacauaauucagaagaggaagggcugagcuccuccauggcugaggcagcucauaagcugguacagaugggggcugccaugcagcuguggguagcacaguugagcacggagcagauagcucugcgugcagcccugugcuugguggggaguggcucauacauagugacucucucucaguugcucugacccuagucucuucugaguacuguccugagucucugagguagguuaacaggaaaaugugugucuguccuguggguuugggaaguguccucugucgcccaccauggaaggaaguaaauaauagaaacccauuacuggguggugacagcuugcuuccucauuacuagaccugaugggaauuaugcagauacacagugcucagugggcaguuauuucccauggacaggacugagcucugacaagcuugcuuucccugacaccauuacuauauuuaaucuuuguuaacuacaaaucacaguggguuuauuuaugauauucaggggaaagucuuaggaguuauggcugccuuguuugguauuguuuuauguauacuaugugcacacaccaaccauucugcauuguucuucaucuugcugucuuaaggaauaaaguaguaguuaauugaacuuaggaaaagggaacaugucgggcuuuaaauaucauaacaaauacauauaugguguguuugacaaucucaaaagaaccaagcaauuugcauuaccgagacaaaaauaauuauuauuuauuccuguguacaguguaaaagaaaaaucaaaucacuguccuagucucaaauagcuuacuuuaguugauaaaacaugcaguaauuucuguguggaucauuucugucugcccuuauuacauggcgcccuguuuuaaagguacacucacagccaagugggcacaacccaagcucugcuccacugagaagaagccaguccucaacgccuaaagucaagaagagcgucagcaguagaauccaugaagcagugaaagccauugcccuuugucauaaugucacuccuguguaugaggcucgggcuggcaucacuggggagacugaguuugcugaagcagaccaagacuuuagugaugagaaccgcaccuaccaggccuccagccccgaugaggucaguugcuucuuuagagcaucuuguuuggggagggcagucuuuacagugcaaaccugugugaucuguuucugccuggagucuacaggcuugaagguuacugcucuaagacaaggacagggaaccagguccugaauucugacauuaaccuuaguaugugcgacccucugggcauaguccuagccuuucggggcucacuuuugacccuuccgaguuaaugccuaagagcuagucugcaugauccuuguuagccauagccuaggccucugaaauucagacuguuacaggcuagauuuacuuaugacauuaagggaagauucugaaagauuuuggccuuguaguuuuauaccauuacauucaaaaauuuuuaauggaauuaacgagaaaaaucagcuggcuuuaucaaaacuugguuccccaaaugaaccuacuguuguuguauuucauugucuauuauuuccuuauguugcagugagucacuggguuuauauauuaaauuuccaguuguucugaagaguguguguguguguguguguguguguguguguguguguucuuuuaaaagaaagauuuggaguauaaauaauugagaaaccuacagaaaugaugaaaaaacuuaaacacgucaacuuagucauuugcagcuuugcuccauugggauuugguaagauacauuauuaaaauuuccacuucuucugcagucauucugaguguguuuauacagcuuuaucuaaucuguccccucagaguacuuuagacaguuauauaauauaaucaaaccaacuuuagagacaguguuagcaaguuagaucuuucaaauauccuacaaaauuagaucauauaaguacauaaucaucauggguggggagccuguuaaauucuuauucuggaaguaauagaaagguagaaauagaaccucaauguuguugaugagcaguggacagaccuaauagguaguucugguguguaagaucagaagauaaaaauaccaaaggucauguggcuagugagccagacuuagaggacucaagugagagugaaacccugcuggaaacuagagauauucaugucacauucuggaaaacaaauaaacaaaacuguuuuuugccugcuuucugagacuuugaauaaggauaaguuuaaaaguaacagacuaauguaguagagaauuucaagacauuugacauagcuauugauggcuguucuuaagguuuguaguaagaauuagaagcagaaagcggaguaauagagcucuugaaauguaugcagauuggccauuugagcuccuugcaacuuuuagacagagguggcaugguuguuuaagagauuagcauuguuaaagauagccgagagcuaugugcuggacaguuggaaagaugcugugagggcaccucaggaauuagaucccacucaccacaggaucuagggcuuaaugcuauaaaguuacuugaaagaguuucccuugagaaagagagccaccauggugacuugcucuuacaggccaccuaaagcacuguuuccugaguuuaacuacagagacucacaagguucaauagccauggucugagauuguuugauuuggcaaguaggccuugguauugucugcuugauacuguuuuuuucugcauguagaaugugacaguuacagaguaauggagguuuccucugagacucaaaagaaaaucugucaggcuaggugauaagugacaaaauuaggaucccugcagauggcuacagagaaaggaaggcaugguauucaggggagaguuaaagaugcaggagaaaccccagguaaauuguagauggccagaauguagaauucucguggaggaaaacuucagacaagaagccagggcaaacucaagaaaggaggaaggaacggaagaacgugcaugguuuuuuaaaagugggcuuguaggacaagcggucugaaaccccuuagaguucacauggggucuaauuccuguggacuggcaacuacauucacauucucaaauauucaccuacugguacauaauaaaacugacacgacuaaucacacaacucuguuuuaggaacaccgaguaucugggcuagugguacacauuuuuaaucccgcucucaagagguaguggcagggagaucucugaguuuugaggauagccuggcauacuuagugaguucaagaccaaccagagcuacaaagugauaaauccugucuccccuccccccagaaagaaagggaauaaaaaaaucuugacauaaugugaaaaucaggauuagcugaacuauuuaucagaauaaaaucccauuuugguaaaaggggcaagcuagggacaugagccccauccuuuaccuaccugcucuguagucuauauuccuuucauuagugucccuaugcuacuucuccucugugucucagagacuagguugaccagcucuuaacuacaucuuuugaaaacacuacagugugucaaaauagggugugugugugugugugugugugugugugugugugugugugugugugugugugaauagggaaucuggaugcacaguucaucaguucuaaaccauuuggaaauuucagguguguggguccuaucuguaugauguauaaguuacuaucuucuuugcucuccaagaagguuuugagauaaauguaggacagucgugccgcuuuaugaaagggaaaaggacuacuguuccuugucucagcaagaccuaauacuggguuuugcuacuauagcauuccagaacucuucagcaauucuauacaauuacauguugaaaaagaauuccuguauccuucuucuuugaaagccuagaccagagguuuuccaaagaaauucuuacuccaacuucaaaaauauacuaucuuacauauucacuuuauugccuaccaaaagaaguauauguuuuaaaaguauauacaaaaucauaaauuguuacaugucuuaaugcuuaaauauuaggaauuuaccauagaaagacauuucauugauuugaugacucaagagcauaaagaaauuauaauaaagaaacuuacacuuaagcuuuuugauuuguauggaaauuuuacagagauuaaaggcagaaugaguaauauguaaaaagaucuguaacucauauuuuaaaucuaaaaaugaaaacaaugagcuucaucgugauuuucuaaaguguaguauugauguggugugugcagaucccagagccucaggaaaggcauccaaauagccuguuguuuggcauauugaacuucgcugccguuagcuugacagaugauagcaauguuucccaaucaccaaaguaccauuguaaaagcauuuuuuauugaauaaagugcucagaauauugcacccuggagcuuuauuuagggaaaugguucaauugauguuuucuguuuaaccucaguguugaccuaucacaauauccacgguuaauaagcaguguuaucauuuaagagacuuaacuaguuuuauauagucguaucagaacuacauucuuauaauccuauuuauucauagcucuaacaguuauuucuacagagaucuuauaaaugagagguucccguguugugugcaucacacugcccuguuuuaaucuccaucagcucacagcacgguuccaucuuagacuuaggauggaugugagaugcugaguaccccaucuuagacuuaggauggaugugagaugcugaauaccccaucuuagacuuaggauggaugugagaugcugaguaccccaucuuagacuuaggauggaugugagaugcugaguaccccaucuuugaguuuuugaaccaguugcuguucuuuguaguauaagccaccuugauauuuauuuuccugaacaaaaggaggaucuuuucuauaccagcacuuuuaauguaguugaauuuuuaaucuacaaauaguagaagucuuggagaaauaaguaauucauaaagguccucuuaggcacagcucauaaguacuugcacuggugugucaucugccgcaugcucaugucuacuuggaggucuaaccgugauagugauaucagagaguaaacagcugacuuuguaugcauaagguagaaucuauuuaugcccuggucauugguucuuaugauaagugaucaauauuucauuuucucuaagacaggaggaaguucugcuugccugugauuuguaucuacaggcuuagcauagcaaacucaagcugaacgaauguuagaugcuccauagaaauuccuucacagaaugaaaacccagugugguugcaggaagccagcacugagcucagguccuaggacucacgagagaacauaagcucagugcagaggucaucaucacagugaucaaggcauagcaugaccucugcugacuguagaccaaacgauugaucggcugugccuuuuaaugagugcuuaguccuguaaacuagcuauuuaguaguagcauucuuuccccuauacggcuacguuuauucacauuaguaaguucuauguuuaaauauuauuucaagauacagcugucuuugccuugcuuagccauuuauaugcaagaaucaucuagaauuaaugacaaaucacaaguaauauuuuauauucuaaauaaaggaacaauauguccuuaauagcauugcauuuggauuuaccaaagaacuaauguauguggaguguuguauuuuuuaauucauuuuauugugugugccuauugaagcaagacuaauugugguguuuugucgauauauuugugagaagcaaaucagugucagugacacaaagccugcauucugugaccuucacgaccaagagagaauaaauacuacauagccugucugugaacauugauuagcacuuuuuccagaugaucaaauugcaucuuagguuaauaauucuauuaaauuauaacaaugauuguaauaaccacaaucaaaaaugaugagaugucaaugauuaaauuaugauuuauaaaguacaugguaaaauauguacucugaggauuacagcuggcagcugugugcauaauugcuaauaggauaaaggaaauuucugcccagcguuucacgaauaguggcccagaaauuccuagauaauggaauuauagagaaagggacugauaaaaucuugcccuguguuuuauuuccuuccucccguauggugcagcucugggccacacuugccuauacugguuacuuagcuuggggagaugugagugugcagaugagaugccugugacagcugcucagcgacugcuaaguggccuacagaggaucacaugggcucucacugagaucuuuuuuguucauucucauuuuaauuauucuugccugugaauuauuaucaauagucacauuauguauuagaaauuucagaaagcucaguagucauaaaaguagucauuugaaauauaugaagccuuuuacuucuagauuaucauuuuacaucucagagcaaaauaucccagagguuauuucuuguuauaaugccaggcagcaguuaauuccauuuaauacagauacacacaaggaauauuugauacccuacucguaaguuauuucauuaccuacaaaauugccuuauaaaauagacucaacugauagccuuggauacacagaaccagaaagugcugguugagaaacgcauccuuuggccucuacauucaugacagcaucuaaagaaaagaggggcagaggaugcaucauauaaagcguuugaccaugauccccagggcuuuuaccugguucuucuagacaguguuauugaacacccacauuuugagcucuagauguuagugaugugcaguaauccuggugcccuuuacauagaauucagauucaaaugccaggugucaagcacuccguuugagaacacucgaaacuagacuucaaagugacuauggaaaaguacaggggguccuuuguaagcacucugaagagucacuuaguagucugcaucaggacaagcacacagugugacuagguuccuugggaaugggcgaggaaccucuccucugugugccugaggugcccacugcaccuaugcuuucacagcaguccucugugugccugaggucaucuucuuuguuucgauucccacggugcugcucuuggacccguggcgcauguguguuugucaggugucuccacugaaggguucccuuacauuucuucauuugacacuguauucauggacggcugucugggauggugcacaccuuuaaucccagcaucugggaagcaggggcaggaggaucucugugaguuugaagcuagcuugguuccaggacaguuagaguuauagggagacccugccuacaaaaaaaaaacaaaacaaaacaaaccuguauucuuggucuggaaguuccugugcacacagccuguaucaaaaggagagcgauacacguucccuguggguuuaguguauaaaguaugcuuuugcaagagggaguuccccaugcucuuuaauuuauuuaaucaaccauuuacuucucacaauggauuccuggaaucuugcucuaugccuguuuaauccccucucccgugcuacuuuccauaucuaaacauugccuuguuuuauguacauauagagaugcuacaggcacaccuuauauauauuuuugcucuagucuuagaaucaguaaucucucuaaggauccaaguuaaaaccuaaagaggaccacggucccucaaacuuacaaacacaucugauagaguaaucuauuucuuaggugcaugcuggacugcuuuccucaagcaugcuuuacuuuauuuuauugguguggggcaaauauucuauaacugaggcucauccccaguccccaacguguguauuuucaguuguuugagucuguaggaggaagauagaaucuagcugccauugccaccaaaagcuucuuugcuucuguuuuacucuucacugucaucagaugcuaguccuaaaaagaacaccucagucuacuucagacacacagagagaguucacuggggcucuccuuugcuacauaguucuccaguaacacacccggguuccaagcuccuccuggagcuggagaacugcugaggaugggcugugcgucccuaggaguuggccacuggauuuguuaggggaaagaucaaccuagaugacggugagcaccaagguucugcugcgaggcuguucccucuggagucacuuguuuaacuuuacauuaucaaaagaauuuugcccaauaccaaggugguuauauuggacaguaacuaaaguuucuguguugcggaaaauguaaccccuuuguuugcuuggcuggauauggauaugucauccucagggugauuaaaccuucuggguggagugcugggcuagguguaaggagauaaacuuaauuuuuguuauaagcuccgaacucagaggaacugugaagccaggcauaaacuaaauaauaaacagaugugagucaccaaauauagaaagccugguccugacuguaguggggcacugugagaugauaggguauucacggaaagaugcaauuuacgggucacaguguaauaguaaccuuucacuguaaauugaaauuuaaccuuggcauauuagaucauuugcaacuuacagagucauugucuuggguaggaagagacaguguggucaggugccaggcucuccucuagaugggauuguuaacaucuacaugccuucuuugaugcuguaguuuggaacagguugcugaugcucuugguuauagugccagaucacuggcaggugauucauuguguucucaaaccugagggcuuggaguaagaguuaugauuccaaguuuacuguagcacacaguugagcauggugggugucaucucaaccagcaaacaccaccaaugcugagaggguagggcauguugcaaaauaccccaagaccugggccuagaaagccauuugauuuucauagacacaaucuuuuugcagucaugcagguccacaugcagucuucugaugcuuacacccugcccucaguaaaggugacaggccacaaagguagaaugacucggaagccuugugagaggcauccuuagaagauaaaucuuuagaugauuccucacaaacaggaaaucacaaagcaaauaguuucuagauggcaguuucucacaguacuuggcaagcacuaagaauucuguuacuguuuguaugauuuaucuucuaggacacggucacagaaaucuuacuaagacuagcaaaacuuacagaagucauaauuuacugaaucuaugcuuauuuacaaaaggggacaacuaucaauugcauguagagaggggaaagggggacucaaauuaaugagacaaauuucuguguguauccaaaacaguauacucuucaaauccagaaaagugaagcacagugaugagcugagggcuggccaggucagaccgauagaaggucagggcuugaguuuacucuaacuugaugaucugucagaucuucuuuucuagucuagccugcugaguauauauuacaauuugaucauaauuuuacccaaaguaucauaggcuaacuccacuauguaaacauuuuaaaaguaucaaaacauuguaugaagauaguuauuuucccuggugcauuaccuacauauaauuugugauugguaacuuauaacugccuaaaucugugugauuauaaucugaagcaauccucauacuugugcagaucacuguuaggaaguguuauggaagagcaugcagaccccaggagagacugcauaaagccuacaguguggcuacaggccuguugaccaugucugucauaccccagcaguccacaggguagaaagcauuccaucugccuucaguaggguugcuguguacugcagugcuucccuuugccccagucucuugugcaggaucuucucucuuaaugaacgauccugcugugugcccugggagcucucagcacuaaggguauguauguaacagcuuuccaucccagagucaaaacagaaaagaaagaaaaaaaaacuguuuugaaaguauuuuacaacugaguuccuggaaauuaccuagagucccugauuuuaaaaugauuucugaucuccccacaaaaugaaaauaguuucuguaccaaaggauugagggucgacccuugccuuguaaccacacauacauccugcucagggacccccuuccucugaaggucucauccucaccaguuuucccugaggccaccauuugcauaaacucuugaucucuuacuggaaagcuuuacugcauuguuucuuagggguaggcaugguauccugugacugucacaagacacuaauauugaauuaaugauaccuggcauaacacagaaguuaaguuuucuugagauuucuugaguucccaaagccuaaauaaaacacuggcugcacaguggugguaaaacugaaaacagaggcucaugcugugcauuccugacagcuggcuuuaccuucaagacaaaagcaagggggacaccccccccugcaugccccaccuccccaccccccaagagcacugaaggaagcuauggccuugcugggcugugcuuguguuucuuugguugcugauaagguuauauacuguuuuaacugucuuauaaugagauugcuuuuaaaaauaaccucuuuucuugaaaaacagccauaaaagacuacauguauuagcuuaaaauugauuuugccacuaauauuuuuuaauuuuauaauaaauaacuauaaacaagaauagcuccuaaguuugagcaccugcauaugcaaggaauuugcuuguaucaucucagcuuuaggacacuuugcaaguaucuuuuucacauaauaguggaaagcaaaccuagauaaagaauuggucacagagcugcugggugucucaguuauaauugagacucagagcccaagcuggucuucuacuuugcuguugucucuguccuagcuauuauuaacugucaacuugacacagacuaaaaucaccugaaauagaguuucaagugaguaauuuuuuauaauauuggucugcaggcauaucuguaagggauugucuugauuauuaacugaugcugcaaggcccaggcacugugagugauaccauccacacauagguggugcugggcuguauuagaaagcugucacacgugaacaagccacagagugagccaacgggcagugcuccuccaugguuccugucuugugcuccugcccugacuuuccaccuugcuaguuggugaccuggaguguaaagccaagucagcucuuuccucagguuauuuuaagccaaaguguugugucacugcaaccggauggccuacggcagucuuggcauuuguagcuauaauguggacacccugauguuuauuaucauggguucguuacagguaucagcuuaucuuuucuacuaggaaaaggagguuaaagaguguacagagcuguugucuccuuugaagcugguagaacuaccggugaugaauugagacaaaccaugaaacucagcuccaggguggauagcgauuuuuuuuucauagaaucuaaugcuaucuggguuugggacucagucaguacacauugcaaaacagucuuuauggugcagaauggucugcaguaaacgguguguguguguguguguguguguguguguguguguguguguguguguguguauauguauauauauauauauauauauauauauauauauauauauauauauauauacacacacauauacacacauauauauacauacauacauauauauauauauauaaaucguuuacuuguuaaaguuugugggagagaaaggaaacguuaucaguuucucugcaucaguugugccucagcaggcuuuuugcacacuaguaugcuguguguuucuucauuuaaugaucccuaggcaguugcuccucauacauucugcucucuccagguggcacugguacgauggacagagaguguugggcucacucugaucagcagggaucuugcuuccaugcagcugaagacccccaguggccaggucuugaccuacugcauccuacagauguuccccuucaccuccgagagcaagcggaugggcaucauagucagaguacgucaugacuuacagcugcacccacacuccagucaucagucauuuuccaggcuugcuaaguaaauauagaaacuaccccagaaauuuucaaagucaaauauuuacucaaauacuuugugcuuuauuauuuucuuaaaaacggguaaaaacacaaacaacagcuaauacuguaugagcugagaagcuggugugaguccaauugauaaagucacucuccuggggauacugaagcagaacaauuaaaagacaguaguaguaauuuuuuaaauuaaaauuguuuguccucaacagaaauugcauagccugauuuauguucacaaaguuacugauacauaccuuuauuaaaguuaucuuacucaaugccaaaauuguauuuugcaauuccauuuguuaagcagugagcauucugucgcacuugagaaacgggagacaguuacuacuuaugcuugaccagacuauuucaagaauuacagugcuaccucucaggugucugccaacuuuggcucucacugcacuuccauguuauaacaguuucuacagagaaaguccccgguacauucucucagacacaggagcaucuucuucaguucaguggcuaucuacaagaagcaguucagcccagcugucucuguuuauuuuuacccuacuacaggaugaauccacagcagaaauuacauucuauaugaaaggugcugaugucgcaauguccaccauuguccaguacaaugauuggcuagaagaggagguaagcacguuauucucagcucuguacaaaaugucuucaugaagcuuucuaaggcgcugacagaaaaguagucccuucccauacuugaaauacuguugucaccacuucaagcagcauucgugaccaaggaugauauuucucucucacuaaauuauucuaaauacuuacaguuccuuccagguacauauacauaaaggcuaagaauccugcuuaguuauucuauuccuguagaaauaauugcuguuuuuauuuaauauacuaaaugugcagauauauaaaaguaggucuaaaauaguauuggauaucuaacaaauuaggcuuaauauugcuaauuuguucucuuuaaaaaagaaaacagaaaaaaagauacagaauuaagcaguccuauaucauuauuccugaacaaguguauuuguaguucgccucaugagauguaauagucacuguuagaguuguguauugauuaguaauuggguuccagagugagacugagguggcuaggacugggaccagcucucuucuccuuugugcacaugacagcaggugccuuguucuuguucuuguuucacucagacuucagacauggucugucagcacagcagccacacccgauauucacgauggucuuggcaauaugaaucaauaucuccuucaggccaguuugauuuaaucagagacaugaauaaauuaaacucccugaagaccuaguaaaaugccauaaaaauuacuuuuggucauaaugacaugcaauuaauuguaaaauacuuguuuaauuuauuuagcuuuaugaggucaaaucaauaaaugucuugccacagacagacaaugucagauugcuguucagaaagauaacuucauuaaagcccugugcacauuuaugugcacaacauuguauuuucuuuccauagauaaaucuuuugccucugccaccgguaugcuuguuacaauuuuguuguagucucaaagccuuucacuuuauuaaaagcaaaacaaaaugauauuuuagcaaaauuccuggggguguuuaccgauaugcauaucuauauagccuagaagugaccccuuuguuuggaagucacaguguuuguuuacaaguuuagguggcaugucuagcuguaggauugaugccauuggaacaauuuaguuucugaagugagucaccagcugccuucaaacagguguucccagaacacaaccugcauuguaccccaaauccucuuucuuuaccuuagccccagcuaaaacuuuuccacuuuuaguagggguaaacaguauuuuauuguaaugguauuaugggacgauaaauggguuggcauauuuuauuuuauuuuccaauuuuuuuuauuagauauucauuuacauuucaaaugguauuucaaaaguccccuauacccucccccugcccugcuccccuacccauccccucccacuucuuggcccuggcaucccccuguacuggggcuuauaaaguuugcaagaccauauuuucacguaccuauugaauguauuuccauuucccauuuacuauauaaauaggauaauaacucaucuaaggccuccuccuuccuuguccaauuaagaccugagccccagcccuggagugucgaggggauuacccugugugaucaacccugugcaugugugugcugcuguacuucugccagacacuggccugugacuuuauacaguggacuaauauuacagcccuguugaagcaauuucugugaugaaacugaagcagucggaugcuuugcccaggagcacaggcugcugugguugucaagcccacccaucuuagaucucggucuggucucuuccucgccccucaguggcacacuuagaguggcccuccugugggcugggacacugugguagggacaacuugaagacacauucugcauguuuccucuagcuucccuugaaguggcccugcuuccuuguaguggccuacagggaaguggggaccagacugcaacacugccugcgauuguugugggggucuccaggcuucaaugcaucagucuagguucucugggaaccacaaacaagagccauuuccuuacaguguggaaacauggcacgagagggccugcgaacccuugugguagccaagaggacucugacagaagagcaauaccaggauuuugaggugagcugcaucaguccuugucacucaaggcucuuccuccuuaugaaaacuuuguuuucuccaugaaggccaaucuuccugugcaaguauaaggccaguguuucugaaguuugggggcauggacuaucuuccuccuuccucuuaauuggggggcggggaaugagugucauaaaggcagguaauuccaucuccucagcagaagcugagagucucaucccucacugcuguucuuggaacacaggugcuguagacauugcagcuguguggauuauggaagauuugcacaaacaacagguugacagguuuagcuacccaagcccccugaaucccaaaugccccagaaucuaaaacucuuuuaacauggugucauugcgcaggaugugucuugacucaugaggacuucagguuuccauauuagggaaaauuuacccugaguucauguagcaauaauuacuaaauacucagagcacguauacaaagcauagacacaacaagucaccugauccccaagaccuggugcacaccacacgguguauacacacauggucgccucauuguacccucagagcugauagagugcaacuguguaagucaaaccaugaaggaugcacauacuuguauaccuguucccuuguccucagagccgauacagucaagccaaacugaguauccaugaccgggcucugaaagucgcugcuguuguagaaagccuggagagagagauggagcuguugugccucacugggguggaggaccagcugcaagcugaugugaggcccacacuagagaugcugcgcaaugcagggaucaagguacagcaugcaaccucugacugcuaaacucuuguugaauccaacuagcacagugccccuucucuuuuggcucucuuuccauguucaagacagcauagccuuucugaaggaggacucugaucuguccguccccaugacagguguacuugcugagaguagucuggggccugucggcuucuggcaggugugcacagccugugacucugcacucgccucggugauuguuuccucaccuccuguucgaugucagaaccuacgacagaccuuccugaagcaucucguauacauacuccccauaagagagcaccuaggaggcaucuguaggccuugagcaccgucagggucggcacugcauugcaagcggcacugguuagggaggagcugggugcaggagaugcccaguguccaucaggcuuugcucuuucacacugagucaccguccacucuagagcuggcauagacaguuauuagcagggcgguucagaagcuccuaucugcucggcuccacugugcuucgaaagcagcgugugucuguccccagagucagauggaagggcccauagugagaagugcccagccacaagugaacgcugacgcaggggcacaagugcuuuugucccugcacuccuugucagcacacgugacuauguggcuacugcagagcucucggguccucgccuucucucccagguccucccuuucccacacagugccuagcuucccagcugcucccuugugcaaacuggccauuggaacacagugucugcaggaguccugcugaccagcauuccugugaauugugagggucagucccuuucccgguggaguugguuuccaggguagcccuuucccuggagacauucucccuuccugcugcacugccauccucuuccccagccagcucuccaaggcuaagucuagcauuuacaggauaaguuuuaguuuguggaaacugucuucuuggguuuaggguuagggccaggguagaguuagggguuagguucuguuagcugcuuucuuagcagcuaacagagaaguuauuuuggcucuaccucaaggauuugaaacuuauuuugaagaugguaugggaaacguaccacuuggcuuugaaagaaaaacacugcagccagaugagggagagaaagucagaggaacacugguucucaggucuaccucgauuguccaaugguugugagcauugugagaagaggccuagcaagagguguuaucagcuuuaguggcagcagauggcacacagaggcugcacucaugacagagcaucagcaagccggagcucacagcugggaagcaguucacacucagcaucucaggcaucuacacucaguuaugccugcagccaaaacgccaggggaagaaaugguuaguuaggagcagaugaccugauuguuucaaaugaccuacaaucuguuuuguaacuguacaugcuagauuaucaguuuuaaaguaauaaaguuccuugguauagaacuucagguauugguaguaauucugggcucaugaccuaucucucuaaccuugcccucuuaacucuuggggcaccaccugacuggaccccacucggaagcagggaguguagugguuaucagccgugucucccuguuugcucaucgacagagguugcucaccaguggcagugcagacugugcuuacucgguuuaucauggggauauuuuaucauuggagguacaguaaagcuugcugauuagacacagcagcacuagaguaaucaauaugccacacgggugucucuguuuccuguucccacaaauuuaucuuucuacagaauaaagaaucugagagacucugaugaugguggugagauuaguaaagcagggcuguuuugcuccucuguauaaaugcccugauuauuuuagugcuuuguaguccugggcuuuuaaaacuuuuuccauucaugaucccuguuugccugagagacuguuuuuacaggacccuaagucagugguucucaaccuguggguggcaaaaccgcuuugaggaucacauaucagauauguauguuacgauucauaacaguaucaaaauuacaguuaugaaguagccaugaaguaaguuuauguugggaggagggucacuacaacaugaagaaugguauuaagggucucagcauuagguagguugagaaugacuaaccuaaacagaauuaaaaaaccaaauauuuacuaaugauaagugauaaauuuauuuuaaaauaauucuuuagucauuugauuuuaccauucauuaaacacaaaaaguaaauuuacauacuaaugagaucaauguccuuauuuuacuauaauuaaaucuuggcugacugauacagcaguauguauagagcauugucaacacaacuauucuauuuuaguugugaaugccacuuuacaauaaauacauuguaaaggggcagaguuuuauuuaggaugauuuuagaaauugggaauucugucccaaauccaagccaaaauugaacaauuuuuuuuaugaaacucacaucagcaaugcaacaauuuuuaaaacauucuaacaguacaguccaaacauacugaauacuuacaugcugaagaaugacagucucauauuaguagucuuucuuuucacaauuaaaucacguuuugaaguaaaaagucuguacaguauacuucauaacguucaauagucugaagcccagaccacagaauuugagacaguccuggauguuccauagcacggggcaugcacagugcacaacagugugcuguguggugagaaccagggcugcaggacaucccagcaagcacugcuggaagcaaugcagcuucuuuacacacuugauucuaaguuauucuuugguuauugccuguucagagacuucuuuggugccauauuuguacagcaucccucacaaguaguuaguuaugugaccacauaugaaaucccaacccacaguuuaagcagucagucagaguguauaccgucacagugugucuguauguaugcaguuuuuaaauguuggaguagcaguucgacgcuuuaugugauaaaaguacauuuugguuuguccugguccauuggccuacuugaacuugacuuccuagcugaagaacuauguugaaacagugcuaugaacuaugugugcucuucuggucugcacugcuuccucacaucugcaggcgucugcauuagucucagcuguaugucugagcaucacuuucugacuuacucuccauaaacaagucaguacaaaacacacaaccauaguuggcuuuuagccacuuuuaggcacacaguugaguucauuuucugcagccauugcugucaccaucugcauagcucuccauuuuuccaaccugaaacuugccugcuuaagcucccacuccuucucccucuguauaugguuucucuggaccuccuauguguggaauuacaugguguuuguccuuuugugucuagcauaacauccuugaggacuuugucagaauuugucucuguuuuaagaaucagaaaagugaucacaugucauuuuuccauugacucgggguacuugucuugcuucaucuugucccuguugagaaauccuguaaauguggugugcaaacaucugugcacagggcuacuuuaaagaaauagacaugcauuuuuaaaguucacacgcuucaauuauuucauagauuuggaugcuaacaggcgauaaacuggaaacagcuacuuguauugccaaaagcucacacuugguguccagaacacaagacauucauguuuucagaccaguaaguagauuucuaaaucacuuugaauuguuaagugaauuuuuuuuguuuguuugaaggguugaaguuuauuuuguuuuaugauuccccuaccccauacaagguuucucuguguaguucuggcuguccuugaauucccucuguagaugagucuggccuugacuucagagauucaccugacucugucuuccaagugcugagauuaaauaaugguguacaccaccacaugcagcuaaaucagugaauauuuuaucguacaauuaaaguguauauacaguaacugcuggguaucuuuuaaaaaucaauguuggagauguuuccuacucuauaaacacauggugaaugacuuugagauauauuuugaugauaaacaagcugcuaguuggaaagcauuuuucuccuauacauuucauuuuuuguuacucccuauuuuaaguaguuauacuaaauaauuuucuccucaacuuauaaagaauguauguugcuuuuuaagcauacauuccauauuagcuggacuacagguacagagguuguuccugugagacaaggcuagauacagagcagaagcaccucuagcccacugccaucucagauuaaaaguuccucuguaacugcacagagaaagugauagaagagaccugaacucauguguuuacuguacauacuaguaaugaugaguuuaauucaaacaagaaguagaaguuccuugggucgugauugaugguggguagacagacaccaugugucuguagcugucugaauaaaaugcuugcaccuacagaaaugguuauuucaguaucauuuacauguaaauguauuuuauuuugaaacaucagaaucucaaauuaugcccugcagacuacuauuugcaauuaaauuauuaaugcuucugauaaaacuuccgaucaauuuuuguugacuuuucagaguuauagcaccacaaauuaaaauuuucacaauaaaaccuaccuacuuaaagaugagucggagauuaauuuggaucaugugaaacuuuuaauuuauuucacuccuauaucaucucuuuuaugccccauaaaaucuucacagaaagcaugugcaaagccagugcauugauuccuggcauauuuucgcucuaaaauuaguauuucagaauaacagcuugauuuguuugcccuuuagauugcuuacuucuuuagacauuaagcaaaaauggaugggagggguugaaauucaugggagaggucacagaagcaacuucaugaaauuauuuucauauuacuccauuuauuaugaagaaacauguuuaaaugaaaccccaaucuauauaauuugucucuuacuuggugugcggcgagaaagggaaacucaacuuccuugggcccugguauuccaauuuauaauucucugaaacuauguuugguauguuauaagccaaugauuuucaacauugcuccuaauacccaccuacuccaacaccaauuuaauaaaucauuuuauagaaagugcuagcaaauccauggucauuacauucuuauaaaaauguuuauaucagcaguagcccucacaugcuuucgugaccagaagccaggaaacagucucugugagaggugcagaugcagagucuguaaggaccgugcuacauauaggaccucguucauaggcuaagcaccuuuaguuucuaaguacaguuucugaaggauccuacugggauuccuggaaaaugucuauuuauuaccuguauucaugauuuuuuuuuuccuucaaugaagguaaccagucggggagaagcccauuuggagcuaaaugcguuuagaaggaagcaugacugugcacugguuauaucuggggauucucuggagguaagccugaguguguguguacaugccuguauaucucucacugucuccagaggucagaccagucuauaacaguguguaucuugguucuaagauaggacuggucuguaguguaccauauucuauugguccaucugucucuuaagacugaccucugaugaagugugugucugccugucuuuccagcccagugagugaaaaguacuccucagcagccuagccagccacuccugucauggcagucgugagaacacucaguccuaaggacaugugguggccaugccugacuagucuucugucccuuccugucuagaagcugcuuaaguucaguaguucaagacccuguccugauucuggguccccugcucauuguuaauagcaucagucuccaguggcuaaaacauuucagcccacaauauguauucuguguuuguccaaaccaguguuucaggugugugcacuuggacacaugguaccugagaaaagagcuaguggccuccaguuaguuucacguuguuguuauucccuauuguaaguaggcaugcuacauaauuuucuacucaacuuauaaaaaauguauguugcuucuuaaacacacauuccuuauuagcugcacccgugguacagagguugccuguggcauuauucagauucucacgauacuucagagugaagggcccuagaggagagugcaggaaaacccguaugggagaggccagugagccagcuguuauuuguccuuaacucugugugguuuccagcuccauggacguauggucgagguaccagcuucuccugugcucccuacugccguccucuuccuagcacacuuaggacccuuauacuguagcauauugcaccagugucuucagagcuaccuugcaguucuuuuaagguuugauaaggggcugucagcuuccagcauagcugccuaugacugguguaucagcaccuccagaucagaagaugccauucauuuugugcuuuuauauuucaauauguuccaaauagucauuucuauuuauguuucuuucauuuguucccuuauauucuaauguguucuaaaacaccuuauaaguagcuaacaauaaguacaccucuuacaggagauuaaaaguugcauaaugagaaauccauaccaaaagaaaaauaagacacagaaguuaaggcaguuggaguauguaagauugccgagaggggaggcuccaaggccguccuggagcaugauguuaggugucugucgccauccccugagcacagggaaacaggaacgcccugcccaggcacacggguacaagcagguugcaugaauuguagcuacaacuggagaaggaaguuuuucacuguucuuggcagaggguacaccuuccacccaccaugaaucuggcagcuaggucuauggucucucuucuguugguagccuucuggaccacaugacaugaagacccacucuuccaggaccuguccuucauaacgagaaaaugcuagaguuccuagaaaaugaauaaaacugugcccauuagacagggcugugagauuuuggauuucagguuuauccaccaucacagagagcuaacaacuggaacugucacuuuggaagggccuugaguaucugauaucauaggucaagccaaggucuucaucagccccaugcaugccugagaaacacugaaaccaaauauaggcagaauuuguugucuacugguuccagggaaguauacacaucauuuggucauaucagccuggcagaacgucauguggccacuggcccuaccccuuguuugagcuguucuccaugcacaaugcgguaccuuuaggagacccugcacucuuuccuaccaggggccuggccacccugcucuucuucccaucugcccuccuguacagcugagccaucugucccaggacagguuacgcugugaaguuuggagggcacaguccagaaugagacccaaaaaaugagagucuguuuacuugaggaaggcugaagcuuucuuacaacucugccuacguccacuugagcccaggguuguguguugacaguagagucacagcacugucucccaggucugccugagguacuacgagcaugaacuuguggagcuggccugccagugcccugcuguggucugcugccgcugcucacccacccagaaggcccacaucgugacccuguuacgccagcauaccagaaagcgcaccugugccaucggugagcccacccagcuucagccacaccacggguggguggugggaugguguucuaccuuccugucaacagugaaaugugaaaaauagccaacucuuuaacuuaaggcaaauuguguugucucuaaaauugauuucaucuguuguacaggaaauucuuauagucccuaacaguuguauaaaacacaaaagaaaaagaugcuuuauuuacgcuccaccucuugguaccucucaggcgacggagggaaugacgugagcaugauccaggcugcugacugugggauugggauugaaggaaagguaggucugugcuuuugucucacacgcucucgugcucuguccucacugccccaccguggcucuguccucacugccccaccguggcaugcugguauacaguaggaagcuagcagccuucagcagccuugcuagcugcacgcgugucucuugaggaacugugucagguccucugugcuuaugaccuagguccugcaucacugauuacucugucugccuguccugggccuucccuaacaccucagcuccuguccccugcuuaagugcuucauucucugaggagguguccuuuucuccugccaacuaagccacgguugauguuugugucaacuuugauuguuccuguugucacccaaacauauauacacacaucaagaccuaaaaaauuuguugaacuugacuuugguuuuucccuuggcugcucuguucuguucuccuugauagcuuugaaaaaucagagguagauuguuuuuucaaauuaugauuuagagaacugucuugaaguagccuggaaccauguaauaggguaggguguccccauagucagugcuaaccccuccccucuuauuuucugugcugcuaauagaucaaagcccuuucuucuugggggcagcugaugucugugugugcacagguucuaguacagucuccucuaccucacccacacugucuggugcagacggauggcaugcugggccaugcuaggggucaagcaggcacugcccuagugucuuaauucauaauucauaugagcucuaaaacucgguguugggugguucucagagauucuuugugguucuucaggagggcaaacaggcuucucuggcagcggacuucuccaucacacaguucagacacaucggcaggcugcucauggugcacggacggaacagcuacaaacggucugcagcacuuggccaguuugucaugcacaggggccucaucaucuccaccaugcagguaucaaugcccaccaugccucagcaggcaguggcuucucugcgagcugugccauuauugugggaguuacgcuggacuuacugggugucacuauauuguagugagauccucuguaaagacgagacaaauguagcacugguguuuaacuuacuguguucugucuuuuaaggcuguguuuucuucagucuucuacuuugcaucuguaccgcuguaccagggauuccuuaugguaggguaagugaaacagauguucugggugccucucagccuccuguaugugagaacuuuuauuuaaaagagauguggagcauauugagugaugcuuuagguguucuggguaauccuuugcauauaaacauuuaagauggcuuaacugcuaugaaaucucauguuaaguuugaagaaacuugaaaaacaccuguacgcauaugccuuugaaggcuaugcuaaguuucucauuagacuuugcauucuuggggaagccauaauuugugucaggaaccacggcagaucugagguuguauaaaagggccccgaagcauaaugagaggggcagaaccaaggggcgggcacaugccaacacugccaucagcagggguuggagcugcaggccacagcugcaggccuucugagccugcccugucccagugggaauaugacuuuaccaugagggaaugggacccagccaccaaccaggaaaugagauagaaagcacugggagagacauggcuagucugucucucgcagcaacaaagcccugcauugagugacagccacugagaaaccuuggacaaguuccucaaaagcagagcagcccaugggccaagaugauauugucaaccaagugugaaaagggagacuccuucucaggaaacaaaugguaauuucucccuuacucauccaucaguuguuaaaccuagaagucauagaaguauuaguguuggugugugaccacaaaauaaaagcucucccugccacaucugcccauugagacacaucacaaaccucaaaucuuacaaccagaaagagccuggaaaguaucccugacguuaguguuccucugcuugcggaccuccaugugcauccccuauguggcaugugagaacagugagcaguaucugggagauuugggaccaugcuggaucgagacugaaaaggacucggugcuguccuccguuacacuagcccagcaccuuuggcuacaguuuucagcugcccuccuggccaguagaggagagacagagcaaggucuuaucuguaagcugguaaaagugcauccuaagugcaugugacccucccagaauuccuaauaacuuuagccaaaacaggggaguugugucuuuguuaagaccugccucuguccucugucagucugcugucugcggcgaaugcugagucucugggcuucugccuccuuccaucucaccucaucaucaaagcagaaacuccuucugggacuuugccauauaguagcaugucccuuaccacagcacagccacccucuuugaaggaucacugugggcuucugggaaaccaguguguuucugaccacauuaagugauauaauuaaggaauggaggccucacaccucaaacccagacauguuuguugcuucccaccauuaguaccuauggccuuguaaaaugugcacgaccuccugagccuguuugauccaaaaggggauuauacuaaggagccucagguaggacuguagagagagagaggcuguucacaagugcuggccacagagcacaagucacaggcaugcagaagaagcuacagugaauaugccccugcgggaugaccagaaccuaucguggugacacugccaaagaagugacagauuaucugcacaaaaauggagacaaacugagcagaguggugcaugucuauaaauaaucccagcacguacuaggcugaaucaggacaaauugaggccagcuugggcuauauaguaaguuucagucuaaucuugguuacaaaguaagacccuauaucaaaaaggaagggaggguaguagauguuuauaccaauuuauuuaaauaaccccaaguugggaauaaccaagauauauuuacacaaaugaaaaauugguucagcaaguauggcuuauccaccgugagauaccauucaguuguaaggaaggcacugugcacacccacagcacagaucuccagggcaugacauggaaucugggaagccauccauaaaauggacuuucuaccuaagucuccacaguagcccuacaaugaaagagagagacagagagagagagacagagagagaaugaauaugagagaauauagagagaauaugagaaagaauaugagagaauagagagagaauauagagagaauaugagagaauauagagagaauaugagagauuauagagagaauaugagagaauauagagagaauaugagagaauauagagagaauaugagagaauauagagagaauaugagagaauauagagagaauaugagagauuauagagagaauaugagagauuauagagagaauaugagagcgaaugagaauaugaaugaguuaggugccaugcuugauggcugaguguggacacauuuggguacuagugugaagaaaguuaggguuucucuguauuagaugguugcaugugagucugacaucauccaaaauuuaacaagaacacuggacauggugguacaacaccacguaaucccaccacuaaggaggcugaagcaggaggaucacagguucaaggccugacugggcuuucuaggaaguuucucuuuguccuuggcuguaagaacuguuucaaaaagcaaagguuaauaagaaaacucugauuuuagauggauccguuucccuguguuugugguuuuuacaaccgucggugcuggguuugguaccuaagcugcagaguaaucuaaacugauggccaccguggagguuugggcuaguuuuucuaagauuuuguuuucuguugagaguuuggcuucccugugacccuagaaacauggucagaguugugucacaagcaucugucgggcuaacucaacuuggucuugguuuucuagguaugcaacuaucuacaccauguucccaguguucuccuuaguguuggaccaagauguaaagccagagauggcgauucucuacccagagcuguacaaggaccucaccaagguaggagcccagugcuaggcuuguccagugagagcgcaccagagcuggucuuuuguguguccagcaaagcagaggcagcgucuguucugggauggcacacucccugacauuuggcaagcgugagaaagcauuuugaaaucucucucuuuuuauuuuuaaaguucucuacuccuugugauagucaugugauauuauacauaagaacuuaacagguguuuugaaccauuuguagaacuuuugugaauuuagcaaagacauccaggcauguguuuugauucuuauaaaggacccuguauagcugcagcucugccugccuagccuaguaucuuuaccaagagaagacuggccuccuuuaacucagugcagaguucagcacucuccagagcccuugaguaccuggcugcgguggccuggcaucccuagcucucuacuuguggguuucagaauuacacuugaaaagugcuucucaguccuguaacuuggagacaugcgcucuucuguggagacagagcgaagcauagccugcccagcagaggcgaaagcugcugucccugugagaggccacacugacaugggacuggacucugaggaguaagcuauuccuagggagguuggaauuggauugugugacaucaaagcauauuuuuaaagcuagagacgaugaggacaaggguagagaaguagcugagcccugcacguacagauuguuguaacuugagaauuuucugcauggcuugcuuuuccuaaacaggcacagaggaaagaaaaaccuacuaaccuucaauuaaauuuagguuuucaguugauaaccugaaauuaucaacuccaauuuuaaagcaguagcaauaugguauagcgaagaaagaauuagauugguguucaaagaauuaguuacuucccagcugaccauuagcacauuaggguguaggcuagcuaacugcuaacaaaccagaccguaauccaguugacugcuaacuagcaggcuagacuguaguucaucugucagcucaccagauaaguuuuggguaagucacauuacuucggggguuuuaugauauuaguauaaagaccaaauuuauaaaacaauaaagccuccuuaaaaaaagcuauaaaguauccaaauaauucuauuuucauauuaaauaaaucuucguuguggucauauaaaauaaguuauaaaugugaucauuaucaugaugauaaugugguuguagcuaccacaagacauuauccaaauuuuaacauauuauaacuagaagggacacuucgagucuaaaaauccuaaaaugagaccauugugauaggaucacaauaaggucauagaaaugaaaacuguaggaaguuauugcaaauaauuagaguuuuaguagcucaugcauuuccuuauccccagauauucuacaaauguuugguuaacaaaaggaagguggaaaccagcucuugauacaaguuuaaacaccccaauccucuaccauaccuguucuuaaaucuaggcggccuccaucccauuagugcuaggacacugagucauguugcucagagugauggcgcuggcucccaggcuaggagggagucucagcagcaacaguguagcacuggcccagucuccccugacauuugaggaaacauagcuuuaccacuuguaaagauuucaaccuuguaaagaucuaccaguaucauuacaggcaucuaaauuacucuaguaacaaaaguauguauagggucccaagaguguaaguaauucacucucucuagcuaauauucaucauaagcucauaccuuggcuaugaauuuggcucacaguucacaguuugcaccacuggcuaauggcagaauugguuugguuuuuaagcaguugcagugauacccaguaaggaaucacaguugucugaacuggguugcaucccggucaaguuuccacuuuugucaagaucaaccauguaaaaagucucaaccucccagagugaucucugcauuauuuagcacuucagcccccauugucucuaaguuuucuuuuuccaugauccagauaucugucauuuuuaucuuuguaguagcuauuauguuaaaaucugauauacuucaaauucuugucuucaucauuucuagcuuuaaaaguauguuuugacaucacacacauccaauuccagccuccuuaggaacagcuuacuccuaagagcccagucccaagucaguguggccucucaugcgacggcagcuucugccuuugcugagcagagcacggacugggccuggugugggcuuuguaagccucgaaacccaugccuggugacacaugcauguccuccagcaaggccacacuuucuaauacuuugcaaagugaaacugugaacuaagcuuucaaaucugagccuaugggacauucucuuuaagccaccacacccuguuuucuaugggcacuuguaagcuuagucauuuagucaagaguauaagcaguuacacgcauuacagauccaucuuacugcucuagucgcauuugcuaguuguggaccuaaacauuugugguucuguuuccucagucuaagcuaugccugccccuucuuaugugucaccagauauguuuuaggccuugaagacagagauuccugguaucugucuacucacuaaguaguugaugaaugaaugaaggaauaaauauaagucaacuacauaaaaagacaacauuuccuucauuaaaaaaauaucagcuugcuuuccuuacagaaaauaauauauuuuuaacugaaauauuucuuguucuguuuuuaaagcccagucgugcucugagguauuaagcuuugcuuaucgugaauucagucgaucuugggaugccaccaucagacagaaagcuggcauucccauuccucucccggcacuucauguccuggaugagugggcacacugguggggagcuagugaguuccagaauagggauaguagaguagcuccaagucaccugaggcagccugugacccugagcugucccugcuuggcuaugaauuuggcucacaguucacaguuugcaccacuggcuaauggcagaauugguuugguuuuuaagcaguugcagugauacgcaguaaggaaucacagcuggcccuucuuaagaagccugcagugucugucacuucuucccuucuguagaauauccucaacaugauucugucuuuuuaaaauguuuaauuuuuaaaauaaugcuuucuuuuugaggcaggguuucucuguauagcccugguucuccuggaacucacucuguaguauaggcuaaccucaaacucaaguaucuaccugccucugccucccaaguguauguuaccuccuggcaaaggcacaauuuuaauuucucuuuauagguuccauaauuauuuuuaaaucucaaaagaaaaaucuauguuaugugauuucuaauucauauauucuagcaacaguuagauacaaaaauaauagcagcucugguaauauuaaacaagcaaagcacucuaguguaacucugauaauacauugaaaaaugcaugcacaagaacugugacacacuuuuggaagaauuuugauuuagagacugaacuugguugacuauugacaagcuggcucuaagauuuugauggaacaacgaggaaacuggcuuuguuggaaccacucgugaaagagcagaguuggcuggcucaguuuccuguuucaggacguggucuauaagaacaguaaagacaguggcugggacagacacagaggaguggguagaagggaguccagaaggaaauccacacacacugcugaacucugaccaaacagagcucaggcggaagagggcagaugucagcagugaccucagacagcugacuacccauucugcagccuccgcucccucaccccgagugcacaggcgcucaaguggccacugaugcacacugagacuguaagccagauggaagagauacaggacacaauaaucuauaaccucaacagggagcuuuuagacacagacccaaccaugauucauaaaggacaaaguaaaauggucuucauuauaauuuuaaaguuuugcuuuaugaauuaugcaguuuggaaaaugaacagauaaaaccauaccauggacugggagaaaauauuugcaaguuaaggauuuguauucauaacccauaaagaacucuuaaaagucaucaagaaaaaccaguuuaaagagugaacaaaaguucuaaacuaauaaccacaauugauguacaguugucaaggaagccugugaaaaaugcccaccauuauuuucugucuguguuacaaauuuagaccaaugagcuaacauuacacagcaauuaagaauggcuacaguaacuacccagcgcuagugaggucaugaacauuagagaucuugcugccgcccuuuacuagacuagcaugauuccuaacugcauucuauugucugugcucccacagacaaguguagcucucacccugcaucuaagaagcuucucuuagcagcaaguggagaccacuauagaacacucagacuguucaaaaugcaacgaugagcugauccuggagagcccagccucagcagauccaucuacaacacugcucuugcacccaaggcucagggaacaucucagaagagaacggaaagguuucaagagcaagaacacaaagaagucuguugugagguugucuuuuuagaaaagacaaggaagcuacacucaugacaccucaacaguaugaacagugacagugaugggcucccaugccuacaguaaaaccauagacagcuaaugauggacuggggagaauuggucucugccaaggaugagccuuccaauugguuauccaauacaaaacgaucagcucugaaggcacacacagaagcagugccaaguagacucggcaaucuguauuuauauauuuauacacaaugcauacauacacacacacacacacacagagagagagagagagagagagagagagagagagagagagagagagagagagggagagagaagaggcuaucaauuugaauagaagaaugguaaggguuggaaggaagaaagugggaaaugauauaauuagauuuuaauuuaaaaauagacuuuaaaaagaaugaaaagaaaugcgaguuuucagugcucugaauccccacagcuggugaggccaugcaccagcaagaaguuugugguagcucuguuagaguugccaagagcuagaagcagccagcuguacuuggaccagaaauggauaaagcauccuggugaccacaagcagcagugaugacacagauaugcagugggauguugugaggaagcaagaagaaaaacagaucauucauaugauaggaaucacagaugaauccagacuauguuuugcuaagcaaaacucaacaccaaaauuacuuugauucuauuccucuaguaucuggaaaguacagaaccagaggucaagaacaggucagugguugacaaaacuuaaaauguaaacuauagggugagggaaucucaaggugucuguuaucugccacuguguggcggguaccugacuaugcaugucagaaccucagaccugugcacugcagaauagacacuggaacgauaggauccagguuaaaaacagauagauugucaucaacucacacuggagauggugugugaucaccucuagucugcagaaaggcuggcaaggacuguacauuuauuucuuauggggaaaucuuuuguguccugaguguacagugaacauguacaaacguguggcuagugagagcagcuucuuggugaugggacaccaggagguaaggacugaucugguagucaggugucaauuugcauauugccaugaguaugacuucacaaagagacacacacaucccaggucagcucgugauaaugaccuggaaccaguggccaugggcacaucuggggcugcaguguucuccaaccagaggagcugagcaaugaaggagaagucaauuccaggucaggcacagaaacuggaggcugaccugaagcaccaagugauagcagaauguaaacaauugcugcagagcuguugauggugacauugaccuagcaugugagucaacccgaaggggcucccucccaggagaagcuaaauguguaauagucuuccugggucugcacugauaggaaaggagggcuucuccuuaagggaggauugcuaugccugaaggaacaccaggaacugccgugaguagcccaggggugccucauaaaauaggugaagacaacuacaugggauauuucuuugacugaaaguauauucccaagauguuugguugguuacaaacaagcaguuuaacaguggaaccccaguagauacaaccucaguaagccugucuuaguccaugugaccagugacagacauuggcuaccacauccuccugaccgagacucuugaguacacauguccccugcuaguguccucaccauuucaagucaaggcuggacaugaugacaauucguaugauccuaacagucaggaggcuuggauaggauugccaugaguuuaaggacagccugugcuauacaguagguacuggcccagccagggcuucacagcaggacucccagaaaaagaaagaaagcgaaugaaggaaaggaaaggaaaaaggaaaggaaaggacaagagaaaacaaggucuugauguggcuuuguuuuauuuuuaaagaaacuuccuccuacacuuggcucgugcuuuugaggagacuugagguucuugaagacaaagaaauccuggaaugcuggccaaauggcaguugagaccaguauauggaaugucuuugauagcaagagguccuacuuauucccagguucauaaauggaaaacuagcugcauccaacuaggauagccgagaugguacccugcucaauuuuuaguaccaauuguugcugaguguuggugaguguagcagugccuggccaggcuggugaguguggcaacugugcucugcuaucacagcgccccugggagcauugugugugucagcccugacucuggcacagaugcagguuggcugggguuaguaagccaccuaucagauugcacugucuggaacagugacaaagugaccagcuacuuucacaggucuuucugugacuucaaacaaauucacucuuuuugaguuucuauuccauuuucugucauuuuauaauugacucuacaauauauuuguacuacguugucaucucucccacccugcacucugccuuuccaauauauuuguacuacguugucaucucucccacccugcacucugccuuuccauuucaaccuugagaauaugauaguaaagcaaucuuuuguugugccucucuuaggaaacaaaguaaguuaaggugugcugaaagaauacuguaaugagagagggaguccuggaacuucugagaagccaaaaauguccucugcuggcacccagaggacagaucugcucauguaugcacaacaguaugcacacuugcacguaaccacagcauggcuccagucuacuuguguguaauaaucacaugucacugugagcgacacaugcauucuacacccagugauaguuugugcuuucauauuaaugauuuuuuuuauucaucuugagguugauaaaaccuuuugcaaaauucuuuuucauuuuguuuuuuauucaucuacagucaaauguucaauuggagauacaaugguaacacccauugaaugugcuaucauucugaguuucugugugucacauuauugagguacaugccauucucuguauuuuauagaagaggaaacugaggcaugcaaggauaaaacaggaggugugugcugggcaaggaugucgccaggugucucuccugagcucugugcucaucacaugacaugaacagagccugucugucauugaaaggagcagacauucuguaucaggaaaaacaguuuuauaaucagcuuaaaauccacaguaaauggauugcuucuguggcuaauauauuuuuaccacagagaucucucaacagauccauuuguaagcaucuacaccaaggaacacgaggcauauacguguccucagacuacuuacugauggugcuuaccccagauauuaugcagggccuauucaucuguagccuguguagagucagaaguugucauccaugcagacuggauacacugccuuccaugcccugauguuugcagcuuucacaagacaaguggcacaaaugccccuauucgcuuccagcaucugaacugaucaucucugucucaaugcagcugaggaaaguuggcaaucaaguaaaccucuuuacuuacacaaaacauuaaaguuaaauuuccuuuagauuccugaaguaaaauuagucacauacuuaauuacagaugaguuuuauggccaaagaguaaacaugcuacugucugauagagaaaugcucuugaaaaguagcugccaaaccugcugcaguucucugguugcuugguugcuugguugcuuggucgguuaguuaguugguuuuuugagauaggaucucucuguguagcccuagcuguccuggaacucacucuguagacaccacccccauauuuccaacacccccacccacccucuuucccccaucccacccccagcuuaaagagguuuuuuuguuguuguuugguuuguuuuuguuguuuuaaguucuuugcuuuuuaaaaucaguauuaacuuuaauaaauuucaguauaguccaagucuccuuaugcuuauauaguaaagauuugggcucaguccacaucuucaaugauggacacuuauaacuaaggaaaacauuuaauaaagguauaacuauuguuuauaguuaaaguacaacuugaauuguaguuugcacauguaccuguaugcauauauaugucccacaugugugcagguaccuauagaggccacaguauguuugcuuccccuggaacuggagcuguagggggcucugcacugccuuauauuggaagggcacuaaguucccuccacugcugagcugucucuucaguccuguaacaacaucuucccaguuaucguucaucguuaaaaguccucaacauaugccaguucaaugggaucuaggcguuggugugcuacuauugccuugcauaccugaugugucuucugggaccacagagcagucagccguuccuugugggcacauaugcccacauuugcugcaagaaacucuccaggggagugaagcugaggaaagagaugcauuagacacagaacuguggacucugauucacuaacaucacaguaugucacaagggaggugugcaaguaggagcagaaacugagggagggcccacaggcucccccauucuugaccgauucgugcagagcuccguaagugagaggcucacaaccacccuuccuucacacauuuuuccggcaauuaucaccugacagggcccagcacagagagaaacaggguugaaccccugcguaagcagcaucucuuguuucaguucgaauggugaagcagaguauaugaaaguccauuccaucugcugcuggauuuacuaauguggcacauuuuccugaagugauuaacaaaucagaaaauuuuacuccaacugggacaagucauaacuaaaguaccaucaccauuuuuacuuggggaaaugaggucccgaggaaacugagaaauaaauauuuauuuucagaaaguaacaaaguagagggaaaaacauuuuaucacagucuuuaucuccuaggucaauuaaguguuuuucuguaggcaccaguuucuugguuacuaagaauccuagggcguggcuguaggaauuccacagaugagaugaaagggcaucugagacccugaccaaccaccagcauucaguacacacccgugauacccaccaaggcagcuacugcaggggacagcaucacgugagguguauaccugcgucagucaggucaggacagcguguagguagggcaggcuccgugaggagcugcccaaccccugcuccuuaggaacacaguggggcugccacccugcucuccuaacagacucuucuguuguucccuagggaagaucccuuuccuucaagaccuuccucaucuggguuuugaucaguauuuaccaagguaagaugggccugauuuuaccagaccuguccuguaacacacaucuucccauucauguacguucaucacuaaaaguccccaacaacuuggggauugucugccugccugucuguguugucuuagcaauacuguuuuguacuuucaccugaaaauuaaauaucagcagcuuaaaaugucucuaacaguaaguauuguccuaugucuagcuuguagauugguauuccaacauguggauuauggauugauauucugggaggcacuuuuggguugguuggggggggguugaguuuuagagauggggucucauauagcccaagguggguuuuauuuccuccuuccgagugcugggguuccaggugugugucccugugcccagcuugugugauguugaucucuaccuacucagcugcauuccccagcccagacaggcacuuuugaacuucugugugucagcucgucagaacacuuugauaaacacuccucaccuugugcugcacaaugguuuccuuggagugcugauggcgaggccuggagccaucuguacguguaauaggaagcuacugcccucuacuaggguucuagugagggacagcucaucuauccuagcauagcugcccggccggucagagagcucaugcaagacucacugugaacucagccaaaggggaaguuggcuuccuguagaucuuuagucugugagucccugcgaaugccgcaguucaguuuuuugauuggacuguccaucccugugaagacugucuguguucuggccccuguugcguguguuugagccagccguuccuugcucccuuuucuagcuaggucacaugauaaugcaguucccaggccagcgaggaagcugcccugagaaaagccacucucuccuucaggaggcauccucauguauggggcacugcugcucuucgaggacgaguuuguccauguuguggccaucuccuucacagcgcugauccugaccgagcugcucaugguggcccugacuaucaggacguggcacuggcugaugguuguggcggaguuccucagucugggcugcuaugucgccucacuugcuuuucuaaaugaguauuuugguaagugcuuggagccucgauucauuaucugcaagugauccuuagcccuggguuuucauuuccucagcuccuucucuuaggacaaaugucauaacagaaagcuuuaccacacaggcuguucuuauggaaagauaaagaucugguagugguuuauaaaauggagacuuucgucaccuugcuuaugcuugcuucacucauguuccuacaagagcugcacuguuuguguuugugguggaagacacugacuacaucaaggcugugagccacauguauccuacuuccuuccgcugucugcagaaguugcaucaggcagagcagcccagccaggcucccgauagcagccuuaguuaggcuucucaccauguaaagaggaugucuucaccagcaccuccuucagauacggagucuagugcuuguuucucccagugcaugcuuaugcuuccccagcccagcucacagugaccaguggccaggaggccucgggaccacaguacuuccuugagcucaguuuuccuaaggaaaaagauccuaagugaaauaugcugggcuuccucagguguccuccucugaggccuacacuccucuccacacuauuaacgcacugcacgcacugcuggguucugucucucugcauccccagccaggucagaucaaccuggucagcguggcugaagagagcauggugugcuugucugaguauugaagaguguagggccucacugggcucucgguggacaaaaagucccaagcuuccuggacuugagagcagagaauguggccauggucagugcacccgugguguacauucuucuagcugccugaaagccuggcaguguccuucuuggucuaaaaagaaaggucccaggcuucagaaaggagaaaccuuuacauguuccucuuguguucuucacacccacgacagcagcaacaguucucaucuugagcaguuguccauacaagcuagucacauuccuguggacccugcacgucacauggggacacugugacuuugggugaugagugugaaguuugcacacugaugaaaacaaagccacuccaggcccuggaucaaagccacagugagugaguugaguugcuacaggccaucacucuuuagcccaggcaggagugaugcagaugggaaguggaaagaguuagcuguacaguaaagggagcaugacauaucugacauggaaggaagggcuucagaugagaacauaaccauuacucuugugucuaucacuguccacagacagugagucagaacacuagggcuagagaacaaaugaccauucuguagcucacugcugucauacaggcaggcaggcauggauucucuaagugggacuuacacaagugacaccaaacagccugucacaggacccgaggcaggacuguugccuccguccccaugcucuccucugcagauugcagcugaugcugucuucccccugccaggccagacugcacagaacaggucucaugcauggggcaggcauuagaagcccugaagccgcagaguucuaaaguggacacucagacacuagcgcaaauucaggggaugugucuggguguuugcuuccaaugugacagaguuguuacauuggcauucugguuaaaagauuauauggcagcaggcaaugcaaggaaggguuaaacccccaacuacaagugcaucccgugcuaacauaacauucuacugcuuuuuaaugcauuucucuaaucaguagcuaacuaaccacuuaacaugucugagccucuuuuaaucuguucuucaucugccuuguucauguuuucucuuggcacagguauaggcagagugucuuuuggcgcuuucuuagguagguaaaguuaauauucccuuccagaguauagaaauuuagcaaaauagcauugauaagcaugcuaaccuaauucuuuaaaaauuuaaauauaaaccaaucuuccccuaacuuggcacuugucaucucagugaagccucaugagccuacccugagccaccuccuuacacagugugcuccugggugcuagcuagcuaggugagggaagucuggggucuagcaggcuguccuucccuaagacagccugagcuccagucccugauaugagagagugccuguggaagcaggagcucucucagcacagcugcucacagcagucugggugccugcacuuuguaagcucuucagcuugcauuaggcuuggcuugcacaugagugcaaccauggccuaguuaacagaaagugagccugcauccucuguaaaccauacuguggguacugccugccuguugguccugugcagguccuucccagugccgggcugugcucacugugagagaagcacacuuuggacugcugaggucaugggcagaccugugucacacagccaugauggagccaauggcucuggggauccugagggggcucagucugggcuguggaucuuaggggcugggagcuccuguaguuggcucucauucucuucugccuccuccugacagauguugccuucaucacaaccgugaccuucuuguggaaagugucagccaucacuguggucagcugccucccacucuacgugcucaaguacuugaagagaaagcuguccccucccagcuacuccaagcuguccuccugaguggggcaugaggccagguagagacucaugcgcugggcagcaugagggacuggcacugcuggcgggcugagggcgagcucacccagcauugcacugcgugaacagcuacugagaggaagugacagccucggcacagcugggcaggcuucgcuccugagcgccagaaguguaauuucugcgguggugaacugcagaaagccauuccugaucagacugcaggggccaugccugcacaugccauugcaccucaggagacaguggguaacucguccucuucagaugcaguuuugcuuuucagcggacaccacacacacaagcccagguggccaagcggugacacugcuguccuaauuccguugcagcuaugaauguaaaccauuccucaaggcacugcuguuagcugaugcauuuuauaucuguaaaaccauacucagaacuguuuacguagaacucagcuguccugugcugccacagcaccaaccacaaugcuuugcucccugaguaggaguccucguccgugugcuuauacccggcacucgucugagccugugauggcagagccucugucgaaggcugcacugagggcucaugggagcucuuuagaggaauucuggccuuagaguuagccccaggaguugugcgugcagcucugcacuguacagcguguuccugucacacaguggaccucuuggccucggcucuucacgcucgggagcaggcugugggagucuccuuugcacuaguacuuuguauaugccugugcucuucagcuugaccuccccucagacguggccacugagacccugacuuccuuggggaaggaagcgcacgcugugagaggagccuuggggagagccuuaaccggccgugagugugugcaggcccuccacccgcuccucccugugagcaaauaaagcugcucagccauccaucccagaugccuuugaccugagcgccuuuguucuuagcaaccugugagcauauuccccugacagacgaaacugcaaccagaaaagcuguuucucccauucuccacacggugucacuguuugcugacaguucacgggcugguuuccucccugcucuaagagggagcccagaccagcuugucugaccucagcuuaucugaccugacuucgagaugcccccaugcccucauugauacagcgugaauuaagaaagugccagaaggcuaugagccaaggccacagugccagggucaggguguagacugagugcuggucacucacuccuccuguaugcuggguagaaaggaacacacaggaagcuaacagcaugcuugucaagaguuauagaaagccucacaagaccaugaaccucugcgguucagcugcuuugaugcagagcagaccuucccacaguggugaauauggaacagcaggaggagucaggcuugagaagucgagaugcaccaaguccuaguuagaagcugugggaagccacugugguuucucauccuugaagugaacagcaucugccccucaggaugccgcuguugggucacacgagacaaggaugggaggaagcccuggucauacaccuggcacacagugacucaggaggacugaagaaaacugcuuaauaaaggaucauuaccugaccuagcucaguccuacaagggagcuugucaagugucaggggaaacgagucaccuugaggggcagcauuguguuccugcuggcuucugagacaaccuuguggguguaguuuuaaauucuagagcuucuuggcuccagagauucucauggacaggcuugccugcuggugagcacuauccagcccucacagggcuucugugucuucugcaggccuccuucccugccauaaagaaagggccucuggguuguugaag

SEQ ID NO: 9007 - RNA, 1346 nt, Mus musculus
uauuuauuuauuuauuuauuuauuuauuagucaucuguacuuacaaaaauucugugaugucuuuucugaaucccauccauaccccagguaugucacccacgugagcugccaucuuuuucacuuuaucaucccuuugcacuccuguuguacaaggaacaaccccuguuguacuguguacaacgaggcguggggacacacaacuguaaucccagcacucagagugcugaggcaggaggauggcgagcuuacagcagccugggcuaccuaguaagaaccugucucgaauuuuaaaugaacaaaacauauauauauauacccagaaagaaaucaggacaagaaauaauuagagaaagugaaugaaacagggguaagguauggacucagccaggguuagcacaagacaggccggcugguuacagauaauggaaauuuccucugcgcuucuagcuagugugcaaagccaagauggaagcacauuuuuuacaagaugcacacugccuaugaaccaaaacucugugggcugaaugcccagggcucuuaccgaaguggaagacuccuacuuuuuuuuuuucucaugauuguguagaggcaaaauaaucgacuuacaauuuagcaaaaauguauacugacuauguaaaaagugggacucacuaugaacaagaaauguaacugucuagcagaacaaagggaacugagaggagggggagggagugucagggaggggguggggcauaugcucaaguaccuuauaugcuuguauaaaaguguccuuaugaagccccagccccugcacaauuaauauuugccaauuaaaauuuuuauugcacuuacccauucauauuugaagaaggaguagugugcuuuccagagguagcucaagugaggggggucagaacacaacuggggguggggucgcucagacucaggucuucaggcauaguggcaagcaccauuacuugcugagucauucaguguccugaaaauuauaucauuugaaauaaaaggaaagcaaaugugaaaaucaguuccgguuguuuucaggguaugucagcauggagacaggucgguuuuuaagagcauagaucccuccccaaguaguugcugaugaagucgauauuauuaaacugcauuauaaugaaagaugucugaaaauaccuggaagccuaagaguacucucuuagauugcaauaaugcucugccaacgugaaucgcuuuugaaaucauuccuguuuucccuggugacguuuuuuuuguuuugccuauuuuuauagaauacuguugguacagaccuaggcuugugucccuaagcacagaugugcgcgcgcaggcacacacacacacacaca

SEQ ID NO: 9008 - RNA, 2160 nt, Mus musculus
cuacuuuaaaguaauuuuauuccaaggagauauacuuggggcauaugaguacauuucugggacuguaaauguccuguccugucucuugagguaaaugagguauauuuccgaaggauuggggaaauuggcaguugcaacuguccucuuugccuccuuuauccucugcaucugccuacacgugacgcuggcagcuguggccuucccugccagauugggagcggugguguuuguguggaaggggcugcuuccccgggcacacaucagaauugucaagaaguauaauuuugugccucucucuacaugccuuaaaaguaguuuuucaaggaagaucuggcauuuaaucuucagcccaaaugguccuggaaauuacuaagcagaguaauuagaacuagagcuauuuuuagaaagcaggcauguaaauauauguuaaguaaugaguaagacacaaaacuggagaacagaggaaaaaaaaauaauccgaggagcaguuucaucagaugucucucuguuccaggcugugcucuuucugggagguuguuuuucucuggguguuuuugagucaggaauuuaaugaaguugcuacaguccgaacucuuuuuauuuuuccauacagucuguaauggcagaguucugacugucuccguggccguggggggaggucgacccgugucuuacugguuuauuuccaagcugagcugagcagguguuuuauuccuucgguacagguagacuugucucucgaugccucucauacccuggggaccagaugaugccagggccuccugcacacagcgggccugcccuccuccugcccaggcgaaggugaugccuagagauugcaauaugguguuaccuuuccagaccuagagggagacucaaaccuggaggcacucgguugaaccuaauauuuugcuaauggacaggcaaaagccaacccucccacccccaccccugaauccuuaguacuucagaagucccuccaaucgucuccgccuccucccaugugaaaggggaagggacaauuugucuaggaauuuuuguccuuuguuucagcggagggcaacaugcgccugccuuuaccaugugguuuuguuuaaccuauauugcgugagcugacgagagcugggcuggacagugauuuauuuuggcguucgagaauguucuuugaaauugaguacaggcagggaugcauuggaaguugugcccagagguggcuguggccucagcagcuucuucagcugggauuuaugaguggugagugaggccuguguuuaugggaaauaguuugccauuaagugucgagugacuauacaaauuuagagaaccccagaguuagacaggagcgguuaaaacuuauccuugggggugagccuaaaggucugucggucagaaagagaacucuaguuccuuacuguuucugugauuuuuaacccagagcucaaaauguguguccccccccccaucuuaagggcuuagucccccccaacccccaacccugcugccccaaggugauccaguaaguagccugccauauucuuggcuuccugaguuuacugaugauuucauagauuuagaguuuccuaauuuuacugaaguucugcgguguuguggaauucuauacauguggaguuggaguuuggcuucugacagucuucucugcacccucuagcuggggguuuuggugguuagacuguauuuacuucacaagagauguguguucugagaugauucaggagggcauccaccugccuugucaccauugaccuccauuccugaccaguguggagcugugcugccccagggccccagagccucuggacacuguugucuucucagauggcuucauuauccuucauuuccugguuucccuguuuaaaggaaagaagcagacacauacgcuuggucacaugugugcccccaagccaugcaccgugcacucuguagguugugcacugcccggaguuugaacaguggaacugugccuugccuuggacacacgucacacugagaugaccggugacuuaguauuucuguaacccucugagaaaaaugccaucaucuguugauaauuauauccucaagauccagauggaucuuccagucguacuaguacuuaccguguccuuagcaugacccauuaacaugaugacagcauucuuu

SEQ ID NO: 9009 - RNA, 9881 nt, Mus musculus
cggccgccuugccgcucggggacgcuugggcuaccgcggcugcgaucgccagggcgcuggcccuuuagcuuggcgccccccgcccccggugaaggaaucgaaucccuucgcagagcgugcggaggguggggauauccggggccucucccgcgcccggaggaaaggggagggcggaggaaauccuaggccagugugagccgagaggauucaaaccaaaacaaaaagauuaaaggagcagcggcugcagcggccgcggggccgggcagggauccugggguggcgcgcccggguuccgcgggggcugcggcgcgcggaggggccggagggcgggggcgggagccaggcggcgaggggagggcgggagccuaggggagggcgcgggccggaggaggggcgggcccgcccgcgcggagccgagcggagccaagcggcggggacugggcgcgacccggcccagcguaggcgcaggagcgggcggagcugaucgugggcaaugcugaggcuggcggccgccggggcccgagccaucguggacaugucguacgcccgucacuuccuggacuuccagggcuccgccaucccccgaaccaugcagaagcugguggugacccggcugagcccuaacuuccacgaggccgucacccugcgccgggacugcccagugccgcuccccggggacggagaccuccucguccggaaccggugagcccggcgcgcgaccccgucccgguccccggcccgcgcagcuuggcucccggccgucccgggucgcccgccugcccacauugcggcgcgcgcuugggcgcacagccugacuuugcgagaucccaggaaguugaacccgccgccaucuggcgaaggcgaauguaaugugacuugcuggugugaauacccgaugccaccaaacguccucuuaucuggggguuauuuuaauuugggauucuccccucccccagccgucccuccucccccucccgcucccuaaauaaaaacgacgggacccagaaagggaggcuccccacccggcccacccgcgcgcacccacggugccugcguuccauaauuuuuaguggagcagcaacagccuggacacacacugcgacguuuagguaaacgugcuuuggaggaauggggggcccauguucggcuugcuuuuuccuguccccucuaucucguauugguggggcuuguucuuggguguguuggugugcaccuagucugcaugucauuugacugugcucuguccccugagugcaaaacgggggcgugcaccggcaauugagccaagguugggcgggggcauggcugcauuugccugaaugcauugcagacauucggguggcacacuaguuguugccagaucugacuuuucuaccccaggcuucccaccuuaaugauuuuccacaucgcuaaucuuuauuaaggggugaaguggaggaagugugggacuuuacugugcucaguucaggucauaccacacugaggucugcugggagcauccucucaaugcuggacugugggggggggggguuccucugugccauuucgaaggucccagcccgguguguuggaagcuggauaaaauuccggaagaggggaguucugguuauauccaagcaguaaacucuguaccagaaaguacccuagguauccuggaaggccaaaauggcgaaacuuaacuacucaaguagcuggguguaaagauuaguccaaucaguccaguuuaaagguuccuaucaacuuuccaaagaagccuggaggagugaagaauucugauugugaaacuuuuggaaaccuguuggaaccuuaguguuuugcgugagcagugggugggagugaguggagugcguggguggagacuuucugaaaggguggcgcguguauguccuuagcaugcuuuggccgugcaugaagcagaggauugcuucauccugugaugaaaugcugagacuguggagaauaaaaauuugaacccugccgaccuaaaaagggcuugagcuguguucacauaaagcguccagaguacaccaaugauuuguuagaaguggaaaugagaauagacugaaaagcuuuccgagcaaacuucauuagagauuaaaaaagaaaagaaaagaaaggaaaagaaaagaaaaaaggaaagaaaagagcuucaugccgggcuuucacuuucuucuauuguugugauuuauauaguguugacuguaaacacuaauaaacgcacacaaacugcuuacauaaaaucccucguugaaacaggugugaaauguggagggggugccaccaggggacaggcugagagaaggugugaagugggaagaagagugcggggcgucaucgaggugggacucccacugccgguggaggcugcucgcccuugaguuuaacucuuggagaucuccccgacuccucucuuccaaagcuuauugggucuagccggcucccuuuccccugcuccaagucucucagcagcaccccuggauuccccaggucuucuugguuggucuggaauuagaugcuucuuggaucccugaaaucagauugccagagaguagacuaccauuuuggaggaauuagcuauucagauuguuuuaaaauccucggcucuauuuugcuuccgugucugucuggagucccuuuggcacgagugcuuuacgggaacaacuugaccucuaacuucuaccuugaauccacaacagaggacaauacaagcggagucuuugccucucccguggcuguucaguuaugaagccacucagcuguaggcagacccuuuauucuuaggaacucugucaguguucuuccccguuuuauuuuauuuuaaggagcagaguuuaauaauuaaccacaaauuaguucauuugaauccagggcccacauccuacuagguagugcuaauugcauuaaaauuuuauucagaggcuccucguuuuuagcauaagaaaaucuccccuggaaugagaggaguugcccaaguucauuuguuuugaaggguguuuggagcuuuugauugugcucaguccuaugacuuucuuucagugaacuguauccaaaccucauuccuguuagcaaaauacauuucuucauucacaagaagggcaaccccugcaagcuagacagggauucaggacaguaaaguuuacagugcaggaaaaaugguguggagggugcacagaacucucuagaaucaguaauugauguuccuuuaucagccauaaccuuacugucccaugccccaccacaccccaaccucugcuccaccuucggagaagaaaaagaaacagauaccacuggucaacucuucuugugugcuauuuuuggcuuuuucaugagagugacagauuauuuuucguuuccaaguauuccuaacgauuuucugcucauguguaagauaaugcaaagaguuuguagaaauggcggugaaugguggggggaggggaggcauugugauaaacgguuuguugcucacgggaggguaaaauauuucugcucacucgccaagccgagauauuccacacacaccccaacuacuacaauuacuacuaguuuuccuccucuccuucuccuccuccuccuccuccuccuccuccuccuccuccuccuccuccuccuccuccuccuccccuccccuccucaucuucugucuucuauguuuuuccuuuuuuuuuuuuucaagaaaagucugguuuaggugacuuuguuuugucucccaguuuucaaggcucuuccuguggucuaaguuuuucuguuugguguuuguucaaaggaaaacucccccaccucauucccacccccaccccaucacccuguucuacaguaaacgaagcucaccacuuucugguauaaauaaccaagcagcuuuagacgggcacauauuugggcaacgccugcuguggucccacuuguuuuacgugggaugccuggauuuuaguuuucauagugcauacuucucucgaguugccgggguccuguugucauuacuggcacacauuuucaauuauggaggaaguggguacagggggggucuccaagugcaucagcgcauuuccuguuuuguuuugguuugucuguggcucgccuuucuuccguccucuuccccuuugagcccgcugcccuugaacuugguucuugaagagcgaaaaucuugcacagcuuuuaguaaagcucggguaaggaccaaggugcgacccagggacccaggcgguggcgggucuccagaaucgcggcagggacgcagugacaggaggagguaccagguagagacagugcucccggcaccauggaccaaaagacucuggagagggcagggaccagcagacagauuauauaagcaguaguuggaaccgcuucgcgacgacgagcauagguuagaagagggcaggguugggguggugguaaauggagguucaugagggucaaggucaugauuuggcagguuucgcucugcguggcuuuccugggacucggaagagcuuguucguggggcccggaagcccagcaauuucgucuuacucccggacgugaucauugaugucucucccgaggguggaaauggaaagcccccgguucccugcacagacccgacccgaagcgccccaguguggugcgcggcuuucuggccagggcgcuaccggucugaugccugcgggaagagguucgcaggccugcgggucagcacaccucaccagugcuugcuggugcuaaucgccauagugacugcugugguguuuccugcccaagccucugcgagccaucagcaaccacuccagcagagccauacucucaccccuccaaacuuggccucagcugcccccuuccgccagugugcucugcuaggucuccaccucuuccagggaaaaaagcgaccgccagagggagggggagauggaggguuugggagggaauuuacauucucaguccagguuauccuucccaucccacgcccugggccacagcacugggccuggcugcucccagcuucucuaagagccagacucauggcucccgggaggagagcggccccuguggaccucgagaugcccaaugaacacagccuggauggggaacaggacgaguuaaccaugaguagagaacagacaacuagacuuuguucucuguuccccaaucgcuaagcaaacccagcccuaagcucauuuccagccuagccaguuuuugcuuuuucuccuggagcuggcuuuucugcuggguaaaaagggacaagggacaugagaugcucugcagccuagcucuagugggcuggaccugggagcuccagaaucaagaucuagugagccaguccuuuuuagaaaggucaggucuggagaagugugugaaucaaaggaaaaaugauaagacgcagccccccuaccccuccuccucaaaaaaaaaaaaaaaaaaaaaaaaaaagaaagaaagaaaagaaaaagaaaaaagaauauugaagaauauuggcauuuugguauucaaaaauaaacaaaacugguuuuccccauuuuucauucuuguguuuuaucuguggguacagaaagcagaauuuacagaaaucauuggagccaugguuagcuggcugcuaaaagcgacuuggagggagagacugucucaagcauucuuauuuccacagucuagaaagauguuucuuuaggguagaauacuagugaggagccauuuggaaguacaggguauuaucuauagacagugaagguguguccuacacauaguuugcauucauuaaauuaaaaguaaauucuuuucaucuuucuccugccauguuuucauuuucuuacaggaggaaaugguauuuuggggaaccuucuguguuagaguucccucaacauccuuaagacgauagccauaacuacuccauagauauauuuuuguuaugagauguaccgguguacaaagacaagccgguaaaauucuggcuucacaguuaaagugagccuggauacaaaacgaaaccgaucaucugcuauuaaucaggcccaggcucugcuucucguuggggagaauccagugagggcuugcuucacuuuucaucugaaagaggcuguaaaaugcugaaugcugcauaaaaaucacucucucaguuuuuguucaauuaaucaaaaugcauauguucaugcugggcguaguuauaucagagagaaaacuugccggggcauuucaaacaacuggggcaguuacauugucgcaaggacgaccuugagggcccaucaaucuuuaaugauaucauugucauuacuauuauuaucugaaguguuaaauuguuaccagaaucaauacaagugugguucuuugaguauauuguaucccacuguuguuuuuaacaucucuguuaagagaccaauuaauuuccagcucagagcuucaguaaacuuuguguguaguaagagcuuucucgcuugccacacaaacacaacaccuuucccuauuucuccuuuugagagaggacagaagaaaagugguacgggaaauaccaauacgucacuugcugauuaaaauaauaugaaauuauuccuaacuauaaaggaauaaaaucugcccaaacucgaguuacuacauuuguaaaacuucuccccggcuccuaaguagcaagagucauuucacccacccucugucaagucuuacaguuuaggagcucuuucacauucacugagauuagacuggccuuguuuccuuaagcagaguaugaaggucguuaacaaagaaagaaucuuaaugcauccauuuguuuucuucuagauucguugguauuaacgcaucugacaucaacuauucggcuggccgcuacgacccgucccugaagccacccuuugacauagguuuugaagggauuggugaggugguggccuuaggccucucugcuagugcuagguacacagugggccaggcuguggcuuauauggcuccugguuccuuugcugaguauacaguggugccugcuagcauugcaauucccaugccuucagugaaaccagaguaucucaccaugcugguuaguggcaccacugcauaccucagccuggaagagcuuggggaacugucagaagggaagaaaguucuggucacagcagccgcugggggcacaggccaguuugcugugcagcuuuccaagauagccaagugccacguuaucggaaccugcuccucagacgaaaaggcagcuuuucugaaaucaauugggugugaucggcccaucaacuacagaacagagccuguggagacgguucugaagcaggaguacccugaaggcguugacguagucuaugagucuguugggggagccauguuugaccuggcuguggaugccuuggccaccaaagggcgcuugauagugauuggguuuaucucuggcuaccaaagcccuacaggacucucaccaauaaaagcgggaguuuugccaaccaagcuccugaagaagucggccagccucagggguuucuuucugaaccacuacuucuccaaguaccaggcugccauggaacguuugcuggagcuguacgcucguggggaccuggugugugagguggaccugggacaccuggcuccggauggaagguucauuggccuggaguccguguuucaggcugucgacuauauguacacggggaaaaauacugggaagcuuguuguugaguuaccacacccugucagcaguaagcugugaccaacaggacagugacagaaaccaaaggagagaaaugaauucuccaugccuuaaaacgaacuuaauauuucuuaaaaacaaaaguauaguguuaaugaauugccucccuuuccuuggggguaaaaauaaugugccucaaucagaguucucucucuagcuaagagguaaaacguuuacauuugagucuuuagucauggacggucucauuccagauuuuauuguuccagggaaguaaauuaauuccugaugugugagaccugaucgagucaguauguccccagcuugaugagauuuuuuuuuuuuaaaucagucuucagagagcucaccgagucuccuuugcauugaaagcagucguucucgugucaagcacugaacaguugagaaagcagugucgguccaccuuggauucucacaggcagugugccugaggagccuuuucccccuaaaaucacuaaccucccaucuaaauagacauuugggagagaauucuccaaauuuaaucuuguuaaguuauugggaaagugauccagcaaacagaggugucuuaaggacguguauacugugugcuggccugaauucacauccugguuagacugucugugaaggaaaaaacugucuguucuaggaagaaauugcuauuagaaccggaguggauucuggaagagaaagcuauagcguugggagacugaaaacuaauguggacagaggaauaagaaaacucuaugaugauucaucaguaaaaggcaaaaaaaaaggggggggcgggggaaucacaaaaggggacucacucuggccugggaaggguuaaaaggagacuuucuguugccaaggaccaaaucucacauagcuccaaacacaguaggcacccuggccaucuaaaaccacauccauuugcuucuccuaagaggcucaguguggaaagugugcuuggucucuggugcaggcacgggaugagagucagguguccuggguugccauuuugcuucuuggccuuugagagaagcgagccaccugcucuaguguuguguccuggugcacacgugucuauccuccugccugccugcuguuucucuucacaccucgccauaguuggucugcuugcccuucaccuuagguuucccaaggcugcccaccacuuuuguaguggagucaaaaccccacggugccuuccuaaucgaaggugaagacugucggauuauuuuucagucuuggguuucagaacaucaaacguucucaaugaaugggaaugcaauuaggagcgcucugugaaagucggggugggggggcagguuuaauucuuuccuugcaucuggggagcagagagaucuuguuucuggaauggcuguuaguaucuauuuuacaagauugacucauucccagguaccuaauguagcuccuagcaugcacgcacaacaauacaauuuauaugguaaauggaaccaaauaaugguuucacugaacguuauggccgcacugaagggaaaugucacgguaaauagcugccaaauuauggaucaugccgaagugucacaacugcacuaaagacaaauagcacuagaggcuauugccacugugaugccuuugaguuaugaagaaggguagcaagccugagcagggcucuuuguguccucgucauagcagaggguugccggagcaggggacaagaaaggcucuuccagugugaugcuuaguuauuaaucugucccuuucagaccuagccacuguaacaggagagaccucgcuggcucucuuguauacaaacauaacaaacggggggggggggcuuuaugaaugucagaaugcucaggaaaugacugguaauggaaaaaauguuguaauaaaauaaucuaaucaaagacuauuauuaaauuuaacauaguauaugucugaaaggcuuaguugcuugcuaugcagauagaugugugaaaucucacugauaaugcucucccucugaaaaggcuucaggacugaggacauuaccagcuaaauugccucuucugaacugaagugagucccgguuuccuucauuuuaaugggaggguaauaaagaugaaagaccaacauuuuaucugauggaucccuuaagcuauggaauaaaaauguauuauguuuugagggaauauacuaaauucagauauguaaaaguaaaauucgcauacccagguuuaaaauaaaacauuaaaaaaaaaaaaaagacacacuucuuucuguccccaaa

SEQ ID NO: 9010 - RNA, 697 nt, Mus musculus
auuaaaggugcugcuugcuuuuccauuuuaguuugauuuuuugcgaauuuuuggcugggguaucucauacagaguuuuucacugggaccuuuuuuucaguuuccucuucaucaaaauccucaucuucuucauccuccuccuccucaucauccucuucaucacguuuuacuuuuuucuguggauccuuguuaccaccuccaggagcagaucacuuuccagacaugccuaagaguuuuucguccuccccuucuucaucuucagacucugcaucuuccucuacagcuauuagguacuguccccuaaugugcacaggcccugaaccacucuucaaccauaagaccacagguaguguaauuucgaagcccccaagggaaacuguugguuguacagacauuuucaaaguuuccagugugacuuuaauuggacugccuucaucguucauugcuucugccucugugauguguaauucaucuuuugccccugcuccuaaacugaccguucuuaaugacaacuggugcucauugucaucauuauccacuuuaaagugauagucuuugucagccuuuaguucacagccgaaaagguaguucugaggccuaagaggacucauguccaucgagucuuccaugagguggaggcacgcacuuuggugugggagaagcaggacgaaaaacaacugccugcuguuccacagaau

SEQ ID NO: 9011 - RNA, 1776 nt, Mus musculus
ugaaaaaaagaggucauauauuugaaagagaguaggggaggguuuggugggaggaaaggaaaggggaaaaagacauaauuauaauaucucaagaccaaaauaaacauuuuaacaauuauuguuuuuuaaacuuuaucuuauucuccucugucccagaaguuacacggccacagggaggugccuccugaaccucauuaaguuuuggaaacuucccacgaguccuacaauucaucccgagcauucaauuugcuccagaauuucugggaggcggcuauuccagaaccagagacuugcagaauagacuguuaggaccaguucccuagagguuauuagagaccgcuuaaucauggugagaaagcaggcuggagaagggcgggcagggggccgcgggagggcaucugagauggggucugcagcaacccugcugcguuuuugucuggugaaugccugagccagaggcccugucccuuuuaacgcccuucaaagcugacaguaccucucaggacucugagcgugccacccacuguggccucuuuagaagagaauagucuggagagcaggggcuuaaggauggagcuacaaagccccaagcagaagaagacgcacuagugaaccuuuguuguggccauguuaguggagacagcucguuccuccuuacuacuacaaggaagcccucaaguccugcgcacucugggaggcuguaguguggccccgcgcucuugggaagaggcgguccagguguucccuacggucccucacugcccccauuucuuccucuccaaaccuggagaugucaccccgggaaguggggagggauccgaggcugaggucagacuugguggggauggggaugagcacagagccgcagccuaaagguuggaggggguccggugggguccugggaaggggcaaguauaguggcuagacagagggcggcagucuaggaacgagggaaguggugaggcccugcggagaagugagaggcuuggucuuagggaagaaaaguggaaaagaaaguguaaagguggccagggaggguagguuucagaagccgggagcagaucuccgcgcugcgacuccuacgcggugccccaggcugguuuccccucccgccgccccucccccucccgccccuggagcugcggagcggcgaccggagcucagggcuggcaauggcgcgggcggcgggcgagcggggccgggcugcacggugcgggcgcuggcggcggggcgcgcuccucgccuucgccgcguggaccgccggcugggugcuggcagcugcgcugcugcuccgcgcacacccgagcguccucuccgagcgcugcacggaugagaagagccggcgcauccuggcugcgcugguaggucccgccgccgcauugcccagugucgcgcguccaggucggguuccagacaccuucuccggguccucggaguccacgucaccugcgaugcugcaacaucguagcggccacuccauccugggauaugggaaugggguggggguacccgccaaagggagauuagguuccuaugcgcguaugauauacccaggcaaagagcucucaguucgcuaugggcgaucgggacaucccuccuuuuucuccagaauauagucuugcgucccgggacagcauucaugccagaaaguuugcagggccauuccuggucagugaugcuuacauccaguucuaguggccagguuuggaggauauacaucuuucuuacgcuaucucgccccuuaagccaccauccuucggugaucccaugggacug

SEQ ID NO: 9012 - RNA, 914 nt, Mus musculus
cuugucucuuccacuucaggugguaacacuaucuccucuccacugcaccccuuuuguuucucaaaccagcuagacuuguuucugcugaaaaccuuuguucuuuccucccugccuguccucuguucccauggcuacugucccaaaaggcagauaugaggcuccauagaaaggucaguucucugucuugacagugacaucccuggggggacugaagugacugccuggcuccucuggauggcagguuucaagugucugcucagcgcucucugcccuggacccagagacugcucagcaaugacccugugguggaaugaaagagcccuuuggugggagacugcugucacccacucucuacaccugucggauuuuauccccacccuuuucccaccaguggcacuuagugguagcauuaggaucuuuucuuugacauagacacuuggugaaacuccacgcugaaccguuuaucacuugucauuucugggacuuaguuauguaaaucuggccuguuaacuaaccaccgagcaaagagcacuugagccagguccugugcuguagaacaaacagcacauucggagccgccuuuuccugucuaagccaaugcggccauguuuacucaggggucuccuuucucaguugaugacaugacaauucuuucccaccuucuguuuucuauucuucauaagcaaguucugcauuccaggccauucccuucauuauucaacaugguaacccccccccacugacccccccccccauccaaaaaauguaccuacacacggcuucuccagauagggcuucuccagugucuccucuaccaucuccaccuccgcccuuccacucuguuucuucuucuuucucuuaaaacuccaggaguguuuuaaagcuacuccugccaggguucuccugacauucuc

SEQ ID NO: 9013 - RNA, 914 nt, Mus musculus
gagaaugucaggagaacccuggcaggaguagcuuuaaaacacuccuggaguuuuaagagaaagaagaagaaacagaguggaagggcggagguggagaugguagaggagacacuggagaagcccuaucuggagaagccguguguagguacauuuuuuggaugggggggggggucaguggggggggguuaccauguugaauaaugaagggaauggccuggaaugcagaacuugcuuaugaagaauagaaaacagaaggugggaaagaauugucaugucaucaacugagaaaggagaccccugaguaaacauggccgcauuggcuuagacaggaaaaggcggcuccgaaugugcuguuuguucuacagcacaggaccuggcucaagugcucuuugcucggugguuaguuaacaggccagauuuacauaacuaagucccagaaaugacaagugauaaacgguucagcguggaguuucaccaagugucuaugucaaagaaaagauccuaaugcuaccacuaagugccacuggugggaaaaggguggggauaaaauccgacagguguagagagugggugacagcagucucccaccaaagggcucuuucauuccaccacagggucauugcugagcagucucuggguccagggcagagagcgcugagcagacacuugaaaccugccauccagaggagccaggcagucacuucaguccccccagggaugucacugucaagacagagaacugaccuuucuauggagccucauaucugccuuuugggacaguagccaugggaacagaggacaggcagggaggaaagaacaaagguuuucagcagaaacaagucuagcugguuugagaaacaaaaggggugcaguggagaggagauaguguuaccaccugaaguggaagagacaag

SEQ ID NO: 9014 - RNA, 6035 nt, Mus musculus
cuacauuuucaucugaaggcugguagcagaauacuggccuccaggcaguuaggacaaagguauuaaaucccaugccaacaaggccacauccacuccaguaaggccacucccugggccaaacauauacauuguguggccuuucaaacuaggacagaguugguaaauuucacuucuucuauuagauauaugaugaauuaguuuuagaaaaguuuauuucuugauauuugcacauacacaaacacauguacauaccuacacacucacaacuucaauagugauaacucaagcucccaaaggauuucuauuauugauggaaguagcucuaaauuuuauguguaagcugaaaucuuucugaaaaggaggaucaaggguggcuucuugcuggaauucugcuggaauuagcauauguuaacuaacugaaugaauugaauugcaugcaggagguauucaugaggaaagggcagacaucugugcuguaaaauagagcugggaacaaaggcuagucaucuggaaaggaggcugccaaaugucucccuucaagauagaguguaguucuacucauauaguuaguuuuccuucuuuccuuaccaaaugucuuuagcaucaguuauuccacagguucuuguccugaguuuaccuugugucauuguuagggcuuuacugcugugaacagacaccaugaccaaggcaagucuuuuaaggacaacauuuaauuggggcugguuuacagguuuaaaaguugucuauuaucaaggugggaacaagaugagcagcauccaggcaggcauggugcaggaagagcugagaguucuacauuuucaucugaaggcugguagcagaauacuggccuccaggcaguuaggacaaaggcauuaaaucccaugccaacaaggccacauccacuccaguaaggccacucccugggccaaacauauacaaaccuugucacuuaaaaugugguaccaggaagacaagcucugcugauauuuucuauauucccuaaguaugaaaaauuucagauuuaugaaaaaagucauuuaaacgugggagugaugauucaugcuuguaaauauagcgccagagagacuaaggcaagcaguugaaaaguuuauggcuagccagggcuauuuauuuagcaagaaaccaaaguaguuaaaaguaaacaaaguaagaucaacuaagcugagcggagagauguccagggguuugggugugggguagacagacuucccucaauaggccaccauaucaagaacccaucugaaaccucuccaccuauuccaacguuggaagaaacaccacagaaguaauccuacauuuaagcuccucaggauaaagaaaguuuucuagaccuuucuaaaugcauagaacacuuguaugaucaaaacuuccaagaggaaggccaaguuuaacaaauguucagaaaacacuuccaaaaggaacagguuauauauuauguuuuguuauguuuggacaagccaaauuaguuuuucuugugaaauguucuugcaaauauguaaaauuagagcuuuguccaaacacauuaaaacacuuaaaugaggcuccuauauacauuuacucaauagcaccagguccauucuucugagagcugggacauccaugguccaccaacaguaacucuggcagccacagaauggggaggucugacacgcuacaaccugugagggcacaggcaaagguggagugagccaugcccugcuuaggcagugugcuuucucccuuaucucaaauuagauuccaaaguaaauaaaaaugcuuuuaacaucuucuaguuaguuuucuuuauucuguagauuguauaaaagccacacaacauuaaacagcauaaaauacuuaaaacuuuacuuauguguguauauaaauuuuaguaacaaaaguuuaucaugaagguagagcugaaauacugucaugauuggcaauugaauauaauguaaaaguugcuacauuucaugguuuuuuuuguaagaaagaccucaguugauccaaacucaugaacacucacacugcacuuccuuucugugugacgcacuuuacucuuguucugaacauucuggaagagaauugagggucacagugagaacagauccguucacucuuggcaggaagcaguacgcuggcuugaggcuuuuaacuuuguucggaacgguuaucuucaacaauaauagaucuuguaggagucacuuccacaaauauguaucgaaauucaaacuggccacucccuggguucugaaagacacguagauguuauuacgcucuccggagcuuccuggaccccaaugacccugagugacccuauggucugaggcuggcauaccucuuccacuucugcauguaccguuccuugcuucccugguucagagcccucaauguagaauuucacacggaugcgcuuuagcccauuguuuacauauucagaaaaacuguagagaaaauacaauguugcacauccaaauucccuguacucagagauuacccuagaguucccccggggacaccgcauuaccggacaugcugucuccgcccacgucucgacauuuccccguagccuuucaaaggcucaccaaauacaccaaucaccugcagaauagagacuacacuuauuuagugugauucuuuucauggcuccuauguaaguauuuucugauggucaagugacauuauuuguuuacauauggcaagugauuuuaggagagaaaaauaaucugugagggcccuugacucaaacaagaaaacuagagaaagggcauuaugcgaaaauaaauaugucacacacagggacagagaugggucacccugucacugguagcuuuacaaugauacaggaugagcggaggcucucuccuugacaagaaacaauuaagcagaaguuugaauguauuucucuauugacacucauacugagaagauaaaauggaugggcaauaguaaugacauuguuaaaauaaaccaggugcaaaucuuuuaugagaaaauccauuugacguagaaacuguuuugaauuuucaaagcaaauacuuuucuuaaaaacauacauacaauuaaauaccauguuuugucuuuuugcugagugucuuuauuaugagaaagaaaguugucagauaucuaagaccuaagagcuaaaagaaaggaauaagcaaaaaaauagguccauccuagcagugccagauuaccuauuuauuguaaggcaggcaguuggccuggcaaaaagugggaccuguaaaaguaugacaaaacauaccuguuuauggaacagcuaggaagcugacucuagcaauauucuauucuuucauguauuuugugcaguucuauuugucucaaugugaaaaugccugagagcccgagccugugauuaccauugcauccaaacacaguugggaugccuacugaggaccacauagaauccccugaauucuguauacaauauagugcccuaaguguagucucugccaacuuucaacucucuuggcgacauucugguuuaggauaguuuuguaggaaggaugccugagaccugaugaugcaggugcacuuaacaccacugaaaaguguauguaugacacagugccagggucaaagugcaucaaagaaugagaccugaaaacagaaaaacagcucagcaugggcuucagaagggaugcacaccuccuucccaauacaaucaucagaaaacuaaccucaggguguguucugcauuuuccuaaggcuuucccauauaugauauuagggcuggacgaaaaaaacaguucuuugaagaucgcguauaacaagccgccugaaaaagcagaaagagguagagagagcgagcaaugaagugaagcacuggggugagaggcuauguaaaggcauucaugugcuugcugggucuguaaccuguaaggccgacuccaaagagcaccacuaucaaguagcugacgucucucccagcuucucucacugcaaagagaaaauaucaacagguuacaaguguguccacagaacccuggccuucgggggcuucagguguuccuagcaggugacuugugacaguggguccugauccaguguguaccauucucaguagcuuaucucaaaugcuccugagcuucagaaaaacuccucacccaggcauagcuuacuagaccagaaaagaacagaccuguuuaguguguguggcaugguuguccacagggcuuagggaucucuggauuucuguaacugauggauauugcuucuguuauaguaacagaaaaccccuaucagucucucagaguaagaauggccacagaugaggccauguacacaggucuauccuguccagacugagacaggcaacucuuaacccgccccacagaccccacugacucgugcacaaaucaaagaacugagcuuggaaucgaaauguuggcuaggaagaucaaugaaucaaauauacuacuacaaagacuguucuuauucugcacuaaguguaugaacauggauuaaagaauaguuuggggagauaagauaauaagagguguagguagagacauuauuuacauaaaugcauguuauaugugaaaauuauaucgucaccaguacacuaucacugauuaugagugcacuuuaccucuuugguaaaauuuuauacacauggacagucacaugaggaacccagguuauucuaauuucaguccuuaauuuuaucuuuccuagaaaucaaaguuuagcagugguauauuuuucccuacuuucauagauacaaugaaagaauggaauauaauaaaaucaaaguagguuaccauaacauacuuucaguuuucaguacaaguugcuaacuggaaaugaguuuaggggacucaguaguauuugcugcucuagcagacauccagaauucaguuuucagcaacuccaucugauggcucacaacugccaguaccuuuagcuucaggggaucuaacaacuuuuuucuggcuuccuucacuaguacucauguacacacugauacacacacacacacacacacacacacucaccccccccccacauaauaacaauaaauagauauuuaaggaagaaaacacuaauucaaauaacagaaagauuuccaucccuaaaaauuguguaauuuaugugacugaacuucacaaauccaaucucuuuaccaggcuuugaggccgagggcugcaacaccaaucuauuccauuguccuuuaaugucauaaacuacgugucacuacggagacuacgugucgcuacguggacacugcacgaggucccaaauugagagcacaauaacaauuagacuacauaacuauauugguggugcuuuccaaaucaugucauuggccuggacaacccaagucccuauucccuccaacacucuguccugaccuaauauuuucacaaaaagauccccauuccuuguguuccugcaguucuccgccucuggugcaggcacucaggaguggggagcaucaagagcuagccgacagucugaaguucuagauccuuuuuguuuguuuuuaccuuucugagacauugagacgccgguuuccucucuuugauuucugcgaauagacacuugcuugguacuauccuccuuugcuuuccggggguccgguccuuguguccagaaaguuuucugggugaaccuaaggacaguucuagguuguacuguuaucuucugcucucgcagcccccaucucaaaggcugaguuuuaaagcaagcuuuggugaacacaaaauguggcaacaacugccugcccaaggacccgugcagcuucuccgcaugcuguacaacucguagaaaagcacaaaucauguuuacaaaaacucaggcuucaggaccgcaacuucuaaagguuuguaauccacacacucaggcggauauuaagcauuguguuaggcggauaucaagaugaaaauaaucuauaagagauguuagguaccacuuuucuuauuccucucuugaauuaaaaugcccuauuuaaccgucuugcggacacucacaaaguggccgccaugcuuucgcaaagcaucccgggaaacaacagacgu

SEQ ID NO: 9015 - RNA, 6035 nt, Mus musculus
acgucuguuguuucccgggaugcuuugcgaaagcauggcggccacuuugugaguguccgcaagacgguuaaauagggcauuuuaauucaagagaggaauaagaaaagugguaccuaacaucucuuauagauuauuuucaucuugauauccgccuaacacaaugcuuaauauccgccugaguguguggauuacaaaccuuuagaaguugcgguccugaagccugaguuuuuguaaacaugauuugugcuuuucuacgaguuguacagcaugcggagaagcugcacggguccuugggcaggcaguuguugccacauuuuguguucaccaaagcuugcuuuaaaacucagccuuugagaugggggcugcgagagcagaagauaacaguacaaccuagaacuguccuuagguucacccagaaaacuuucuggacacaaggaccggacccccggaaagcaaaggaggauaguaccaagcaagugucuauucgcagaaaucaaagagaggaaaccggcgucucaaugucucagaaagguaaaaacaaacaaaaaggaucuagaacuucagacugucggcuagcucuugaugcuccccacuccugagugccugcaccagaggcggagaacugcaggaacacaaggaauggggaucuuuuugugaaaauauuaggucaggacagaguguuggagggaauagggacuuggguuguccaggccaaugacaugauuuggaaagcaccaccaauauaguuauguagucuaauuguuauugugcucucaauuugggaccucgugcaguguccacguagcgacacguagucuccguagugacacguaguuuaugacauuaaaggacaauggaauagauugguguugcagcccucggccucaaagccugguaaagagauuggauuugugaaguucagucacauaaauuacacaauuuuuagggauggaaaucuuucuguuauuugaauuaguguuuucuuccuuaaauaucuauuuauuguuauuauguggggggggggugaguguguguguguguguguguguguguaucaguguguacaugaguacuagugaaggaagccagaaaaaaguuguuagauccccugaagcuaaagguacuggcaguugugagccaucagauggaguugcugaaaacugaauucuggaugucugcuagagcagcaaauacuacugaguccccuaaacucauuuccaguuagcaacuuguacugaaaacugaaaguauguuaugguaaccuacuuugauuuuauuauauuccauucuuucauuguaucuaugaaaguagggaaaaauauaccacugcuaaacuuugauuucuaggaaagauaaaauuaaggacugaaauuagaauaaccuggguuccucaugugacuguccauguguauaaaauuuuaccaaagagguaaagugcacucauaaucagugauaguguacuggugacgauauaauuuucacauauaacaugcauuuauguaaauaaugucucuaccuacaccucuuauuaucuuaucuccccaaacuauucuuuaauccauguucauacacuuagugcagaauaagaacagucuuuguaguaguauauuugauucauugaucuuccuagccaacauuucgauuccaagcucaguucuuugauuugugcacgagucaguggggucuguggggcggguuaagaguugccugucucagucuggacaggauagaccuguguacauggccucaucuguggccauucuuacucugagagacugauagggguuuucuguuacuauaacagaagcaauauccaucaguuacagaaauccagagaucccuaagcccuguggacaaccaugccacacacacuaaacaggucuguucuuuucuggucuaguaagcuaugccugggugaggaguuuuucugaagcucaggagcauuugagauaagcuacugagaaugguacacacuggaucaggacccacugucacaagucaccugcuaggaacaccugaagcccccgaaggccaggguucuguggacacacuuguaaccuguugauauuuucucuuugcagugagagaagcugggagagacgucagcuacuugauaguggugcucuuuggagucggccuuacagguuacagacccagcaagcacaugaaugccuuuacauagccucucaccccagugcuucacuucauugcucgcucucucuaccucuuucugcuuuuucaggcggcuuguuauacgcgaucuucaaagaacuguuuuuuucguccagcccuaauaucauauaugggaaagccuuaggaaaaugcagaacacacccugagguuaguuuucugaugauuguauugggaaggaggugugcaucccuucugaagcccaugcugagcuguuuuucuguuuucaggucucauucuuugaugcacuuugacccuggcacugugucauacauacacuuuucagugguguuaagugcaccugcaucaucaggucucaggcauccuuccuacaaaacuauccuaaaccagaaugucgccaagagaguugaaaguuggcagagacuacacuuagggcacuauauuguauacagaauucaggggauucuaugugguccucaguaggcaucccaacuguguuuggaugcaaugguaaucacaggcucgggcucucaggcauuuucacauugagacaaauagaacugcacaaaauacaugaaagaauagaauauugcuagagucagcuuccuagcuguuccauaaacagguauguuuugucauacuuuuacaggucccacuuuuugccaggccaacugccugccuuacaauaaauagguaaucuggcacugcuaggauggaccuauuuuuuugcuuauuccuuucuuuuagcucuuaggucuuagauaucugacaacuuucuuucucauaauaaagacacucagcaaaaagacaaaacaugguauuuaauuguauguauguuuuuaagaaaaguauuugcuuugaaaauucaaaacaguuucuacgucaaauggauuuucucauaaaagauuugcaccugguuuauuuuaacaaugucauuacuauugcccauccauuuuaucuucucaguaugagugucaauagagaaauacauucaaacuucugcuuaauuguuucuugucaaggagagagccuccgcucauccuguaucauuguaaagcuaccagugacagggugacccaucucugucccugugugugacauauuuauuuucgcauaaugcccuuucucuaguuuucuuguuugagucaagggcccucacagauuauuuuucucuccuaaaaucacuugccauauguaaacaaauaaugucacuugaccaucagaaaauacuuacauaggagccaugaaaagaaucacacuaaauaaguguagucucuauucugcaggugauugguguauuuggugagccuuugaaaggcuacggggaaaugucgagacgugggcggagacagcauguccgguaaugcgguguccccgggggaacucuaggguaaucucugaguacagggaauuuggaugugcaacauuguauuuucucuacaguuuuucugaauauguaaacaaugggcuaaagcgcauccgugugaaauucuacauugagggcucugaaccagggaagcaaggaacgguacaugcagaaguggaagagguaugccagccucagaccauagggucacucagggucauugggguccaggaagcuccggagagcguaauaacaucuacgugucuuucagaacccagggaguggccaguuugaauuucgauacauauuuguggaagugacuccuacaagaucuauuauuguugaagauaaccguuccgaacaaaguuaaaagccucaagccagcguacugcuuccugccaagagugaacggaucuguucucacugugacccucaauucucuuccagaauguucagaacaagaguaaagugcgucacacagaaaggaagugcagugugaguguucaugaguuuggaucaacugaggucuuucuuacaaaaaaaaccaugaaauguagcaacuuuuacauuauauucaauugccaaucaugacaguauuucagcucuaccuucaugauaaacuuuuguuacuaaaauuuauauacacacauaaguaaaguuuuaaguauuuuaugcuguuuaauguuguguggcuuuuauacaaucuacagaauaaagaaaacuaacuagaagauguuaaaagcauuuuuauuuacuuuggaaucuaauuugagauaagggagaaagcacacugccuaagcagggcauggcucacuccaccuuugccugugcccucacagguuguagcgugucagaccuccccauucuguggcugccagaguuacuguugguggaccauggaugucccagcucucagaagaauggaccuggugcuauugaguaaauguauauaggagccucauuuaaguguuuuaauguguuuggacaaagcucuaauuuuacauauuugcaagaacauuucacaagaaaaacuaauuuggcuuguccaaacauaacaaaacauaauauauaaccuguuccuuuuggaaguguuuucugaacauuuguuaaacuuggccuuccucuuggaaguuuugaucauacaaguguucuaugcauuuagaaaggucuagaaaacuuucuuuauccugaggagcuuaaauguaggauuacuucugugguguuucuuccaacguuggaauagguggagagguuucagauggguucuugauaugguggccuauugagggaagucugucuaccccacacccaaaccccuggacaucucuccgcucagcuuaguugaucuuacuuuguuuacuuuuaacuacuuugguuucuugcuaaauaaauagcccuggcuagccauaaacuuuucaacugcuugccuuagucucucuggcgcuauauuuacaagcaugaaucaucacucccacguuuaaaugacuuuuuucauaaaucugaaauuuuucauacuuagggaauauagaaaauaucagcagagcuugucuuccugguaccacauuuuaagugacaagguuuguauauguuuggcccagggaguggccuuacuggaguggauguggccuuguuggcaugggauuuaaugccuuuguccuaacugccuggaggccaguauucugcuaccagccuucagaugaaaauguagaacucucagcucuuccugcaccaugccugccuggaugcugcucaucuuguucccaccuugauaauagacaacuuuuaaaccuguaaaccagccccaauuaaauguuguccuuaaaagacuugccuuggucauggugucuguucacagcaguaaagcccuaacaaugacacaagguaaacucaggacaagaaccuguggaauaacugaugcuaaagacauuugguaaggaaagaaggaaaacuaacuauaugaguagaacuacacucuaucuugaagggagacauuuggcagccuccuuuccagaugacuagccuuuguucccagcucuauuuuacagcacagaugucugcccuuuccucaugaauaccuccugcaugcaauucaauucauucaguuaguuaacauaugcuaauuccagcagaauuccagcaagaagccacccuugauccuccuuuucagaaagauuucagcuuacacauaaaauuuagagcuacuuccaucaauaauagaaauccuuugggagcuugaguuaucacuauugaaguugugaguguguagguauguacauguguuuguguaugugcaaauaucaagaaauaaacuuuucuaaaacuaauucaucauauaucuaauagaagaagugaaauuuaccaacucuguccuaguuugaaaggccacacaauguauauguuuggcccagggaguggccuuacuggaguggauguggccuuguuggcaugggauuuaauaccuuuguccuaacugccuggaggccaguauucugcuaccagccuucagaugaaaauguag

SEQ ID NO: 9016 - RNA, 7208 nt, Mus musculus
uauggcagccaucagccaggugaaguguaguuacagcaccguguggagaagaugcagucaacucuguuugaguauccauacuucuacuuuaagaagaagaaaagcuuauuagguagauaguuugaagcuucaaaguugagaucaggugaccacaggcagaguccuggaccauauuauuggaauaaaagagggaugacuucucagucuuuuggauaagaguguggguagaucagggauggaaauguggcucuuuuagaaacacaguugucagucuaacagagaagccgaaugggacgcagcuccacuggaugcugaagugaagaaguccagaugguggcagcagaggauauauuuacagaacaugggggguggagaauuuggaaucagauguguagaaguuuguuuuaacagaaaaagaggcuagguaccaauccccaaaugcucuuauaggaacagguuuuguaauuuguacugcacacacugaguuccuuucacuagagcuauuuggaguucauaucauuauauuuauauuucuccaaauucacaagaacgacuaagauuuugugauaccaacuuuuuaaugugcccugcugcaugucuuugaaacauggaaugguugcccacucuggacaucccuaugccugcuccagguggcagcauuucuugguggagguguuacaguucgaaaauguaaagaacuggcugagcccuuauucauugcucucugcuuccugacugugagggcuguaagaacugcugcuugaagcuccagcugccuugauuuccucuccauaauggacuauacccuugcacuugugagcucaaauaagccuuaacuuccuuggucauggccuuuuuucacaacaacaagaaaagaagcgaacagagaugucaauagccaaagagcaccaaauuauuccauccagcuacugaauagcuguguguuuuguggagcuguuuacuuaguuuagaagaauagagaguugauuaagggcagaucagacaaaacaguuguacugguaacaucuucuugguuccguguuaugggguaccuguaagcccuccagcaaaccuuuucuuuuauagucacucauggcuguaugcugaaguucauccacauuguagaccaugugugugguuuauaaccuaagaaagacccuguccccuacuuauguaaaaaacuucucugcauggugacagugagacacuggaagauguggcacuucuuaucucacuguggcucaucagacucaaggauuucacagcccagcacuguacuguaucccugaggcauuggcaacaacgccuuuuugggucuaugcacauguccuccuucugguuuaccaaacaaaggccuacaagauagagucucuuuuuuauuuaguuuuugauuacccuucauuucuaucuuggcagacuuuaaaggauuuuaggaugugugcugugaucucggggccugauaugguucccacugauuugauuagucgguagggcacagcucugacuuaucugccuuuucuucuucaugucuuaguuucugacauagugaaguaggcauucaacagaguuuuuauuuaaaaaucaauuuaaaagcaaauuuaguguauuaaauucuaacucuggguaauugggaaccuagggauuagagccacucuuuacucuuaaaugauuucuucauuuacaugugugugugcgcacgcacaugcauaugugcaacuguacacauguagaaggaagagaacaucuugggagagucaguucucucuuucuacccuauggguucuggaaguucaacacagaucaacaggcuuggcacagaggccccuuucuuccugaaucauuuugcuagccucagagugacuuuuaaaauauucaggauaguugauuuuagagucucccugaugugaaauuaaaugagucuauuguucuucaaaaguuggaagugcucauuauagucauugauauacaagagaacauaucuauuuuguuucuguguuaaauacugugaaaauaauuaauuucugcuucucuucuucuaaauauaggucuuaaaaaccucugugucacuggaggucuguugagggaaaaacauaggucuucuuaguccuaacaaagcuuagccuugacccagaagaagaagaagaagaagaagaagaagaagaagaagaagaagaagaagaagaagaagaagaagaggaggaggaggaggaggaggaggaggaggaggaggaggaggaggaggaggaggaggaggaggaggaggaggaggaggaggaaggggaggaggaggaagaggaggaagagaaagaaaaggaaaaagaggaaggagaaggagacggaggagaagaagaagaagaagagggagaagaaggagacggaggacaagaagaagaagaagaagaagagggagaagaaggagaaguaggagcaggagcaaggauggugcacacaggacaguuuuccagcugguaaaucaucaacagggaucuugcugugugaaggauguauuaaagaaggauaccuuucuaauuccuacauaguguccaugguagugaacugugucuauguuaugcaguuuggugaaauauugaaagaaugaagccuauuuaauguacauauugacaggugucaucuaguguguucaggcaaacacuaaaggacuuucacgugagaggaguagguugugguuaacuagauucagugagcucagagcucaucaauuuggcaggauggcugaccaauaagcuucacggaccugcuugucuuuacccuccuggggcuacaggcacaugcugcucugccuggcuuuuauuuggaugcuagggguccucauguugggaagugggcauuuuaucaacugagccaucuucuaaacuuaacauuuuuauuacuauuuaagauuauuuaugcagcucacaccaauacaguuuuauugcagaggguuuucagaugccaagaaaaaagauaaacuuauucacuuugguauuaauggagugaaauuugacagaaaggccaugcuaucauauguaucuccaccaugaucaaugagaugccuggcuuuuugccugucucuauggguuucuaauaaucuguggugccaggaggaauauuggcucuaguaugcacuucuccgaugaaggagaauagcaguagacaguguguaauacaaaugaagauguucacuaguuuccuucuaaaauaaccuuuuauccacacuggccucaauuaacugcagaagguuuuaaauacuuuucauuacauuuguggugaguguguguguguguguguguguguguguguauaguguauguaguauguguaguguguauaguguguguaguauguauguguaguguguguauguaguguguguagugugcauaguguguaguguguaguauguaguauguauguguaguguguguguguaguguguguguauauguauguaguguguguauguguauaguguguguguguaguguguuuguguguaguguguauagugugucuaguauguauguauaguguguguguguguuuguguguaguguguaguguguauguguguaguguguguaguguguauagugugucuaguauguauauguaguguguguguauguguguguguguguguguguguguguguguguguguguguagugugcaugugcauggaagccacagaguguaugaggagggcaaaggagaacuugcaggagucaguucuuuccuuccacuauguagguucuggagauugaacuugaguugucagccauuuuuuuuaauugguuauuuuauuuauuuacauuucaaauguuaucccccuucccaguguuuccuccacaaaccccauauccuauuuccccugcuucuaugaggguguuccccuauucacccaccgacucccaccucaccacccuaacauuccccuaugcuagggcauugagccuucacaggaucaaggugcuccccucccaguggugccagagaaagcuauccucugcuacauauacaacuguagccaugggucccuccauauguacucucugguuggugguuuagucccugggagcuuuagggugucugguuggugaauauuuuuguucuuccuaugggguugcaaaccccugcagcucccucaguccuuccagugacuccuccacuggaguuccugugcucaguccaaugauuuguugugagcaucugcaucuguggcaagcucuuuuuccugcugagcucucccaccaguccauguaggcuuuguauugaaugugaggaacucugacuguuuagaagucauuccucccucccuuccuuucucucuccuuccuuccaugcuucucucucuuccuuuccuugaagaagaaaaauauaagucuuguucuaugggauuacacugacaagaaguuucacuuuaauuuucaaugguauuagaaccauuagaauaacccaugaggggaacacacagaaaauucugggaagaugucagagaaaagaggauagauaaaugaaauccaguaaguaauaaagaaucagaagccaugaguuuaagaggggguggaggucagggugguagaaacaaagggaguuggagagggaagagagagggugagaaaaaaaguaaaaauaaaagaagaagaaagguaugccaaaaauagccagcacauuuucuaaaggagugcaccguguucuccuuucacuuuguauuuuaauuguuuacauguacuugagauaaucacacauuuuagaagaagcugaaggcacaguggggguaccuuuuauuuauguguguaguguguguaguguuacacacuaccuuuuacauauuugaggauaacucugacaucaggaucccauguccuggauacuuaagaacauauuuucuucauaaaacagugauuaauuaagaacgugacauugaugccuuaaggccacaugguagguuugcugcugaucuugugacaaauauuccagagaaacaguuuaagaagaguccaccuuaacucaugguuucagagguucccuugcuuggcacuugaaucuguagugagaccaugcaucauggaaagcagagagaggaagagcugagaacaaggcaccucuucacaggggaucacucacaggaaccguuuuccaguuaggaaccguuuuccacuccucaaggcuucuggugaucacggcugaguaucaacuggaaguuuccucaguuugaauuuagaguaccuccugcauguuuucagguucucugucuaugaaagaaacacccacuauguucugugaucuuuuuauugcucccagcaugguaugaccuuagauggguccuuggcugauggaacguacauagaauccuagagaagguagagccagacaucccuggggaaagcugcucucuuccuuguggaguucauagacauuuuguagaagaguuuugcuagauuauuuaaaugauuccucccucauauuucaucaauuuguacauuuaucuuauuauagggccauaguaccaggugucccaugccaccuauauaagcacauuucaaugcuuauauaaucccagauuugaucagaaggcauccagucagacucauaugugucuugacagacuucccuaaucauucuugaagcaaaucuuuuuuuuuuuuuugguacaugugugugcaccugugcuauauguguguauacaugcucauguauguaugcaugugcauguacuugccagcccaagcauagugcaagaugcugucuuuaaaacaaaauaaaaacacacaacaguuuucucuuuaaaaccauaucaguugagauuuggguuaacuaaaauucguggugaacuuugaguguaagucaucagauaugcugauucugaauguuggaaaauaagcaguaacuuauaaagaaauacuaacuguugguguugagaggcaaggcuguugagugcacuaugcuugugaaucucagagagaugcuauguugaauggugacaggaugcagaauaggugcucagcaaccucgagacccuuagaaguaauacagaaggaacaaguagaagagugaagagaaauggaaugaccuggaaaaagaagugugaacaagcacaauucccaaagagacuuacacuaucuguuaugggaauccuuacuuccuucugcuauuuuuuggagaggcagucuugguauccuugagaaaguugagucuccagcccaccauuagcuuucccuaaccauugcuacauucacuucugcagcacuuguugacaugcaauguguuaguuagcuuccugacuucucacuuauauguccacugcaugauuaaacaggaguuugcuacuguaucagcggugccuacagcuguuccugguaugcaauagcugguaaguaacauugaaacaauggacggaugaaaacacuacuaggagcauagcaauggacauuaggcuaagacaaccuggaaagaguaaagauucaaugacucucauuauuggaauuaucaaguaaaaugaaacugaaagagaaagggauguauaagaaugagggaaaaaaaaagaagagugaaguuuuggacagagaguaauggugcucuuguuucuaaacacagacgauggcaguggugugguuagggugcugucugggacugcaugugugauacccagaagcgugaugcuaccagcagccccuggagccaaagccagaguccacggggacuuaagcauauuaacuaucugaggaaggagguggauuauucagaugcuauugacaauugauagccacaggugaaagaagagucauucuuuauguauguggccauugaugacuuucucuugcucuggugagaugucccccagccauguccauauggacauuaguaacuggacucagaaaguucuacuaaagaagauacaaaauuaggagaaggaggucuuagugagguagagccagaggguuggagggggugaguccgugcaugauauuuuauuguauacacguaugauauuuuuaaagauuaaaaaagguggauuaaaacuuuaaugcaaggcaagggucaugugcagaauuagaaauaaaugacgcuggcauguaaguguguuuaguucuauggaauaaaaacaucagauuguguaagagaacaaaaagacaguaaacgagaacuucagcauaaaagugucacaagucaucacaaaaaggaaugccacucuaacaguagcuaga

SEQ ID NO: 9017 - RNA, 1653 nt, Mus musculus
cucugggaagagcccuccuagcaccacugcccuguacucuggucccuggggacguuauaguuaauguauuuuauauaaauacacagaggaauagaaaauauaaaaucugagaaguugagggaaagugaggaacuuggggagaagaaggggcugcagaccuugcucagggcaacuugaccucuuuuuugacccccuuggcuucuggcuucuccuccuugguuuucuccucuucugugacuucuuuuuuucucuucaggaucuuucucuuucucauccucuguuuuaacucuuuuggcuuuuuugaaguuagaagaguucuugcgaccaccuucucccuccucaucugaguccgagaacucuuccucacaggcaaugcguuugucagaggagcagauggagaugcguuugucagggucuuccucauccucaucaccacucuuuucugggauggcauccuccgguauggccugcaucuggaccccaggggcauggggcagcauucucaaguucucaaagagacgcugcuugaucuucuccagguacuuguuaguguucugguuggucauguuggaagggcugaugugaagcuugaaauccgguccaaauuauucaaaguagucauuguagggcagcucauuagggaucucuguguccagggccaccgcuguuuccuaaguccagcaccgagcaacauuccggaugguguagccaccuccucccagcaucagcauaggcaaguugaaacucuucacgaacuccacacacuuggcguguccuuugauggucagauugaagcaaccuaaccgauccccagacagggaaucugagccacacuguaagaccacugcacuagacuggaacaucuccauuacuuuggacaugacuggcuugaagauugcuucauaggauucgucgucaaugcugucucgcaguggguaguucacagcauaguacucgccuuugccagccccaauguccugucgguccccaguuccugggaaguacucuccguauuuaugaaaggacacagucaugaccuagucuguaguauagaaggccucuuccaggucaucgccauggugaauaucaaugucaauauagagcacccucuggugauacuuuagcaguuccgggauggccaagacgaugucauugacguaacagaagccagaugcuucagacuucuuugcauggugcaggcccccagcccaguucacagcgauguccgucuguugcuuauuaagcuucacagcacuugcgacagagccuccgguggauaacugacagaacucaaacaagccauaaaauaccggacaguccucaccaacauugaaucucugcaucuguuugcuguauucagacauauuaucugggugaauagaaagcaggaauuuaauguagucaucagugugguacuuggucauuuccucagcauuggcuuugugaggacgauagauuuccauuuuucgguagagaccagaguugagcagcaaauugugagucaugcagauucggugaggcuucauggggugcccuuguccauaauaguaguuuccaacguccccaucauaguaguaacagacuuuccucuuggugcccugagucugugccaucuugcucaccgcccggcucucccgucaguuagucugcccc

SEQ ID NO: 9018 - RNA, 2410 nt, Mus musculus
uguguccauaauuauuauuuauagcaccuaaaaaccacauuggauuuauggauagccaauaaauauaugaugaacaaugaacaaaugaaauuaauaaaggaaaugggaguucuaguuaguuaaaucgacgggaagcaccacagggacucuaacuuaaaguauguucaauugaaaucgaacauggaggcuauaauagaaaaugcuacuagaguuaggaagucagucaaguggggaaguuguuucuuuggaauguaauaauugaacuagaccuugacauauucagaagaaguugcaacagacauuagggaccacuuccuucaaaggaaagccugcugaugaagaagaaagcuuggauuacuagagacaaaaaaaaaauugggagagguagggaaaggaagggauggaagggaagagaagagaaggaaagggaggggcagaaagagggaaggggauagagggggaagaagguuucucaaugauuguacuucaccucacaugacaauuuggguuaaaggucuaagaucauugauuuuguacuugaacauguuaauuuuaccuggguugggaauugagccacauuguagaaacugaaccugacagacacacaggcuauugagaagauuguuaaaauauacuguuucaugagacagggcauacaauugacuuguaagagaagcuacagggaccaaugccuauuuuauaauaacauugaaggaaauuaauauauuuguauuagcuaaaaugcugaaauuaugaucaggguagacauuuacagaucuggaaaaacaauucugauuuauuuacaguuuuugaaauaauacuuuuagagaaaacgcauguagaaaggcaaaaguaaacuuaaaauaaauggauaccuuuagcuugugugcgugcuaggugaaguaaacaaaacuuaaaggaaaaagccuauauguguaugauuagaaaauaaaauauuaacaauugaugugucaaaggaggcuugucuuauucagauaucauucuucuugcaucucuacucauugcuucacuuacuuucacuuuacauuguuccucuaguuucacauucuauguugguguaaugauuuaauuaauacauguuuuccaugcuuccuuccauuccuugcuauuguuugcacaacgcaccauuaugcaccauuaugcaccauuauggcugcaaccaacuaaaacaccagcuguggcuguugcugaauggauggacagaugaacaaacaaguucuuguagucugguucuugcuggaauccaucacuuaugguucagaaugcacauuggcagagucagagugugucccuucaacaagaacaaguguguuagaagcaggauguccuugagaaaggaggccucacuuguagcuuauacucugugagccuaagugaucacaucugaguccggcagcaugagagucaaagaacuguuggaaacuuuaaaaaugaauuggugucaagguacaucgcauucauuaaaugcuaauuuacauuuuauuuguguacacuuagcuaaauggccugaucuuaagugagauaaaauacauaaaguggcuuguaaaaaauguuuugauaugcucuaccucaaagcugaaacguugcaaucuaaacaccuugaaaucaaaagcuaucuuucaauaucagcucuguuuucuuuuaguuuuaauguaaaguauucuuuuauauaccuuuuuuuuccaaaggaaagcaaccauggcaguagaacaauaguacauaaagaagaauuuaaaguuacuucuguaaucaaaacaaaacaguguauaaguuuugagagcuaacagcuguuuuuagaugcaucaugggaugacauuaggaucauuuguggggggagcaagaaaacuuagcuaaaggaaauggugcauuuacauuuuuuaaacagcauaauagcaguuaaaaaaauauuaaagguaauuugcuuugcacuaguucgucugccuguggcccacaaggggaaauaaugggacugauugcaaucaaggcugucuugugagacugaacaaaaagaaggaagcccuagcucugcucuacaucuuuaaacgaacaguuuguuuugucuuuguuuuacagauuuacuuacguuucuuggacuaugagaugcagaauucaaaugagugcaaaagaaacuuuguggcggucuaugacggaagcagcuccguggaggauuugaaggccaaguucugcagcacaguggcuaaugacgucaugcugcgcacaggccuuggggugauccgcaugugggcagacgaggguagccguaacagcagguuucagaugcucuucacauccuuucaagaacguaagauucucuuacuugacuguuuguccuucagaaguguccagggcugcaaaacuccucagcugcuaauggggcucucuucaugca

SEQ ID NO: 9019 - RNA, 10211 nt, Mus musculus
auuaucuuucuuuuucuuuuauauuuuccuuuuccuuuuccuuuuccuuuuucuuuuucuuuuucuuuuucuuuuucuuuuucuuuuucuuuuguuucuguuucucuuucucuuucucuuucuuuuucuuuuucaucuuuucuucuucuucuucuucuucuucuucuucuucuucuucuucuucuucuucuucuucuucuucuucuucuucuucuucuuuuuuuuuugagacauuuuuccuguguaauagccccuggcuguucuggaacucauuuuguagacuagguuggccugcaauuuauggggccucaucugcucuuuucuccgaagugcugggauuaaaggcaugauucacacaccccuuccccagcucugggggacaaucaugauuguuaauuucccuguccauuguggacaccauucccugagcugggagcucugggccgaacaggagugagaacuagcagaguaagcaggcagcaguuuuucuuugcucuugacuauguaugccaugugacuagcugguugaguucaugccucgacuccccagaugguuugagaccuggagauggaagcacaaacaaagcuuuucuuccucaaagcuguuuuuggucaagauauuauauuacagcaucagaaaugcaauuaggaaaaccagaaaggaugaaguauuaucagaagaaaaagaaaaccuuugaugcucaggaauuccaaguuucucucccagugaaccacuaauguagaucccucuugguggaauuaacuggagggaaugagaauuucucaggggaaggcagaagaagcaauagauggggagcugagccaugcuuaccacucaucaagguuucagaaaagucuauaaacauggaaaaguaugagcagacaaaaguugauaggagagcaagacauagauuagcuuuuauugauuuaagaacuagggccauugaauaaagguagaggacuacaugaaaaccagguuguuugguaucguucauuaaaaagcagagaagauuacuucauucagaaaagugcuuuaaauauggaagagaaucccacccagcaaauugaauagagcuuuuucucuucucauugugaaaggucacggcaggacuaauuccaauguccaauuaccaggcgcaaucagcaccacagcgaaggagaaucaacucaauuucaauugcaggcauuuugccuuaccuuuaacuagcucuggaaagacucagcaauuuucucaucaaaaagcuaauuuuaggagcaaaaugucaagaaaagaugaaaaagagccuggcuuugcagaggcugggaauuguaaaaauuugugcugcacuuguaagccuccugucaccucagucacccacagaagcuccuccgcaguauuuugcucugauccuagagaauguaaaaucagccaggaagaagaaaacaucugccuaauuuuauaaacacaacugcagggugaugcucuguuccagguggccccuauauuuuaaacugaccuggugaugauaaugcuacacacacacacacacacacacacacacacacacacacaccucauacacuuuccauuuguuuagaccauacagugaauacaaacuauggugguucccugaagcaauuauaauugucaagagaagaaaaaccauucauauuugaaaucuguguaaggaaaaauaaguuuuguucucuaggcugauauuuaaaaagaaaaaagaaaaaaacaaugucugacacaaccaggcuccuuuuuacccuuucuugcuuccuacugcacagaaggaaauuuuuauucaaaccugugaaacacuacagcucaagaaggagcaacuccuguguuuagguccaaugcaaugugacuugagagucuuggucaguguucucuguguuucagugacacucacaucugguauauacucuaugaggccaacuuacagaccuccugcuaaaguuauagacaauuucuuuuuauuagagcaacaugaaaauuacauaaguguuauccaagcuuuuauauuauuggaaauccagauucuauucuaaaaacggccagauaauggcaaucaaaaggaagcaagccuuugauuuugauggcauuugagucuuucuuugugaagaagauccuauauccaggaucuggucaaccaaacucugccugauccucugacucugagaauucuuucuuuacuauggcaaguaugugccugugcuuuuguauguauauggcuaugcugguuuggaggugaugguguguguguaguuaugccuggggaugccuucggauuuucucuggagugugucaggcauaagucacaucuaagacucgcuguagcucuugguucucacuauuuaucuuugcaaaaacccaaauuuaaagucugugauuauuuucacccaguucaagaaaagaaagcaucuuuccuggauauuuuggagggcauuucaauugcugugcaacuuauauaggcuuauauaggaaagaaaacacauuaccuuuuuuggagaugaaauuuauacugauuuaaaagaaaccauugcaagcuucauauuuugauuaucagacauuuucuuaaaauucuugcaugguuucauuuuuuagauggaaaaugauuuuacaccucaguaugagaacuuuucaugaugacgcauuauguaugacaugggccauucaaguuuaaagaaccagaggacuaugaggguuacugcaaaauggugccuccuggauauggcagggauacugccaaagugaacucacagcagcuguggaugccugacuugaccugcagaagaucaaaccagucaucgaugaagcacagguaugugaaggguucacaagacccuguucauauugaggaccuauaggcaguccacagcuccuggggaagggagaguuggcuuucuucaggaauggacuauugauagguugcugaugcuccagugguaauccaaaaacagaagaagaggacaugacuuugaaagggagauguuuguguaaggaugugagaaggagugguugggaaugggguggauaugaucaagugcauuguauuugugucaagaugauagcuauaauaauagugggaggaaguauggaagaauacuaagccauuuuaucaauucuuuuucucaauuaauuugccuuucaugaacucaaagacucauuugaauaagacauaauaaaacauaaacauaaaaaacaauguaauauauaaaauaaaauauaguaguuuguuaauuuucuuucuucccuaguaauggguuuuuuguuuuguuuuguuuuguuuuguuuuguuuuguuuuuuuuuauaacagugagugagaccaauaaggaauuucucaucauugcugggaucccuugcagauguuagagggauccugucaggugucugcaugguguccuuguuaucagaaugucaaagcucucucaugcuuggccaucuuccuuacgcuugaggaaugguacauaugaaccuguaaguaaacuaagaccuuuacuuacugagauacuagguugcuguagcuuugaaagagaguuugugugaauaagauuaugaggucaagaauagcauacugacugugaguaauaguguauuagucgggguucucuagagucacagaacuuauggaaugucuuuacacauuaaaaaaauuuauuguaaugauuuauagucuguaguccaacuaaaccaacaauggagagcugugaaugggaaaugaaugggaaaaaucuagcaguaguuaagucccacuaggcuaguuguuucaccugcucuucuguauaagcugggauucugaagaaguaggcaccaacagauguucuggcaaguaaguuuaagcagaugaagaagaaugaguccuccuccuuccaauguccuuaaguacguugugagcagaaagguguggcccagguuaaagguguguaccaccacacuuggaucuggaacuugcuuuuucccaggcuggccuugaacucagagaucugcuugccucagucugcuuggauuaaaggcauauacuaccuugccugagccuaagauuuucauggccauugugccucaggacucucaugucaagauccaugucagaagcccgugucuuucagcuucaagaucuagaucacagguauguccuccauuucugaauuguaguucauucuagauguaguuaaguugacaaccagaaauagccaucacagauaugaaaaauggggagagccaagggaaaaaaugauauugugaaaguuuuuguauauuggaagauuugaacaccuuauuuuuaguguguuauuccuagucaaaaaguuaagcuauuccuaagauguaaaaagacccagacauuaucagaugguucuucuuguagggaaggacgaauuuaccagugaagaaaaaaauucucacauucuuaaaacaaacaaacaaacaaacaaacaaacaaaaaaauaaaaacaaaacaaaaaaacaaacaugccauuauuuggaaaagcuuaauguuuuggcaugaagagucaccauuaaaucuuugucagcauccauaagucuauaggucuauuaggaaggcauccaguaaaugccgaaaguaaaaguugcaggaguuuucuucuuucuaugcuuugaaaacacccaugaaaaauacauuucaaauaaaauguugugcaucuggauggcacuuuuuagugucccaaaugucugaauuauauugcacuacuuaaucccuaagacagcaccauaugcuagagagagagagagagagagagagagagagagagagagagagagagagagguuaugucauuguacaagggaugacuugaucaagggcacuugcacaguaaauggagauucuaaauuuuaaugaagguuuuucauuucuuauuuuucaaaaacauauccaaauucuguauucucuucauaacuuuauggugcuauuuuaaugguuuuaacuauaagcuccauuugcuuacaaaauauaaauauuuugcucaaauagaguguucaucauugcugcaggaauaucuguggcugcuucugcccggacuacaggccuugagagcagaaauaaaaaaucuacgugcaucauucucuagucuuuguucagggaagucauaaauuucugugagagagcgauaauguugaucugaugugggauaguuuuacaguacugugagcccaugaagaaagaggaaugguaacacauguuauagucugcuaaaguuuuauuuuaucugcaaagcugccauaaagcaucuacuuuuguuucauacucugucuccuuaaaaugaacacuuccugugauuucgacuuuggugcaggugacuguuucccucugaaaacagcccagccuauuucuuugagugacuuguuuagggccugguacugauuuuuugguggcaccaugcuaacauaggcagaaagcggaggcuguuggacugagugagggaagcaagaaaaugugccuugccaguggcaaggcugaacaccuucugaucauguuaucaccugagcuaaggcagccagugagaugaugcccugccaagguauugggaucugcuugacauauagccaggaucuuugauaguuuguccucaugaugacuugcucaaggugauggaguuaaguucaucuguggcaggauggggcugugcggaaaaaaaaaaagugauggugcugaugaccuaagagugagcauaacugaaugccagagaaaaaacuggagcagcaggagggauuuaggccaugaugcuuucuguuuuccaucaagacagggcucaaaguaggauuuagucggcuccuucaacucaguaugguuuucuuucuggucagggucaaagucucagaacugucuaccaaggcauaggccacugcaguagggagaagacaagacagagacugaaggagaaaguugaucagugucuguucugugcugcgguagcagagaacuagagacugaguaauuuguuaauaaaggaaguuuacuuauuucacaguuuugaaagucuaagagcauggcagagacaucgacuaggcuauugugaaggcucuguguaaguggcaugacacagcaggagcauaaaagaaugaaaaauuaggagaguucagaagaggcaaacaccuggaccaaucuuaauuuauaaugauuugcuguuauagggauugcuccacuucaguaaaguccaaguuauucccaugagaccuccuauacucucucucucucucucucucccucucucucucucucugucucugucucucuccaaucagacagucuauucaugaaugccuagcucccaagaccaaauuaccucuucaaggugggaacaugccagcauccaggcagacaugguacaagaggagcugagaguucuacaucuucaucugaaggcugcuggcagaauacuggcucccaggcagcuaggaaaaagguauuaaagcccacacccacaaggccacaccuacuccaaaaaggccacaccuuuuuggugccauugggaguuuugacugugcuguuuaccuuaccauaaagcuuucaccuacacugggguggcugugccauuggugccauucccagggucaagcauauacaaaucaucauacuuaauaucuacccuacaauaauuaaacaugagucaaagagaagaugagccuuggugacugagaaagacaugaauauaaauuugucaguugauaaaaucucacuaaauucugccuagcaaagccacaggguucccaggguggggagugaguacugaggagcucuggaggcuggugauacacuagaugaguaucaacaugaaggagcugauugacugguguguaauacuauggugcaccucagaagguguggacacuugcugugugacuuccuggggggugggguggggacagcaacagccaccaggaagauaucuagauguggggaggaaaugcuucucuguaguauucuggcagcaagaucugugggaggcagcacagaggccauuguuggcaggaugguacaugacaggguuuacagcucucauuucugauguuauaagguuacaggcagugaccuugggagaguucacacucaauuuaauuuuuauuguuucacggaaugggaauuguuuucugccagucaauaaaguagugggcacccugccguauaauggaugugaauagaccauuaccauuugcuauggcuccuugacugcagggcacucuuauuaguggagauuuuggagccacagggauuuuaucagccccagggccaguuccuuauccaugucagcauuccuguugcugcauagaaaguguucggcccuuuucaaacagaaggaaagucccaaguccuugaagcuaaaaaaugcacccagaagggaaagagccaccccaguguaggugaaagcuuuaugguaagguaaacagcacagucaaaacucccagaaaggagcaacaggaaacaugcugguaaaaaaaauauugugaaggaagugugcugcacagcagaggacuggugaaugcucacaacaaaaucauuauuaguuaagggauagaaagaugaucaauccuuuuuccuaugugcaaugaaaaaaaaacauuaaauauucuguauuuucucaauucuucagucugucgaaacugagcagauauccaccaugaaacagcagcauuaaguggaagcagagcuuggccucauuuagccguggaauguccucauuagaccaguguggcauaauacaacauugauuucaaauucuuugugagggccaaguaauggcauagauguugaugucagaaaaaaugagaaagugagccuaacagggcaaguacaacagaggaaauagauaauuuacagaagaacuguuuccuggaaguagaaggauuaugagucagaggcagccugggauaguagugagaccugaucugaaacaguuuuuaaaaaguaauaauaauggcugcugcugcugcuguguguaugugugucuguauaagugcaucuuugugugugugucucugugugugcauauguauacaugugugugcacgcccuccccgacacuguguguguguguguguguuggucucucucugaguacuaucucucugugugcauguaugugagaggaauaaacuacucaauauucaugccuauauucuaguuagucuaugaauagugaugguaaaaagugaacccuucuacgucuguacuguuuuacaguuggaagcacauccucauaacuuaaacuucugggggauagacugcuacauuucugaugaaacugacaagaaaagcugcaauuaguucaguuccauacaaucccuucucuuucccacaccaaccaucucccuccgucugccccugugcccccucaccuuguucaacugugcuuguggaagcuuucgucuucuuguaaugcuagaagguccauaucguuugucccauccucguaugcaagauuugugaggaucgggaucuugcuuuguuucauucuuagacauaucccaaguaccugauacaaaggugcuugaacaaagaccaaauaugaaagaaaacaaggauuccaaaaaaaaaaaaaaaagaaaagaaagauucuuuuguuuuuuuuuuuaagauuuauuuauuuuauguauacaaguacacuguggcugucuucugacacaccagaagagggcauuagaucuccuuacagaucguugugagccaccaugugguugcuaggaaucaaacucaggaccucuggaagagcagucagugcuuguaacugcugagccaucucuccagcccaaggauucuuucaaaggaggaaaugaaggguuacaacucagaaaagggagugaaaaccugccccagaacuuuacacacugcugaaaaacugggucuuucugaaucaauagagaaaaaagaaugucuuugaagaaucuuaacagagcaauggugaguacccagucugggcacacauuguguguaacuaaacuccacaguugguaggaaaaaugugaauuuuuggucuuuaguuuauuuauuuauuuauuuauuuauuuauuuauuuauuuauuuauuuauguucucaggcacuggugggagacuagagguggagaaccaauaguuacuacauaugugcauacacauucuucaggacuuuauuguacaauagagagggccauacuuuugccuucuaaauauuuuuacauugcuauugucacagaucccuggcaaccucuucaugaucuccaugaagacaauauagcuaggaaacucuuaacagagcuuucuuccuuaaacacagauaccacuguuacagaguuugugcuuacacugauaguaaaaauauacuagaguuucucauugaaccaccuuuuuuucuuaaauguuguggauggaccugguguugcuguucuugugaaccauccccuaaugaauaaaggagccaauuacuggguguguaggugggacuucuggguugguuggauggaggaagagaggaagcaggagaguuaggucuauuuggaacggggaaagcagaaggguaagauguagcugcuagaguuucccaauaucaugguggaccugcaaggauuuuccaugugaggaaucguauuuuaauaaggcuuauaagauuagguuuuaguuguugggcccagagauugaguuaccauuguuucugaacuaaguuuguguugcgguuuccuucacccuguggcucaucuggguucaagagagaaagguauggcagcaaaguguggguuugccagaugugcaccacggaguuggcaugauaacaacccgccagugggaacuuagugagcuggguagagagauuauggaguucugagucagaggcuucaugagauaaagacaggucugccauugcccgcaaguguguggcaggccaugcugcugggccagggacucaagcaugggaaugugcuuaaaugucuucacuguuguguuaggauugccacucaucuggacagaucacaacaggccagcacaguuccacgggagagagguuuguugugggaggaaaaggacaaaagggggcaacaaagaagaaugaaagagaacaaaguucgggggggggggggcucugcuuuuuauuugggcccugacuuacugcacaugccacugcgcgcagguaaagguggacagguggaccagguggacgcugggaauguauagcaguugccauggcaacagauacacaggucauuucauggucgccuauggguaaugucauu

SEQ ID NO: 9020 - RNA, 1170 nt, Mus musculus
cagaagcagagaagaaggagaaagccgaguuaaccacucaccccuagcuuccugcugcggauuuucacguagcccugcuugacuaugucguuaaaguuggaggccauggccagagcggucggguuccucugcugggcgauccgcuucucggagucgacaaccgcuguccgccgcccgguccacgcaggucucgcauccagccggccgccgccagcagucgcgccgccgcugauuucuccccaggcuccugcuggcgcggacccggggucgauagcugggccgccacacacggagacaagggauccgggcccggaacugcucagcagcaccagcaccucgcgacccgucgucaccuucgcccccggccacaagcggagcaccgcgacccgcgccaccgccaguuguaccccccuccgcgccaccgcccccggcagcacccacaggcuggcgccucacucggcggcgcacagcuggccggagcgcaccaucgcggcuccccggcgcggagaagggggagggacggcggggcgggccguugcgcccgaucggcucccucccccuugcccgcgggguggcagggcuggaggaugcuggcaagaugcacuccaucacucuuuucuugggcaaggaucuucgccugccacccgcgccuaggauauggcucccacaguagcccugugcuggcaccacucgcccaggcuuggauuccuaaggacaaggcuccucauuccaccgcuguuaaucuggccuucccaaacugggcaguguggacagagcauugagggggagacuucacagguucgcaagaggcaaagaagagcgagacaauuguuuauuucagagauggugucuacaauacauuuuuuaguucuaggcacacguggccuuucccggucuuugcccuguugggaaguguaaaucgaagcccuuccuggugcacacacaaagagaccaacccugcgcaugugucuaauccucaggcugcugaagucagaaggaauccuggaggcagcaggucacagauguccucuauagaaaaggcuguggugccuggauugacaaucgcguuuuuugguuaacuagggcucaauguacuacuggcauuucaucuauucaggaaauaaaaggcagaacggugcuccauagaugugcugaaauguucaacuugua

SEQ ID NO: 9021 - RNA, 1170 nt, Mus musculus
uacaaguugaacauuucagcacaucuauggagcaccguucugccuuuuauuuccugaauagaugaaaugccaguaguacauugagcccuaguuaaccaaaaaacgcgauugucaauccaggcaccacagccuuuucuauagaggacaucugugaccugcugccuccaggauuccuucugacuucagcagccugaggauuagacacaugcgcaggguuggucucuuugugugugcaccaggaagggcuucgauuuacacuucccaacagggcaaagaccgggaaaggccacgugugccuagaacuaaaaaauguauuguagacaccaucucugaaauaaacaauugucucgcucuucuuugccucuugcgaaccugugaagucucccccucaaugcucuguccacacugcccaguuugggaaggccagauuaacagcgguggaaugaggagccuuguccuuaggaauccaagccugggcgaguggugccagcacagggcuacugugggagccauauccuaggcgcggguggcaggcgaagauccuugcccaagaaaagagugauggagugcaucuugccagcauccuccagcccugccaccccgcgggcaagggggagggagccgaucgggcgcaacggcccgccccgccgucccucccccuucuccgcgccggggagccgcgauggugcgcuccggccagcugugcgccgccgagugaggcgccagccugugggugcugccgggggcgguggcgcggagggggguacaacuggcgguggcgcgggucgcggugcuccgcuuguggccgggggcgaaggugacgacgggucgcgaggugcuggugcugcugagcaguuccgggcccggaucccuugucuccguguguggcggcccagcuaucgaccccggguccgcgccagcaggagccuggggagaaaucagcggcggcgcgacugcuggcggcggccggcuggaugcgagaccugcguggaccgggcggcggacagcgguugucgacuccgagaagcggaucgcccagcagaggaacccgaccgcucuggccauggccuccaacuuuaacgacauagucaagcagggcuacgugaaaauccgcagcaggaagcuaggggugagugguuaacucggcuuucuccuucuucucugcuucug

SEQ ID NO: 9022 - RNA, 33293 nt, Mus musculus
caggcuaccuucgcugggcuaccgggauccugaaggaggccggccuaccccgccccgccccgccccguuccuggugggcgcugcgucccaggucuuccucacuuuccuuucgggggaggcgggagccugcauuauuugucucugcucgcgcucaucgcgggauucacaccgcgcuccauggcgaaugcaguggggcggaggagcugggcagcccuccggcucugcgcugcgggugaggagcacucggggugguggggaacgggugggaaguugguccggaaugaagccgggccguguggggccgcgccgcgggguacuuaggauuucuacucugccuccuuggugggucaggcuuccuccgcgggacucugcgugaucuaccgcccaaugcggagagggcacugcuaucuucucugcuaucaggaagguuccuugacuccacugauggaaggacaaggauuuugagccccaauuuggcauagguucugggucuuguuacaguggaagcacuuuucuugauuaaccuaagagagggaugauggccaagggcagauacugguaagauauccaagacugguuugaagagaccaagcaucuuuaaagcucucagccauuuacuuucagcagggaguauuuggguuuucugugguucaccccugacucagccaccaauuuagaacccucugugaaccaggcacugcccuggaauaaguguuagaacuggagugcaguauuuucuuuuuguaccuauuuuggggaauuacauuuggacuuuguaucgaggggauaaaugccacuagagaaaaaggaaguuauuuuuaucucuaggccagaaaaauggugaaaaggaaaaauuaaaacaaguggaaauauguagaauuauguagaaauaugucuuguguguauucgccuacacugcgcuugccuuacgaaacaugauugcaugaagaguaaauuuuuacugaguggaugaacuacuuuugcuuuugugucacuuacaaaccuuauaauggaucauuggugaauuuuuugguagauacuuuaaaaaguucaaacauuguauaggcaauuuagacuuaaggugaaaaucaaaguaauaaaucauuuauuuucuacauuuuuuuccuuuccaguuauuuuacuugaucuggcuguuuguaaaggauuuguagaagaucuaaaugaaucgugaguauacauauauguguaaaauacuaguaaauucuauuuaacuuugucuaauucagaugccaucaaaauguccacacaugaaucuaaucuuuuaauaauaggugcaguggcaacugauauuaacauugccaauuuuguuucuggaguuguuuaacaugccuccauuuacaugcaaaauggaggagugccccagagaguuucccuaauaguucuaaaaugaaaaaccagcaaauguuuccauauuguuucuuucuuuugguuuaauaauacagaguuagugcuggaauucaguguuuaaucuguaguaaagcagguuuauucacaagaccuugcucauaauaggugggaagucaaacuucauugcaaaaaucaaggucaaucuuuuuuuuuuuagguuuuuuauuaaaucauauuuuuucuuaaaaauuaaaauauuaauuuuauucaucuauuggaagaugggggcagucaguccuugccgaggcauauaauuggaagucaggggauaaggcacaacauuggaaacaagaagauaacuugcuagggucaguuuucuucuuccaccguguguauuccagggauucaacucagguugucaggguuagcuucgagcacuuucaugcacuaucuuccuggcuuguauuuccucuauuacuuucaaauucucccaauccuaacaagccacacauuccucaaauaacauuauuuucauguaauauuuuaaguucuaucuccugucuccugauaguauuguucaucuugaacagugguaaguagauguaugcguguuaaaggagaugugcacaccaaagauuuaguucauuaaggucaaucuuuuugcauugacugcagcugauagcaaucuuccuugguaggccacucggguuccuuucccacauaagauuugguauacaaccagucucuggaggaacauguugucaaggacucaggccucccaugccaaccaagcucaugucuaccagcacuucuagcguacuuguuaguaucuuuauuggaggcuucaccuuuuucauguacuuugcuacuuaaauguucuuauuggggucuuuaacuuagucacuuucccacuuaggcagagaagcagaaguguuuucuucugugauccucagugauacgauuucccugccugcugcaucugcuugaugcauguaugguacuauuucaugauggaaacaaaaaauaccuaccaaggaacuaccauccuuuuuaucucauauuuuucauuguuaacaauagaugaaucaagacuuguuacuuccaguuuuccuuauguauguggggggggggguguuuguguguguauaugugugaacacaaucuuugcaugcuuaugcagaagacgguuacucugguaguccugcccuucuuuguuauaucuuuaagacaggaucuuucacuuaaccugaggcuugucaguaucuagcaaaccccagcacucuuccugguucuauucuuacaacacucagauugcagguauaauguuagcuuuuuuuuuuuuuuuuuuuuuuuuuuuuuuugagggugcuagaaucuaaauccugacccugcuugcacaacaaacucucuuacucacugaacaauuucugcagacaauuucagcuuauuccuugugcccaucaaucaucuuggcacccaauuguaugguagaauugcuguuguaaauaaaggugugaucaauucaauauaaguacucuuauaauuaccaagaagugugaacaucuagucauagugaugggcauugagguuguguuugaagauuguuuauagaaaguauguauuugaggaaaacucuuugauaacaggagaguagcuuuauuucacucaaugauuggguuugucacuaucagccaccuuuucauacugcucuuauaaugguaacucugccagaagagagggaaguuucacuuuugggagucauuuugcucccuacaugaugcucaccugaaaggcucuuuccauugguuuuguuuuguuuuguuuuguuuuguuuuguuuuuguuguuguuguuguuguuuuugguuuggguuuuuucgagacagcguuucucuguguagcucuagcuauccuggaacucacucuguagaccaggcuggccuugaacucagaaaucugccugccucugccucccaagugcugggaugugccaccacugcccagcuauugggaaaauuuaguagaguaucuugcuuguuugcagaaugugaaaacugaaauacaucuugugauagugccagccaauguuuccacucagauccagaagacagugcccaugaaaagggaauuccauugugaaaaggcaccaaaacaauaugaaauaaauaugucccauuuguugcauccuggaagaggcugaauacacuguauagggagauuucugaagcccaaagucaagccauucucaccagaugaaacauguuggaccccuuguguugucuguaauguucaucuagaccugaaucccagucucuuaagugugcuuugucauccuaugcuuuguucagauuuucuaagagcuuugcaucuaaugguggcccuggaguuuugaaugaauuagcugauggcauuuuaugaguucauuguagccugaaaugaaccucagacaugugaucccagugcagcaauucuggauuuguugcuuuucacagauacuauuuacuggauaggauaagauuuggcagucacugaguaaaaauuuuauauaaaacuuuuauuguucgguauugauaaguucaguauuauuaaguaaguuguacauuuguaaauuauucuaguugcaauaauaaguacuauaggcagggauauuguuugugaacauaaauauaaaaucagauuuuuuuucuuuuuagauuuaaagauaaucgaaaagaugacauuuggcuuguugaugugaguauauaaauuuaaguaucauuuuuggucucuguuaugcaaagaaaacaguuuguuuucucagauauuucuacuuguaauaucuuaaccucuuaaaagaauaaagaaauguguuaagucaauacugaaaucaacauaaucuccuuaagauauaaucuacaacuucauuauaagaaauagucuugggagguucggccagcaacugaccaaugcagauguggaugcuugaagcucagggaccagacugagcuaagggacccuggugggggagcuaguggaaggacuggaggagcagagcagaauugcaacaccauagaaauguguauauggaugugguaugugugcacauaugcgugcauauuugcaaguguguauucacuugugugugugaguguacauaguguaugucugugucugugaaggccagugguugacauugugucuucuucaguugcucaacaucuuguauaacaugagacaagcucuuucacugauggaucucaagauuuucucuauuuugguuacgugucuugcccgggggauucccuuucucuuucuccuguggacuaagauacguaaucuaaguggcauguacccaacugaguuguacuuguguuuuagugacccaaauuuggauccuuagaggaguauggcaagguguuuuuuguuuuuuugguuuguuuuguuuuuauuagauauuuucuucauuuacauuucaaaugcuaucccuaaaguccccuauacacucccccgcccugcuccccaacccacccacucccacugccuggcccuggcauuccccuguacuggggcauaugaucuucgcaagaccaggaccucuccucccauugauggccaacuaggccguccucugcuacauaugcaacuagauacauaguucggggggguagggggggagaagccggguacugguuaguucauauuguugacccuccuauaguguugcagaccccuuuagcuccuuugguacuuucucuagcuucuucauuagggucccuguguuccauccaauagaugacugugagcauccacuucuguauuugccaggcauuggcauagauagccucacaagagauaguuauaucaggguccugucagcaaaaucuugcuggcauaugcaauacugucuggguuuguugguuguauaugggauggguccccagguggggcagucucuggaugguccuuucuuccaucucagcucugaacuuucucucuguaacuccuuacauggguauuuuguucccauucuaagaaggaacaaaauauccacucguugagucuuccuucuucuuggguuucauguguuuugcaaauuguaucuuggguagucuaaguuucugggauaauaauccacuuaucagugagugcauaucauguguguucuuuugugauuggguuaccucacucagcaugauauacuccagauccauccauuugccuaggaauuucauaaauucauuguuuuuaauugcugaguaguacuccauuguguaaauguaccacauuuucuguauccguucuucuguugagggacaucuggguucuuuccagcuucuggcuauuauaaauaaggcugcuaugaacauaguggagcacguguccuuauuacaaguugggacaucaucuggguauauauggcaagcuuuuuaccagccaucuuccuaccccuauuuagauuuuuauauuuaaaugacgcagagaacuuucaaguucuugacaaagaaauuuauuuuugaugaaaugcugaaaguaaggucauucugugagaagcugggaccaauuuuuuuuuaauuaaucauuccauucauuacaucucaaaugauaucccacuucccuguuaccuguccacaaacuccccaucucacauccucccuccccuuugccucuaagagggugcuuccccacccacccuauccugccccaccccuccagcaucccccugugcugggacaacaaaccucuacaggaccaagggccuccccucccauugaugucagacaaggccauccucagcugccuauguaucuggagccauggguccuaacccuaacccucccuguagccuccuugguugauggucuagucccugggaguacuggguggucuggccagcugauguuauucuuccuuugguguugcgauuccccucugcuccuccaguucucccgccagcucccccaccagggucccugagcuccaagcauccacaucugcacuggucaauugcuggcugaaccucccaagaccauuucuuauaaugaaguuguggauuauaucuaaaggagaauauguugauuuucaguaucgauuuaacucauuucuuuauucuuuuaagagguugaauaauaccaaacacuuucaucccaauacugagcaaaauuaaauuuggggguuugcuuuaacauguaucaaaaaaaaaaaaaaacccaaaaacaaaaacaguauaacccacaaaauggaacaagauagcaggguuggugacuguuaaagguagaagauagagcugagaauguacuguuuuuucucuuuuuauuuauguuugaacauuuccauaguauugaguauaaaaauaagccucauuucaugaaaauucauaaauguuaacauauaacucaagaaccuaauuaaacgcugaugauucugaaauguaaagaacugugauuguaaucaaucugacuugucccugggccaaacaaaucucucagugaucacccauauccugccagugaagacaguaaaauuuagcaaacacaccuucugucagaaaacucuucugucaaauuuuuguacuaagaacagauguuuuucaugaacacaaguugcaaaugguauagugcaugcauguuuauuuagucgucuuauauaaauauggacauauuugcacagaauuaaagacuuugaauccguuucuauucuaaauaaauagucaauuaaaaugaaguuaaaaauacuaguuuugaguuauuuaucuagauucauguguuuuauuuuguuauauugccccuuaaaacuaucuugucugaaacagauuaauauuaaguugcuuaaauagauucuuuaaacuuuuguuugaucuucauggugauacagcuuuuuaguguguuuucuuucuuuuuguguaguucuaugcacccugguguggccauuguaaaaaguuggaaccaauuuggaaugaaguugggcuugaaaugaaaaguauugguucuccaguuaaaguuggaaagauggaugcuacuucauauucuaguaagcucauaguuaauaauuuuauuguucugauaauggaaauacuuuaauuauaacaauuucaagguaaguagaugagguguuuugucauguaaagcuaucuuaagauuuaagauuauauacuucgaguuaaaugaauuagccauuaaaauuuuaauauaccaugugaguuuaaucuuaaucauaacauagacauacaagccauuguuuuccuacuugaguccagacuuucaucccaauacugagcaaaauuaaauuaaaaauaauauauuauguaggaggcaacuacagaaaaguuaaauuuguaaguguaagcugaggaaaaaagauaacaauaaguaggcauuuaaaagauggaucaaaaaaaauaagugaagauuagaaagauauggaaaguugaaaauaagauuaaugaaugggugcagaaacugaaugaaucugagacaaguacacagcaccacauaaaccaaaucugcccugcucccuguuuuguauacuguuauauagacuauuuucaugcuccauugucaaaacugagucgugacagaaacuacauguccccauaaccaaauguuuacuaggugguuuuaagggaaaugauaaaagaagaaauuaagcuuagagaaguuuggggugucauagcaauuugaagagcauggcuucagagaaagcaagauuggcauugugaauugcuuuugugugugauacugggaaagcuuuuaaagacccuaaacuuuggcuuuacugguaaacauuuaauuguaauauuucuuuuacuggcuauuuugaagauugaaugaugugacacauguaaacuccuuuguauucaauaaguucgguucccuugucuuuuacuuaugaaaguagaauuauguuauauggcaauaugugugcuugcucucuuuaaaacaaaacaaaaaugggaaaggaucuuucuuuguaguucaggcuggccuggaacauucucugacauccuaggacucaggucaguccucuuccucaguaucccaaguacuagguuacaagaaugaaccaacauacccagcuguuuucugugcacuuaauuauuauuauuagacuauuaaauuauuauuaaacccaguuauaacuauuccaccucaguauaauuagcacguguaccaugaugugaacaaaauacuuugaauuuguugaauuaugaaaaaaauuuucaaaaguucauauguuggguuauuaaguaauuauaagaaaaugucaugcuuuuuuuccuuugugggauuuuuuuuccccuuugugagauuuuaauacuuaaaaaaauauuuacucagggcuggagagauagcucagcgguuaaaagcacugaguacucuuccagagguccugaguucaguucccagcaaccacaugguggcucacaaccaucuguaauggaauccgaugcccucuucuggugugucugaaggcugcuacaguguacucucaauuaauuaaaaaaacauucacucaaguuuauauaaauauacuuuuuuucuaaguaaaaggcucauguuacuuaguuuucucaauuuaaaaagaacuuagaaauauuuuauucuuuuucuuaucaaggcauugcuucagaguuuggaguucgagguuauccaacaauuaagcuguaagucaaguguuacauguuuagaucuauauuuuuaauaguccacucugcuuacauuuuauucuaguacuuucuuuggagggugaagguuuggguucagccauuguuuuuaaaccaagugcaugagagacuacacuucuauacaucuucauauuuaaguauuugguacccaucuaauucaguaaauguuuucugagagucuacuguguagcaugcacuuacagaauaagguauauauucauuaucaaaggucucuugaggagccccaaucugugccugcuuugccacugcaaaucacauuucauucuuguauacagagacuaacuucauuaaaaaaaaaaagaaagaaaucaagagaagaaaauugauagaugaucauuuuaugauagaugaucauuuuaaucugaggguauugaccaagucuacaagagaaauuaaguugaaaaaaaugguguggagauucuaaagagauuguuuuacagugauuuugcugcauguuccuguuauuuucauuagcuguauuuuggcaccgugagaagcuaagcaguuguuuucaaaggguuuuguuuucuuuucuucuguuuuuuuguuguuguuuuuuuuuuuguuguuguuuuugggguuuuuuugcuuuuuuuuguuuguuuuuguuuuuuguuuuaauuagguauuuuccucguuuacauuuucaaugcuaucccaaaggucccccauacccaccccccccaauccccuacccacccacucccucuuuuuggcccuggcguuccccuguacuggggcauauaaaguuugcaugaccaaugggccucucuuugcagugauggccgacuaggccaucuuuugauacauaugcagcuaaagacaagagcucccggguaaugguuaguucauauuguuguuccaccuauaggguugcaguucccuuuagcuccuuggguaauuucucuagcuccuccauugggggcugugugacccauccaauagcugacugugauccuccacuucuguguuugcuaggccccggcauagucucacaagagagagcuauaucuggguccuuucagcaaaaucuugcuaguguaugcaauggugucagcuuuuuuuguuuuuaaguaaauugacuucucugauauuuuaaaacccugaaguuuacaauuuugaguaaauaaauuuuucagggggugggggauguugacauuuuuccuuugugguuuguuuguuuguuuguuuguuuguuuuggaaaauguuauuuuucuauuacaguguguauugauggugcuuucucuuuguuauuaggaguucugguuuugcuuauuguucuuuuuuguacaauuggcuagauacaaauuuauucauuaacagguuuuguggaagauaguguaaguuuuaagaaagcuauuuuuaugccucauucaagaugcauauuggagguuuugccauugccaaaauauccuacuuccuaguccuuuuauuuuccacuugaaggagaguaauuaaaguuacucugauuuaagcucuugauuguaaaugugcaaauuacucacuuuccaggagauguauauuauaauuuuauacuacaaaguaaauguauuccuauugugugcauggaguauggccucuucauaugcaucuuaaguugcuguuccucagaagacaauugcauacuuuguuuuacaggagugugcugcucuuaaagcuucaucuucaguguuuuauacauuuuaaguuuaugcuuuaauagaggggaauugagacuaaauaugaagacaguuaauuuccaauucuuaccuuuaauuuuuaagauuaaagggagacuuggcauauaauuaccgaggaccacggacuaaagaugauauaauugaguuugcucacagagugucuggguaagcagauuuuacuauuugaaagaaaauguauuuuaguagaccacauuggauauacauauuuuagauauuaaauguguuguaugcaguuaugaaaaauuuauaguuauguagcauaugcagugaaauucuauagguauaucauaauuuguaguauauguuaauuuuguguuuaagaccauuuuauguuuagaauuuuucuccaaugaauuauaauacauuuucaaauuuuuauuauauauacaauuuauauauuuaaauuuauaucauguaaauaaauuuauuuacaaauauauauccuauuuauaaaggacauccucaacuccuaccucaccccccucucagggaugcuugaaacugacuaguacuagaucauaugaaucucuuuuucuuuuucucaaaauaccuuguacuugaaggaagcacuugauuuccuuucuuuaguaucuagauuuccaguguuacuaacuucugcacuuugaguccauugacagaguaaggauuauuugcauacaaacccuucaauaccuucauaaauaagucuggcaacucaaagggcuguagaauugcagaugggcaggucguguauacaacauauacugaacauagggaugauucacuggcuuucuauguacucuuugagggaaacgaguauauaguaggguuucccauuacucagaacugugcacaguuuaauuuacaaacuguuuccuguggaaguuucuacuuaguauucucagaccauaguuguaauggguaauuggaaacauggaaaaugaaauuaggaaaaucaguuagcaacuucaugaaucuuuuuuuuuuaacuuuaugagucuuaauuuuuauuauguugguuugccguauaucaacuuauauuucuuguucucuaauuuuagaguuuuaagagaagcccagaauauaauuguucuuauagacuugggauuucaucccuaguauguggugcuaaaaauauuuuuuuaauugcaucuaaguuaauuuuccuuacuaucacauguuuuuuaaucugcaauguauucuagcaguuuuuguuuaguaagugacauagcuaaaacccagugagccauuugcauugaacuacagaucuuugacuuauugcuuaucaaaaaguagauuuuuccacucacgauuccugaugauuugaauguuacuuuuuuaaacgaaaugucuaugucuuacucagauguagagaacaucaguguuuauaauuauauguuuguaucuuuuugaaaaauauuugucaagaucaguuaaucuauauuggccuugaaguucuaggcacuuuaauagcuugagaaaauauauugguaaauaaauagcuugagauuaaaacaggauagguuuguuguguaaaauaaugccucaaaauacuuguaaaugcacagaauuagaaaugauccuuauuagaguuugugaugcauauacauauaauuucaauuguauuuuuuucauugugauugcauguuucucuucauuuucucugugaauaaauaaauuuugaaaugaguuuauuugaaggaaguggggccaggaauaagcacuugauucucauggcuucagauagcuuuguauuuggcaguuaucgaaugcauuuuuccuuaacccuaggaagggauucuccugaugugaaaguaccucuagaguagaggcaauuucauggcucaguuccagaguugcaucacguccugguuaauuacgaaggauugaaacagaggcagggaaagugaugcaaugaccuuaagaauuguguguuuuaaaaguguucacuuuuacaaaauagguucuguuuauuuguauguuuuguggacugaaaguauaauaaucuauacuaaauuuuuaaaaagaaagcauuuauuuauuucuuaacuguuuuauaaguaacuuuuaguguaauuaauuuauuuacuuguucuuuuaaaauagcuauaauaaauuuuauagcauaguuuacucuuugugauagaguaacuauuguuuccauuuuauuuuucugaaaauaguaauauaauuggaagcuuaaggcuuugaccucuguaggauacuuaagaaguauguaauauuuaaacugacacauauuauauaaauauuaauccuuguagacuccugagauacuauuucaugauuugguucuguaaauuugcuuuugaaacugaaauaauuuucacgugaauugucuugcuuuuagccaaagacuguaagcagaugaucauucugugucucauuaaucaaaaacuaauauugaugaugucuaaaagauguauuuggaacuggcagauuuaauuuuggguacuacauaaaguguuacuaugcaauacacaaacaccauaggcugaaauuuuacuugggugggcuuggugcuauauuuaagugcagauaaacauugcuaaagcauuaaauauaaucagcugucacauaaaugugaauaaaaugugcacuaccuuuagcucauacccauuuguuuuguuuucacacagggcucuaauucggccucuuccaagucaacaaauguucgaccauguacggaagaggcaccguguauuuuuuguuuauauugguggagaaucacccuugaaaguaugaaauuaucuuuuucuuccacauaaacaaacauauuguuguaauuuauuugcugugaagcugugauuuuaccaaaaccuuaaaguaaaauauuuuaguucaucuaaguauuuuucacaacgaaaauacuuucaaucucucuuacuaaauuugcgauuaugaaagugaaguaaguaaaaauuuggguaaauauugccuaccuuaguauuucuuauguuacugaccagauuauuuaauuuugcaucacuuuuuagcccuuuaagugaaagacugaaaacugcaaugcaaauguuaccuuuuuaaagcaaagcacuaugccuguuuacuuagguguguguuuguacauaccuucuuuacugccaucacuaucgucauuauucaucauugcugaucucuguuaagaaacccaaacugacuuaguucauaauucauuaacucucuuugaaagggagaauaggagcacuuaguugcagugauuauuuaccuugacaacaguguuauuugguuuggcuauaguuucuucuuucacugaaaggugacaugguaggaaauucuccuacugcuuauagauagcuuuaauuauuaaaugggaaauaaauugugaucuuuuauauuuaagauguccucuuucuguuuguguuaucauaggagaaauacauagaugcugcuucagaguuaauuguauauacauacuuuuuuucugccucagaagaugugguuccugagguaauauuuaauauuugauuuaaugauaauaauuuauucauaagaauuaugauuugauuuuacaugucagauuuauucauaauguuguaugaaaagaaaauuuuuuacuauugaugucggauuauuuagggacuuuuuucucugaaagaauacuaguaagcagugauaugcaucaaaccccaaaaacacuuaaaaguaguaaguuauguauaugcugcaaauacagucuuuuccugguuucucacaccaacagcaaauaaauaaauauuacaaaaacagaauuccagagaugccaccaaaaaguaaauggacaguguaagaguugggauauguugggguggacaacuguucuacauuuuuucaauccaaaaauaaaggaaaaaaggaagguaugugugaguagaaaauaguugaacugaaaccugccucaugcagguuuauggauagaaugugucagaaacaaggaagagauaaguacaagacaaguacaagacagugcaaguacauucccaaggaaagagcauaccuuacauauuugagaaacaacacaauagccaguguuccuacaguacugugagaaggggauagaagcaagcagaagacaguucuguuguguaugucacaguguauauaaugaaguugaaguucauaaggaacucaagucuguucauuuaaaaauguuuagaguacagugcaguagacagaaaauagauccagagaucaguugcuuaagagucaauaugcagaagacuaugaaauaaagcguccuuuaggacaaugguucucaaccuuccuuaugaugcagugcugaaauauaguuccucauguuguagugaccaccaaccauaaauuuucauugcuacuucauaacuauaauuuugguaguuaugaaucauaauguaaauaucugauaugcaggauaucugacauacaacugcugugaaauaguuuauccccaaagggguuaaacccucaggcugagaaccacugcuuuuuuuuuuuuuuuuagauauuuucuuuauuuacauuucaaauguuaaccccuuuccugauuuccccuccgaaaacccccuaucccauccccccucccccugcucaccaaccuacccauucccacuucccuguccuggcauuccccaacacuggagcaucaagccuucucaggaccaagggccucuccucccauugauguccaacaaagccauccucuacuacauaugaaguggagccaugggucccuccauguguguacucuuugguuggugguuuauucccugggagcucuggggauacugguugguucauauuguuguuccuauuguuauuccuccuauggggcugcaagcuucuucaacuccuucaggccuuucucuagcuccuccauuggggaccuuguucucaguccgaugguuggccgagagcauccaccucuguauuugucagguacuggcagagccucucaggagacagcaaucucaggcuucugucagcaagcacuuguuggcauccccaguaguaucugggguuuggugacuauauaugggauggauccccaaguggggcagucucuggauggucuuuccuucagucucugcuccacacuuugaaucuccucucauggguauuuuguucccccuucuaagaagaaccgaaguauccauacuuuggucuuccuucuugagcuucaugugguuuguuaauuguaucuuggguauucugagcuucuaagcuaauauccacuuaucagugaggaaccacugcuuucuuacauaucuaggauuuuauauuauaaauggaauucugaaaugauuucagcuuuuugaggaaccucuauuuuugucaaucuaaauccacuccaguuuuaccaguuugauguaagacauuuuucagagcagaucauguucauacccuuaauuugucaugucuccuuuuuuagauauaauuauuaauuuuuauauuuauagucaaaucccuuuuuagcacacagguaugugauuuuucacaaauuuuuguaacuacuaucucuugaaguuguagaauuaccuggacaugagaggcaggagcucaagaccagccugugcuacaugagacuuuauuuuuaaaaagaaaaaacugaaaacaucgaaaacagacccagcacccacuucaaugugauaguagacaucaaagaauauaggaaagagagauggaacuagauuaucuccuuuaagcccuuccaggaaugaccacugcauuccuuugaaagggaucaaagucucaugcugaaaauagaaacuuuauaucauuuuggugggagagugucuaauagcugguggaucuagucauaguuggaaacuuuuuaacuaccugagguguggguuuuuuuaauauauauaaaacaugucauuuuugucauaaugcagcauuaucauaagaucauuuaucauauugccucuaugcuaagauguaccugaauuccuuuauuuacuauuauuuucauguuucauuuacucauggguaauugccuagccaaauuauuugucuucugauugucauaauuuuacucuuuugaaauacuuacaaaauaggcucuuuuagaugauuccuuaugaaugacaauuguguuuuaagaaguaguuuggggaguacuuguuaccuaauguuauucaaguuauccugugagguagauacugucacaggcuuuauguuucuaggcugaggcaguugacccuaaaugaagugacugaguauaacauagcuggugaguugguggggugacauccuuagguccugcuguccugugcuucagaaucgacuccgucuuuuccuacucagaaugcuguucauggucuuuuagaaacucuuaagaguaguccuugcuuuuucuuauaucaagcaugaugcuuccagggagguaucugaaaacauucagauauaaaauuuggcugaauacacuagcaagcguuggcugaaaggacccugauauagcugucucuugugagacuaggccggggccuagcaaacacauaaguggaugcucacagucagcuauuggauggagcacagggcccccaauggaggagcuagagaaaguauccaaggagcuaaagagaucugcaacccuguaggugcaacaacauuaugaacgaaccaguaccccggagcucuugacucuagcugcauauguaucaaaagauggccuagucggccaucacuggaaagagaggcccauuggacuugcaaacuuuauaugccccaguacaggggaaugucagggccaaaaaaugggaauagguggggaggguaggggggacuuuugggauagcauucuaaauguaauugaggaaaaugcguaauaauaaaaaauauuuaaaaaaauaauaaaaaaaaauuuggcugaacuuacuaaaaguguacccuuuuuagucuugaguuguuguguguauuuuuuuuucuuguuuguuucagugcuuuugaaauugugguuacuaauugaauugcuaguguuaaaacuuaaauuucuaauguguuucugcaguacgugacgcugaaagagaugccugcugugcuuguuuucaaagaugacacuuauuuuguuuaugaugguaaguucuaauuguuuaugaugguaaguucuaaagcuuuaacucguauaaagccuuucauaauuaaaacauuguuauaaggaggcauuuauaaaagauuuuguaagugcuaccaguguugcauuugguagagugaucuuuuaacccuucaguaguuuucuaauccauguacuuucaucauuaguugcugacaaugauuuugugugugugagugugcgugagaaaucauuaagauuuccuaagaaaucuuaagaaaugaacuguauucuauuucuaagcauuaaauguucagacuuaauuuuaggaggguaaguuuacuuucauuauacauagauaaauaaaacauccucagcagaauggaacuguuauacccuguuuagguauuucucucccucugucagaaaacauuuccuagaaguaaauauuucauuucauuuaaauuuuauuuugauaucuuucauacaucauaaaaugaaugacauaauaaaacccuaguacucauaguaauauagaugguuaacaggaccuuacugcaguugcuuuaguuguauuguuucucuuuugaagcauuucaaagcaaauccuaauggcauuuugucagugucucauuaaucuucuuuuuuauaaaugugggcuauauuuuuagcucacuugguuauugaaccacuggggaggaaaaaagucuuuucauuguuuuagucaaggaacauguuauuuugauaacugagcugagaaaacucagcaucucuauuuuuuuuuaacuguguuuaguugaacuaaguucuugauauauaauugucauuacugcaugcuauacauuacuauacauuagguguauucuauuacuuaguaaaguaaaaaaaacacuuaauauuacauuguuauuuuuauccuuuaaaugauuugugcaauggauaguauggcagauaaaugucauacaucacuugaacauuagauaaggagaucuaugaacagcaaguuuguucacuggcucauucauucaggggauaguuauugaauguuuacaauuaucaccaaacagucaaaugaacaugagaggaacuugugcauauaaaaauaggagaaagaaaagaacccauauaugugucuuuacuuacauucuuuuugauuauggaacugcuagcagaagugcucagucuuugugccugccuaaagaaaguccgucuccuuucaccucacuuccuacuucagaugucuuugugccugagaggguauugugcauguccaucuuuguugccaaauuuugaaccugccugaagccuucagguggacaauagaucacauaauaccucagacauuuauucuacuacugguuauuuaugaaucuggaaccauuuggauacuacuacagggauaguuuuuucugaagaguuucaaauucaucauguuguacaucccuuaggaaauuuacuguuaccauggaaugaagauccuggccuaguaaucaacuuguaguuuuagguuccguuuucuaauuucuaaauccagcccuaaauaauuucaguuuuuacaaauuuauuuuacagauuugguugcuuaagauaguuuauuuagcagugugacaggaaaguaaaagcacuccuuucagucaaugaguacaguguagucgauaaaagaccuuuacuucuaaugguuucuucaugcccuuguccuguuuccaaaaguauuucagaacaauauuuuuaaucaagauauaauuuccugucugccuagauaaggaaguauuuaacguugaaaugcagcuaauguauguguauguuuaaguuguaguuaugagaaagaauuguaaauaagauaaaaaucuaauaagcaggagcaaagaaguuacaauacaaauuacccacaaugauaagaaccagguaacaccuucacuaggcugucauuuaggaauauauguuuucauuugaucauuuugucacuaucuuuucaauuuugcuuuucaaaugaauguucaguuuauaauaacuauguauuauaauuuuuuaaaauuuauaaguggacuuuauuaauauauugcaaaauauacuuuauucacuuugcuagauugagacauaacuaucuuguacucugauguauuucuuuugcuuuguuucaagaguaugaagauggcgaucuguccucauggaucagcagagagagguuucagaacuaccuuacuauggaugguuuucuccuguaugaacuuggagacacagguaagaagcagauggccauuccuguuucauuauagaauuuuucuuuaauugaauauguauuuacugguucuuuuaagacuguauuuccuaaucaaaguagacuuauguuugcuaguucugcuuucaaagaauugaggcuuauaauaccauggauauguacccucauaagaugaucaguguagcgaaagagaaggcuaacuaacaacugauggugaugaggaaggcagggaaugagggaaaaacaacagaaaucaugaagcuacugguuaaaguaaagccuucucaccaucuuuugaggucugcuguuacuugugagugggaauuggucauauuguucauugcuuaagguucuaugguagaaauugacaaagcaagaaaauaaauagaaguaugaaaguuuacagcacauagaaaguuuaaaaguuauaaaaaguuuucuuaggagaguauuauauaaauuuggacuaauuaaaaguggaacaacuugaaccggacgugguggugcacuccuuuaaucccagcacucgggaggcagaggcaggcgaauuucugaguucgaggccagguuggucuacaaagugaguuccaggacagccagggagggcuacauagagaaacccugucucaaaaaaaaaaaaaaagugggggaacuaggcaaaacaagagguuggggauuacguuagcuguaaaccaguucuccccugagcuugggguaggaagucucacuguggaggucugagggaagcgcuugcgccagauagacgccgcaccgucaucaugggcaagggugaccccaacaagccacgaggcaaaauguccucauacgccuucuucgugcagaccugccgggaggagcacaagaaaaagcaucccgacucuucagucaacuuugccaaguucuccaagaaaugcuccaagagauggaagaccaugucugcaaaggaaaagucgaaguuugaagauuuggccaagagcaacaaagcucguuaugacaaggaaaugaaaaacuauguuccucccaaaggggauaagaaaggaaagaaaaaagauccaaaugcuccgaagagaccacugucugccuucuucccuguuuugcucugaaaaucacccaaagaucaaaauugaacacccuggccugucuauuggagauacuuugaagaaacugguugaguuguggccugagcaaucugccaaagauaacuguaugagcagaaagcagcuaaacuaaaagagaaguacaaaaagaauauugcugcauaccgugccaaggacaaaagugaagcaggaaagaaggguccugguaggacaaaaggcucaaagaagaagaaugaaccagagaugaggaagaagaggaggaagaugaagaagaggaggaugaagaauaaguggcuguccuaaaguguggaguguguguguucaggcaauuauuuugcuaagaaugugaaauucaagugcagcucaacauuagcuucagcauaaaaacugaacagauuuuuuuauagcuggugauauucuuuguagggaaaauacuuuuuaaaaaguuuguagcuuuuucaggggcuacaacguacaguuagauuuaaagcuuuugaugaugaauguuucuaaauauuuaaugguuucuuuaauuucuuaugguagcaaaaaaaaucuucauagggauuuguauuaacagaaaaaaaauuuuuuaggauguuacauuuguuuguuuguuuuaauuuguaauaaaauaaugcuuuuuuuuuaagugggacaacuauuguuaccacaugugucuccucucaugguuacauggucaugaaauggaaaugcaguuauagggaagagauauuugaaaacuaaauaaaaacaagaaaaauuaagcacuaacuaguacaugaaauacgucaagaaauaauccuauggacuguuguuuucaacagaaagcuaacaguaaguugagauuauauaguuaguauuagagauguaguaugcagacugagauuaggaaaagcaucaaaauaauguccagugacacuuaauuuuuuuaacuuaacccuacauuuguauuccuuccccaagugaaauauuuuaguauguuuagguauauaauuucauuuaacuuucuucauaaaucugaaaaacuuguuuuccuaagauaaaugagaguuucuugaaguucaguuacauaggugguacacagugggaucuugacuuuguccuccagggcuugguaccgugcugagaacauaacaucuucaacccaaaucaaugccaucagaauaccacugcucuguuacuacacuauucuacccuccugaacauuaucaguaggcauauaaguuacuguuuuacuacuacuacaggaacaguaugucacucaaauuuuauucuauaugccauuacuggugaaauuauaacagaaaauuaccacacaaaaaucauuuccuguuauaaacuauuguuugggggggggguuagcaacaauuuuuaguaaacuuuuuaaaaucaaugucuucuuuaugguauagcuuuccacaaauacugugucagucuguggauuguauaaaauuuaauagagaaauuauagaaaauguauuauuauuuaccuccuagagguagaagaaauuuuucauuuguaaguaacuaauucacugguccaggcugcaagcauuauaccauaagauguuggguuaauuuuauguaccauauaaaugaugauuggaguuaaaguuuagaaagauuuuaugauaguucacauuuacaggagaaauauuugacaaguguaauaauaguuauacauauucaguucauugaaaaugaaagguauuauucuuaauuucaggaaagcuuguggccauagcaguuauugaugagaaaaacacaucacuugagcauaccagguaugguugcuuugaaauggauuuaagcuuuaagugucauccagaucagcucuuuguauaaucucuuuagaguaucuuguuuugucuguaguucuuagguaaggcaacagauauuguaaugagauaauuuaaacuuuuaaauugaagaggugaaauauuuacauauuuguucuuccauagauuaaagucaauuauucaggaaguugcuagagauuucagagaccacuuccauagguaugugcauguguucugaaaaguugucuuuguuugaaagguugucuuuguugaauuuggcauuacagugagguaaaccaaaauuugcaucccuaaucuuuaaaauuuaaaucuacaucugagaugcucuaagggcuaaaugcauggacucugacaugacacuaagcgaaaaauuccacaccugccuucccaugauaguagucagaacacaaaaucacuuuuauacaauugugugaaauuuccuucaggauauguguauaaggaauauauggagaaaacuugaauucuguaauuaacacuuugguuccugcccuagggagcucaucauuuaugugaaaauguuccaaaccaugaaaauuuucagaaguuucaagcauauuugauccuaggcuuucagauaagacaguccauaugaaaggugaaucaagaauugauugacuuggagcuucccgucagcauaaggauacaugcaugccacaucuuucaaguuagaguagcuucauuuauauuucaucccauucgugcuuccugagaguguuugacauauguuuuaugguaggaaaauauggacauaaaauuguaauuuggagacaauuuaaaugaacagucacauguuagguagaugauuauaacaaauuuucagaaaaaauuaauagaauaaaacauuuacuugggaauaagaauuuuugcuguauuucaaauguuuggguuuguugcugcuaucaaaaacagcaauagaaacuucuaggauucauuauuuucuucauauuucaaaucuaccaaaagcuuauugugcaauucuccugguacaugguagcugaccuuuucuaagugguccuauuucauaguaaaucaccuuuccuaguauuuuacuugcaguacauuucuucucugccuuuuaaaccuguauacaaugaggugauguccaggguuuguuguugcugaucguguacuugcuuauuaauagaacauagucuuagagcguagggguuucuauguucauuauuauaugcuuaccaauuucugguuuguacuauguuccacuuuucuuuuaaucuaauauuguccucuuuccuucuuucucuuuguugcugcuguguuucaaagagauuuucaguuuggccauauggauggaaaugacuauauaaacacuuuguugauggaguaaguaaaguguugaugguuuugauagcaguuuuucuacuuugauaucuaauuuugagagauaggaagugacuuaauuagcuggaaauaagcauaccaaaacuacuugucauuuucuggugcugaccacauuauagauaaccaugaugagccaucaugugguugcuuggaauugaacucaggacaucuggaagaguagccagugcucuuuacugcugagccaucucaguagccccagagauuuaauaucauucuuuaguauagaagauaauuucccacuucggcauuauaacguaguguucucaaaucauucuauaauguguaacauuuguaguuuuuauaauauaagcuuuaauaauuuuaauagguaauuauggucugguaagguuguucacuauauaggcacuugcucagaagccugacaacuuuaguuuaaucccuauauagagacccaguuccugaggguuggcugacuuccacauguaauuauuaauacuugaaguaauugacacuaguauuuuucaauuuuaaaaaucaucaauagauugauacaccuguagaauaaauuuuaguuauuuuuacccccauucccuucgauuuucucccacacuucccucugaaacacuucugcccaguaugucugacccaacuuaauuuaauuugaguuauuugcaugaguguaugguagguuauugcuuggaacauuuguaacaucagugaagaaaaugauaaccuucugacccaacagcuauuaacugccaguaaucacacaggaagguauaggacuucauagucuuuccccaccccacccccccaugcaugguauaauccuggcagacuaagucucaugcagaacuugugcagauagcuauaaauucauacuugcaacagcuuuacuaugugcagaagucaacuuuuugcugcacaucuccccauucucucuuauauuuuuuccuuucauccuccuugccaauuguuccccaaaucacaauaaaguuuuaguacaaaaaaaaaauaguaaaaaaaauuuauauauuucuuauugcccauuuauuguuuauagaaguuguaagguugaucuuguauaaaccuaagagaaaagauauucuguauagucuuauagaaaaaauacccuauaauagaaauauaguuuuguaguacaugugauaagaauuugauaagacccuuuuugaaaucuucagugaguagauagauuuauuuuaaaaaauguuuugcaacauugcacagcagauuuguuucgauaacuaacaucaucugaaaugauaguaucuaacaguaaacacuuaguuuacauaguuuagucaguugugaaauaguagaaaaucugagcucaaauuacagucauaagaucauagcuuaaguuguuaguuugaaggguaugauaaguuuuagucuuuugguuuuuugguuuuguuuguuuugucucugacaaauaccugagggaaacauuuuaaaggagguaaauuggcuccaguuuauaggucucagacaauguugguggguuccauuggauucaguuuaaauaaggcagaguaucaugauaacuggaauguguggcugauacuccucaccuuaggugaccaagaaguaaaaguagaggaaaaggaaaggaagcaagauaaaccaucaagugcauguugccagucacaucuagcuaggcuuaacuguugaagauucccugcuuacaaagauaauaucaccaguugaggaccgagccuuccacacaugagccuguccaggccacuuuauauucaggucauaacaauagggcuuucugugcuagggaaugauccucuuugaugaauguuuaaauauauuggaaaaauauguauccuguuguuggguagagugacaguagacuagagaauucacaguaguguuuauucaacauguauauguuuacucaaauauaaaagguaucauucuagccgggcggugguggugcacgccuuuaaucccagcacuugggaggcagaggcagguggauuucugaguucgaggccagccuggucuacaaagugaguuccaggacagccagggcuacacagagaaacccugucucgaaaaaccaaaaaaaaaaaaaaacaaaacaaaaccauucuaaauguuuagcuugaauuuucucauguaauuguguagcaaguuaggaauuauuaauuuccauauuuuacaagaaaaaauauuuacauguaagaagcuaaauuucuggacuaaaaucuugcaauguuaagagaaagugccagaaucaaacaguaugggucuagagauaucuucuugccuaucuggguuucugaguaccaucuaaaacagggcuaaauguuaucaguauugcauacaguacgauucagaaauuuauacuuugcauagcacagauuuuauucuuauauuuaaucacuguuacucggguguugguuuuuagguuauuuucauacaauauuaguuuaugauagauuuuaugcacacuuugaaaaguucuuguagaccacagugguaaagauauuaaaaaucucuuuucuucucuaacuauagcuccuaagauauaaaugaggaguaagauauuuguuauugcuaugcuuaauauaaguuuugauuucuuuuuuuuuucuuuuuucuagcgaauuaacagucccaacaauaguuguacugaauacuucaaaccaacaguacuuuuugcuagauagacauauuaaggaugcgagcgacaugguccaguucauuaauagcauuuuggaugguacaguaccaguaaguaauucagguccauuucagagagauaaaugggagaaggcagaggagaaacuagcaguucuuuaccuuuaauccuaagaagaaaggguuaggguuagagggaaucagcuucaucccacugcuuucuccugucucagucagccuauuagaaagguuuuguaugacagaggcucacaggugcaaaugucccuugaaguguuacuugagacaccuuugcuugucacaguaaugggaaaagccucuaauguuggacuagagauaguaagaaauuugugaugugggauaauagauuuuagagaauuuacccuuuuggaucaguugaauuaaggacaacugaaauaaguuagcagaaauuauuuucuauuuccuaauaaaagcugugaacaaucacaguuuuccaaccaucaagaaauguauugagaaucagagguucagaaaagaguuuuaaaaauaaucaugugaaagaauugucauaaagacuauacgauuuuaauuuucuuacuguaauauuucuuagacuaccuauaacucauauuagcagacaaaaaaaccugcucagaugugauuagcauacaucuuaauuaagugggaagaaaaauccagaaggaucuuuguugcuucaaugauaauuuaauuacuguuuucuuacauuuuuguuuuaaguuuuauacaaacuuugaaaagucaacauugcauaccugucauaguuuaaagucaguaaauuugugaaacucccuuaguuacauagcaaguagcaauauugguauuguguagaaaugguauuuugauugaaagaaauugaguuguaguggugugagcccuuuuguuugugauuuaguaaaaccugaucagacuuucauaacagauuucauuaguccuaaaguuuagcaaugcaaagaaugggccagacuucugggauagcuagaugccaggguuugauauccccaggaacccuguuaagcucugucugcaugaggauguuccuaggaaaguuucugccucaauguggcuaagcaacccagagaaacucaaagcuuguccaagccuggcgaggguggaccagcuucaacaagccacaaagaucaugaauaaaggcagagugaauuuuagaauauguuaacaugauaagauaggaaaggacaaaagagggucuuaacuauuuaacaugaauuuuggggauuacguauguaauauuuuauaagucaacacuuaccuccaguaacaugguuauguaacauaaaaaugaacuacuaauaugugcauaauauguuuuauucuuauuaaauugaaggcccaaggaggugauagcauuuuucagagauugaaaagaauaguauuugaugccaaaucuacaauugugguaaguucugacaguaucuucaauagcugaaaaauuugggguuuucaaucugcucucucuuuacacuugccuucuuucuuuugcacuuuauuucucuaaauugcuggcuuaaauuguagaaucaaaaugugucucuaacagugccuuccuucauuuguucaucccagcugucuugcuagcugcuccaugcugcuuuucauuuguugagaccaaggcaaccaugaaaauguagcuagccuucuuuauugauaaggaguaaauuugaguaaucugaauaaauccauacauagcauccaucuguuuagcagucacauuuguuuuccuguuucuacccaaauggauuagccacuugcuauuuuguccaccagcugcccucauuuucaccuaaguccacaccuccucucaacagucuacaguacauuccucauaccacagugucacaguggccaucaguucugagcacuuucuuuccccuuuccugugauacacaucagaagaucccauccaucugaguacuuuccuuacuggcuuuuaaauauuguugagacuuuuuaaggcuugggcuaguugucauaaguuaccuugcucugcuuuuuuucucacucaucuuuaaauuucccucuuacucugaaucaauccaaaauggucuuuuuguuuucuggauuccuccagagacaaagacccaacccauuaaauacaucuuacaguaaaacucauucaguaaaauuauuuuucugacaacugaggaaauaacacauaacauaaaaugaacuaguaaguuaguguggcuuuacuagcaacaacaugacucauguuaaaaugucaugugaagagaauauguauagggcuauaaguaaauggcuguuaagagcugguaccuuuuuacaggaaaugaacccaaguucauuuccgaccuacaggagaucugacaccucuggccuccagacacacacacacacacacacacacaaauaauuaaaagcuuuuaaaaaaacaaaaucauaagaacacauauauauaacucuuuaucagaaagaacccacaagcaauuuccuagaguucaacauaguaacaguaauuaucuaagagguauuuauggguaaugugaaaaaagacagaucuuuauuaaguacucagacuguuugguuacuuuuccuauugcccaucgccaauucugcacacucacaugugcauguaagaguguagaguuuuuauuuagucuuuaacaugguaggaauugcuuggguguugacauuaauuuauugaaacugaguucaauagcagugaggggaaucuguuguggucuuaaauuuacaucauguauuuuaugucaggauucuauucaagugcaacuguauucucuacccacagucuauauucaagagcucuccacuuaugggcugcuuucuuuucgggcugccacugggugucaucaguaucaugugcuauggaaucuauacagcugacacagauggaggcuauauagaagaacgauaugaaguaucuaaaagugaaauggaaaaccaggaacagauagaagagagcaaagagcaagaguccagcaguggagggucucuagcaccuacugugcaagagcccaaagauguauuagaaaagaagaaagauugagacuucacagauaaaaaauauuugauagaaugucaaguuauuaaagaguauuuauugaauuuagagauuuaaucaugaucuauuuacagaagagaacauauucuuuguauuuugcuaauaacaacugcaugaauuaaaauaauucuuccauaaguaggaagauguuuggaacaaagugaugaacaguuuguccaaaacaaagccagaucauuguaucaauuacuuuacagaugcccauuauauacacacuucucugugugcauguucuaugacaaaguuaagaagcuuggacagaauauuaaauugaccauuaauguggaagauggguuuuuugcaaagagaaauaguacuuucaccuacuauaucaauucuccuauauuuuggauaaaauuuauauaaacaaauaaagucuuuaaaauuuagacauuuuaagaggacugguaacauuuucuguguaucaaauuuaagguucuaaguuuaaaacuaguguuuuuauauauagcauagugauuuuauuuuacuaguuguuuuuaaaggagaaauguuacuuuuuuacuuauacucuguuacauuauuaugauaauggcauauaacccuaugaagugggugaagaaucuuguaauugacuuuuaaaaaugaccaugguauuuuggguggcuucagccuuuuccugugcuguuuaguagagugcacuguccaccacuggaggaagaaauggcccucuuaguauaucuugauuuuagccaaagcagccuaguauuuuguuuugguuuuauuuuacagcuugacauaacuucuaauauuucuguuaauuaugaaugcuuucaaaaguuauauaaaccauguuuuuaugauauauaaacuaauuauuuaaaauuuauuaccacaccucuauugugggaggccauaacagguuggugauauaaucaacauguuaaauucagauuucaugaacaaggggagagauccuaguucucuucucuagacucagcuuugccucuaugacagucacaaccucgcaucuuucaucagaaugcagucgugucuaagaguggguauuuugugauaauguuuacuauagaucauuuguuaauuuugaugccuucauuuuagcuaauuucagaauuuuuauuagguaaugucuagguccuguucuuugaguaucuuagaguguguugaaaggauccgcugagcauuuacaaacaugguuuguagcucuaacccugaaguuacuuggggacuuugcuuugauugccaagggagcuucugguuucugaugcaauacuaaccaauauugcaucauaguaaugaauuaaagcauguauaucuguagagcaagagaauugcuaauuauagucuguguccaaguguucuuuucauauuuaaaagcaaccauuuuuaauauuuaaucaccuaucauuaacuuuauugauaauuguguauguauguagucauggggaauguucagaaaauaaaagaauauucucaaauggaaacuggagauaagcacuguuaaaaguuacuguaacaaacuccucuauagaauaaacuucuuagacucuuugggaagcuucaugguaguggucccaauggucaagccuuauugcaggagaaaaaaccugaagucuguacagaugccucauuaaugauaaugugugguaagaagagagacgugaagaaauagggaguaccacuauuacauuuuauuauuguuuaucacuaccaaauguuaaauguaucuugucuggucaaucauccuuguaaauaaguucucaauaggaaaaaagaguaaagcacagcuuugcauuaauaaacauaugcacagaggugauucauuguauucugaaauaguuuucuuuuugaaugagugcuuugguucucuguugugaagcaacuuuauauugaucuucaauucuauuuguacuuuuauaaugugcauuagggaaaauguguaagugguuuguaaguaaauaguuuuauuucuuuuuguauuaaacuuuugauuuuuacauguuucuuuuugaggauauuuuuauuugcauugucagagugcucacauaaaaaaagaacuuaaaauuugcucacucaugugcuuuucuuuuuaauguuuuaucagaguacuauuugcuuaucaggagaacauacuuuagcucuauucauaaucuaagaaaaaaauugauccucuaauucccuugguuagauaccaacaauagaauccuuucaggaaauugggauucuaccuuuuuuuuuuaaugugucaaguucugauuucugaaauucaaaaacauagcucauaggucuuuaaacaauauuuaagaguauuucagaggaugcaugcuuagcccaacauccucagcaccucuguucugaaaucucucuuuguuguguuuaucaauauuuuuauaguuucuuuugucuggaaauuguuugacguuuauuagaucuagagguuuuuacucaaaggacuucugaaaccugguuuagaaauaauguaaaaaaugccaaaugaguaaaggugauggaaaggucucuugaagagcugaagcgaucauuuauguuguuucuguuuauucaguuuuauugcccaugauguuucuaauguuuuggcuugguagguagcucuaaauuuuaagaaaagaaucauuuccagcauuggggacacagagacaagugaaucucugugaguucgaggucagccagggcuacagacaaauauauacaaaaaaauauauacauuuuuuaucaguguuucaugaggaaaugaacggggggggggaucacucagcuauucuuauguagaaauuguuaaaacaagugugagauauuaagacuuaaauaacaggacugaguuugcaauuuuauuuuuacaaauauauauuuuuucugaaugagucuaagucccaagaaugagaauaauaauaauaaauaauguucuaguuugggcuaagcuauaaaaguuuuugaaagacuuuauuacuacuaacuuguuuaauugugauacucugcuuuaugacaccaguuggaaaccuuuguuuuucuaaaauaaaguaauuaaaaacaucauugcauaauugcuaccuuuaauauguguuuuucagaaauuugccacaugacuaaucucuaaacaaaaucagaagcuacaacuaauaauauuccacacaguacuuuccuuuuauuaagacauaguuuauuuauaauuacagaaacacaauuuuagauuuuaagcaggcuuggaagugaau

SEQ ID NO: 9023 - RNA, 3795 nt, Mus musculus
aaucggguugaagugaucgcacuuucgguuuuuagcggaugcucgaggaggccgcucuccgagauggagagaagggcguagauaaggauagacguauccaggugucuaccguccgcucucccuaggagacguccuaggaagaccgggggaggaucagggacgccugguggacccccaaggucacgaggagaucaaucuccuagaccaucugggcucgcggacagcuccgcggccaucugauucuuucgguuuuugucuaucuaccccaacucggugcugguuuggguuucuuuuuggcuuagcauuuguguuugcgucuauuguccuuaucguugaaccugucucucauuuucgguuucugugugugucuugugugucucuuuguguucagacuuggacuaaugacugacgacuguuuuugaguuaugccuucugaaauaagccuaagaauccugucagaucccuaugcugaccacuuccuuucagauccucagcugcccugccucccacuccaacuccagggagcagccagcgggucacagugguccugcccauggaccuagagccuagggggaaaugagcuugaaaaaucuggagcaaaugaggaguggucccugaaacgucaguggcccuggaugucgugacugcuaaagagaaaaagaggaagaggcugugagaauagccagccaagagcuccgcagguuucccugauugcuucucauuccccugucccuugcaucccgucucuuguuaacagaaaaacugcuuucacuuuaagauaagugccgguugcagccagcugugagagcugcacucccuucucugcucuaaaguucccucuucucagaagguggcaccacccugaguugcuggcagugagucuguuccaaguuccaguuagggaggcaucugcccacuuggggcuucuguccaagguaaggagcaccugugagucuaacugccaggcucugaugggggucucaucucugcgggacuagaaagucccaacaaucugaccaagguaacaggaaguuacaaaagcaaagagaaggacaggguaaguugguaagaaaguuaguguaaguagauaagaaagugcagaggaggagaaacaaaagaaggauagaggucugcaaagaagugagcuaaaagcaaaucuucagcagacucaggagaaauagaugacaguggcaaauagagagguuaacaguaaagagaagugaaaauagagaugaaggagauuagagaggucugaaaugagagagauacucugaaugagaaauauuuagaggaagaaccaguaaauaagagucagacaagaaaaagaguuaagaaaacaugaggcugacaaagacagagaccagagucagaaucagagcugugcugugagacaaaaagagauaagaaaaaugaaauguuggccacaaaagucaggaaaauuagaaaacuuagauaguaccuggcaacaaaaaaaaaagcuuuuggcuaaagaucaauguguuuaagagauaacaaaaggggugcuaauacagaagcugaguccuuagaagaguccgguggccuaccuguugaagcagcuagaaaaagagacuguguuucauacuccuccaccgaccagugcaaaacaagcuaaaaaguuccugggcacugcgggcuuuugcagauuguggauuccagguuugcuuaauuaaagagauaaacagcccuucguauagagaaauaaaaaacaaccuuggauggccuuggaugccauuaagacugcccugauguuauccccagcuaugggacuccuagaugugacugagaacaaagguauugucaaagaaguucuuacucagagauugggacccuagaaaagaccuguggcauacuuguaaaaaauuagaccugguggcuguaggauggccugcuugucugcacauaguggcuucuggucaaggacgcagauaaauugacucugagacaaaacuuggcacauguccuaaaaagugugguucagcccccaugaccgauggcugacuaaugcucuugaaaacauuauccaaccgucccccugaccgauggacacauuaucagagcuuuuuguugacugaacgagugaccuucgcucccccugcuguccucaaucucacuacugccugagacuucgccuacucaucauugugcugacauucuggcagaaggaacucauacucgaaaugaucugaaagaucagaucagccuuggccugagaguuugagcugguacacggauggcaguagccuggagguugaggguaagcggaaggcggggacagcagugcagugguggacagaaagcaagugaucuaggccagcagccucccuaaagggacuucagcccugaaagcuaaacuuguggcuuuaauacaagcucuauauauacagacaaagagagcuguugacaucugcagaaaaagaccuaagaugcuguggcuaaaaaaaaucagauggcaaaucuaaccgcccaggcauccuaaagagcaaugauccugacagucuaaagacuaucaaguuauagacaaauuaagacugguaaaagaaacccuguaugacauaguagaaacugaagaaagaaaacuaguccucucaugagaagacagaccugacaucuacugaaaaauagacuuuacuggaaaaaauauguguaugaauaccuucugguuuuugugaacguucucaagauggauaaaagcuuuuccuuguaaaacugagacugcucagauagucaucaagaagauuauuaaaaauuuuccaagguucggagugccaaaagcaauagugucagauaaugguccugucuuuguugcccagguaagucaggguguggccaaguauuuagaggucaaauaaaaauuguacagaccucagaacucaggacagauagaaauaauaaauaaaacucuaaacagaccuugacaaaauuaauccuagagacuggcacagacuuacuuggugccccuuccccuugcccuauuuaaaacugagaauacucccucuugauaggguuuuacucuuuuuaagauccuuuauggggcuccuaugcccaucacugucuuaaauaauguguuuaaaccuauguuguuauaauaaugaucuguauacuaaguuauaaggcuuacagguggugcagaaagaagucuggucacaacuggcuacagugaacgagcuggguaccccaaggacaucuuaccaguuccagccagagaucugaucugcguacaccugcgucaugcugagacccucaagccucacuagaagggucccugccuaguucuguuuacuaauccgccuuauucugguuuuguucccauguuaaaaauagaguaaaugcaguauucuccacauagagauauagacuucugaaauucuaagauuagaauuacuuacaagaagaaguggggaaugaagaauagaaaauuacuggccucuugugagaacaugaacuuuuuaccucggagcccacccccucccaucuggaaaacauacuugagaaaaacauuuucuggaacaaccacagaauguuucaacaggccagauguauugccaaacacaggauaugacucuuugguugaguaaacuugugguuguuaaacuuccccuauucccuccccauucccccucccaguuugugguuuuugccuuuaaaagcuugugaaaaauuugagucuucgucgagacuccucuacccuaugcagagguguacgagucucggccccagcgcgcuggcuuccccgccccccccccgcuuuauuaaauagcuuugugugcacgccau

SEQ ID NO: 9024 - RNA, 670 nt, Mus musculus
gucuuuuuuuuuuuuuugaguuuaaguuauuuauuuaagccaucuccucuuacaagcaaagggauggaagaucagaguaauggucgccaucugaggaaaggagagaugagcuuagcauccaaugggcuuucgugguccacacagagaaggguccaaaaccagugcuguggucccuuguugccugggggaggccagguucucuuuacucaucuucaaagccgguuggaaguggguucacaugaggguuguggaagaggguaugguuaccgucuccccagggaaagggcuugguccugauguaacguacgggggucucuccugcucuucgugccccgacuugaggaacacguugagcaugcucacucccaccccgggcagcgccacgaaguaggugagggccuuccacauccgagcugaacccuccucgccgugggcgccauucgacaugggccgccccaacccggggagggcccggcccagcggcccagcggcccagcggcccagcggcccagcggcccagcggcccagcggcccagcggcccagcggcccagcggcccagcggcccagcggcccagcggcccagcggcccagcggcccagcggcccagcggcccagcggccgagagacccgagacacagacagcaccgcugacgccaucauggaauuaca

SEQ ID NO: 9025 - RNA, 1752 nt, Mus musculus
uuugggcgcuucgcugauggugucggugaaccuuuuucccgccugagcgcgacuaacugcgggucuugggcgccuccagguaacucaggggagggggcgguggcgcggagugugcgggucgcgcgggcaagcggccgaccgaucguggcggugguccggucccggcggcguggggagggagcgucccggccccuuuccccucccccccggaaucggcagcuucggcggcccgggaggcggcguccaguccuggccaggaccgggccgcccgcuccugucagccgggccgagcguuggcagucagccgagccgacugcgaacuuuggacgccgaggugacucugggcuuggcucggcgggagcccaggcgaggcgaggcgcgccccgagccaagucggggguccugggcgagcuccccggcucccgcgcccgggccuucacagcgacuucucgggaucuccuggagcuugucaacucgcuggagagcuucgcgaaggcuuuuguuggacucuuguccucugagaaacaaguuguguggguuucugggcauuagcagagucaucggaacacacaaaaaccaguuccgagucucucggggccaucgcagugaaucuucauccuccgccguugagucucucuuuuauacagacgcgggcauuggagauucccugguguuuuggagcugaagugaggaguuacccuucuuguggcuucaagcaccucgcuuuuaaagcucggcucacuguuaacuuggaggucuuuuucuccccagucccguugucuuucauuagaacuuggacuugaaguuguaggugggacagaaugaguggucucgguagcucugugucuguacuucuccaccgcauguccuacugucauuugccgccuaccugcuguggucucuuuagaaugggccagagcuuuguuuauguuuugcuuuggcuugggggaggggacacuuagaagguuuccuugcaucagagcacuuguuaauauggauacuguuucauuuucuuaagucaaguuuacuuugguuuuugcccucaaggucauguugcaguugacacagcccguaagaaaggaacuuaagaucuccuuccacuaaaauguuccuugaaauugcaaggugcaagaucccuguugccagugguguuugagcuuucuuaugggccaccugaaaauuacaucuuccuuugucacuuucuaguccugugaccuugggcgaauuaguccucuuugcugccccuguaacccaugaaaauaaguuuguuucauaaguuuaucucauguuaggucccaauuuuaucuaacauguucauauuagacuguaacugaguauauauguaaauauguuagcacaaagcagcuagaaucgugcuuugugaauagaaucagcucaguggugaccauaccucucaaauucaacuugaucuugaugauuuuguuuguuuuugaggcagggucucacuauguggugggaagaucuuuacugcuucugccuuuaauaaugggauuaauaaagucaugcaccacugcaccggacucauuauuuaguuauuuuuugagaugauaguaguuuagaauguucuugacuuuccuuuucagcuaaggcugccucaaauucuugaucuugcugccucuaccugacaagcauuaugaauagagguguguaccaccacaccuaguucaaaauuaacuuuuaaguguuuagguacaauuaggaaagccauguguuuaaggaucagcugggcua

SEQ ID NO: 9026 - RNA, 101742 nt, Mus musculus
cgucgucuugggccgcggcgcccgaggcgggagcaagaggcgccgggagccgcgaggauccaccgccgccgcgcgcgccauggagcccgagugagcgcgcggcgcucccggccgccggacgacauggaaacggcgccgacccgggccccuccgccgccgccgccgccgcugcugcugcuggugcuguacugcagcuugguccccgccgcggguaaggugggcgcgggggacaauggccggggccgcaagcagccacuuugcaaguugcggacgaguuggagcgcgcuccgggggaccacgcgccgggggaccucgcgcgggcccuuugucucucccgccggggccccucccuggggaccgagcccgccaggugcggcgcgggcgggcccucaccugcccaaggcucgggacgccgggcgcgcucaggagugcgcccacgggcaucgcgauggcccgggacaggccuggccuaucgcgaacuacugggaaaacuuuucgcgagccugcuugcggcggccggccuaccgagcccugggaagugccagaaguugcuagcuaggaaguucggagagcccugcgcggggcggccuggcccugggcugcugucgcuuugaccugcgugggcugucagccuuccaaaccgacugacaccugccagguguccccgugaccccagugacccaucugaccgcucgggcccccaagcgguggccaggcacccagccccgcugaccagugcccagccccgagaucgguugcgugggugccuugguguggggagguaugguucugccucaguuggacccaccuuuagggaaguggcccgcucgggaacuuucuaacuuuuuuuugguguguccugagggguggagcugaggucaggaggacucucgagaaacgaagcaguuggaaacgcuacacauguucuuuuaauucggagauugccaugugguuuuuaaagcaaggcucuugccaccuaaaucauuguuuucggguguuuguguuuuguuuuucuggaguguggcuguccaaggguccggcagauacucuugaacucccgggugguggugauggcaguuuggggcgggguaggggacaaccucaggucccuuugucugggccuuauuaaggcgaacagcugucccccuguguauuuccaggguagacacuugagggagguggcugggccuggcucugugcucagauucccugggcugcagucucuuccaccuauguuuggggggaggggucgaggggagcuggcuucauccagucuuggagcucucaagcucagccagagggcucuuggggagucucccccuaaauuugucucccucgggaucauguuuacauuuucaggccaucucugguguuagcaaaacaaggcgaagacaaaacugugacaggcugugggaaguccaggccaguucuacucuucccggaaaugccugggucgugacugcagaagggguauggggcagcuauuuguuuuaaaggugggguuuguaagccgacuuuccuguccuagguaggauugacauuacucugggauccccuagccugucaucugguaucccaaauugaacaucuuuauaguuugguggugugugcggcaaaaauagagucgauuauuuuaacauuaggaagccaggccccaggaguaccagcugaugggguaguccaggccuaaaauggaagcaaagagaagaaucuuccugaagcucuuauuugaguguuuuuggcugugcgacccccaaaugucugucugagauucuugcuuugggagucuggagagaagggagugagugggcagcuaauuauuuuuccugauugcuuccuguugcaaauugaagcugugagcccacagaaaagccuuuguucuaguggucccugaauuccccauucuggaagcccuaggcuuuccuucucaccgccuaaagcacucacuugucccuggaccagccuagccugucuggcccccuggaggagguuccugcaguugugggcugucuaccccugggagggcccagccagcacauguuggguuauauuggguuaaaugcugagcagaguccccucugugcaagaaauuacccaggcaaccuguuuguccuaagcuucucuggggaaagccaccuccuggccccaacauaguuggaacccuuuuuauuuugacuacacagugucauuacucaggcaucuagcagaauuugcacaggggugugggggugggguacagccaggugaggacucugucaccugcuuugcaagugggugccccaggguuggagcaggaggugaucaucugaccaagguguuuuguuuuguuuuugaggcauaguuucucuguguagcucuaguugucuuggaacucccuuuguagaccaggcuggccuccaacacaaagauccaccugccugugcuuccugagugauggauuaaaggcaugggcuaccaccacccagcucuauaggguuuucauguccaguugcuguuugucuuugggaggcuuacauagccucucugugcugaguccucucuucucuuauaucguucggugggaagcauuugguacaugcagcccaggucugggguagugguggcagagcuuugaggacaguugugugucauggccuuugaucuggccugggaauucuggagcuguuguuacaugguuuggguuuuuuuuuuuuccuuuuuguauguucauaugugugcaugccugugcauguaaaggucagaggucagccuucagugguuuuccucaggagucgucaugugcauauggaaauuaaaggucaacccggggaagugcuucucaagaaccaucuaccuuguucuuugagacaaggucucucacuggaacuugggucucacugauugauaaaccucugugacuggcucuuuaccugaguacugggugugugucccgcuugauagcacacacuuucccagcugagcugucuucucaggucugggcuuuucuucuguguugugaucuuggcuaccaaguggcugauggcuuuaccucugcagccacagaugaggauggggaaauaaugccacaugggcagggcccuggggcccacagccgagugccagccuugccacuuaauguggggagguaggcagaugacuccaucuugcuucuccccuuagcaacauggucaugaaaauccuuucugccacuaauuuagugacuucuuaauggagucauggcugccauuauguacccguuuuucuggugacuggugccagguuaggcuuucuaaggacaguguggcauacagacagucucugugccuggugucauggggaugggcauguuggggacaggggcuaugggcgaaaugaauccugggcacauagaccagagagguuccagucuacugugagaggucagcuugugcugugugaccuagaggcuaggaagccucuggggagauugaacaaggacgggaggacacgcaaccuggagucagucagggagucugaggugaacaguguggagcugggguuauuauuauuauuacuuuuauuacuacuacuauugguuacuuuuuuaaaauuugagaacagaguugacaguaacuguguucggcuugaaacuagauguguagacuagggugaccuugaacuacucacaaagaucuuccugccucugccucugccucucgagcacugggauuaaagaugugugccaccauacuuggcucuggaacugauuuuuuuuuuuaaaagacuuguuuguauuuuaaguuaugugugcacgugugugagugcaguuuaccacugggguucagaagagggcaucgauccccuggaacuagaaguacaagccauugugaggugcccagguacaugcugggaccacacucagguccuccgccagagcagaaacuaugggagcagcagcuggguucacugucaucuaagauucacgagguggaggccggaggggccccagcucaaggucagcccucucccaucaaccaagaaauaaaaauuaaaaauugggauuaaagguccuggagagauggcuuagugguuaaaaacacuuaaccuggucuuauuagaggaccaggguucaguucccagcaugcacguggcagcucacaaccauuuguagcuucagucccaggugauccaucaccccaucaccccucuguggcacauaaauagguaaacugugcauacacaugaaauaaaagcaaaucuuacaaauguugggguuggagcuuacaccuaggaguuaacagcucucccaagcaugccgggcccaggcacuggacuuauguggauuacagucauuauuauaaaaccuuuucauuguuccaaagcaaaccccauuuuuauugaacagugguuucccaucucuuuacuacaguuuuuguuuugugucugggaucugccuguucugggcacuuuuggagggugguaggagugaugguaucuuucuguguugccuaggcuggccuugaacuccugggcucaagugauucccccugccucagccuccuggguaguuagcauuagccagcuuguaccuggcuggauuucauauguauucugucugacaucuuuguagcauguggcaguccaucccccuuuuuauggcugagugauaucugcuaugcagauagaccagaguuuaucuguuuguucacugguugacuuguccugguugucuguggcuuucagcaaaugagcugcaggggggcuggggggggggacggggacggggacgggaacgggacuguggcaggagguucagaagugugacaggcaauggggacaagcuggacagacugugcuggccuccagccagucuguguuucccuucacauccaucugcauggagccuggguccugagaguguggaaugagucuccuguuuggccucccagggagucucagagggagcuggacucuguggucaggaggcaccaagcuggaucacuucuuagccucuagaaacaggagucuguggggcaggcguggugggagccgagggcugcacccagcuucugggcuucgugacucugcucacauuugcuuggaaagccucacaugggcucugagccagccgccuggggcagagccguccaagugugacggguggaggcagcuguggagcccacaaggagguagccccaggccuagcuggcgggucuaccccgauuuccuuccagccucuggaaaguggcuugcuggcucuuagccucaguuuccacaucuacaaaauugagcugaucggccagccuugccagcaccugugggaucugugaggcuugggaggacacaguguuccuucccuuaccaccauagugagggagauacuuggaggccgccuuggauacccaggcucccuuuaaagggaggcugagugcaggcugcagagcugaacuucuuguccuguguugggcagagaugcugcagauuaguucuuuugggguggccaagccaaaacuaaaggccccaccuggcugagaggggacuugggccauuguguaaguguccugucuaagucauauaggauuuguguggcagauauagugcuuuugcuagcguaguagguguccuuuggucccugcacucagccccaagggaucguucguuauguagcucuagccuugggcuuccggcgcguccuuggcugcuccugugggaaugguugacagcucagugacuuccagugagcacugccuccugcagaaugguuggcagcucacugacuugcagugagcacugcuugaucaggaggacccugguccacugugguaaccuugauuuccaguggaaccugcugugccccgaggggcccucagcaucuccuguuuucugcuccucaagccuggggucucuuggccauggacccuuuggaagguuuuuauggugacaugugcccuuuuagggguagaaggcugcccuuucuggguguuuuccuaguugucuugugagaugacaaguucugggggcaucuacuuucagcuugccagggugccguuuaccuuguggcuaaacugaggcaugguuuugucaaggaaggggacucagccucucugggagucuuggggggucuccaggcuccuccagaauugggcaguggcuccucuccuagaaaggagcccaugaggcauugcaugccuugggugucagugcaggugucuaggacggcuaagggacccgcaccccaucacggcuuucugccuucauauggagcccuggaguguccuccucuugugccucuguuuucauaaagguaaacgugagcgggcccauucucugagguccuuccaagccuagccaaguuuuuaccugcuccucuugccuggcucuguugcuuccaaucugucccuugcgaguguaguuggcaccacacuggccucaaaaguguucucucagguucuuugcagcccuuccaguaucccuuucaggucuguucugcugucucaccagccuauggggccgcccaaucucugcauucuuaacccugggacccaccaucucuaguagagccugucuguguuguugguugcaguugucaacgugacacaaucuaaaauugcuugagaagacagauugucuagaucaaguuggucugugaacacgugugugggcgauugucaugauuuccuuaauuggggugggaagacauugucggugggaccauucccuggguuugggcccugggccauguaagaguggggaaaguuugucucuccucuugacuaucaaugcgagcaccugcuacaaguucccgccuuaauuucccuguagugacaggcucuagccaggaguuguuaaccaaauaaccuacaaguucccgccuuaauuucccuguagugacaggcucuaaccaggaguuguuaaccaaauaacccuuuacucccuuugaguugcauuugucagaguccccucccacaccgccaaucaagggacgaguucuguccuucauuucugaacaguguuuguuuguaugaguuuggccuccaacaguuacccaccuggggccgggggugggguagguggggaaaguacagggccagcuagaagccuguaccugagccuucugcccuucuggggguucucucaacauguggcugagccacacuggacugugcuacgaagguuuggcagucaccaaugucugcgucuuaggccuuugcuuacagucagaaaauaucauuuuaaagaugguucagcgaaggcugagaggcuguggugcucuacugccuggugcgggcccugccacccacugcccuuugacuauaacaggucacaccaccuccucuugguaacagucuagugacaguagaagccccggugagccugagugggcaccagggugugcuccaagcuggugacugcguguuugcagguuggccuuuucuuuggccacuacuuacacagcuggaagcagggauggucuauuaggagugucacaggagcuaguggcaguccgacccauuguggcuaagguggacaucuaggcauguagagcauacuugaggucgaucaucaugugcuggccuuauguagagcccugucuacagccuuucccauaggugcccacccaguaggggcacugcuagggguuucaggcugauccuagcuguguguguguguguguguguguguguguguguguguguguguguguuuugaauccaaggcauguccucagcacacauucuacuguugaauguacccuaacuccuaugucuuaauuuagaaaaacauuuuuuuuuuuaaagauuuauuuauuuauuuauuauauguaaguacauuguagcugucuucagacacuccagaagagggggucagaucuuguuaaggaugguugugagccaccaugugguugcugggauuugaacucugcaccuucggaagagcagucgggugcucuaacccacugagccaucucaccagccccuagaaaaacauuuuuuaaaaggaagauuuauuuaccguauuguauauaugaguguuugcuuuuaugacuggcuuguguuacaugugcauguacuguccacagagaguguagaaucccagacaugggaguuaugcagggguucggagcuaaaucaguccucugcaagaguagucaaugcucuuaauauauaaaccaucucucuacucuccagcccuuuggaucagcucccccuaccccaacugcaauaaauuguguacagcacaaaacuugccaguuuuuacugcuccuuuuaacuuaaaaaguuauuuauuuacauguauuuguauaauuguuuugcuugaauauuugucuguguaccauaugugugcuguuuguccacagaggccagaacagggcaucgaagccccuggaaacuggaguuagaguuacaguugugagcugccauguggauguugggaaucaaacccagguccccuacaagagcagccagugcucuaaccacugaaccaucucuccagcccuccuccuuucuaguuuuuguuuuuguuuuuugguuuuuugagacaggguuucucuguauagcucuggcuguccuggaacucacucuguagaccaggcucuguagaccaggcuggccucgaacucagaaaucugccugccucugccucccgagugcugggaucaaaggcgugcgccaccacgcccggccuuucuaguuuuuauuacacuuuguuuauuguaggggagugguuugcaugcuguagcacacaucuaaggucagagaacaaccugugggagccgguacucucuccuuccauguggguaccuagggauccaacucagggcucaacccucagcccccuaaccaucacucugacccuugacuguaucuaagugugcagagaucugugacacuaauacaaauucccaucacccaaacagaaauauuuuaccuauaagauggucucuucccaucucugcucaccccugccccugauaaaaaucuuccugcucuauguuccuauaauuccccuuccccauuuuuaaagaaagggcuucucuguguagcccaggcucuccuggaacucacucuguggaccaggcuggccucgaacucagagaugccugccucugccuccugggugcugggauuaaaggcgugcgccaccacugccuagcugauauuugcugauacuugucuuuauagccuguuuuauaccuccccaugggcauagcuuuugaccuguauuuuugcuauauuuuuuugcauguguucaucuuuuuuuuuaaaaaagauuuauuuauuuauuauauguaaauacacuguagcugucuucagacacaccagaagagggagucagaucucguuagggaugguuguaauggaccaccaugugguugcugggauuugaacucaggcgggugcuuuuaccugcuaagccaucucaccagcuccguguucaucuuuuuaauguaaaucugaccacucucucggcaucuguagccugucuccaccugcugaccuguuggaggcguucucuauacuuugcuuugacuccuuguucuuuuugaaagccaaguggugguguguguggcaagcuuguagcuugguguggguauuaauuguuugguguauuuguuccacauuuccuucaggucuguggcuaaucuuuaauaucauaaagaccuuaaagcgccuuugccaaguauggugguuuuugacuguaaucucagcacucgggaugucgaggcaggaggauuaaguuugagguuagccugggcuacacagugagacccugucccaaacaaaacaaaacaaccaaguguggugacacuugccuguaauuccagcacucaggagucugaggcaggaggguuucugugaguuugaggccaaccugggcaauauaguaagacucugucucaaagaaacaaaaaauguuuuguauaauugaaccugucaguuuuauuucuuaaggcugcaugucuuuucauucuaacuccagauucuaaauucuuucauuuuuccuguucagucucuguuuuauugcuuuguauucuacauucagauuaucuaucuuccuguuuguuuugagacagggucucucuguggagcccuuucuggccuggaacuauauguagaucaggcuagccuccaacuccuagaaaucaucuugccuugccuuccaaguuuuaggauuaaaggcaugcgcuaucacaccugauuucccugcuuuuuaaaaaugauuuguuaaaaauuauaacuuuugggcuggagagauagcucaaugguuaagagcacuggcugcucuucagaggacccagguucagcuuccagcacccaccuggcagcucacaaccgucuguaacaccaguuccaggggauccaacaccuuuacauggacacauaugcaggcacaacaccagugcauauaaaauaaauaaauaauuaaaacucuaaacuuugaugcuuuaugugcauaguauuuugccuguuuguauauuuguauagcguccacauguggugcccauggagaccagaacaucagauccccugggacugcagcuguagaagguuaugaacuucuguguggaugcugggaauugaacccugguccucuggaagaacaaccaguguucuuaacacacacauacacucacacacacacacacacacacacacacacacacacacacucacacacacacacacucacacacacacacucucucucucucucucucucucucucucucucucucucucuuugguuuuucgagacaagguuucucuguauaguucuggcuguccuggaacucacuuuguagaccagguuggccucaaacucagcaaugcgccugccuuugccucccgagugccaggauuaaaggcaugcgccaccacuguccggcuuguuuuuaacucuuuuuguuguuguuguuguuuuuauuuuuauuuuuugguuuuucaugucaggguuucucuguguagcccugacuguccuggaauucauucuguugaccaggcuggccucaaacucagaaaucaaccugccucugccucccaagugcugggauuaaaggugugugccaccaccgccccgcuguuuuuaacguuuuuuuaagauuuauuuauuuauuuauuuauguauuuauuuaauguaaguacacaguagcugccuucagacacaccagaagagggcgccagauuucguuauggaugguugugagccaccaugugguugcugggauuugaacucaggaccuuuggaagagcagucagugcucuuacccacugagccaucucacuagccccuguuuuuaacucuuaauccaucuuucuagacuaaaagauuuuugcuuuaauuauguauuuuuuccucucuucucuuucucucuucucucucucuuuuuuuccucucucucucucucucucucucucucucucucucucucucucuguguagguauguucaccuuaguguccacagaaaccagcaagugcugucauaccccccggggcuggaguuacauuugguugugagccacuugacaugggaucugagagcugaacuugggucuucugugagagcagucagugcucuuagccacugagccaucucucuagccccugacuuauuuuuuaaguauauggucugauaugggcaucuagucauugaauggggacccgccccaacaccuugauggaauggcuagccugucucuauucaacuagauugccauucuucccugugugguguccuguccccaggccugacuacugauccuggacccuuccaccagguguccugucauaccucucuguccugaucuuuuuguuuggagauaacugugcaaaucuguccccaguguucuguuuggaaagcuuguugacugucuuuggguugcacagucagccucuugaccucuuccuuugaucucggucugggagcaguagccggugacuucuaacaggugucggggcagauaugacguguucuccagccccuggcuguggaagucaauucacuugccaucugugguagagcccuuccuaucaucugggguuuucauuagacacuauguuuugcuuucuagaggcagauagugggauggucuggggacacgccugccgccaugcucaccuggagagcucccaguggaagggguauguaauuaaucacuaagcaggugauugcgcucuccuguaaaucauuagggaauaaaaggcaaguggcucccagcacuucccugagcugugccucucugcuagcuuggaugggaagacugcuccugccuggcagagcucucaggaaauugcucaauggggccauuaauagcugcccaguguggccuagccagagcucagccugggugcccuccagccuuugucccugucagcagcgucagcuuagauccuugcaucuacagggggccaccagggccuggaacuggagccagacauaaugcauaccagguggcuuugggcaagauaugcucucuccauuugccuugggaggccaggcaaccuuuccauguuguccccaacccaacuugguuucuccaggagacugaauggugugaguuagggugugaccacaccaccucagcccucucucugcucauguuggaagcucaggguggaugucauuucuaacccuuuuccucacuuagaccaucuaggcucugaggucucacccguggcccugcagugcucauuugguaaaaggucagaugggugaugauguuggucaucaugcuuucuagaaccuucuugcugaucugucuucuguucuagacaaaauaauuugggguaugugugcauguauguguuuaaacagggucucuuuuaucccaagaugcauuuccuauauaguugaggaugacugacuuuuuuuuuugguuuuucgagacuggguuucucuguguagcccuggcugucuuggaacucacucuguagaccaggcuguccucgaacucagaaauccgccugccucugccucccgagugcugggacuaaaggcgugugccaucacgcccagcugaggaugacugacauuuugaucuuccugguucaguuauagguaugcauggccacucccuguuuuagucggugcuggggguuacaaccagggcuuuaugcaugccaggcaagcacucugaugacugagcugugucucugacccauuuucuuuguuccccuuaaagauuugauuugacuucuaaucauguauguguguguuugugucugugcauaugagugcagugccugaggaguccagcagagggcauuagcucccuggagcugcaguuacaugaaguuaugaacugcuggacauggguguugggaacggaacuugggucuccuggaauugcaguugagccaucccuacacuuccucauuuucuuuuuuuuuuucucuuuggagacaggguuucucuguguagcccugucuguccuggaacucacucuguagaccaagcuagacuugaaaucagagcacugccugccucugcguccuaagcacugggauuaaaggugugugccaccacuccuggcucccccauuuucuucaaacccgguuuucauugugucuuuaaugucucagcuaagcuuuccaguucuauaucguauaacgugggaguauuuuggccuggcagaccuuuccuacuucuccagcccgaaugaucuccacaggguccaggaccgucugugcaucaccaccccuacucugggaagggugaucuucugcuaucugacuuugagggauaccuguccugccucaugguuucugagcauugugugagacccaccuugcugcagcaguuacugcguuggcagagccguuugcgcggagcagcccauggcucccgaacacagcucauaauaagcagcagccucugugauaccggcugaccuugugagcccggacucugugauguugugauggggccuggcauccgcaaacgucguagcccggacucugugaugucgugauggggccuggcauccgcaaacgucacaugaugccuuuauuuauucaaugacaguaccuuaugaggcuccgguuggacucagacuucugcguagcugaggucuugaacgucuauccuccugccucugccucugccucuugaauccugggaccauggguaugugccaccaagcccggcucauuuuuaucauguucaaaaagcucucugugacccuuuuaauuuuggaaaaaagaaauacuuggacaaauguuuaguuuucuuucugugugucugaaugcaugcugugcauguaggugcccgcggaggccugaagagggaguggaucuccuggagcuggaguuagaaguguugugagcugcugugugggugcugggaacugaaucaaguccucugcaagaacaggcagugcucuuaacugcugagccaucacuccagcuccuuuccugugguauuuagaauguuggcuuuaaugagaaacauguugcccuuucuugauuguacccuccaggaguuccugugccugaguucuggucuugccuccucucccugcucccgcucugaggaaacaguucuauugucaugcuggucaguccagaaggcucugggguggcauuaaaacuggguauuuuacaauggagcaugguugcacauguguaaccccagcacucaggcaguagaaauugggugaucagaaauuuaagcuuauccucaguuacauaguacauuugaggcuagccugggcuacaugggaccuugccuuaaaagggggugaagggaaagcaaucacaacacugucauuggagcuggagacaaggcucagcucacugguuucugccguggucccagggcugugcugccuuuguccauguggcugauacagacggaucagcaguggaggagcggggucuucuuacguugcccugcgcugucagaaggcuugagagcagcagguagauggacggacacacagcaagucugcucagugagcacugugggaaggugacaucuagaccgugcucauuucaaucuugaggacauugucuguuagagaaaaucuuucuccuuggguccgugcucaccgaguagaaccgggcggcugagcagaguagagccugcaggcagaggucucugggugcuuucucccuuucuuccugagugcccaauugcagaagcuuuagguuggucuuguggaagaugucugucuccuagcugcagacccuuaggugcccauaaagccuggguagucccugugaggaguugacacaugggaccugccauagucaggguuucuauugcugugaugaaacaucgugacuagaaagcagguugaggagaaaaggguuuauuuuuauuuggcuuacacuuccacauugcuguucaucaccaaaggaagucagggcaggaaccuggaagcaggaguugaugcagaggccagguugggugcuguuuacugguuuguuuacugucuuguuuuccguggcuugcccaggauaaccagccuauaggggccccacacacagugggcuggcccucucucaucaaucacuaauuaagaaaauacccuagcuaggugguggugacucacacuguuaaucccagcacucaggaggcagaggcaggcaguucucugugaguuugaggccagccuggucuacaggguaaguuccaaaaaagccagaccuacacaaagaaccccugucuugaaaagauucugacugacugacuaaauuaauuuaaaaaagaaaaaaaugccuauggcuggaucuuauggaggcauuuuuucauuuuauucuccuuucaaauaacucuagcuuggaucaaguugacauaagaccagccagugcagggccuuaaccuacauuguuguguggucuucacgucugcuguguuuacagcucugagcugaggcugaggaguacauggauccugccuaguguuauguagggagcugccgaggcagguaggccccacacaagcaggucuccaccagucuuccggacuuccuauguagcggggaagaugaggaacauugccuagugaucgcauguuguucacauagcuuuuacagaacugucagcauugcgcacaaugcgccaaucuuguuuuuuuguuuuuguuuguuuuagguuuauuuuuauaugcgugaguguuuugacugcaucuguggcuuugcaugacuggaucccuuggauguagaguuacaugauugugagcagucgugugggugcuggcaauggaacucagguucucuggaagagcagcuggugcucuuaaccccugagcagucucuccagaaaacacucccccuguuuuugagacaggaucuuauuaguccaccuagacugucuugacuugugauccugccgccucagccucuggagugcaggggucguaaguuugagucccacaccuaguucucuaaugaaucaaccuaaguguuguggagagacaguccccucccccaccaggcaccugaguccucugggcugaguugccccaggugguacuuugcaagguuccuugccuuuauuaggccucagucuucucaucuguagcacaggugacugcaaauccaccuccuauggggacuaaggaccauuuggcagauagcagucuaggaaggcgggcaggcaugggaucugugggggucagcaagccaggaccugccccagaacagagccagacuagagcuucucucuggauuucuucaguagggaguuuggguuauccuugggucucugcacaguccguguguccugguguccauaacaggcacugugggaagggcuccuggguucuucugcauccucaccaacuucuggaccugcugccccugaggcuccaagacagcuagaguccagacucacauagaauccuccaggcacgucugugcccugauaagcuugguugaggccagaaggccaggggcuagaauuucaucucuacgcccccagagaugguuugugucuuucccuucauuguuuuugccuguccauuuggccacaugguggacagaauugucauuggauccugaguuggcgccugucaccauuuugggcgguggccccugugccuuggcaccuggguucccacuuuuuuuccaggagcuguggcuuguuugaaagcagaaacuugcaaguuuggcucaauaaacagacuuuggagagcgaugauaaguuucgcggguuucugacucgucucugcacuacuuaaaggaaacaggcgcugguacaaagguaggcuuguuucugaaaucgguucuccaguuuccucuccgaggacagaacaaugugaucuuuguggccacacgggaaccacuucccucucuggcccgcaggggagggccugggccaucccaccuucucccaccuccguggaaaugcgucagugccagcuagcuggcaggucugacugacuguugcaggguuggcaguaguucucaggguguggcaccgaggcaccacagccugacugcagcuccaguccugggucccuaaguucauccuugcugaauucuuaaucugcaucggucuuggggacacaaggacucugaucucuuccugaccuugagugucaguggcucuuucccgaugcuggggacaguacccagggcuucauauauguugagcagacauugcaguuccaagccuuugcaucuagugcugguccucagugaaaggggagcccaggcucaggucacugugcagaugcaccguaugguggcugccaggaaaaucccgguguccacagaguccacgaagcccggcugcucagcuuaguuuuuugcuaaagaugggugagggucccaggccauaugcaggguaaacguggcacagcaggagcccugugccguucccagaaguucuguguaguuugugcuugcgcugcuuuugauacuuagacaguggucugaugagaacaauuccugggugugugugcuucuuacacuaggugugguuagugacgauuuccuuuguaaauaaaugcguccuccuuuggaacacccagaaaacaacagauuaaacaacugaggcuugugcuggccgcugcccaguggcugagauggaaccaccacaaccccaggaugagagauggggaaacugaagcucaaagagguagagaguggaagccuauuugcauuguaaaugguuucuuugaaauuacuuuaagggucugugucucuucuaccccugcaggcaccagguaugugcauuguauauugacauacauguagccuaaacaccugcauguguguucucacuuucuguccccuccucuugccccucccccucuuccucucccucucucccucuuuccagaucaugaaacucgccaaaggggccccuggguucugcuccuuggugucugagacacgguuaacguaugugaaacggaccuggggacaggcugcaaugucacaauuauccucuugggggaguugucugaugggcugcucuuccuauauaugaaccugaguggcuguccuguaccugguagaacaagccaggagaccuugagagaaagcugccgcugucccaaggaaggacuugccuccgucagaguguccaagcacucaguccccaggggcuccgagugcaucuccguuuugggauugcugucuuacucuuugccguggucgugggccacuuccgggagccuggcaggcugagagccaugggaccaagaugguguguaaucagaaugcuauauuuugucgaaaauaagaauguuaguaaugggcugguuucuggcaagucaaacugggacucugaaauacauauuuuucucuacucuguccuaaaccuucuaauuagugaaaacgcacauuugcagacauaaaucaaugucacgauuuguccuggggaucccugagcugguagcauuaugugguugcuaaauuggggcuuugggagugugcacaugcuuguuugugcaugcacaugugcacgugugugucagagggugaagguucaggagaagcugaguuucccagagaaguccuggaaccuuuccuuugggccaccuagcaccacccccccaccuccccccccccccccccacacacacauagacuguuaaaguucuugagugcagaugucaccaaguuaaacugauuaacaggggaaaugacuuucaugguaaaggacuuccuuucuggaaaccucuacugcagagugucaguagcuagguccagcauucugcagaggcuguuggccuggugccuccuguuagacaguugagaccuuagucaugugaagacgagccagcuuugguagguuccaugaguuccugggguuaggugcagggucuacucagcuggggucaugcagguucaacguuagacugugaaguaaugucccagagcaccccuggugauuugucaucuauacuaggggaauuacuugccaacaguccucugguggccagauaagacagucacuguccuagcagcccauaggaugugagcagagugccguggugaggcacaggugagccugucgcugguauacaucaggguuuugguuugugaaaggagcaggaggugggcuggcugcuggaagaggaucaagccagacugggcaucucccccguucuggauuccaugugccucugcccagucucuccuggcucuucucacucuauuuuauuucugacuccaggccagugcuuuucaaaauauguuuccugguuuaaaaccaaaaaaauaggacaaagaaugucaguugaguguuugccuaaugugcaugaagcccugggguugauuccccagcguugcauaagccagacaugguggaaaaugugucuaggauugggagcugggccuagcuccucuguguacacagcguggccuaggugagcugcuuagcaauaggcugugggugcucaccuguggaagggaaugccucccucauuugggcucagguuguaauuggcccacagcuggugcuggcucugcuguggguguaggucuauggccccaauguugaguggcaggcuucaguugagagcaaguagcucagacuuccacccauguaaucugauggucacccuugaagauguccuugguaggagugacccucuguugugugggagugaggacuauauaguucuggaagaggcccaggccacuguaaaaucccucagagaguugccagucagacucucgacagcuaccuuggcaggccaggagccuuuuucugguccugagucuggcuuguuguaggacauucaagggugggugaacauuguccuaggccagcaccuuugugcaacagagcuacaagcaggggguauaaggacaauugccuccuguccucagcaaaggccacacacacccugccuguuucagguccuugguggccucaugucaggcacagccuuucagucugcuguggcacaguagagacccucuagcccaugccauucuuuagugaagauugggaggcuccauccuccuuuccugcacuccacgguguccaacccagcggccuuguuuucucucuuuacauuucccuuuauguauuuuauguguaugaguguuuugucugcaugugugucucugucccaugugcacaccugguauccaugggggccagaaggaagguaucacagcccugaggauagagucacagauggucagaagccacuguguggguguugggaauugagccucuggaagaauagccaguguuuuuaacugcugggccaucucuuuaaaaugacauuuauuauuauuguguguaugugcaggcaugugugugugugggggcauaacgcauguguggaggcaagaggacaauguuguagagucaggucucaagugauuucuuauuuccuguucuacccccaaaccugcucccccauacguuuccugcuugccugcuucccugaccuuugaaaugugguuccugcccgggaagcuugccuaaaccucagaguuaaugaaggcuuccucuggugccgugagugugugugcacaugaguacucuugccuguguguguacuggcaugcuuuugcauguugcauuaggaugugaucaugagucccaugucugaguguaagaaugugcuagggcuggagagacugggugaaguacugagaggcagugaaacagacgugccugugcagagaggcagaggacaagcugcacccuucagugggggugucuggaugcagaggugguugcggggaacagagaggguuggaauuggagugugaggacuuggugugaagagucgcucuaguucuguggccugccugcacagaccugauguaauucuguaaguggggccagcuccccauucuggccaguccaagauaggguuugugguauucuggaagcuucuucucacugccucacuaguacagugggcacugcugggugugcuccugaggauucccuaacucuguuacaauaagagcuuucagggucccagucagccucuguugugggagauguaugcuguccuuuugagugggcugugcuuacauuucuggaugugcagccuggccauggcuguuuugguuuugacacagaugauggucuuggccagcugugauuugugcccugcuggacuuaucaguuaugcauaccccaaagaggugaguguggcugcacuggggaaggugcacaugacagcaucugggaagacagggguuucccccccagaccucggaaaccagguagcucugagccagguguccuaucagccaggugucagggacuacagagugagaauggcuaaugucccagagguggccugauagaauauguuggcaacuggggcuguucugggaaguauggaugggggcugugggcaagaagaggagguuuugugacucaguggguccagagaccuguggauggauggagagauggauagauggguagggagggcuauagguagcucagcucaggaggagguggggaugagagccaucucccauguuugcugaagucuccauuaaagguaggucugugguaggguaggagggauuacaagagaccuaagguuuuauucuuuguaucaaacuguucauuuccaucaauacaacauuagauugucacugagagcagccuuagcugggaucgagucccugugaagauuugagauucuguggcugaggacauggcugccauaguugguuggguuugaguggcucugcuacuggccaagagacaaauaugaugggucccagggcccagggcucuggggaacuguggauuaguguugguucuuccuuuuauuuuaauuaguuaauuauuuuguuguuguuguuggacacaggauuuuucuacauagcccgggcuguccuagaacuauauagaguaggcuggccuugaacucccaaagaucugccugccucucccucccccagugcugggauuaaaggcauguuggcacuuucuuuuacuugacuagggaugucaguggcacagcaaugagcacucucuuuguucuuggugacuggagaagaagagcagcccucauugcuucuguugagcuuucucuuugguccccaucauuuaucugaagaugccucuuagaaaagcauagagcuuccuggcuugugcagcacaguccaccacccuagccugucuucuagugaauagcucccaguggccuuccugggaguuuuguagacugucauuguucugcugguacuauuaaaaaaaaaaucugggcuggagaggugguucagcggucaggugcuagaugcucuuucagaggaccagaauuuuaguucuuaguagaagagauggucaauaguugaaagcacuaggcugcucuugcagagggcucagguuugguuucuaggacuugcaucgccaagcacaaccaccugcaacuccgguuccaggggaccuaaugcucucuucuggccuccgugugguaccgcacacacauggugcacauaaacucacacagaauaauaaguaagcaagcacacauguaaaugaaguaaaugaauaaaaagcuguacuccuguaaucccaggaauguagagacagaagggacuugcuggccagcugggacuagucugggcaaaucaguaagugcuaggauuugagagacucuguuucaaaaaucagugaugggggaagagacuaacacacacacgcacacacaauacacacacacacacacacacacacacaauacacacacacaauacacacgcgugcgcgcacaguguguccauaugcauuaaaaauagucucaguugaguucucugggcagugagggcagugggaagcucugacugggcaguaucagauauaagauggaagaaggugaguggagcuagaauggggagcccuggguccuguggaugggguacaaggauguguauaagugauccugugaguaucccaagcugguagccauccaguguucaggugcugaggaggcugaggugugucccauaguagaaaucauggaugugagaugcauagcugcagcuugaugucucuuuggggugugaucaccguuuucuguguugucuuccuucuuugagaccccagccuccuuccagaaagcuugcgcaguacacccacgccuggugccaccaccuuggagcuccuugcuuaggugcuguguggccgugugaacuaugccuguguguguaugcucuccaacuaaguugguagcuucuuguaugugaacccuuauucuuucuguggcuuggccuuccccauugggauggugauagaaucuccuccccacccccaugcaccgugugugcacaggcuccuacacacucuccaaguacucagagguccaauguaaugcuuugugauuauaaauaaggcauggaccaaaauugcucuuuauuuuggggucucagcaaaggguugaauuaccuggaauugggccuuguuugggguaaccacgcaaacaguguaaaacaugggcuauuggaguggaaggcaaaccaucuguuaugaauucuauauauaaauauuggauauacuuacauggguuaaaaugggauuguuggcacugggguuuucagagucucaauucugcuguggcagggacgauaaacuaaucacagggcaugguggccaaggcagaagggggccagggcugguguuuuuuucugacacugauuugaugggguccugggagcgauugcuguacacacaucagggauaauucugagcuauuuggcuccccucccugacuguggguacugaaaauuucuggggauaugggacaucuauguucuugcuuugaagggguauauacaaaacuaaacugauggggacaucaggguggaccaagggagcugucauaucauaggggauuuggccuguucagcugucagcugggucuuuuugaaacauuaacucuuugcugucaugguuuugagacaagguaguccaggcuggccuugaacuucucauccuucugcuucucaaguccauguccugggcaugugccaucaugccaggucaaaacauuaguuuuaggucugugugugaagaaacaguaucagcagaguguucuugcuuuggaucucccaucugggagccaggccagaaugaaacccaggaccccaaguuuaaugacgcugacucuagccuggggagcacuugccacuagcagcuuccaggacagcauccucacauuugugacuugagccccccccccccccccauuucacagggaagauacugcugccccugggucccuguguagagcauacucugagaccaccggugcccucccuagaggucuggauucuugccuugucauagucagcuucaaaaauaauacaugcauagauagccccuuagcaacagaaguggguucagcauuagcauuugaaaauacauauuuaccaauccugaggcagagaugcuucuaguugaccaagccuuuauuaguccuugucaccaguuagugcucuuucaugcccucaguguacauggauucauagugauguggguguguguauccacacauacacaugugugcaguuauauguucauguaaagaccagagcucagcauuggaaaucauucuucaggagucauuaucuuguuuuuaagauuuacuaaguugugugcucguuugucugccuguuuguggguaugugcauaaaaguacagggaccagaggugcugugugcccucgagcuggagccaccccuggauucucuccaggaucggcauaugcucuuacugcucagccauuuauuuugugguccuuaauacagcaggugcuaugguauuguccaaaugcuuugucccagggucaucuuugucuccuagaggauuuuucacaaacucccuuuccuuucuuuuccuuuuuccuuuuuccuuuuuccuuuuuccuuuuuccuuuuuccuuuuuccuuuccuuuccuuuccuuuuuccuuuccuuuuuccuuuuuccuuuccuuuuuccuuuccuuuccuuuuuccuuuccuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuuuccuuuccuuuccuuuccuuuccuuuccuuuccuuuccuuuccuuuccuuuccuuuccuuuccucccgagugcugggaugaaaggcaggcgccaucgcccggcucacgagcuuuucuuagugaucuuuuaagggucccaaguguggugcaagcugggccauggggcuuaaccccuaacaucacucuuggugugacuuggcacaaguguaugcuucuuuaugaaggcugcagcucugggccuggagaauguauaccaggaccccuagucuaccaggggcugugcauuugagaggcaugggucaccugguaggggaggaacccguaggaccagccuccugacugaggcuggcacuguguguuucuacccugggaacuuugcauggguuuuaaugaggccuccccuaaccacuguauguagugugcagccuucuccuguucuguucccacuccuguccugucccugacucuggcccauucacagcauuaaccugacagaugucacuaccugcuuuuggucuuugcccggugucuguuucuccacuggaacgggaaccuuggaggccccugguacaagcagccccugcuugccagccuaugaaggcaucuugguuuugccacuguggcucuuuuucuuucacucccagaacuuucuuuuucuccuccugagcuuuccuuugcagcuucugcccuugaaaaggagaggcugguggagccuuggggugauacagugucuguguugucuaggauuccccaggcgggggaggagaggagaagcagccugccccaggugaggguggggagccacccacauucuggccugccucacugugggucccuggggccacugccaggccucuuagaaggaaagcuagcuuuccaggaguaugcuguggguuccccuuaaaacuuagggauuaagugugugguuucuuuacuuuucagagcugggagcacugccccaccaucucccagugaggguuggagaaaaaaaaaguccuagguuacaaauccacccccagccucccugucccugccccugcccccuccccucccaugugccuuugaagagcacaccugaacuacugaaagcaaguugaggugaggaaguggucuuuccaguuuggggagcaguagagccagagcuuggggauuuggggagccuuccugccucucuauacuggccuaucacuaagggagccuuugggcaacuggaaggaaggagucuugggagcaggggcccgggguagccgugcaugauucucuuucccugggagcugguuccuguccugcuuagccauccugacccugugcucugcccacagccucaccgcuccuguuguuugccaaccgccgggaugugcggcuaguggaugccggcggagugaagcuggaguccaccauuguggccaguggccuggaggaugcagcugcuguagacuuccaguucuccaagggugcuguguacuggacagaugugagcgaggaggccaucaaacagaccuaccugaaccagacuggagcugcugcacagaacauugucaucucgggccucgugucaccugauggccuggccugugacuggguuggcaagaagcuguacuggacggacuccgagaccaaccgcauugagguugccaaccucaaugggacgucccguaagguucucuucuggcaggaccuggaccagccaagggccauugcccuggauccugcacauggguaaaccucuguuuuucuccugcuccuauggggaggcgcggggaacaggauuucuucuguagaguaccugaggcaggcugaugaggugccuugggaagcagcccuugcugggaaucaccucccuuccagauccugaacuguaaaacauggcauguuuagccagggauggugguucacaccuacaauccuagcauucuggaggcugaggcaggaguguugccacaaguuccaggccaaccugagcuauaaagaccgucuuaaaaauauacaggaacuggggagaugccuccauuggugauguacuuaccucguaaccaggaggauuugacuuccauccaugaagaaaguuaggugcggggcgucacaugucuauaaucccaggaccguggaguuagagacacagggaucugugaggcuugcuggcugccugcagucaaauugcccagccccuggucccagugagagacaagguguuuuaagguauuuauauugccgucuuaaaaacuccaugaccaagaacagcuuggggaugaaucagucaguauacuugaucagacaauacucaagucaugccccaccucugaguaaagucagggcaggaccucaaggcaggaacccagagucaagaacuaaacugcuuagugguuugcucuccauugguuguucagauugcucucuuguagcacccaggaccaucagcccaggcacugaacugcccacagugaccuguacccucccccaccaaucaucagccaaggaaaugcuucccaggcuuagaggccaaugcaaacugacuguagcuuagcugagcaggacguugugucucaaucaaacacacaaacaagggcagaugaggaugaugcuuggguuugaagcuuagcauccuucugcacuaggacaggugacccagguaaguucagggaccucccaccccuucugugacuguuggcugugguggcucugugucuggauguagcaccuacucuguguauucuggaaguuaccuauauuggugcagucaacucacucugacccuggaaagcgcaggacagccaugaaggccacuuugggaggggccaacagucaaaccgugaauguccuucacugcagucuaggggccacugcuggcuucagcaucaggccacauucuacaguguucuagauaggcaugucuucguucacuccuugccauuccuccagccuucuuuucucaggguugacucuggggugggaugcacagacccuugucuaagcugcccuuucguggccaugacccugaaguuguaugcuggcucaggugugagaacaaucagacagacucacggacucacgucuugggcaagacacacauccugguuuuggcuuuugccuagugcuguacucaguugacauuuuagcuuuuuuuuuuuuuuuugagacaggguuucucuguauagcccuggcugucuuggaacucacuuuguagaccaggcuggccuugaacucagaaauccgccugccucugccucccaagugcugggauuaaaggaaugugcuaccacacccagcuuuuuuuuuuuuuuuuuuuuuuuuuuuuuuuuaaagauuuauuuauuacauguaaguacacuguagcugucuucagacacaccagaagagggcgucagaucucguuauagaugguugugagccaccauaugguugcugggauuugaacucuggaucuucggaagagcaaucgggugcucuuacccacugagccaucucaccagcccuuuuuuuuuuuuuaaagauuuauuuauuauauguucuugcgcaugccugacucaccagcaagaacaacgcugcaacaggauccuucugcacacauuuauugggagagcuugauugcagaggcgaagagaccccaagcccagaacuggugcugcuuauauaggccuaggagaggcaugucucacaccgggauugguugugcuuggguuaugcuuaccaccucauuugcaugccuacaucugauugguuaacuugucucucaucugauugguuaaguuguuucucauuugauugguuaacuuaucucucaucugauugguuaacuugucucucaucugauugguuagcuugucucucaucugauugguuaauuuugguuaauucucaaaaccucaucuuggcaaaaaaagcuuuacugccuauguaugcgugguggccagcagaagccagcgccacccugcaacggcacauguggcuucccacaauauguuaaguacacugcaacugucuucagacacuuuuuuuuucuucucacucuggccccauugccuugcuguagcugucuucagacaccccagaagaggguaucagaucucauuaccgaugguugugagccaucaugugguugcugggauuugaacucaugaccuucgaaagagcagucggggcucuuaaccuuaaccgcugagccaucucuccagccccccccccuuuuuuuaaaagcuaauuuauuuacuuuacauccugacugcagucuccccucccuccucuccucccaguccgugcccccaacauuuuagcauuuguaauguccccagagcuucugagaaaugcauccaggaagcacgaugcuggcuguggaccuccccuguguguuuguauaaaccuuguaggaagucugugcagccaguccccguguagguuaggcuccagcugacccaugcacugccuuuuuccacugcuggggauccuaaguucaucuuuuggcucucuagcaauggagugcugucuggauccugauagugccaccuuauugugagccuuuucagugagcuacucugggugacuuuagcugcccuggcuguggacugagcagaagcaggcugggagaguggguguggccugugcccaggcuucugagcuuggcuggaggguuugcguguggucuggcaggauugccacugcuuggucuagggaguuugaggagcagaccaggugagggcacacuauguggcugaagucacuucuuuguccagagcuggccuuugaguauguggcuucagaagcuaauuuauacuuugugcaaagggccaggaagugguuuuguguguguguguguguguguguguguguguguauguguguacacaugcugccacauaugagaguauauaugagaaaccugugugcaaauguuacgugaaugugugugaauguuuuaugugaggaagucuaugcaccuggacaagugugugcaggggugguuguguguaagcguaacugugccuguuuaugcuuguaugugaguguguauuuaugagaguguaugugcacauacaugaguauacaggagauucugugcacauguaugaaugugcuuuuuaugugagaauguauaugcauuuguguguauauuauuauacauaaggguuauugagcuugugcacacaaaucuaugugacuguuaaggugugcauguguguguguguauauauauauauauaaaauuguguaugugugcauguguacuagagagcauguacgugugauugagugugugauagagcaucuguggaugaguacauguguuuguaaagaagcuugcauguauguauguguucaguucauaugcaccagagguaagugggauuuuuuggggguguguguggggugacagacuagcagcuacccccuguggguucccucacuccucagcugcauagaacuuaagucaucuuccuaggacuaacucuguuaucuggugaacaaucucggaccucaaauccccagggacaacaguacccugacagucuucccaggaggugugggccauuaucccaggagagucucuguggcuaagagggauuggucuguguuagagucugauaaaaugggcucaggacuagcaccccaguuuucaacaggaucccucuguguuuuugucucucucuacccugguuuccuacucuuccugggacagaaugcuauaguucuaaccuaccacaugcccagaugcaacguucgugaacaugggcaggaagcuguggguuucaccauugcccuagugaccuuacaggguacugguaggguugcggagaaaaugauauaggcacaguguguuugagaggaaugagugccaccagguggcuucuggcuguagagacaggaugaccaguguaaggggccuggggcagagaagaguacuccugugggagaggaugacucaaggucuuggcuuuggguugagccugucuccccauagcaguuauagacggcagaggagggcagcagcuuggcccaggcuuguagcagguugggauagaaagugucuagagugaguucuauucugaaggcaggagcagcugcgaagggcgacauggugcuaugucuguguccccaucuauacagauauacagaggugugcugugacuuugucaugccacaugaaaauacuaagagcuacccuuggcuggaugaaugcuguaacacgcauacccacauuccaccacauaaaagauuaugcaguuugaauucuccccccucccccucccccucccuucuucccucccucuccuuccuucccuacaguuguuuaggcccugcuaugacccaugucuuccugugcuguugucuccucuggagacuuccuuggaugaggggauccugucccagccaccauugagaagaacggcuuuguucaaaugcccaccuccauuuaaguacaugccuggugccugcagaggccagaaggcauuagaucccuggaacuggcguuucagaggguugugagcuccuauauggguguugcuaacugagccugggcccuguauagaaaccaguguuguagccgcugagccaucucuucagccuguuaugcacucuguccuuacuugagcugcuguggccuguguuaucucugggaucagucagccuugguccugugggucauguguacacuugcuucugacuucuucacuagacgcucuccucugggucacgcuguuccuuucaaauccugccccuggaccaguguugaccuuggcaaugcugccacagacaggacaucucaagcuuccuuccugugcccuggauaaauaaggguguacaagcuguggggugcagcucggaguggggacagugaaaugcagugcaagagagaaacuuggcucuccccucagcacugcggaggcccugccugcccuugugccuuccugugucuccuuuggagacuuucuuggaugaggggauccugucccagccaccauugagaagaacggcuuuauccaaauaccuaucuccgugugcuuagcucaggacuggguuagcagguguggcagagagggcucugaagcugggaagacccuggcucagccuggggaagcccugcagcauaucuggauggggcuaaaaggccuccuggcagaaaugcagcugguacugccuugagguaacagcccggcauugcagcccugcaccuuggcccugccucagcuucugccuugccucacugaggaggaggaugauggccuuaguccugccagcuugcccugcagcaguacuggaacuggcaugggccuguccccacugagccagcagcucucccguuccccauuuaaggaaaccugcaggccucaggaaguggggaagaaaugugguguacuaaccucauuucccugccuggccuuagcucuggcuggaccacagcaccaaaugggaagcguagaaacacgcuucucaguggguggcaagucccugggcuaauuccaggccuguaggagugggaagcacagggaaagaaggcagcgcccaggccaugucagccucagcugaggcugaccuaccuccagaugcccagagcaucaccccaguuauggcccugcugaugcaggaugaagcaugcacaaagcuugggccuuaccugcccacccaggcugcugucuagagcugcugcuugcugugugugugagacaaguccacgugccagagcccccacuuccuaucugucuaaugggggcagcaggcuggcuuucgcaguacuggcuggcacagaggguggugcaggacacucaggaguuacccuguguggggugcuuggcagagaaggggauauuuucaugauguuccuaugccuacccuucuagaugacguccucaucgucccucuagaagguggugauaguucuggcucaccuaggacccccugcuggggacacagcagugagacagccccugugcccauuauugcaagagcugagagcugaaucugcaagggcagccugugcucuuauagcucccgaagcaucucuccagccugcagguuauauucucaaggacauguuccucaggacuggagacauggcucagcacuccucucucaagggucucaguuuaguucuuagaaaauacuuucacaguuuacagccagcuccaggagaacuugcagaccuguacuuacauguacacacucacacacacccacacacacacacacacacacacauacacacacacauacacacacacacacacacacacauacacacauauauacaaaaauacaaaaaaagguaaguauuuuuuuaaaaaaaacugggcaugguggcacaugguuguaauccuaguacuugggagguggaggaaacaguggggugaggcuagccuuagcuacaggagaugaggaugguggaggaagcaguggggugaggcuagccuuagcuacaggagauggaggugauggugaagguuuauaccucuuucaaguauuucaagcaauaucucuauuuuaauuccuucacauaaaaaccuaaaguuugggucccucaaacgauagucacucguuauuucucacaggucuggugggugagcuuucaggccuggguuagggauuggaaccaaucccuagauccaucugugucuuuccuuuuaucccgucuccucacuagguacauguacuggacugacuggggggaagcaccccggaucgagcgggcagggauggauggcaguacccggaagaucauuguagacuccgacauuuacuggcccaaugggcugaccaucgaccuggaggaacagaagcuguacugggccgaugccaagcucagcuucauccaccgugccaaccuggacggcuccuuccggugagugccuaguggccgaggcgcccuccccacuauaucugcuguccucagggaguugaggcuccuuaacucaggccuuagguucuucccuggagcccccaaggauuguuagaugacuuugggaacagagcauaguuaccaugucugaugucacagcugauggaacuguuuccacagcaauaugcugaacguuccuuccaaacugugugagaggaacauacauagccuccgagauggcagcugugcaaggcgggcucugaguucaaucccugcaggccacacgauaagagguagaggaccauuucuuucuguuuuuguuuuuucuagauacgguuucucuguguaauagcccuggcuguccuggacuugcuuuguagaccaggcuggccauaaagucacagagaucugccugugccugcuucccaaggcugggauuaaagguguggccaccacacccagucugagaaccaguucuuggaucuccacuuagugcuguggguuucgaguuccucccauauacauaccauacauaucguauuuuaaaaaagagaaaagacuacaucugacccauaucugcgcccaguuuguacugggaaaugaguaagaaaaucucaguguucaggggcuggagaggugcucagugguuaccugcauuugcuguguuugcagaggacuugaguucacuucccagcacuugugcuggaaggcuuaucuggugcccucuucuggccucccugggcacugcacucagaugcacauaccugcacacacacaagugaaaauaaaauaaaaauacaucuuuuuuaaaaagauuuauuuauuuuuuauauaugaauagcuguacagaugguugugagccuucaugugguuguugggaauugaauuuaggaccucugcuuacuccggccagcccugcuccuuccuggucaacuuugcucgcuuaguuccugcuggcuccggcucauagauuuauuuauuauuauacaguacacuguagcugucuucagacaccugaagaaggaaucaggucuuguuacagaugguugugagccaccaugugguugcugggauuugaacucaggaccuucggaagagcagucggugcucuuaaccgcugaaccauuucaccagccccauaaaaauacaucugaaaagcaaauaaauaaaaaguucagcguuuagacuguuugggauuuuagaguugccggucagggcuuagaucuggccgggacuagggcauucauugcucuuuguccugccucugccauaguaucuccagggcagcagcggcugugugacuauuaucauaucuacagccuugcuagagacugugcagacaguaggugcuugaucaaugaagaggacagguagaugaauucggccuguucuccuacuugguuguuagagcuuccugcuugguguggcccugugccaucauuacacuugagaaauagcugugaccuuugugucgaguuagggguaguuuacucugugacugaauauuacuuacugaguugacaucaggucuugggcuccucaugggaagguuaaucugaccuuugcacuggaggagcuccuggcuuggggcauaggagcugcugugaaggguucaucuugaguuugauuaaaaaggcccacauuccaucaauuuugggaugauguccagccugugucuugucauuuguagggcgagggugaagaugcacauaggguacacuggucagggucugaucugagauuuggaaaucaggcuagcccaaggacagacggugggagcaagugaucucagcaugaucuaggcuagcccagaaucuggaaagcugcuagccuugggcaagcgguccugacaagaggguagcaguuaguauaacagauagcgauaacucuugcauugugucaguguccagggacauuuaccauuuuguuugauguucacaacaaaccccauacuaccuccuguaugaugauaggcagggucucaacgccauacagcuggccagagccuacugcagagugguggucguuaaauaaccacaagaugcuggcucugcucaauuccaguccuauuaccaguguugauaaucucauuaaacaugauguccgcugugucggcgguucugaacacacagggcugagagugccucccugcuguugguguggacugucggacagaacacaucuggcugagucagcaggaagcucuuugcacaucaggucuggggacccaggcuucucagaaacugucaccagguguggcuccaugcauuuuucuuuucuaggggcacuuugucccuuuguccaggggcucuuacguuuuugucacaggcacccaggcuggcugggugggcgcugcccgugcauaccuggaagggcugacuggaguggccgagugaggagagugugcuugcagcugcuucccuuugaucugacagacacagcgggucugugguggccuaaaggccuccagcauagggcagaguuggccugagaggucuucuccuaaccacucugccuguuuccuaccuacugcaggcagaaggugguggagggcagccucacucacccuuuugcccugacacucucuggggacacacucuacuggacagacuggcagacccgcuccauccacgccugcaacaaguggacaggggagcagaggaaggagauccuuagugcucuguacucacccauggacauccaagugcugagccaggagcggcagccucccugugagugugagcuggcaauggggauggggugggcggggcaggggugggcacuggggauggggugggcggggcagaggacaggcaggggugggcacuggggauggagugggcggggcagaggacaggcaggggugggcacuggggauggagugggcgggcagggggcgggcacuggggauggggugggcggggcagaagacaggcaggggugggcacuggggauggggugggcggggcagaggacaggcaggggugggcacuggggauggggugggcggggcaggggauaagcaugacaggguagggcuugcaggucggagaggcuacaucaggcagaucugcugguacagguaggauaggguagagaugggaaggauauagcccggauguggggcucagucaggucaguggggcaguauagucaagcaguagggcagaguggauccaggcagugcaguagggagcugguagacagggcuaagaagagaucagaccaagccucuauccuacagaagcacccacagagaggcaccccugcagagaagugaaugcuaggauagaaggaggagcuugugugugugugugugugugugugugcgcgugugcguguguguguacaugguauaugugaguaugcuuguacauggacaguguuucugcaugugguugucuaggcaggcuaguacgguggacagggccucucuagagcuguuucaggcuuucuagggcagguggugccauugugaaggcccaguagagcccugaaguguaaaauacuugcucagagucuuacuucucagccuggggucuuauaugguagaaucuuaauagaagucccugacggugacucugaguuucugugacagacugaggggguuggaugggaggcgggaagaggccauucuaggcucacucaguugcacaugcaccaaggaucaguauuucuggccacacuuuauagaagguuugaaugugggucuaggaacucaagccacaaagguuaguguaggaggggugggggagguggucccugacccugucaagaguacauaguucuugaacucuuuugcuuggagcugcccacucuucacugaguguguugugagggcgaaggucaacugcaggagacucaguuccaguugacagaguugcaggggugcugagccccacauuccugagguagaaggagggucugggaaccuuuguuagauucaacuguacaguggucacagaagagccugggggaggggccuaaaugugguaacccaauguggacugagucugcaggguccaggcagauuaaagagacagggugugcucaggaguccacuaacccaggguucccaggcauggcugccuaagcgguccugagaauuuccauggaagcauggcgggugacuuuucuggggaaaguagcauccuuugaaaguuuaucuucuuguuggagaaagcuuagcuuggggaaugugcccugcagggcagggcaggucugggaugguuucugagaaauuacagaacugcugcugaggcugaaggcccuccaugggggguggucugagugcgguuagguaggacuaggaggacgagucaugguguagggcuggagggacaucugacaguuguccuguaggauacaugggauguguaggaugccagcccccgugggagggaguggcugggcaguggugcgcucacagcuuguacugcaacuuccuuccauccuguccuguucuguccccaccaguccacacaccaugcgaggaggacaacgguggcuguucccaccugugccugcuguccccgagggagccuuucuacuccugugccugccccacuggugugcaguugcaggacaauggcaagacgugcaagacaggugagguggaacauuggcacuggcagggacagguggggccuggccugguggugggggcugucaccagcuaaagugacaaacauggcagccucuucacaagggucuacucgauuuagugacaacucugacgcugaguucaccaucagcucugagcugaguuugggaguuguggaucccucaucaaaacagugauauccugguuuaguagugccuucagagugcugagcacgucaacguagggccacacccugaaaguuugcugugcugaguuuuauccaaaagcuauuaacuguaaaaaggaaaggaugggggcauuagugggcacugcccagggagcuaaccccaguguggagccccugagcuuuccuggucuguaucaguuuugcccucuggagcacagcagccacuacacugagugcagacaugguuuugguuuggcuucccugcaucugugucguugauuugcuucuuguguuucaguuguucaagucuuaccucucuguuaacacuucuaugcaaauggaggucccagaucagccuuguugaaaguuuucuuucugacucagagagccaguuucccuccuuuuugaauauauuuuuucuuuuuuuucuucgagauuauaacauaauuacauaauuuccuuuucuuuuuccuccucuaaaccuuuccauauaucaauccuuguucucuuucaaauucuuggcuuugugggccaauaucuguuuuuuuuuuuuuuaagauuuauuuauuauuauaaauaagcacacuguagcugucuucagacaccccggaagagggcaucagcucucauuacgggugguugugagccaccauguggcugcugggauuugaacucagaaccuucagaagagcagucagugcucuuacuugcugagccaucucgccagcccguguuguugauuuuaagucagggucucacuauguagcucugacuguccuggaacuuguuauguaaacuagacuggcuugaaaaaucauggaaaucugcuugccuccacuuccugagccuugagcuccaagguguuugcccucugauuucacugcuuaauucacacaacuuucggcucaggccucgcuuuucaucacugauugcuucuggguuccugguguagucagcauucucaccuccaggaaauggacuucugcuguggugccucggguagccccuucugguaccuacguaccuagaggauaguucuccggguuggcucugaggcuugucuuaucagguccugugaggagcacagccauccugaggcugguucuccuuuauuuuuucuggggacagagccugcuucccucaccauuggcccucucccacggggaaaggucagggaggcagcugccuuccauauugccuggucuaagcagcagcuuccuugaggcugucuccugaugucagugugugggguugaagggauguccuuacucagcuccagcugugguucaggcauggggugugccucugaggguuuccuggccccugcugugcucugcaguguggacuuagauuguaggugccugugguaucagaggucaggaugagcagcuggcccuggccuuccugugagccagguuccucagugacucagauguccaggggucacagguuccacuuuccuaagaauccuaucucuacuagcugugaaaggcacuccuaggaagacugucagagaaugccgagcgcacaggacaaagcauuugucacccagaguccuccugugguggaagugugcgagaggcugaggacaucgcuguagucaguggacuucuguaugcuaaauccauacuuuuuccacuuuggcugaagaugcccugacuguaguauuguguuaaaaggagggagaugucuccagaugagagaaaaggcgcaugucugguuagguuucuauggcugggauaaacaccacuaucaaaagcaacuuagagaggaaagguucauuugucuuacaggucauaguccauccugacgggaaggaaaugaggacaggaacugaggcagaggcuguggaggagccuccuccuggcaccucaugcuuccucagcuugcuuucuuagauaacugaggacagucugcccagggaugaaaccggccacagggcacugagcccucccauuaaggaaaggcuccauacauuuuucucuacuuuaaaaaaucuuauuuacguuuugagaaucuuauacauuuugauaacauuucucuucuuguaacuguuccuagggucuccccaucuuccuaccuauccuacugcauauuuuuucuuucuguuaaaaacaaaauaacacacacacacacacacacacacacacacacacacacacacacgacuauugagucugauuuguauuggccaacuacuccugagcuugcgggcuuccuuggcaagcgguuaauauauccaguguuacucccugaagaaaccugacuuucucuuccccauaaccucucaguugcaaugagcuucuugcuagggugcgccucacgccugcucccccuucucugugcugggauucugucugacuuguccucgcgugugccaucagcucgugugcaucuuaccugucgggucuggagagugcuguuugcgccauaucuggcuccuacagucuuucugccuccuugucuacagagaucucugaguuuugagaggaggggugugaaaaagacacccaguuuagggcccaggguuucaauauuggagacaguuuucucaauugaaguucccuuuucucaggaugacucuaguguuugugccccagaaugggacugagagacuaauguuuucucuaaggcgggaauuccuagccuugccuccuucugcacuuccucuguguccucaucccuuggacaguuccuaggcugcuaggguggagaaagaaucaaggauccagaaguagguugggauguaccucuguucacagacugcccagcaggcaugaaggcucagcuucaauccuagcaccauacaaaucagguguggccgggcgugguggcacacgccuuugaucagcacucgggaggcagaggcaggcagauuucugaguucaaggcccaccugguggucuacaaagugaguuccaggacagccagggcuauacagagaaacccugucuucaaaaaaagaaagaaaagaaaagaaaagaggugggaguggccaggggcuaccuaaggaucuccuugugucuguggcaucuaugagaucucuaguguuguccauuugaggccaaaugggggaaacugucccauaagggaaaggcagaugaguagcuagcccugcccagagggcgggcagguccauagggaaaaggagagggagcuugggaagugaugggcauggagacgauggggaccggggaugguagcgugucuugcucucaccaggauccaaguuucucccuggugguaaggaaacucccuggcuaccuucagccucuccuagccagcauacuaggcuugagucugugcccuggcucucuucuuugagacagacucagccuccuugggcuccgguuccuuuaucugcagcgagaaagcaagagcagcacucuggagugguuggaggaaggacugaccacuuggcaaguaggaacuggacuugaauuugaacuugaucugggaaccaggcggacacucuugagaccaagagaacaauucuucccagacguuuggaaucgaguugaugccaaggcuagcuggugccagguugugguggccgggcuggagagaucucagcgaguacacagcaggcuacugaccugcugcagaagucuguguuuaucuuggggauucugaguauacuugcuucccaucuuuaugguuucagggccaguguugaccuagggcagggacgguggccaggcugucacuggacuccugugacacaauaggcgucguagccacugacaggccugauggagcaggcuggagugcggcugagucugcucuagguggacacggaguagguggcagccacuaccacagcuccccuccucccgugacugcuggauuccugggcuucacuucauggagucggagacgagaguucugcucugaucucaguuugagcaaaugaaaaccagcuuggagucuuccuugaagacugaggugcuauuccuaucaggaccccaguuaaugggagagugggaagcgucccauaaaccgggggcagaagggucagaugcuuguguggccauucccucaggauccugagccacuucuucccucucugugaggugaggagagcagaccacccccuuagauaacuggagauuggauggaaggccuggugcauauggaggccaccauuugacauagaaaaaagaucuucuauauagccuaggcuagccuauguagcccaggcuggccucacauucauuucuccugacacugcuucucaaguacugagauuacaggcaugugccaucauguuaaaauaacuucucacacugguggugcaagcacagaccgcacgccuguccuuugaacucaggagcuuuuggguccugaggcucugugggcagggggaccuuugccuucgggucucugcuuucuguccccccagcucuucugagguggcugcagugagaccagcagagcaaguagccugcucccuucagcucagccgagcugugaggccuggaguggcuguguuguggauuuccauagauuagggugacugucagcccuaggaagcuggaagcugagaguccugugugcuuggccugggccagccucccucccugcccccucuggagcagccuccacaggcagcuggcuuugguuucccccauguuuuuccaauuauguggaauggucuaaaaacagcaguagcaggggccuuauuugggagucgccaccacugucuguccuccgcagccugcagcucugucacugucagcgucuccaaguccugcucuuuguggacccuucgcccuggugcucuggcuuuugucaccuagacuuugggacagugacuuaacaacacguauccuacuuuguaggccacaaacuaucagaccagaggacucuggccaggcaaagcuggccacuggaccuauugcugugggucguguggacaaggccuagcaagucacaggaugggcauggauuggguaccccccccccacuccuucaagauguaguuuuaacagaugcuuaacugucaggacggucugggugggggcugcugaaagaacagagggccucacuguugggucugauggguaguugggacaacuggagcuacuuugacuaacccucauauccagucauccauccauccauccauccauccauccauccauccaucuuuccacccacccacccggacagauuagccagaugggcaggcagcccucagccagggccaagaauaauggguguguuuguucccagagucuggcuggcuagucacuuaucagggaaguaggucaaagggaaaagaaaggagguccugugggggagucugcaccgcagucuugauuggcauugacuuugcaaacagaaggcagcugcuguucucagccauggaccgugaauuuuuaauagcaagaaaauuggaucucaugguccaggagacugcgugguaagccuguaugccgucguguugugcgucuguguaacugagguguaacugcaugagaaacacacauuuugugagugucgggucagaucaguucugacaguugauacauguguguaacugccaccccagcgagagacuguuuucaucacucagaaagggccucugggcuccuaccucucaucccccugggaggcagggcacaggccauauucuuagaaaggaaagcuuuccuugggguuagggcacaggcuggcuaccaguugaugcuuucuggcuguggugagcagugugaggugucuuccacagacugacaaucgugccaugaccaccucuugcuucaugcuccccuuacuccuguagcccacucccaacuccugccugguuaccugaggccccuuugucuuuggagagcaguuaugaguugguaggguccuggagagcccucuaagcuguccagaggaacccccaccccaaacacacacacacacacacacacacacacacacacacacacacacucucacacacuuucucugagcaagcgauuccccguauucugaucuccaucacuuagaaggagucuugccagguccagagugacucagcugacacuuggaccuccugcuugucuuagagaaguguauagguuccagcuccuuuuggccuccagucucugugcaucuuguaccucuuguuuccuggaaacaaauuagcuccuuucuggccauguugccuggaccuacucccacccccacacacuucugugcuucccugguuggccacugcuccaagcuugccuucagaggccugcuuuaaugccaugucuccuuggcucuguguagguccucugagggauggcgugugcuuagguuaugcuuccaugucugcugugaaggacaaauggaugcagcucccucacuuggagcuucccaguggaccagggucaggcccggggaagcuggguacuucuugguggcaagagcugagguucucugguuaugucugcgaucuuuagcagcuagcugggaugcaucuaguggggccagcuuuauccucucugccucccucagggacaugguguggcagcauaugguuuccuaggccuccucaugugccugugaagucuggguuugugcuuuauccacuuaggaaugccacccgaguccugccucugaacuuuucagcuguguuuaaauuuauuuauuuugauuuugugagaucaggcugaccucaagcuugugguggucuuccugccucugccucgagcgcacuaugauuacggauaugcaccaaccacgugguuucugugagccauauggacugcugauagucaacuucgaccuaaagaaaaaugauguuuucacauagucaaguguagucaauuauuuggacuccagccagccaccauggaugguaguaguaguguccccucagggugcagauggcugccauggcauaggucucagccuucgcucacuucuuccuggagcugcgugagggucuuuggggugguucugcuucucagauggggggccacgcacaaaagugagagagcuugcucacagcugcugaugggaccacagcuggggcacucagcucacagccuguucuacauacccuucccggggcuccuucuguagacuccugaugcagagcacacagauguucauuaagccuuaggcagcucuaggagcuacaggacagacagugugaaaccaauggcuguggcuagagggauggcucagggguugacacuuuguacggauggagaaccucacucaggucauuucucagcaugaauguccugccgcucuaaacagacuggguuguuuguuuguuuguuuguuuguuuguuuuuaagaacugagccuugagcccagagcuauguguacuagaccuuuccuugucauuguggcagacgcuggacaacagcaacacaaaggaggguuugguuuauucuggcucccagcucaagggcccagcccaucaugauggggauggacagcgggacggauggcugcagggcugugaggccacugcugcauugcagccagaaagugggugaaugcaggaacuuaguuuacugucugagaccccaguguaugggauggugcugccauauucagggcgggucuccucugcucugcuaagccucucuggaaacacccucacaacacacccagagauguaucucauucccaguccugucgagcugaccaugaagaacguggcacggugagguguagccuucuuuagcgaccucaccagcuggguuggagucuccuagcccucugccccaaccuuuaauuugcccaggcuuaaagccauucuuucugugucaccugugaucuucauuagagggaggaguguccauugccucaguguuuggggccucugcuggggcugagauaggagcuuuccgauauguucccagcucuucccagcuuugauggagaacuguuugcacuugaguuucaggucaagcggcuuguucaaggcuguuugguagagaaugaagguggucacugacaucaggccuuggagcuuacaccgacuacugagccagacugguggugugaguaccugcucaguggccagagggucaugguggagagggaaagcagaggcauauagcugggaaccagugagaggcugugacaagagauggaagaggaaggagcacaccugggagaggccuaagauuggcucugacuugacucugugcuggacagcgaguaacuuuguugagaguuaugcucucagcccagaacucaggccuggugucuguggggccauuccucaugagcucagccuuccugcacaugccuguuggucuguucgaggugagccauucaggcaaucacuugggucucauguuaggagcagagcccaagacagcucuggccacuuccuuugggccugugacccuguggucauuaggcaggguuucccagcguacuucuuggcauuagucuaaccacuuaccaccuaagggggcaguggagaaacuuaaucaauugcuaaaaaaacaaaaagcucuuggcuaccugccagccgggaagccgcaaggccaggcagggccaggcuguuuacggucucucucgggcugcagagugaauggagaucugcucagucacugcacugcccacgcagccucgggccucagagcuaaggaagaagcuguccaugccugcucugggggaagcugaggaggagaccagggcaggagucauggggacagagaagggcuggaucuuagcuuugggucuugaggagaaaggaguuggcagggcagagccacagaguggaugccucccgggcugugugcagccucacagaggggcugggcccuuuaggggcagcuugguaccuugguauugugguagacuguguggaagggcugggcuguccccuauagcugugagauagcaacugcucugccugggaucccugccuucuuucuuguauuaauugggucuugccauauucccaaggaaagaguauuaguuuucuuguuguggugaggggaaaaaaccccuuuuccguggagagauuagcuuuucagugcccacagcgcccaggcuccugcagcaaaggugacugacaagccugggccacaccuguagguggauuggaguuucggcuccauccugccucuuacccugcuccucccuuuaccauacugagaccccagaagccaaagccuccuggccucgcucgguucuggccccagggaagaagccuugcacccuggucgcaaugcacccuggucgcaucccuccuagucugaaacucuucccggucuacaccugaccccaguucagaagccgccuuccucaugacaggaaaaauuucuguuuaccucagaaaggaaaccgucaauguaaaccaggagagaaauguaaaguauuauguaugugugugagugcuuuucuuacacguguguguaccaugugaaugucuggugcuuucagaggucagaaggggucagauucccuggaacuggagcuccgaguguuugugagccaccauguggguacuugguacugaacccagaucuucuguaagagcagccagugcucuuaacugcugugagucuuuucucuagcuugauaaauagcaacauuuaaaugacccagaauucaucuggcugaagcugcuuguaacaggucuacacguuuuccacuuuuuccccaacaaguguuuauuggguauuuauuuauuauuguauuuauuuugugcguacaugugcuacagugcacauguggaggucagagagcaacucaaaggcguugguucuggccaccacuaggguccuggagcuuguacgagguuagcaggcuuggugguggacaccuuuauccacugagccaucuggcuagcaugauuuucacuuuccccauguauucaaguccaaaugcguauuuguuuacaguguacguacagacgcgagcguugcuucucauaguucaagagcauuuucuauaucauuaagucuucuccgggccugauguucugugucucuguaaacaccuauaagcaugaaugcccccugagauguaaaaugaaccccuucccugcuucucuuccuccuguguauugugggaugucuggccugcucgcagcuucuccugucagguguugggguuuuuuugcucuucuggagcugugugucaggauuugugucugugcacugcagaauaggcuuuguguuguacucagagggcagaugguuccaaccugcucuccagaaagccugggcuggcugcaacgcuugaagaagcugugacacacuagacuucaaauagacuuuccuagcacuccguccgucgaggugccagucacuagaggccacuuguuuucauaguucuugacugugaccuccccuccccuccccuccccuccccuccccuccccuccuuucuuuccuuauuaagcaaaagaccuuauguuacguguuuguguuugucugcauguaugugcaccccguguguguggugaugauggaaguuagagcuucaggaccccggaaauggaauuccugaucauggugaucacuguguggguucugggcacugaucuaaguccucugcaguaccagcaugugcucauagccacugagcucucuauccagcuucuccuuuuuguuugauuauuguaugugcaugugggcccgcagggcagugggcaugggggaauaaagggagugggagaaaaccugcgucccgccagaguucuguugccacucgcuuuccacacggcccagggugggugucuggcugugggaagcuacggacccagccagccacucuagucuaggggcaguccuagguagcagggucucagucugggucauccacagaagagcugagaacaaaaugagggccccagggcggaagggaggagagggcagggagacagggcgcugggugguucccacuugggugagacuccuuggucugguccaugcaggaaggccuucuggcgggagguuagacgaagcauggcuggccuugauuagcagagacagccuaugguuuuagagcuuuauuguagaaaggcagagagaaagagagaagguagaaagagggagagaggccgacuaugcccacauggagagagggggcaagggaaagagaaagaaggagggcuagagaugagaguaagaaaggugagagcuuaaagagagagaggaggggccaagcagccccccucuuuuuuuuuuuuuuuuuguuuuguuuuguuuuuugagacaggguuucucuguguagcccuggcuguccucgaacucacucuguagaccaggcuggccucgaacucagaaauccaccugccucugccucccgagugcugggauuaaaggcgugcgccaccacgcccggcuuccaagcagccccuuuuauagugaccugggcuaccuugcuguugucagguaacuguggagguggagucuagccagaaugccaggagcuuggggcuuuaucugcaugacugauagucacacaccucuccugagggggcugugggggcaguaacuucggcaggagucagggguccaggagacaugauugaacaccuucccauguaggugggaaucaccacccauuggguccccgggguuccagaccuuugcuuggcuggagagcaggcugucugugagcccucuugcuucagugcugugacuggauucuuucccugagguguuuggcucuucccggucccccggucccucauggaaaaccuuugccacccuuguuaaagaaccucagaucaacccuucgagcuucuuuccuucuagcuuuuauaugagugcugcagucugucuggcugucugcgucugugguuggaauucugcugcacugcacacacagcaugcuauuugcuuguggcuuucuuaaggacaggcugaguuuggagcugccuagugcccuguguguggcggguccuuagcagaguguggccuaugggauggcucuccccgcauauacuuaagagcauguacuguccaccaugcuucagagugagcccugcucacugcccagcugucccuucugcuuagagucucugccuuccagcauugcccgagccuccuccugaaucucuuaucccaacauccuguguaugagauccaguuugcacaccaugccuuucuugagguaaucaaacaaagcagaggcaugguggauuugguggguccacagagcagugcccuccugugagaaagaccguagagacacacagugcagucggcugugugaaacuggaggcacggaucagagugguuggcaaugaaccaaagaacgccaaguauuuccggcaauaucaggaacugaaggaggcaggaaggacccucccuuagagcccagggagggagguagcccugcugcacccacaccuugacucuugacuucggaaccccagauaagggaaggaauaaacuuaucuugguaaagucacagguuuagggugugaaggcugagcccugugccuagccccuggcccuaccuguguguuccugggugaaauagagaaagacgccaggugucuguccacacagcuagguccaauggcugucagugcuucaggagagggcaaggcuucauuuuugguaaagggccuugccaccaauuuugaccaccucaguuagauccuuggaacccaagguuucuucuguucuacacacacacacacacacagacacacacacacagacacacacacacacacacacacacacacacacauacacacacauacacacacacacauacacagacacacacagacacacacacacacacagacacacacacacagacacauacacacacacacacauacacagacacacacagacacacacacacacacagacacacacacagacacacacacacagacacacacacacacacagacacacacacagacacacacacacauacacacacacacauacacacacacacacauacacacacacacacauacacacacacacacacauacacagacacacacagacacacacacacacacagacacagacacacacacacagacacacacacagacacacacacacagacacacacacacacagacacacacacacacacacacacacacacagacaaagaaaagaaaagaaagaaaggaaggaaggaaggaagagagaaauuuuuaaaaaucaaguauuuacucaaacuuuuaguuucuaaacuguuuguuuccaugauguuuaaacaggcaucauuuacugguucugcaggcaccgagcaguaggcaggccugucuccuuuaugcuagcauugucccuuguccuccugcacuacuccaggccuacaguuacguuaugacugcacuuaaaaacauuuauuuguuauuuauuuauguguaugagugcucuauuugcauguaugccugcauaccagaagagggcaucggaucccauuauagauaguuaugagacaccaugagguugcugggaauugaacucagaaucucuggaagagcagccagugcucuuagcuguugagccaucucuuccgccccuagccuuacuuuuuuuuuuuugguuuuuagaggcaggguuucucuguguagcccuggcuguccuggaacucacuuuguagaccaggcuggccucgaacucagaaauuugccugccucugccucccgagugcugggauuaaaggcaugugccaccacgaccggcccuagccuuacuuuuuuuuuuuuuaaagauuuauuuauuauuauauguaaguacacugucacugauuucagauacaccagaagagggcaucagaucucauuacgggugguugugagccacuauguaguugcugagauuugaacucaggaccuucggaagagcagucagugcucuuacccacugagccaucucgccagccgccuagccuuacuuuuaaagauccuucucagagaucagccaugggcaccaccagccuuggcaaacauuuggugagaggcuccuugcagcucccccuuccuagccugggcuuuggcuagagccuucuauuaugagcccuggaagccuguguuauaucuguaugcaaggcugggcugugguccugucucagugucccugaugugguuucuguauuuuucuuuguaaaaguaaaaaugcuccaaaaugccaugcagcagugggguuccagaggacccccugcucaccaugauggaguugcuugacagccauggguuuagcucagcugagaauuacugcuguagucuuucucaggguggcuaggaagaguccccauugaugacucuucuuuagggccuugugcugauuucgcucuuagagggcuugggccuguguguagcuuggggacacucuauuggacucucccuugugauggcagagaauagcccucacacccccgcagccccuccccucccccuucccuacuccccacuucuuuuucauggcuacacuuugaaauuguggguucuuuguuggucuugcucacucuauggucucugcucugucacccuggggugugaagggacugagucugucacccuggggugugaagggacugagucugucacccuggggugugaagggacugagucugucacccuggggugugaagggacugagucugcuuuuucuaccucuuucuuagccauagcuggucucggccugggcuaagguagcuaccuauaaauagaaacugguggucuggcugagcuggccugagugaguacaagcaucuuauacucacuccugguuggcuuaagggaucuuauguucccacuugcugcugugugcccuucagccaggagcuuggccucucugugcaccagguuccuggcauaauccuaccugaugugaaaaugugccuuauaugggugacuacauuaggacuauggggcaggauuagcacaacagguuucaauaugguuugaggguuuccacuggggaccagagcuuccugaagugggagcacugugugaagccaggggacaguuggcacauacauacugccugucccacacagagacccugacaguuagugcccuuggucccuuccugagcuucuacgagcagacaucucuuaucuaucacauugacuaaaccuccugacuccuggcccaguguuagagccaggaagugucccaggugcguucggccuggagaaacaagcccagugagucggagcccugccugaugcucacaccaggaaguuucagccccagggcugugucuccucgggcaggguugacccuuguucugggcuuggcacuguauaaaaggccacauagccgucccuacgagacugugggaugaggacauugucagccccuguacagugcagggguuaauggaauuuguugagaauggagccagaggaggaaaagguugagauuccaaguucugcuccucucuccccucacagcaugcaccuuugcaggcagccuggauuugggucaagggucucucacaacuauuauuucuccuccugguaccucaguuuccccagccuugaagaggaagcugcugugacuucuuccuugguggaggagucagcgcaaguguccugaccuuugagaggaccucgagcaagccagcauaaguguaggcagcugccuacugcuagggggcuacauggucaggcaugacugacagcaggcuguuggcuuggaggcccgcaagcgagggaggucccagcgcuuucccugcugcaaaaggcucuuaacugaagguggauggccuugggaugccagaauucaucacuggcccugaccuccuugguucuguggaucuagagaacgucaagggcuggaagggaugacuaacagugaugcagcucugggaggaagcucuggcuuggccccaguagucuugggaggaccuggaacucagagauccaugcugggaguaaggaugugcaccaccaugccaggccuuuuaguacugacucuugggcccuggggacuggaacaugugaggggcacacuguugguucagaagagacucuaguggccacauaacccccgaaccuaccuguaaaagucugaaccucaccaagcagccagggugguuagagauggccguccugggccaagaaagaacaguccugcugaugugccugaggcucucugaacugugcccaaggucccagagugucacagcagccguggaaacagcuuucacagcuuccguccgcaggcucucaguguccagugccauguugauuuuugacaacucacaguggcucugagauguauuggaaguguaguccuugcuuaucuccugugagacccuggucuacagagcccacagugcccacugggucuaggccacuguagaaggaacuggagcguccggacugggcucagguggcuuggcucucuugcuuuuggucucugccucagucaccuggugugucgagugguccuacguuuuuuguuaguguuucugcggcaggcauuugggggccucugagcuuuagagccgggcucccuccaucccagugcugugcuugacagaacuuacuugacacagauguccaucccugucagggagcugggugacagagcaagacagggaugccuaguguauggagaagaacagagggacuggcaguuggggucuggagcccugugccuccagcaggauuguuuuuguagagaugggcuuguggucaggagagggacaaguggcagaggcucuuacacacagguggaagccagauggccugcccgagggcuuccagcugguuauucaaccucucugugcuucaguguuaucuccugugaaacaggaaaauacagugucaggcccacagagccccugcagccucuguugugguccuggcugagccaugccuguaagcgccacugccggcccaggcucucgggccugccucagccacagcgauagaccucugaccucacagcuuguauccccacaggggcugaggaagugcugcugcuggcucggaggacagaccugaggaggaucucucuggacaccccugacuucacagacauagugcugcaggugggcgacauccggcaugccauugccauugacuacgauccccuggagggcuacguguacuggaccgacgaugaggugcgggcuauccgcagggcguaccuagauggcucaggugcgcagacacuugugaacacugagaucaaugaccccgauggcauugcuguggacugggucgcccggaaccucuacuggacagauacaggcacugacagaauugaggugacucgccucaacggcaccucccgaaagauccugguaucugaggaccuggacgaaccgcgagccauuguguugcacccugugaugggguaaggcugagacgacaggugggcucugggauaguccuugcugccuauccucugagauaugcagagucaggacuggucuaaaauaagcauuucucaaagggcuugcagugcugcggcugcaguugguccuuagaccggacuuagaggagcucagggccaggccauggggcaauggugagaaagcccgagggcugggcaagcaagcauaaggacccaugaugacucuuaggauccacaguaaaaaauggacaaacaaaaaccaccgaagaacuggaaggggcuagagaggucacucagcaguuaagugcuugcugugcagauaggaggauaagcucggaucccuggaaacccauaugaaugccuagugggcauggcuaaacuaagguggagccucugaccccagcaucugugcccaguggugagcagggcuccugagcuagaacuuuaacugaccagacccugauggggagggugccacagaacucugggcgugaugcuggguggggucgggaagagucugcgcuuagugcagggugugaaccugugugaggggcagggccggucaggagugguggcuacagucuucugaacacuguaagcgcaaguguguucccuguuacggugacaagcuggaguacagcaggagcugccgaugccuacaagugcuggugccagugcuguauccugccuaccugugggcucugccccaggcuuuuggugcagcccauugugaggccuuguaagccagagaguuugaagggguuauguguagagguccagaagugggggcagcaguuaguguggagugugggggaaggcucugugcugcucuuuagugaccuugggcccaauaguaggcagaagaauuugcuccgugguaauggccagagugcaggguuguccccaaagaagauggugacaaggagcacuggggucauuugaagcugugggugaggaagcagggauucgguggucagcucaggucgggaagcuuaaggaucuacucccagcuacaccagaacucagugaggucgcagccccauggccacagaggucucgugugugaacugagguaggagcagagaucaggcccuuccuagccugugacuucugagccugaggguccaggguaaugggauggcaagugacgugugucugaucccaggucccaggaaggaagaguguuuccuacgcaggggccaggaggcagguccgagguagcaggaggcgaggcucuacccugaguccggaguggccuggguuuucuugcauugaaacuucugcccucugccuccaaauuuuucuggggucaccauccugagcauaugggagcuuugcuucuguuucuagaaggcucccugccgcccuccucccgcuguucuggacucuagcaaacaggucagggacaagggugccccagaugaucuacagggucacuuucagaauuuuccuacggggugggagcugagccugccgcccccuggcagcccuguguuguccugugcugugggggugcucugguguuccuauugagcuguaggcuaacaggcuaggguaggugugucccucagaguuggggccuagcaagggcagaacagacacuaucaugaccguuugcuuuuucucuagccucauguacuggacagacuggggggagaaccccaaaaucgaaugcgccaaccuagaugggagagaucggcauguccuggugaacaccucccuuggguggcccaacggacuggcccuggaccugcaggagggcaagcuguacuggggggaugccaaaacugauaaaaucgaggugagugaggccccaggcacagaugugcauggaggcaugcacacuuguaagaagccacccuggaaaguggcaucauggaaccagauucuuuaguguugcucugaagcccagaguuucaugcagaggccaggccuggaugcccuucaccccaucccauguuugcuguggguaucacugaguggcugugcccugcuguaauggccaaagagaguccuggaggaaauugugagggguugggccuaugacuuguuugguagagugcuuaccuagcaccacacacgugggguagcacaugccuauaaucugagcacuuaggagguggagguggaggcaggaggauuggagucugggguccuugacugcaaagugaaucugaucaccuaggauauuaggauauugucucagaaaacaagaaacaaaaaccaaaacaaccaacaaccgcucccccaaaacaagcaaaagggguaugauuacacacaugucuuuaauucuagcacauggaaagaagaggcagacagacagaucuuuugugagauuaaggccagccuggucuaaauaguaaguuccaggcuagccagaacacugagcccgaucuuaaaaagaaaaacaaaaugguuuaugggaauuguucagugggggaauguggcugcugggaguucuauucuuggaacccacaugcuggaagcaggaucaacuccuaugacuuuguuuuagccucuacacaugagcugugcugcacaugcaugucugucugucugucucucccauacauacauacauacauacauacacacacacacacacacaaagaaaaaauuuuaaaaguuuaaaaaucaaauuaaauaugcaaucucuuaaaaaaugguuucuaauguuucauucccacagacugagaggccucggggagguccgugcuggcuuuaaagcaggaggcaggaggauugguauaaauuugagaucagcugaguuacauggugaauccuaggucuuuuugggcuacauaguaggacccugucucggaacaaaacaccagaaacuaccggguccucggguauccuccaugccgcuuaggaaguagaucuguugcagccauggcuguacgaugaguguggcagccuuguaccacagcagcuggugguggggcugacaguccagguucccugagcagcgccuuguucgucagugccugugugucuucagcagagccccucggguacuucugauggaaccucagugccuggugacccugucagcaucaugaguacuucuuuacucuccuugggguggacaucuucccgcuuuuucugauaacuucuugcuccuuguuuguggcugccacgauuuguugagaccaccauugaggacacucuuuaugguucuggaguggccugauauggguggcuuccaagagaagagacugcgucugaaacuguuuuccuggggaacaggcguccucaguacuggggaggugagcugagggucagaauuggcugcuguccuucucuuggggacagcgggagcugccuuguuuaucaugggcuucccuagugauagucucuguuuugaaaaaaggaaaccaucuuguugcucaugaacuugaaaaugccugucuccugaaccaguaagccgaagccagucucuuccuccagacagcuaaggaggcuuugguacccuagcugccagugggagccugacagggauacccggcacccagagaugcuggaccauguagcuguugcucugugcucccagcagaguggccuuuaguagguccagucauagccacugcccaugcuucugguccccagccucuggggacacucuucaccuuucugucucugugacugguuuucuggguauacuuccuauaacuagacuucucgaugcaccuuuuauguccggcuuuguugggaacauauucaggcucugugcugccccgugcacacuuucuccucuucuguagccagucacgugacuguaugggacacgccuugcagugucuccucaguccuuugcucuuguccaucugucaggaaugagauuccugucuauucaugcacacauuuuuugucugaauacaguuucuuccuucccuugaguguaugucugguagagggauugcaauuuagguggcauuuaaaguaugauuuacuuuaccagggaccaauaaacucuucacaguggaugccguaguucaugauccugucagaagccuuugagagucugaauucucugcuugcugucguccccccccccccccccccguguaagccauagguucacauuagguguuuuccuucucucugcaccaauccaaguagaaucucuaguugcugaacucugcccaccugccucuccucuugagaccagccacugugacagccaccaagcuggccaugcuuucugucccaugcagucugcuccccauccuagaaaaccuaucucugggaucuucucuuggccccagcaucucugggucuggaguuuccugaacucugcuuggaucugugcccuccuuugggucagaaugggauguucucugaauccccccccccccccagcccaauccugccugguuugggaauucauggaagugugugaccccagggaagguggcagcugcagaauuggucccaugggaaacuugaaugacagccccuccuuaggcucaagggucuagggaagaccagagaccaccugagcuaauugugcagauguguagcaacuagucaugaugcuaaaaagaggagcuggggauguaacuuccuagugcucgaguauggcccuuagcauguacaacacacacagccaccauaggacauuucuguaauuucuauucccacauguuagagcagguaagaacugcuuacucucauuucuuccgggucuaagaggaccugugauccuuacuaaaggaugacaugagguguggucccuuagucacacagaggcguucccccugggaagcucugccacugugcuagcccagauccaaucuuguccucacccuggguguggcuggaccuggccgagaaagcucuggccucuucucauuuugcuucagggcagcucaggagugggagccaaggcguggccaccagguauccgccacccguuuuccccaguuucucugugggcuucuuucacuguucuagaauggauccaaguaaaguguguuccuacugcagcucacuuuaccaugcuugcaaaguuuaguuugaucaauaggacuagggauguagcucgggugauaggaugccugucugucgugcaugagcuaaacaugguggugcacaccugugaucccaguguuagcaggcagaggcaggaggagcagaaauggugaacuggaagccagcuugggcuauaugagauccuaucucaggaaagauaaggaaggaaggaagaaaaaaaaaaaagaacacaacaggggcaaggcaagauggcucagcaggugaaguugcuugugaccaagccugugauaauuauguucagagccuuggaacccacaugauggaaggugagggcugauuccugauucuccucugacuuccauacucaaacuguggcacaugcacucacucacagggagguggggcagaggagagggugcagggaucugacugcuggccgguuaacccuggagcagugucuuuccucggguggggcuuauuuuaucccagucccaguuuggcuuguauuguggaauuagucacuagguaacccagagcccugcuuguccaucuccucccucaccugcucuuccugagucuuucucccccaggagggggagcucccugugcuaauggguugugcuggggucaaccauucccccagacgguuuacccauagcugguggccugugcaccaccugugugucuuguaaugggaacauaaggaugaacucuagcagggaagugguugucagaugcacuagggaggcagaggcaggcagauuucugaguucaaggccagccucgucuacagagugaguuccagcacagucaagguuacacagagaaacccugucuugaaaaacaaaacaaaaaacaaaacaaaagaauggacucugggcugugugaacugaggcuauuuguuacugcccucuguuggucacuuaacaccauugaggcaccuagcucagcccuagcugcagccuccagccaagacccuucacaccucccggagcaccugccccuaccuaguucucagcagcucugauggucuccaacucugaauggcuauagauuggagcccagcuuuggucuuuaguuuggucuuuccgaugcaggagacugaggcccaugggcugcaaagacucauucaaggacauucaauaaaagaucaugggauagagugggggcgaccccuggcaguaggcggcggaacuacacugucuuaccugcugcucuucaccucuugcugugaacuguagcaguacaguauucagugcuaggccugccuuguaguuuuugcugucuguucuccugaugagcaagaaguacagccuugcucaggaggccagccaagcuuugucuguaauuaccugguguguuuccucauccuuuucucugugccugggaugucaccauugccacugcugaucuucgugggucaccagagucccacucauccuguggcuuuaaaaaacaacaacaacagggggcuggagaggugguuuagugcuuaagagcacuggcugcucuucuauagggucugaguucaauucccagcaaacacaugguggcaucugaugcccucuucuggcacacagguguacaugcagauagagcacucauacauaaaauaauuaaaaaaaaaaaaaaaaaaacuaacaacaacaagaagaacaccccaacaaaaggagaguccuggggcucaugauggucuugacaucgucauguagcugggaacgacccugaccuuccuuccaccuccugagugcuaggaucaucugcgugcucuaccaagccuagcuucuggugugugggaucaugccaggugugcacugugccagcugagccacaccccagccuaaauguuuguuuuaaucggcauagucuuuucuagaagaagacuuggcucuucugugccagcauggacaaggaaggaaaggaccgccgguccgugggguuugauuuaucacuagaggugcccagaagggacaaaccugcccagauugugguuuggccuggcccuuugaaacugugcuguaugccuacccagggccuaagcagacguugcuaauagaucccaggaagccuucccauagagcucgcccuguaaguaguccaggcccccacucaugccucaucagcagucagggagagaggacucuuggccuguucagugugcacaccagacuacagaggcuguaggacaugggaagugucacuugucugguaauagcuggccucuuguggcacuugguuaggugcugauaaagaggagccucuggggcaacuugagccugaggcaggccccagguugguucuugguugguacagccccugccuauccagacucccguuuuugcccucacacaggugaucaacauagaugggacaaagcggaagacccugcuugaggacaagcucccacauauuuuuggguucacacugcugggggacuucaucuacuggaccgacuggcagagacgcaguauugaaaggguccacaaggucaaggccagccgggaugucaucauugaucaacuccccgaccugaugggacucaaagcugugaauguggccaagguugucggugagucuuggagcucugagccauggcuccacuuggccaguuggccccaggaaaggugacaggaucagacgugggcuugguguccagaaggguguuucacucuaaggauggacaagacaggaaauggugacuggauaggugagaguagggguggccaggaagagagaagggaguggucacggauuagcuguguugggaauaacuguggcugaugugucacuucuugcugaaugccaggccuugguaagagcuucagugccugaggccagcuguaugcuaaugcuaguguccucaugaacacuggggauggagggacaaggccauuugaggaacaaguggaaaccugggacucagugcaucugccuugcuuuugucaucgagccuggcugugauucucaaauacacaccuuuuaccugacaggcaggaugguaaaagaguguacuuucugaggacuccaaacgugggucuguaugguggggaccaaggaccguuugacgaaggaugggcucuguuccagucugccacucccaugcuuggugccacaccugggccaugcuuacacgucucagguagccuuugucuaguaaauaaaugcaggaauagcccucagugguuugggccacucuuauagucagcagguaggugugguguuuagagagcugccucagccuggagaguggcucaggagcucacagugccuccuggucuccuggaagacccaggcucuguucccaacccaaccaacuguaacuucagcuccagaggcauccgauguucucuucugacuuucuucagcauuugcacacaugugacacacacacacauaauaauaaaacaagaaaacaaaagaagacaaaaaaggaaccaaaucuaugggcuggugagauggcucagugaguggaggugcuugccgccaagccugauacccugaguucaaugcucaggucccacaugguggcagaaggcaccaauaccuaaaaguuguccuuuuaccuucacaugugugcuauggcaugugcauuuauguguguaagcaugucacacguacacacauguaggcacacaagcaggcacacaugcaggcacauguacauccacauauaucacgcauacacccauacauauugcauucacauggggacacacaaguacacauguguauacacucauaccgcacacucacauacacaugugcauacacacaggcacaagcacauacgcucauacauaccacacacaaccacacacaguaaaugcgaccgagcugcccggcuuuagcaguaggaggcaggugguugagcuuguaucugcaggaucaggcagggggugccuggcagaagaagagagacagcugaacaaagacccaucagggaggcagcaugggugaccagcuuguauguccugucacugugguaggccacauggcaaccugcagggcugacaggcuucauuucaccagccaccugugaaaaugcagcuggcacgugcgggcaccgaaggccagguccaccugcgucuauugggaagcaauccugcccgggcugccaagucaacuugagaagcugccccuucaccccguuuguuaucgauaaggagaagaacacuccuuuuguaguuuaaauucuuaacauaaguugcuaaggcuguaguuuggaagcagaguaagauaacaggcuggcucagaaaaaaaugacugauaccuucugagugcucuaaucaaagacagaugucauuggcuggccauggcacaccugcauuuuauagguugcuaagggagucagugaauuagggaacauucuggaagaacaagaagaaccaaugucaucagguuaggcauugaggaggagcaguuggcgagagguugaguuguggcaccaucgcuugaugggcugauguagcucaggcugggccaucccucguuugcagacgaugguaccuugaagccuucuguacucaguuuccacuauuaacagauguggugcccugagacuggggccuggcagugguagggcucuguugcauugucgcugauaacugacuauaguagaugaggcuuuggcugcucccaaccagacuuucuuucacuccuccuuccgggguccccuuuugguagguggcaggaauccagucacacacaacugugagcuggugcuccuccccuuugacagacugcugucguucagagcugugcauuugccucacaggaaccaacccaugugcggauggaaauggagggugcagccaucugugcuucuucaccccacgugccaccaaguguggcugccccauuggccuggagcuguugagugacaugaagaccugcauaauccccgaggccuuccugguauucaccagcagagccaccauccacaggaucucccuggagacuaacaacaacgauguggcuaucccacucacgggugucaaagaggccucugcacuggacuuugauguguccaacaaucacaucuacuggacugaugucagccucaagguaccuggcaugagguuguaaacgccugcagcuuucuaugaggccuugccugugaagcugcugcucagggcuccaugcugcuugguuuuguuuguuuuuuaagaacugucuauuguauuagggcuagagagauggcucagcaccugaggaugcucccuucucuuccagagggucugaauuuaguucccagcauucccaucaggaggcucacuauauccgauacuucagcuccaagggaucuagucuccucuucuggccuuuguggguccauagugcacuuaaaugcacuuaggcacacacagguacacaucagaugguuuuaaaaauuaaggaccaaaggaguggcucagugguuaagagcauuggcugcucuucuagaggauggaucuagggucgugauucccagcacccacaugguauuuccugacaguccaguuccaagggauccagugcccuccucuggcccuggcagguacugcauguacagacacauucagacaaaacaccuuaacauaaaguaaaagucaaucuaaaaaccauuuuuuaauuuuaauuuuuuucugaaaugggguuucucuauguaagccuggcuauccuggaacucauucuauagaucaggcuggccucgaacucagagaucugccuaccucugccuccugagugcuggguguguaucaccacugccuagccccauuuuuuuaaaguuaaaacuuuaagacuauauggggguuggagagguugcucagugguuaagaacgcugacuacucuucuaaaggaccaggggucaauucccagcaaccacauggcaguucacaacugucuguagcuccuaagaucugacugcucacauagacauacaugcaagcaaaacaacaaugcacauaaaauaaaaguaaauauuuuuuaaacauuagaguauugagacuaaggagauauuuuaguggccagaaagcuugccaugcaaacagcaaauuuaagaaccaggguugggaucugcuggugggcauggcagccugccugagaucccagccucugaaggcagaggcaggguguagcugucuuuggcuacuuugugauuuuucuuucuccuacucuuuccacucuuucaacacccuaacacuagauaggagagggaacaaaaggauagaggagagaggcaaaagaucccugaauaaagucaggggcuggaaagagggcuauguuaucauuagacuacuuccugcugauuagcgacaucgaguuccauggugaaauuuugaccucugucagauaucuucuucuuucuucuuugugacuacuuaacacaacuaucaauaaccaacaaccuucccugccucauggugcccuagccuuuuauacccuuuaaaaaguucccagaauuccaaaugucagacagucacagaaauuauguguaacuggcaaaaauuacagcugugcuagagcaugaggcaaaucauagucagcugcuguggacagucugaagcagccccauaucccacaucuaugauuaaaaugaaacuauauuauaauauuucugugauuuuaaaagaaagcaaaauucuaaaauugucacuagagcaggggaucccuguugcaagcuggcuagcuagacugguuguauggcuccguuuugguuuuaguuaagagacucugugccaugaguaagguggaggaaugaucgggaaagacuccuaacaccagcugugagccuuucuguacaugcauauauauguggacacacacacagacaaaggaauuauaguaucgaauauaacucaguucaggcugauaaaauaucaacacaccuccuuuuguuuguuucuguguuuuuuccgggcuggggcaggauuuuuuuguggcgcucuagcugaccuagaacuuacuacguagaucagccauccuugaacucauagagauccacucgccucugacucuugagugcugacucuaaagguauggugcccacaguuuaauaagcaaauaggaaugucugugugguagguccaggugacaugcccauuuaaagugcuguaggaaaugcuuggugagccuuggcacugccccaugcucucccauagccguuuaccucacagcuggucccacucacagugugggugucauuguucuggauggggagcagggaggagaccugucuccuaaacggggccuguggagugugcugauuauguaaaugguuguccugggauaucguggugccuguguguuuaggagcugccuguggcuguucuugugccgucaggcugaggaaagcggcuacaucugggaggugagagaaagcugaaaugcucuuuguucuuuuuguaaaaguuggcugaucucugcucuaauucauuagauaacuaacccacuucaauuaccuuucuuaaaaaaaccaaaaucaagcuagagagauagcucagugguuaagagcucugaaugcccuuccagaggacacagguucaauucccagcacccacauggggguucacaacuguuuguaacucccaagaucugauacccuagcacaggcauacaugcaaaccaccaauguacauaaaacaaaaacaaaaaaaccccaaaaucaaaucauuuaucguuguuggguauaguggugcaugacuguagcacuaguacuugggggucugaggcaagagaauugugaauuugagaccagccugggcgauccuguuccaacaaaggaagguggggccagggaggaagcgaagaaagaagaucacccacaucuuacguuacuguuuauuucuugugguuauuuacuuauuuauuuuuaaugcuuauuuuuauuuauguccgucuguguuauauacacugguaucuguggcgaucagauaagggugucaggucccuuggaguuggaauuaugggcagcuaugaaacaccuggcguggguguugggaacccaguucaggucucugcaauagcagcaggcacuccugacaacugagccaucugucuacuccuuuccuaauucuuauuuuguuuguuugguuuuuuuuuuuucuuuuuuuuuuuuaagacagaguuuaccuauguaguccugcugucuuagaacucacucuguagaccaggcuggacuccugccucugccucccuaugcugggauuaaaggcaugcaccaccacgucagggauuuuuuuguuuuuuaaagauguaucuauuuugugugugugaguguuuugccuauuuguaugugugugcaacacaugugugcagugcccuuggaggucaaaagaguguguuggauucccugaaacagacuuauagaugcuugaaggucaucauguggguguuaggaacugaaccccugagaucccuccagccacgcccccuucccugauuauuaacagcucuuagagcauuucuucuuguuugaaaaauucuuugcuguauauauacacacccacagaauuuuauuuuacuuauguauguuguggaaaaucuccaaccccaauaagcccaugcaaggaaaacccaguuguguauuuauaaaccgcacgccuauauugggcagauauauaccguuuucuuccccagcuaugaaauccugcuacuugcagugucuccaggccaugcacuucugcuacaucuuccuuccaacaucucucccucuguccuccauuugcaggcucuugcaacuccccccccccccccccccgccuuucuuguacggagagccagccuccucacuuucgcccagcgauuggcuauuugucaucuuucuuagccaaucagauaauuaagauguauguguauguguguaguccuaugacuauaugagcacauguauguucagugcucccagaggccagggagaggucagaucccucugaaguagauuugccugaguuugugagcugucugacguaggugcagcgccuggccucuaguucuccugacugagcgagcagcaagugcucugagcugcucagccaucucucugucccagcccuuuauguucuuacucacucccagauucaggugugauuacaaguguuuuuaagccucgugauaaaggucaucuuuuuuauauuauagucaucuguuuggagacucggcucugucuccugggucugcuggacccucacauggcccuuucuuuccucaucuucgcagacgaucagccgagccuucaugaaugggagcucaguggagcacgugauugaguuuggccucgacuacccugaaggaauggcuguggacuggaugggcaagaaccucuauugggcggacacagggaccaacaggauugagguggcccggcuggaugggcaguuccggcaggugcuuguguggagagaccuugacaaccccaggucucuggcucuggauccuacuaaaggguaagggcuguuuuugucugucguaugaugcaggccccucccgucuguccacagggccucugccucagaguggcuggccccacagagcaccuggugcuugccacuagccucaaaggugccagggcugggaggauccuagaagauuaucuuucucauucuuagaggggaaacuuaggcuagcuagcauugacgcugcugucaggcacuaauguaaaaaggcagagacaacgucauuuguaacacaagcauuggagagccagacacaggcagauucucagguuugcuggcuagccagucuagucaaaucggcaagcuccaggcucagucugucucaaaauaugacagaaaaaucagugaggaagauacucaguguuaagcucuggauggacacacacauacacgcacaugugcacgcacucacacaugcaugucugaugccagcucaggccuccuuucugcaauggugaccagccugcccuucauagauggcgcugaggcacuuggauuuaugacuguucagaaauguugguuugcaagcucuuggccuuggccuaagauccaccuaaggaggagccccaccuugggagcugaggccuggugggccaggucuggucuuuucuggugcuaaaagacccuuuuggagcagggcacauacucacucuauagagcauccacacugccauggggacaacugaacccugccugaaacagaagcugugagcucaggauggcaggaggaagacaaaggaccaggugcuagcaaaggccaagaaagucuuccagaucuuagaaugacggugugggcagucuuuccagaugugcaggggcagaggaggaggggcccuucugugcuacuuuagcacugggcagguuuucacucuugagagaagggaccaucaucuggaccugcccacaucucucucuauuccgugagacacaccagcacucggccggcuuagugaagaugucgcuugcuuuagcaguuuagucugauggcuuuucugcauguccuguuuggcugcacguggguucuucccauacccugagaagagucagcaguguggaagaagcuaacccgaggucuggcuccuccuuacuuacuggggaaacaucacugaccagcuucccccagggcaagaggguuaagucuaggagguguugguuccucucugcuguauucucuguuuagcaaggauucaacuaagcuggcaugccccucuccccuuuacugguaucuuccagcuacaucuacuggacugagugggguggcaagccaaggauugugcgggccuucauggaugggaccaauuguaugacacugguagacaaggugggccgggccaacgaccucaccauugauuaugccgaccagcgacuguacuggacugaccuggacaccaacaugauugagucuuccaacaugcugggugaggcuggugaccucggagguggggugagggcugagugacagggcucucgcuucccccuccuuaugcaugccagccugcucuguccaaugagucacuuggcaucacaaaggcaaagacacaggauucuuccccucuccugcggcauguccccaucuagcccugguauccuuacuaggaacguguugggaauggauuuccggacucuaggucccagccaaacccugagccaggacugguauuuuaccuucuaccacaugauggugcuuuuuauuggagggaaacugaggcuagguauguaguagggcuugcuugauaucacccugcaaggacucuuuagagcuucccaggccuagauuuggccuccaccagcuaguagcaccaauuccuucugcauccagaccccuuucuaaccuauguauuuaaaaacuaagcuuugaguacaugauacuuuaaaaaucuggauauuuuuguauauguuuuuacuuuuuagaaauaauguuugguugggcuguggcucaguuaguggaaugcuugcccaccaugcguaaagcccauggguucaauccccagcacauaaacuagguguggugguguaacucauacgcccagcacucaggagguggaggcaggagcgucagaaggucaaagucacccuuggauauaugaggacuuugaauucagucuaggauacgugagacuggaugcauggaugcauggaugcauggauggauggauggauggauggaugcauggaugcauggauggauggaugcauggauggagagcuguuuuugaaacuuaacuuuccuuuaagucauacuguauacaauuuucugcuuuuuugugaccccccuauauacgacaaacauguuuucacaucauaaccuugucuuuguugguaccauaugugccaugauuagaacaugggcuuacagcucacaggcuguaacaugaagaugugcagggauggaccugugccuggucgagaggcuuugagauccucuaggcuccuuccuggccugggaccuuaugcucugcucugccagacuuguuccaugucucucucugacucagggcucacgccuguuguaugcugggugcaucagugugccacacccuagucaacagguagcagaggaaaauaggucugccaguccacucugucaucugcucucggaggggcugggccugaccuuugagaucucagauaucuguucuuuuccauuacucugagucuccauggggaugcuauagccaugugacuguggggaucagguauaaauggccugugugcucaaauagguaagauggaguuaggcaugcugacucaagccuagagucccagcaguuggaaggcugaggcaagaggaucaucaugggccagcugaggcuacacagugaguuuucuagacuucccuaggcuguagaguugaaauacuguuggaguaaacaaacaaagguccugucuacugaaagcucuccugugagugucuuuuggcugauauccagauuucucucugaggacgauggguaggcuugccacauagguaggcaaccagucuaccuaugcaugaggcuacucaggcuucccugcuuggcugagaguccuguaaaucaagguugacugacucucccagaggcucccucagcucauuggccugcuagcucucuugcugacauaugugcuauguccccgcacaggucaggagcgcauggugauagcugacgaucugcccuacccguuuggccugacucaauauagcgauuacaucuacuggacugacuggaaccugcauagcauugaacgggcggacaagaccagugggcggaaccgcacccucauccagggucaccuggacuucgucauggacauccugguguuccacuccucccgucaggauggccucaacgacugcgugcacagcaauggccagugugggcagcugugccucgccauccccggaggccaccgcuguggcugugcuucacacuacacgcuggaccccagcagccgcaacugcagccguaagugccuugauucccacuugcugcacgcaccaggccuuagccccugagccaccacuguggcugagauucuuccagccaccagaauggcuccugagucuguguucuugaugcuauaagccugcacaaccccguguugauugacccaguagguguuacuuucauggcggggaaagugaaauucagaaggccagggaaugacuucccaguagcccucugaggacaggugugucuugucagcaggcgccauggugauaugauauuggcagcgagccagauacagacuggccuccagcuagagcuggacagucccugaggccucugccaucgggucuugugcaucacccauacguagcacggcucugcugccuuucccuguugagccggugaggacccugagauuugaaagggugggaaauguaccugacccugagcuggucugcaguggccacagccagagucaccuccauuugucugucugugcacuacauguguguagugcccagagaagcaagaagccuuggaugcccuggaacuggagcuacagacaguugguagauaccacauaggugcugggaauagaaccccagguccuguggaagagcagucaguguucuuaacuccugagccaccucuccauuauuauuauuauuauuauuauuauuauuauuauuauuauuauuauuaauuauuuuugagauagagucuuacuauguagcuggccugcaacuugcuauauagacaagacugcccucaaacucguggagauucaccugcccccuccuucucccccuccccccuccugagacaagguuucucuauguagcccggcuguccuagaacucacuuuguagaccaggcugcccucgaacucagaaauccgccugccucugccucccgaguacugggauuaaaggugugcgccaccaugcccugcuuguccccgcuuuucugagugcuguguguccaccaugcucagcugggcuguucuugaagcagguaggggagcagaagcaagaaugcuuaacuuccuagugucuuggaacaguggcuuggauuucaaaccacccacuguaacacacugauccuggaggcugccugguacacaucugaguaucauaguuccugaaucugggcagcuggccuugggccucaggaccugggcucccugccaggaaggagagcuugcuuucuaaucucuccaaaagcaguuuucuccuguucugcucucuguggguaccuguauucacauccacacucccacacuccccaccucuugcacacaacuuaaaaaauaauaaaagcaaaucuuaaaauaaucccgggacugggguagagugcugaccuagcaugggcaaagcaaauguagcauggcauaaacagggugugguggugcaugccuguggccccaguacuugagagauagaggcucuuaguguuugaggaggaugaagagugaagagaguuugagaccauccuugacguccuggacaaguucaaugccacucuaggcuagaagauacccuagauuaaaaaauaaaauaaaauaaaauaaagaaaagggggaaaaggugugaauuuauucagaacaaucauacagacuucugugaugauagcagaaauagcccagaauccgugccagcugacaguucuguguccgcucuucucuaagaggcccagugucuguaaccacucugggugccguaucccuggccccagccucucaucucccucuuacugaugcuuucugcucagucuguuuguccagcuuuucagcuugcugauguucucugcuaggucugucuguccaacagccuuagcuggcuaugcuugccacucagucuguuuauccagucccuuagcuuucacuugcuaaugcucucugcucagucugucuguccugcuccagcgcccucagcuugcugaugcucggcgcucggucuguuugucccacuccagcgcccuccaccuucuugcuguucagccagaaauuugccaucagccggaugauccccgaugaccagcucagcccggaccuuguccuaccccuucaugggcugaggaacgucaaagccaucaacuaugacccgcuggacaaguucaucuacuggguggacgggcgccagaacaucaagagggccaaggacgacgguacccaggcaggugcuccugagggcagggugugggaggugcucugcccagagcuugcccugcuggcuuccaggcugcuccccuuuucugggcagggcugguggcaaacaaggauuugggcuccaguuauguaauuauaggugugauccuggccuuggacuuacgagaaacuggcuuucccaguuguugguaggggaaggggguugggugguagugggucaggcuuuauggaucuuuuguccaaugugguuuucuguugcuuagaaacacuacaugcuuccuuuauuuuauaagaugcaugcaauuaaucuuugugugugucuguguuuaugcgugugugugugugggaaugagacagcaguguuggguguuccucaggagcaauccaccggguuucuccuugggaccugggacucccugaucagggugggaugcuggcuggcaagucaaagagaucugccugucuccaccucucaagggcugggauuaagaaagugugccacugugcacagcuucccaaugugggaccugccccucugcucacagggcaagugcuuuucccagccaucucuugugccgcuaauucuguaauauaaacucacaagccugagcagauuaccaaagagaacaguugggcuucugagacagagccugguaggguuggagagagggcucaguaguuaagaagacaguuugauucccaggcugccuugggcauacccaugguacagagacauguacagaggcaaaacaccuauacacauuaaaauaaauaauaguaggaauaacacccccgcccccaguggcacauagaaagcagguugggguugugggaaguguuggagccucuuugccuggccagucagucacuccugcaucugugggugugaagcuucagggacucagucugugagccgugugaaaugguggcaggguggucuugggaagcaggaggcucugacucagguguggcuggaugugccucauagcacaugaauggagaugugugcgucaugcagucuuccugcauccacaggccaggacagcugucugcacucaccuuuuuuccauuuuguguguaugugugggugugacacgcacgugcauauguccuguuugcauguguaggguguaucuuucugagcacaugcaugcguaugcguguguucuugacagugauguugggaaucuuucaucuuacugaggcagggucucauagucaaaccgauaguccugcuggugcgcuugcucugggaucccugucucacagccuuuauggcugucaugcucagccugugugaauuucugaggcucuagccugugugcgcagcaagcucuuuaaccauugagcugccuccuccaugcuuguuuuguuuuuugagacagguuuuucuguaucccaggcuggccucagauucagucuguagcauaggcuggcuccucauccuccugcuuccuggcucccagguaccgggacuccuacaguugggugcuaccucaacuggcuuuuucauucuucuuauguuucccuuaaaugaaauuguguauuacugaaugcuaagccugaauucacuuuaaauuuuuauuauguuuauuuaacuauuuuguucuauguaugugagcaggugacaugguucaaguguggaggucaggggaauuugugggagucagcgcuccuuccauauauggauccagugucaggcuuagcagcaaucauccuuacccagugagcccuuuagccagucuacuguguucucccucucucccucucucccucucucccucuccuuuucccuaucccucucucccuuccccuucccccccucccucccuccccaauccuccccucuccauuccccccucccugucucugucuaucucucuguuucugucucccugucuuacccccacucccaacccccucucuauagcucuggauguccugggacuugcuauggacacuagacuggccuggaacucacagauaucccccugccucugccucuuaagugcugggauuaaaggcaugcaccaccaugccuaauuagcccaguuuucaaaucuaacagaguugagcuucucccggucugugacuaguccaggaaggaccugccucaggaagccuaucacaacagccacagaacccaguggccccuuucccaauguaugcuaugggacagcuauguuaaagcagaacuuacucccaugggcugguuuucagaucucuggaaauguagauuuuuuuuuuguuaaaaauuaauuaauacauuaauuuguguguacgugcaugccucugugugugugugugugugugugugcccgugcaugcgugacuagacacuaguuugaucccuuuaagcugaaugacuguguuuguuaguuacuuuucuguugcugugauaaaacacccugaugaaaaucacuuaaagaagaaaggaugugucucacaguucaaaguucaggcuguuagagcucaagcuaaggagguagaagcagaaccaggcagcuggucacauuguguccauagucaagaagcagagagcuaggcauggaugauggucacauuguguccauagucaagaggcagagagcuaggcauggaugauggucacauuguguccauagucaagaggcagagagcuaggcauggaugauggucacauuguguccauagucaagaggcagagagcuaggcauggaugauggucacauuguguccauagucaagaggcagagagcuaggcauggaugauggucacauuguguccauagucaagaggcagagagcuaggccugggggcacacuucuaaucccagugcuugggaggcagaggcaggcggaccucugugaaugguucuagaccacccagaacuacuuugugagauaugucucaaaacaacaguguaucagcagagagcaguguaugcugugcugucugucugucugucugucucucucucucuuuuuuauuauuuuuuuacauuucuuuauugagguaugugccauugcaugcaugcuuggggcggggucacaggacaccuugugagagugaguucucuccuucuaccauguggguuccacagagcaaacucgggucgucagacuuaccagagacccucucugccuucuuuuuaugcaaccagaaucccaggcaggaaauggcgcuauccacaguaggcuuucuugucuagguuaacccaaucaagauacucucccaccagucugcccagaagccaggugaucucccagguaauacuagaugccaucaguuugacaauuuagacaaaccaccacaagguguauaugauaaaaauccucacugaccuguuagguuaucaagucauagcuauagguucgacucuccuuuucuucauauucuucuuccuguucauccucuucuuccuuucucucuucuuccuuucccucuuuuuccuccucuccuuccuccccuucuucuucuguuagugguagguucgacuccccuucauauucuucuuccuguucauccucuuccuuuuucucuucuuccucuuccuuuccaucuucuuccuccucuccuuccuccccuucuuccucuguuaguggugaagauaguggcugguucuucaacuccacgcugggcaagugguuccaggcugucaccucccagacagucaccuugaguacuauggaugacuguagcuuuuguguaagaaagcgccaugguacaaaucauaaguccugugacuuucagacccuccccuccccuugucugccucagacacuuuccugcaccacccaguccuucccacuucuccuugccugccccagauaccccuuagcugcauuugccuacccaucacucgcuguacauccuugccuugcuccacccuuugacccaagagccucacaccugcccuaugccccuugccuggcucugcagccuggguccccucuccgugcauaagaagagagguaucccucugcucuccauuccuacucuccuggccacugaauuaaaagaacaagguuugaacaucgaaagccaagagccugaguccuaaacaguggaaaugaagggagagagguugggcuucaggucucaugucuaucuaguugacagccugccaguguccucugguggauuccaucaugggaccuagagucugguguccuguuggggcucuuucuaguuuguucuguguauucguaaaugggcauaucacuaagaucuaaguugagggccaucgugaugacucaguggguaaagguguuugaaaucaugccugauggauggccugguuucaaauccugggacccauguggugcaaggagagaaccagcucucaccauuuguccucugaacuucacacggugucgugaaaggugugcguacacacauaugcauaaaaccaaccaaauaaauaaacuuguuuuuaaaagagccgggucugcaaguaaugccucacauguguugaaaucuuaaccuugaggcugacuugaccuucugcucucccuggguguucauggcgcauggcaguguggugcuagcuugguuugcuucucucacagcccuccaugcugaccucucccagccaaagccugagcccagacagacagccacacgaccucagcauugacaucuacagccggacacuguucuggaccugugaggccaccaacacuaucaauguccaccggcuggauggggaugccaugggaguggugcuucgaggggaccgugacaagccaagggccauugcugucaaugcugagcgaggguagguggcccuagggagggacgggugagggcugcaaccugcucagcccauguauucauucgcuggcccccguguaccuguagugcuggccucgugggggcuagccaguguucccaaugugguacccaggacccccagcugcacaagcugaaggugacgucuagguggugguuuggggacccuggggaugucaacccugcugcaugggccuuguaccagucuguucagcuugaucuuuguggcugcaggauucugccccagacacaacucaaagcgcguccuuccugggaucccccagcgcccuugugugcugguccuuguagugccuuguuagugagagacccuuggacaggugcccacgaagcucaagaacaaagcugaacuugcauagaggcucaggcaggagcucacuggccuuuaaguccugugggguagacauguaaagcagguguuagauuggcaggguguugucuauaggguucccgauaaugaucagagccugaugugccaguguucaaauccugacuccugcacuucgcuaccgcagugauggugggcaggugaugcggccuucagaggcuuggugucccuuucugugauggugacggugaugucagucuuucagcccauagauagcuaaguagagccuagcugcuggagggcgcugcucaggagcugugugaacacccucugaggaggugggaacaaauguucuguggcuacaauguugauccauauacugucucagacacuuagugucuugccacuucagguuuucccucugaccaguugcuucucuuugcuucauggccuucucuuuucagcaguuuucacuggauucagggcuacccucacacacaaggauuguagcucaauccuaauauuuuccaagaccccauuuccaaagaggcucauacccuaaguuccaggguggcaugaauuucagggacacuauuccccccaccaugagguauaacccggcagccuggaggaccugugaggucaggggcugggcugggccugcggaugaggugggagcucacagcgcccgcccacuucuucccugcaucucccaugugcugugcuuccgcagguacauguacuuuaccaacaugcaggaccaugcugccaagaucgagcgagccucccuggauggcacagagcgggagguccucuucaccacaggccucauccgucccguggcccuugugguggacaaugcucugggcaagcucuucuggguggaugccgaccuaaagcgaaucgaaagcugugaccucucugguaugcacccuggaugucuccagccacugaguccucagucugcaacuguugggggugacccuaccgugcgcucccagccuuccuuacuaccaauagggguagcaguuaaaaucuugcucggcuugcugugagccuggcauugugcugugagccuggcagcucuguauucauauguaauccaaauaccaugggggccuggcugugagccccuggacuacggauccuagugccuuuucuucuaguaaaagcugugugauuggggagguggcucaguugguaaagagcuuccuaugcaauagaaggaucugaauucugauccccagcacccuuauaaacagccaaggucuauggcccaugccugcagucccagccaaggacuguggcccaugccugcagucccaacagaggacuguggcacaugccugcagucccagcugaggacuguggcccaugacugcaaucccaguguuaggaaggcagagucuggaggaucccugaggcucucuggccagccaaucuagccaaaucugugcacuccauuuucaguaagagauccuguuucaaaaaguaagguggagaaccagccagaugacucaguggguaaaggcccuugccaccaagucugaagacaggaguuugaucccuaagacccacaugguggaagaugagaacuuacuccucuagcaaguugucuucugcaagugugcuguggcaugacccuccucccccaugaauagaaguaauaaaaauaaaaacuaagggugcuggagagauggcucagugguuaagagcacuggcuccucuugcagagggccucaguuuaguucccaguacccacauggcagcucacaaccaucuguaacuccaguuccaggggauccagugcccuuuucugggcuccuuaggcacuguagguauaugguauacaaacauacauaugaacaaaauacccaaucacauaaaguaaauauuuaaaggucagguguagugauccaugcuuuaaucugaguauuugggaggcagaggcaggugaaucucugugaguuucaggccagccugguuuacaaaggaauuccaggacagccaaggcuacacagagagguccugucugucuuuuauucauucauucauucauucauucauucauucauucauacuacauacauauauacauacacaccuuaaaugauaagauugagacuucuggccuucauauguaugcacacuuauguagauaaauacauccacauaaauacugggcgggcaugggcacacacacacacacacacacacacacacacaaugagugaggagagaaagcaccaugcuuacagaggccagugaucauggugcaguuagaugguaugauccugaacccuaggccugcccuagugcgagcagccugcuuauaugguaucugucccagcucccagcccuggagaguauagaaaugccccagacucgcauggccccuucuuuaaauaugcauucuccugagcacagugggucuggcccuucacuuggcugccacucauggagccuuuaugcuaaccacaggggccaaccgccugacccuggaagaugccaacaucguacagccaguaggucugacagugcugggcaggcaccucuacuggaucgaccgccagcagcagaugaucgagcgcguggagaagaccacuggggacaagcggacuaggguucagggccgugucacccaccugacaggcauccaugccguggaggaagucagccuggaggaguucuguacgugagaggggacaguguuugugguggggucuccugggggaaggugaaucagcccuacuggcaucagaugggcugcuggugcaagagcagugugccugaggagcucaugggcucagcaccgaaggccagugcauguccagaugucugccucuucgaucaguuuguuugcugauauagagaaguacccaaacaugcuuuuuaaaaaaguucugucuucuaccuacccaccuacccacacuucuaccaauaucauucuguccauccguccauccauccaucucugucacuugucuauauuuaucaucuauuugucaguuugccuuugagacauaguuucuagguagcccuggaauuguuuuuuuuuuuuuuuuuuuuuuugguuuuucgagacaggguuucuuuguguagcgcuggcuguccuggaauuuacucuguagaccaggcuggccucgaacucagaaauccaccugccucugccuccugagggcugggauuaaaggcgugcgccaccacugcccggcuagccuggaauucuugacaguucucaugagugcuggaauucucugagcugggggaggggaggcaguacacaucauggcagugauuguaugaugaagaaggcuacaugcuucacuggcagaaacccaagcacaaaggagagagguggaaucccacugucuccugcaaagacaccuccccacccccacccccaugacccaaaagcucuccacuaggcuccugcuguuuuguuuuguuuuguuuuguuuuugcaguccucagagugaauuuaggucucugcuugcuggauaaguacucuacccuugagcuacaccuccaguuagguccuacuccuuaaaguucugcugcuucucaguagugccccaguggcaaguaccucuccugggaagugcaagucucugaguuucaauuaccaaaagaagaaaggaccuugcauccgcuccccuaggugcaaagccauuggggagcauguguccaaauggacagccuuucuugucagcugcuccgauguccuggggguauacugugcuuuuccaggguucagaccuguggcugccccuccaugcugccacacccuuacagcagucugacuccucccuagccccacagggaccaucagcuguccagagcuucccucccagcuaggcaugaugucucugaguaccuucccucuucaugcuggaauggugguuggguugaucuugugccgguggcacagcugcuguacagguacagcgcugcugccagacucggucuuuacaucagauuccaugucaguauugauugacugggcugggagcugggaccaaaugagauggucuucuauaggaaucuggccuuugccuucuacacacguugagcucugaggaggaagguagaggcugacccaacuccaucuugcugugucccugcagcagcccauccuugugcccgagacaauggcggcugcucccacaucuguaucgccaagggugauggaacaccgcgcugcucgugcccuguccaccuggugcuccugcagaaccugcugacuugugguggugagugagaccuugggacuuugaguagggagccauaucacugccuugcaugcccgaaaacugugucgaaucuccaaagcaugccauuucuuuacuuauggcuucucucucucucucucucucucucucucucucucccaccuuuuuuuaaaaaaaaacacucauacauacauacacacacaucuagugcuaugguuuucucccaaaaaacugcuuuuccugcaucucacagauuuuaauacguuguaucuuaguuuuuggauaguucagaugugugugugugugcaugcacgcgugugcgucuaugugcuguguaaacuagggguuaaucguggcuguuauuccucacuuugcuuuuuuagacaagguuucucacugggaauuggagcuugccaaucaggcugugcuaucuguccggugaccccaaagauccucuuguuucugcugccccagaacugggguuacgagcaugcgucaucacaccuggcuuuuuacguugugugcuggggauugaacucagguccucacacuugugugacauguacugaucccguucccagucgaugaaauauuuagaaaaaauuugagagacaacuucuucagcccaagugcuauuuagcaguguguugugaagugcagguuggcucaguggugaguacacuugccuagaaguauuugaucucuagauacuuaggagugucccagcugucucuguucugauuuccucuuuaauucugcuguggucugagugcuacccuuguggcaucucuguucuuuacauacauuguuaugugcucuacggccucguguguuugggacucaguagauauuucaguggucuugaggagacuggggguucugcuaugucagguguaauagucuagaaaaguuuauuagauucgguugauugcuaguacagaucagccgccuuuucucuuuccugauugcuuaguccauuaucaguuacggacaggguuguuggauuuacaacagauuuaaacaaagauuuuuuuuauauugucuguguaaauauuugccuacauucaugucuaugcaguuuacauuguccacagaggccagaagaaggguaguacauccccuuggaaccagaguuacaagcaguuaugaguugucagaugggugcugggaacugaacucuggucuucugcaagagcagccagagcucuuuaggucuccaguccccuaauaacagauuucugcuucugaccuuucuccuacccccucccuauauccuuuuccccuggugcugcaugguugugaugguggggugucauccagaaacaggcaaggaagaccuagguucaaacccuggacucugacuucuaagaugagugccuuucagcuggacacaugccuuuugugagccacugcuucccccuguagagacugagaccaucuaccuggcaggcuggcuuuccuuuaaguaacagagcacuuguggggaauggccauaaaagugacagucuucaaugcuaccgugauuaagcgugccuccuucggggcuuccucucuauugugugcugggcagccugggaagaguucucaccagcaucaggcuucauccuugcucgugacuucccccguauacuuuggacuuucacugagcaacugagcauuguucucuaauggcuagaccugcuccugggagacuggucugauacuucaaaccuuacaguuuggccaagaacagagagggcauuugcugucuguccauucccuuucacaucuaguagcuuaaacagacuuguggucugaagcugcugucuguguggcucccguggaugccugagccuccugccuagagcggggacuauggaguggcccccacugauccaggccuggcucuccacuuaggagcaugugcuuagccuaccgugagauuuggaagucccuccuuuugguuuguuuguguuguuuuguuuuauuuguuuggucuuugagacagugucucuugcaguccagguuggccuuggguuucugauguaguuaaaaucaaccuugaacugcagauccuuuuccauuucccaaaugcugugacuacagggcaucugccuuuauccucaguuugaggucucugcucacagccugugagauguguauuuucaaugcagacacuuugcaaucuuccauggcuacuugucuggucacaggaugaagggcuugcuuaggcccuuagauggaagcccugugacacaucaggcaagugggaaggcaggccagggccuaaagugcuucagugcuucaacaauacagccccccacucccucuguauggcuuggccuagccacacaccuguuccugccccacaggccugucacucaugcaguggaaccuggguguacagcggaggagauggaggcuuugagaugcuuaggaacaucucggguuuuccauccugaauauggugaaugucaugauugcuacuuaauucaaaguucacagucaguccauguuccuuaccuaagaaaagagacauggaggggcucaauggguaagaacacuuaauugcaaacaugaagaccugaauucaaaccuccauuagccacaucacaggcagguguggcucuuggagcaccuguaacccuagugcuauggggagaaacagggcgucacugaggcuugcugacugccggcaagcuccagguucagggagaggcccuuuuucaaagcauuaaaguggaaagugauggagaaagaugcucuccaugucugcauagguguauguaccuccacauacaugugcauauacaacacacacacacacacacacacacacacacagagagagagagagagagagagagagagagagagagagagagagaggagaaaauaagagagauauugaggcuguagcuugguugguagagcacaugcacaaggcccuggguucaguccuucgcacuguguuaaccaggaauggugguacaaacauguaaucccuuuccuaaggagguggaagcaggaggaucagaagcucaagcucauccagggaaguuugaaagcaacuuuuucaucccugccuuuaucugugcuggggcugaagguaucacaugagcaggagacaguccccagggcacugcugacacaaagucaguggaagcgcagcgaugccuuugcguggcucgcuggguggagccugcaugacuguggucuccuucccuccccuagagccuccuaccugcuccccugaucaguuugcauguaccacuggugagaucgacugcauccccggagccuggcgcugugacggcuucccugagugugcugaccagagugaugaagaaggcugcccagugugcuccgccucucaguuccccugcgcucgaggccaguguguggaccugcgguuacgcugcgacggugaggccgacugccaggaucgcucugaugaagcuaacugcgauggugaggcccuacccuggcugccaucucccucccaggucccauuaaagccauuuguccuuccuuccuauacaucaaacacggggcuccauuuugccuuccacagguaagggugcuagaaaacagcuaaauuggcaggccgucuuggugggaacaaaugaaguaaguuuuaggcacagccugaaggaaugcuccugcaugaccccaucuauucuucgggcaguugacuuaaagacaggcugagacucacauuuccacauuugguagugacuucugcagaaauguaagauaaauccauuagucaguugcuuucagggcucacacccgguacagugucaucuucaaaggcagugccacacucacugcauugugccaucugugggauaaugcuggccaccugggaccacucugacugaccacgugugucccgucguccuguccccguccccguuccccguccccguccccguccccccgcuuuugagauagggcuuuauauagccugggcuaaccuugaguuugcuauguaucuauagucuugaacuuauucuuuuucuacuuccuacaugcuaggauuauagguauauauuaucagugugauauguagaggaucaaacccaaggcuccuaaaugcuaugcaagcacucugugcuuaucaaccuagcuacauucuuacccucccucccucccucccucucucucucucucuuucuguuuuuuggauuuuuuucccccugagacaaggguuucuccauauagcccuggcuguccugaaacaauagaccaggcuagccuugaauucugucugccucugccucugccuccugagugcugagauuaauggugcaucaccaccaccuggcccucacccuuaucuugagauugugugugacucugugugugugacuguguauguguguguguguguguaagacucugugugugugugacucuguguaugugugauucuguaugugugugugacucugugugugugauucuguguguguguguggugugugacuguguguaugugugugugacucugugugugugauucugugugugugugugugugugacucuguguguguguaugugacucuguguguaugugugugugauucuguguguguggcucugugacucuguguguguaugugacugugugugugugugugacugugugugugugugugacucugugugugugugugucucugugugugugugugacucuguguguuuguguguguaugugacucuguguguaugugugugugauucuguguguguggcucugugauucugugugugugugugacucugugugucugugugugugugugugugacucuguguguauggugugugacucugugugugcgugugacucuaugugugugugugugacugugugugugugacgcucuguguguguaacucugugugugucugugacucuguguguguguaugugugugauucuguguggccuuggcagguuucucugugaagccaugaugauugcuuugcgugcacacacacacacauacacacacaugcacacaugcaguuauacucuuuuuuuuuuaaagauuuauuuauuuaguauauguaaguacacuguaguugucuucagacaccccagaagagggcgucagaucucauuauggaugguugugagccaccaugugguuguugggauuugaacucuggaccuucagaagagcagucuggugcucuuacccacugagccaucucaccagccugcacuuauacucucaagacaucuuuuuuuaaagacuuguuuauuauauauaagcacacuguagcugucuucagacacuccagaagagggcaucugaucucauuacagaugguugugagccaccauguggucgcugggauuugaacucaggaccuuugguagagcugucaaugcucuuaacugcugaggcaucuuuccagcccccaaggcaucuuuauccacuaagucagugguucucaaccuuccuggugcugugacccuuaauacaguuccucauguuguggugacuccaaaccauaacauguauuuuguugcuaguacauaacuguaauuuuguugcuguuaugaaucaucugauaugcaagaugcccuacgugugacccugccagagggucuuuugacacccucucccccaagaggcugugagacccacaguuugagaacugccgcauuaagccaucucgcuggccagccuuuaauuaacauuuuuuaaaauuuccauuuuauguguauggguguuuugccugaauguguguauguguagcacgugcaugccuggugcuggcagaggccagaaaaggguguuggauugccuggagccugaguuacagaugcuuguaaggcgccaugugggugcugggaacugagcccagguccucuggaagaguagcccuugucuccuaagugcugacaugucuccagcccucccugaaccucucuuagcguuugcugugugugucgcucuagugccugauccacacugaacucugucacaggccacauguuuucagcaccauagacccaggcuggcacugagcugcuccuguggcauucuugcugucucugcccgaagcugcuggguuaugcuuucaaugacucagaugcuggcugccacuuuccugcauccccauucagcaugaccccacguucugcaggggacaaggccuggaguggccuuggcagguuucucugugaagccaugaugauugcuuugcagcucaccagugcucugagggaucugguggaagccacgauaacggcacaugugcccaaaccaguuugcugccaaugucuguaaauaaagguacauugucugugccaggcccagugguuccuguacaugugggccacucucaggcuagacgagagcugggugguugguuacagagccagcaaugucugcuucuggucucagaguaucauaugugaucaguuuagaaauccucccucaucccacucaccugcucacccucuucaccacugacagcaggugcuggcccuccacuucuaggaaggacagagugcccuugucuccuguucccaggucagcaccuggagcaugucaggagaggguccagauggaugguugugagaggauguuaaguccccagaugcuuccucagagggccgcagucugcagauuuguuugcccacucucucccagguguuagaggagauaaccuuggucucuacaaaugcagcaccuacuuccauggaguucugggcuccacugacccagccugcacugaggaaauggcguuguugccgacuccaccuuccuggaaauccugcuugauccuggagcugaggcuacugcucugugcugucucugacucaggcugcaugccuccugggcacaggcugggcaucaaggucucugugcccuuuggcauugaacagagcuucagggaucauuuuaaggagacuggauuuuccaugaucuuuucuagcuggguccuagaaaguauuccugcuacugggucuguauuuggaaucagaccuuuucgguuggagccaggcaaaacugcugcucucuggcuccucugagcaccgccccuuucuccccacagcugucugucugcccaaucaguuccggugcaccagcggccaguguguccucaucaagcaacagugugacuccuuccccgacugugcugaugggucugaugagcucauguguggugagugguuucaggcagcuccuugagggggcagggucugguguggagauuggguggagcuguggaaccugaggcaccuaggaggcucauuuagugaguggccuucuuuaguuucuuucuguugguggaaugaaaugcccugacacaagcaacguggggagaagggguuuauuuggguucacuucuagguuacaguccaucauuguggggagauccaggcagaaacuggaagcugcuggucacauccauaguuggggggagggagggacggagggagggagggagggagggaugcaugcaugccuacucauaagcucucuuucucuucucuuauaaauuuagggccaaaacucagguucccauguacccacaggccaaccugaucuagacugucuaacaagugauucuaaauugugucaaguugacacaaaccaucagagagaggcaacagcuagaaagcagagacugagcuguggaguuuccuaaugggguggagugcuggcaaagccagacauagagagguuggccugcuugggagucugccuccccgugagcuguuggccucagaccugaguagcagccacacuuuugcuacugggacccuccuugguacaaucugcucuauagcagaggagaccugagauugcaugugccucaagaaaaaugaaguguauauauuguacauacaugcacacuuauaaauaugccguaaauaucccuuggauaacauugauacccaggagugcagguguuacuguggaugaugggugguuggggcagucagagaaagcuugcuagaggcugucaguggagacaggaaggaauuggaauucagagagauguaaugcuuugcugccuguggcuacucuauccacugcauggggaaccagggcuuagcccucagcucuggagaggagggcauaugggagagggcaguuuccccacggacucagacaccaucucagguuagacacuuugggcucagauggaggaguuaggguugcugauguccucugucuuuugcuaggcaggggccucaucuggugaggucagcacaugggcugccauaggccuggugugcuugcugacacuccccacacucaggcccuguccucugaggcagaagguuuuuuuuuccaacuccuucagguuguggaaggaauggagcugaugucugugggacuguugguucccaaagugaacauacuuuugccagcugaaucagggauguguccuucucguucugguggccuugauauaagggcucugcccccaauagaccccuguagacuggcacccagcugcucacaccuaauuccagaccacccaucccagcucucuuccaccaugacacaggcuagggaauacuuguugccaaccuccgcccagugcacugugggcaaugccaugagagcauggcucagggucacuggaaaggaagcaggguuggccaggcagagaagacaggugagggagcccccuggcaggcccaggaacagcggcaguggucccagagugagccaaacccauguccccagcuuaccugcuacuccugcagcugcugggguuugggcaaagguagcccuucuagggucacagcauguuucccgugggagguccucccccuagggauuaaugugagcgaucuaucccuacccaacagaaaucaacaagccacccucugaugacaucccagcccacagcagugccauugggcccgucauugguaucauccucucccucuucgucaugggcggggucuacuuugucugccagcgugugaugugccagcgcuacacaggggccagugggcccuuuccccacgaguauguugguggagccccucaugugccucucaacuucauagccccagguggcucacagcacggucccuucccaggugaggagccugaagcauuuacucugugauggaggggguuugguugaguugccugggaagaaccuggagggucacccacagaaacacggucuuccaggggugacacuuuuugcuucaaacccugucagcagcagggugugcccauuuccaugccucuugagggugaaaguagcuguuuccucugaggccaccugaagacugcccaagccucugcagcuuuguagggguagaaggcagaacuugucaggggcugcgacagcaucacucucccaggauucuuaggaugccuggccucuguuugugugguauguucuccacucagccuuccugagaauuucucugagucugagugcuuucuagagacuuggauagcuugcccugguaucgccagaaauccagaucugcaggaggugauacaugacugcccgaguaggaguuuuguggguguugggaccgaggcugggcauuugcucauucugacauggccuguccauucccacaggcaucccgugcagcaaguccgugaugagcuccaugagccuggugggggggcgcggcagugugccccucuaugaccggaaucacgucacuggggccucauccagcagcucguccagcacaaaggccacacuauauccgccggugagugaagcaggcaggcgaauggauggcagugggagacucuccccucagugcuggcuccagggacuuccuggguggaaggcuuucuaagcuagugauucuuccagcaccccagagaagggugcugagugaugccccccacuucucaccccagagaagggugcugagugaugccccccacuucucacucgugcuauuguuuucuguguaggagagggugaccuguggcuauugagauggucgacaaaacacagauacagaaggggauguggcucaguucuuagggugcauguuccaaggucuguguucuauccccuacacaggauaguggguauagagauggagguagaaggauguggaauccaaggucauccuuguuuacacaaggagcuggaggacagccugagagacaugucuuuauaucucaaaacccaaaauaacaaccuggugucagggcgcacacacuuuuaauuuuagcccuugagaggcagaggcaggaggauuucuaugaguucaaggcuaguauagacuacauaacaaguucuaggacagcuaaggccgaaggggcucaaaaauauagauagugccagacaucaacaugcuggcuuuucccugugcacacagaccuguggucaugucauuuauauaucagaugcaggaagaaguuugugacuaauaauaagccugaauaauucuaacaauacccugcaguagguuauaugaauguaacagugaagauagggcuaaugggaugguuuaucagggcaaggggcuugacaacaacugccagccugaguucaguuccugggagccacgcgcuagaaggaggaaaccaguucucuccggcugcccuccacccuccccacacacuauggcaugugcgcuggcccccaaccaacacauugauguaauuuuuuuaagaaagagucaagacagauauuagcauuuucagaccuagguaacacacccuagagggcaaagccacagugggggcuacaauaguggguguccuuggagaccucagugcuugacugcauguucuguaggcaccuugccucgaccaggccuugcagcuuacacaaaggcaaggacagccccuugagcuucuuccaggggcucccuagggagccuccccuugccccuugggguagcccuuguuugugugcugucauuuccuuaucacuccuccccuuauccuggguggauguggcugaggacaguguuaucugaggugacaggacaggagcugagucuucugaaaguuccagcgacaucuggaguuuagaacaccucacuguuuuuguagucacauagcuaucucggcuggcagagcagcucagaacuaccucucguaaguuaaagcccugcacucagugcacugagcauagucacaggucugcagaccugcacaucgaagugggauccccaggaaaccacagagucagcucuucagaagcagcuaguguagugugcucagagugcaguauucaaagagcacggaauacagaugcuaacuaagucaaaugggacucuaggagcuauguauaccugugaguucucugggcauuauuauuguauuuugagauaggaucuguuccaccauggccuugaacucaucuuucugccacagucucccuaauaccugagauuacaaguaugcaccgccacuccuggcuuucaugggagacucuuuauguaagcuuggagucagaauuuauggguuuauaagguaugaacuuaauuuucucuaagaaggaaguggcuuuucuuauuuuuuauuuuuaaacuucaguuuuaggucauugugaauuuaugcucaaccccaggggauaauaucucccaccccagguucucacaugguaaaaagccacauacaugcagucuaguagcauaagcaggaccuagacaggauccugcaaauguggauuuuaacagcuuacacacgugcagguuggcacucuagcucagugguagagcgcuugccucucaugacucuagcuccagauucagucccuaguaccacacauauugagaauagcauauugaggcuaguugccaggauaguuuaccugagcacuguggcucaugccucuacucccagcacuugaguggcugacucugaggauugccauucguaugagccagccugggauaaaugguuagagccuguuuuaagaauaaaauuuaaggggcuggugagauggcucaguggguaagagcaucugacugcucuuccgaaggucaggaguucaaaucccagcaaccacaugguggcucacaaccauccguaacgagaucugacucccucuucuggagugucugaggacagcuacaguguacuuacaauaaauaaauaaaucuuaaaaaaaaaaaaaaaaagaauaaaauuuaagcuggguguggugaugcacuugagagguagaggcaggcgaauuucugaguucgaggccagccuggucuacagagugaguuccaggacaaccaggacuauauagagaaacccugucucggaaaaauaaauaaauaaguaaacuaaacauaaaauaaaauuuagcaaaucugugugcaccuugggaggcugaguucagugccaaucuguucugcauaaugauuuccaggcuagccuauuuuacacagugaguuggaguuuagcuugguuuacauagugaauacccggccaaggcagggcuacauggugagacauugccucagauaaagaaacaaacacacagacagagaaguaaauaggaccaagugaaguaaagcaguugcuccugaagagccuucucagagccuggcauuugaugguagcaaugcuuauccagccccugugcucagacauuacauguuagcgcaucccuaggaaguguguguggugaccacagccuggcuuauuccucaguggguguagaugagaugccuguuuuuuccuugucacagguggggucacugggagcugucccaaucuuaguaccucaaccuugguaccuaucugggugucuugguuugucauuuugaccucuuuugcuagaggggacaguuccccuucaugccagcagagggccacacuugcaagacugcugcugucaaaacacaacuagucuagcguaggauuaagcacuugggaggcagaggcaggcggauuucugaguucgaggccagccuggucuacagagugaguuccaggacagccaggacuacacagagaaacccugucucgaaaaaaccaaaaaaauaaaaaauuaaaauuaaaauacgugucacagccaggcgguggugguacacgccuuuaaucccagcacuugggaggcagaggcagggagauuucugaguucgaggccagccuggucuacaaagugaguuccaggacagccagggcuauacagagaaacccugucuugaaaaaaaaacaaaacaacaacaacaacaacaacaaaauacgugucacuuugaggcuagccuggucuacagagugaguuccaggauagccaggacugcacagagaaacucugucucggaaaacaaaacaaaacaaaacgugucacugugaggaaauacccaacacaaacaauuuaaagcgggauggggggguaggggggagugguuuauuuuggcucauggguucagggauucaaagguuucagccuagaguuuuuugaaccaaacaacauggugguaggagacgggguggagggcagaaccgcuucaugaguucagacuggagagaaaggggcacagaaaggagcugaggcuaggucuuccucaggaaccuacuuccaaguaggcucuguccuccuuuuugccacuucaaaugcuuucagaccauguuucaucuaccauugauccguugacuagguccuggcacucaggaucugaucagagacauacuuagaggggucugucaccaagcccccagcaaagcacaucucacaguccaguuuguugucuucccaucacagucaguggugaguggcaaugugcacagcuucuugaaaaaggggugagccaccaccucuaccuccuucuccaaccucuguauugguuaaagcuccagcagggacuuggggcaucuugaguaggagccaggucacagggaauggcaggagauacaggagugaaagucaagugcagccagugggagguaucugagggaagcagagagagaggcacacagccucugcagagagaccuacugcugcugggcucagggcuaaugggagugcucuugcugacacugcccccuacuggccagcacaguaaugcugagagggccgaggacaucugguugaaagcacuuuggucuccaugccucugaucagcaccuuuggggaagauggcugaugccaccccucugcuuccuaaguuucacuagcucuggaaggguucuggggaccacaggcagagaauagagcuccagaccccaggcuggcaagcugaguaaaugauucagccaggagacgcuuggaguaacccgucucccucccucuccucagauccugaacccacccccguccccggccacagaccccucucucuacaacguggacguguuuuauucuucaggcaucccggccaccgcuagaccauacagguaggagcuuguccucgccuucccuacuagugagaagggccuugucuccgccuuccuccaugugugucccaugggcucugucuaugcuguuugccucuccuugcuggguuugugggguguggcugagugugagcucagagcugguuuuauacaagugaauacauacauaaugggcuucuccauugcuugagacaccuggagcacggccggccuugaaggaaucuaggaaaggauucgcucccccucccuccagugcugucucacugcauggaaacgagugcuuaggcucugcugugucucagcucagccauggcccuggucaaaaccugacuaauguaaccuccauuacgaugauuuuucaauugugugugugugccugagaagaggccagaggcauucccuggagcuggaguuacacacaauugugagcuaccugaugugaguuuugggaaucaaauucugguccuuuguaagaacuauacauguuucuaaccacugagccauuucuccagcuaaagggugauuuuugcuccuuuguuaagacaguggccuaucugagcuggaaaccccaaaagcgcucagccagacuccaacccacaaguuaccuauauugggguucucagaccgguucuccugagugagaguggugcugugagcauuccuaauacuggggugaugcaaauagcuuacucuuuuucauaagaccccaaugguaugccaucaaaaauucacaccagagaaccaguaagucuauuggucgguuugucuuagaggggugcaggggccccugcucugugucaaaagucuuuauccaccaccacaguaugccuuuaggaaaucuuucuuuuuuuuuuuuuuuuuuuuuuuuuuuuuuuuugguuuuucgagacaggguuucucuuuauagcuccucuggcugucugucuuggaacucacuuuguagaccaggcuggccucgaacucagaaauccgccugccucugccucccgagugcugggauuaaaggcgugcgccaccacacccggcucaaggagcagccuuguacacagguggcuaggcacacaugugaacuucuucuguguuccuucuaggcccuacgucauucgagguauggcacccccaacaacaccgugcagcacagaugugugugacagugacuacagcaccagucgcuggaagagcagcaaauacuaccuggacuugaauucggacucagaccccuacccccccccgcccaccccccacagccaguaccuaucugcagaggacagcugcccacccucaccaggcacugagaggaguuacugccaccucuucccgcccccaccgucccccugcacggacucguccugaccucggccguccacccggcccugcugccucccuguaaauauuuuuaaauaugaacaaaggaaaaauauauuuuaugauuuaaaaaauaaauauaauugggauuuuuaacaagugagaaaugugagcggugaaggggugggcagggcugggaaaacuuuguacaguggagaaaauauuuauaaacuuaauuuuuuaaaacauaccug

SEQ ID NO: 9027 - RNA, 9592 nt, Mus musculus
ucuuuccggggcaguccgggugggguccagcgcgcaccagugagcugagcuaacuggguuucgcugcgguccacguccccgcgcggggcugaaucgcugaaguggcugcgcugcggugugagggccacgggccugccgcguccggguaagugacccgcacugcuguccagggagcugucgugaaggccccaugagccgcuuggggauggacagcgaggugcggggcggaggagggaugaauggggacccggugcgcuaggcggugaggaauggagauucaaggcggaggagggaggaaugggccgagcccuuagagaagcauggaugcgcaggaggaggaggaggaggugggcugacggcgaucgccagucgaugcugggcaguuugcgagcacucuacggacauucgagaguaggcgagucuuggaucaggcuguacccuagaagguguuggucucggaaauaguugaggccugcaccccaaacucuucuaccuaccaaugaggaaaauccaucacauuuuuccuuccuccucauuugucuacuugccugccuccccuuguggccgcuagcuugugcgcuuaacggucuggcuggagcuuagaaguccaacucuuaaaaacuuguauuacuuacaccccgaccccuaggaaccagcucuaaaauuucaauaagucaaccagcaaacuguuuaaaauacagguuuuccguuuauaaauuagacucgccuguuggacagcagaauaucagaaauacuggcuuagcaagcguuuagaacacagaccuuuggcauuuugguagugagaccugaacuuucagauaccuggagauaagcggugcaguuaagauaauauuuaauguucugggaucgugggcuaaugucugccacguggauacauccuuuagaucacagggcaaugucuguguacauaauacguccaagcaggugaugugucaggauuagguaggugacugugguuuguccuguacuagcuuucccaauuucuguucuguaauuguguaacuucccuagcguggaguagagacgggggcccugcugauagggauuauuaauggucuuugcugagucuggacuucuugaauugaaaucuguguaugucagagaaaaagcucaccaauuugaggucuagugauguguauauagcaauccacacaucauaaaggcauuaaaggcaaggcaagauugggagugcaaucugucaaacaaacauuagaggaauugggcagcaucucaaggguuaguugucacuuggggacucacacaagucaccuggcugaacuuuaguaggaacagcucaggaaaugcagacuuaaagucuuauguguauagacauugcccugugguggaaagggugugcccgugugacacgauggaauugagaacaugauacuggccuucuuguaugagcuggcagaagguguccugaugcugauucccugcagauccuguggggaccaauucccaaaaagagacucaaccccagucuguuuguucuaguuucugaguuaauacuugguuuuuuuguuaguguuuucuuuccucuauuuaauguguauggguguuuuguuuuguucuaaagauuuauuuauuuauuauauguaaguucaccguagcugccuucagacacuccagaagagggugucagaucucauuacagaugguugugagccaccaugugguugcugggauuugaacucaggaccuuuggaagagcagucagugcucuuaaccacugagccaucucuccagccccuggguguuuuuauguacauauaugucugugcaccacaugugugcagugcccuucccauucagaagagguugucggguccucggggaguggaguuaacagacuguuauuagacagugcaagccuguaaccucagcauugggaacucugaacagucagucuagucaacguggcaagcuccaguggguucgucaagagauccuaucucaaaauauguaauauauaauauaaauauaauguaugauagguggcucgagagauggcucaggaguuaaaggcacuuuuacaagauauuuuuauauguauggguauuuuguggccauguauuguacaacaugagcaugaaaugccuacagaggccagaaggcggugcuggauccccuggaguuguagguaguccugugguguaggugcuggggaucuaagccuggccuguggaagagcauccacuuaacugcagagccuucuuucuggcaaggucucagagugacacauuccuuuaaucucagcacuugggaggcaaaggcaagcagaucuuugugaguucaaggccaaccugguucacauagcuuguaauaagccaaccaggguuacacaguaagacccagucacaaaaaggcagacagaaauagaugacucucacugugacucccgacuuggaacucauugugcagaugaggacuuagaccuuugggcauccucauuccucugcuucggaaggacugggaugcagugcacacugucaugucugguccuucuguagaugcugagaacauugagguccaagcacucuaaaacccucgaauggaagcuuuaggucacauguauguucuuucugagucaauucguaaagguuuguauagcuucugcuauguuguucuguggacccaaagucuucauuuguagcugggauacccuugaacuugccucuugccucugccuccccauaguacagguaaguuucaucaugcuuaguucuguaugugaccuugacauugaccaugccagacagaugaauucacaguacaagagccuuuuugccucucuucaguggcuaauuccugugucugugggagugguuucuagacccauccucuggcuaggagucaguuauuaggaguggcacacaauaaaugucucccaagaaaccuguggaguguuuuagagauauucucuuggaacuacgcucgcgcacucucucucucucucacucacucucuccccccaucccuuccaaaccccauauguguguguguguguguuuuaacucacauguguauaugcaugcacaacuuuuauauauguggcuacuugcuugcaugcauacggcugacugcgugggaacacagguauaugcaggugggcuuguguauacagguguguguguuucuacacacacauuugguuuugaauagcagguuuguggugaugccaugccaucacugucugcuaacgccuguccuccagaaggugcgaagcugccugucuagucuccuggcaucaccaucugcugacgccuguccucaggagcuccugggugaccauuaaacgcucaucaaugaaagccgggccuaauagcucacacuuguaagcccagcguuuggaggcuggacagguuugaggccaucuacaaguuugaggccaucuugggcuccauaaugaguuccagccagccucaguuacacugggagaccuugucucaacaacauggcucagaacacuucucuuacagaggaccugaguuugggcccuagcacuuccgucgggugguucccaacuguauguaacuccagcuccaggagaauccaaugccucugggggcucucacauacacacacccacacagauagacaugcuuguguauaaaaaugaaccuuaaaacucagccaugcugggcaguggugacgcaugccuuuaaucccagcacuugggaggcagaggcagguggaucucugaguucgaggccagccuggucuacagagugaguuccaggacagccagagcuauacagagaaacccugucucgaaaaacaaaacaaaacaaaaaaaaaaaacuucagccacaauaguuccugggagagaggaugucugcuuaguguccucgaauuacauaaaauuccugauuccauuuaguuccauuaccucugagaaaggaggguuucccgacagauaaauaacugguuuaccaaaauugcuuuuuuuguuugguauguguguauuuaaaauuuuuuugauuuuuauauauacaaguacacuauagcuaccuucagaccuuccagaagaggguauuggauccuauuacagaugguuuugagccccagugugguugcugagaguugaacucagguccuggaaaagcagucaaugcucuuaaccacugagccaucucuccagccccauguuugguuuuuguuuguuuguuuuuugagacagguuuucucuguguagcccuggcuauccuagaacucacucuguagaccaggcuggccucgaacucagaaaucugccugccucugccucccaagugcuggcauuaaaggcgugugccaccacgcccggcccauguguuuuuuuuuaauuucccugugagggccagcaagauggcucaagggguaaagcuugccaccauuguuaaccaccugaguuugaucacggcaguccagaugguggaaggagagaucagagucccuacagguugugcuuggaccuccacacaugcacugugcuaaauaugcacccaugcacacacauauaauuaguucuuuucauuaaaacaacaacucccgccaagcaaguaguguaugccuuuaaucccagcacucaggaggcagagaggcauaucucugaguucuagcagagugaguuccaggacagcuaggguuacauaauauaaauaucuguguuuucugaugaucuuaggugaccccugugaacggguugguggacucccaaaguggucaugaugcacaggaugagaauugcagauguaagaggacuaggaagaugggucagggguuacaaccucuggcugcucuugcauuguucagugccaaacacuccugucaggugcucacaaaugccugugacaccagccccggggcauccaguguccuccuucagccucuucagacacauacacaugugcacacacacucacaaucacauaaacaagaaaauaaauguugaaaaccaucuccaugugaacuugucagcagcugcccugugccacagccucccagcugacagugaugaaauagcugucuucuuucauuuggugccuucauaagugucuccccaaagggauccuugcuguaaaauacaauuaaaaaaaaagauaauccaaacccauuccucaagauaguuauuguugacauucacguaguggugcacgcucugucuguaaauacacauuuacaucuuugguuuccgcgguguuaaguuguuuguguacgaaugggacaguauucacagcaccauuccagaguugcgcugcugugaacauaaucuguagaucuccagggugggugacgguggcgugggguggcguggcguggggucggguggggugacgguggcgugggguggggugguacgcaugugcagcuguauuaccgugagcuguguguagagccagaaguugauaaucuuccuuaucucaucucccauguuuuguaggcagggucucucugaaccucagguuggcuguuuuagccaaccugacucaaaacuuuggcauccaucugucucugcucccugcaaacccaggguuacaggugcaugccgccaugucccuuuacaggaaugcuaggggccugagcucaugcaaggguccuggugccugugcaauaagcaccucaacugcuaagccaucuccccaaugaggccucauguugucaggugcugaucuggagcccagcauguagccaaggcuggccaugaacucuugcucucccugauuauacccccuaacuacgauaauuacaggcaugcuacaccaagaccuccaucuuuggacuugaaaaaauguucuggagcugggcaguggugguaaagguauaccuuuaaucccagcacuugggagggaggcagaggcaagcugaucucugaguucgaggacagacuggucuacagagcaaguuccaggacagccagcgcuacacugaaaaacccugacucaaaacaaauaaaaguuguugaguccaaauugcuacaucgugacuugugacaaguugugacuuggacagcucugauagcuagcugucuuuuccccggcccugagcuguugagugcugcuccuucugaggccuccucacuggacgcuugucccuuguucuuccucagcaguguugccucucucaaccguagcuguuucugauaccacagaggggcaucugccucugucccaccugugccuuggcgaaugccauggccugggagugcccugcccagccgcucucaucugcaaagccagacuucauauggcaaggacaggaugccaaggccccagcugcucaaggaggacaucagccuggccucccagucugcacugagcagcugucgcuggugagugcuccgggcccugcuuguuuuggaagaccagacugggacuagaaaggggccugagguacuggguuuguagagucaagagaaggacacggagucagccaccaugaggugugugagagcacugaaaccacagcugguaaacuauagugugugggcuguguugccuggagugccuacugugugaauauagaugcugccauccaaggcugucuguucacugcuguggcaggcaggacuaaguuaguaccugagagagagccugcauguucuccugucugaaauauuugcucccuggcccuuuauagaaaagguuuguccacucuugucccagauuuguaguguaggcacaaggacuggaguguguucagggagcugaggcccuccuuagugcuagaacugccugucacaucuuuucuccuugaacuccccagcagacuucuaauccagggaugaggcacagggaacucccugaaccugcugaagaugcugguagcaucuuuagggcaucagcagauuggagggauccaagagccaucaaggcgucuucacggcccagcugccuuaccccagcuuguagcugagccugaauucucugugggaagccuucauuucagcucuuccccugucaggaugucacucucucuucuuacuacccauccuugcucuuuucuuuucaaagaacaaacaaacauuuuguacccuagaauauaagacucauccaguacaggccugagaaguugucauccuauuggcuugucugucuccugccuaacucuaguucuaggaagagcaugggacagugcuugugcaguggggagcaagacacaaucagguuggcuuuacucucauggcugcuugaguuguguucuuucuggucucuggccccugguccuggucuaagcaccgggccuaggcuuacacugcagacccugcagagcccugggccucuggggagucuguuugcugccucgaaaacaaacaccugaccaaaacaccuucuucaucccagaucccugggccgagcagaaggcgauugcugacagccugaagggcugucuggccaagacacucagcccugcuuccaacucacccagcaagauguggacagcccuggugcugguguggauuuccucugugcucuuaccuagaagccauaugaugucugcagagccacguaagugagaaagcugucugaucaccagggaagcccccgggaucugauuccagaagggagcuaucuacaaacuccugccuucccagcacaggacugagauggguugccagucagagaugggguuagagagugcacuggugggagccacagcgugaccaggcaguagagaccugcagaguggccuugucuucuagggaucucgugcucguccgagcucauuuguuagcaugucagaacugaguauucuccugcccggccaggcucugcucaucuccaagaggccuucagccuagccuauaucugagccgaggcuguuuagagugggaaugucugugcagccucaggggcggguagaagggcugaggcuugcuuuguuuuuguuggcuaaucacaugugagccuucugguccuauucucugagaauugaauccaguuacaaaguucugaaguuuccacaggcuauagccucagaaugggcaaagggugcccuggguagcugugcuuagcuggugggggguguggagaagaagaggcacuggacucaugugucaccuccaucagcacccaggccucugguuggagaauaugguguuguacagcuagcacaggggccagcagcuaaggugacagcagguaacuccugcaugugguugaaaguguucuaucuuucuucucuucuuacuuucaggaaacauagucacuaacaaguggccuaaagcaguaaaucaaagcaugcugagggacacaguuccaaggacugauaauacauuuaccgagagaacagccauagugccaccugcuccugucacauugacaacagagaccugggcagccacccugaacucuaccagagugacagcagaggugacaacacacggaacaaacacgagcacuccaacaaccagagaggggacaacagacagggugaccuccagaacucuggcuguaccuacauccucgggccccucaucugcagagcagacuagacccaccaccauugcugggcuccccucccucagcacaccacaugcagaagugccaagaacaaaugccagcgugucaccaagaacagccauggcagcaacuguggccccccacacggcgacucuugcugcaggcaccguaaacacaagugauccucacacaaggacuccgaguccugccaaaagcacacccacugacacauccagcaagaaccccauacccaccucaggugcccaaauacaagguaccaccguccagcugaccacagaccagccagugcauagcacagcagguagaucagcacuuagucccucaaacgccacccuggagcccaccaccacccagguacaaaccaaggagccaucugccagcacagugccagcgcgugcuaccagccugagcccugauguagacgucauaucccccaccacacagccaagcccuacauuaccuacccagggcacaggugggccagguacacuccugacaacagagcagguggggaccaaaaccacaucugguacugccucugcugggccaacauccaggagcucaggggacauuaagguaccaaccacagacucgugccagccuagcacccaaggccaguaccuagucaccauugaugcccugaccccauccuuggugaacaagauguuacuucugguggugcuccuuguuggggugacccucuucaucgcaguccuggugauguuugcccugcaagccuaugagagcuacaagaagaaggacuacacgcagguggacuaccugaucaauggcauguaugccgacucagagaugugagggcuucucgggaggccagccucuaccauggccgccuguuuugccucagaccaaacuaagugcuuccagauccuuucggugcaauuucagagcugugccagaugcuagacacauuuaauagcugucagaucagcucaugaucauaucaugagaaaaccgccuuuucauauuuauuuuucuaacugaucacauacgcaggaguggccauggucgagagggccugacacacuuggcccucgauguaugaaaucuugaccagaauuaaaagcaaagacgucucuccuguccag

SEQ ID NO: 9028 - RNA, 6532 nt, Mus musculus
gcagauguaagaggacuaggaagaugggucagggguuacaaccucuggcugcucuugcauuguucagugccaaacacuccugucaggugcucacaaaugccugugacaccagccccggggcauccaguguccuccuucagccucuucagacacauacacaugugcacacacacucacaaucacauaaacaagaaaauaaauguugaaaaccaucuccaugugaacuugucagcagcugcccugugccacagccucccagcugacagugaugaaauagcugucuucuuucauuuggugccuucauaagugucuccccaaagggauccuugcuguaaaauacaauuaaaaaaaaagauaauccaaacccauuccucaagauaguuauuguugacauucacguaguggugcacgcucugucuguaaauacacauuuacaucuuugguuuccgcgguguuaaguuguuuguguacgaaugggacaguauucacagcaccauuccagaguugcgcugcugugaacauaaucuguagaucuccagggugggugacgguggcgugggguggcguggcguggggucggguggggugacgguggcgugggguggggugguacgcaugugcagcuguauuaccgugagcuguguguagagccagaaguugauaaucuuccuuaucucaucucccauguuuuguaggcagggucucucugaaccucagguuggcuguuuuagccaaccugacucaaaacuuuggcauccaucugucucugcucccugcaaacccaggguuacaggugcaugccgccaugucccuuuacaggaaugcuaggggccugagcucaugcaaggguccuggugccugugcaauaagcaccucaacugcuaagccaucuccccaaugaggccucauguugucaggugcugaucuggagcccagcauguagccaaggcuggccaugaacucuugcucucccugauuauacccccuaacuacgauaauuacaggcaugcuacaccaagaccuccaucuuuggacuugaaaaaauguucuggagcugggcaguggugguaaagguauaccuuuaaucccagcacuugggagggaggcagaggcaagcugaucucugaguucgaggacagacuggucuacagagcaaguuccaggacagccagcgcuacacugaaaaacccugacucaaaacaaauaaaaguuguugaguccaaauugcuacaucgugacuugugacaaguugugacuuggacagcucugauagcuagcugucuuuuccccggcccugagcuguugagugcugcuccuucugaggccuccucacuggacgcuugucccuuguucuuccucagcaguguugccucucucaaccguagcuguuucugauaccacagaggggcaucugccucugucccaccugugccuuggcgaaugccauggccugggagugcccugcccagccgcucucaucugcaaagccagacuucauauggcaaggacaggaugccaaggccccagcugcucaaggaggacaucagccuggccucccagucugcacugagcagcugucgcuggugagugcuccgggcccugcuuguuuuggaagaccagacugggacuagaaaggggccugagguacuggguuuguagagucaagagaaggacacggagucagccaccaugaggugugugagagcacugaaaccacagcugguaaacuauagugugugggcuguguugccuggagugccuacugugugaauauagaugcugccauccaaggcugucuguucacugcuguggcaggcaggacuaaguuaguaccugagagagagccugcauguucuccugucugaaauauuugcucccuggcccuuuauagaaaagguuuguccacucuugucccagauuuguaguguaggcacaaggacuggaguguguucagggagcugaggcccuccuuagugcuagaacugccugucacaucuuuucuccuugaacuccccagcagacuucuaauccagggaugaggcacagggaacucccugaaccugcugaagaugcugguagcaucuuuagggcaucagcagauuggagggauccaagagccaucaaggcgucuucacggcccagcugccuuaccccagcuuguagcugagccugaauucucugugggaagccuucauuucagcucuuccccugucaggaugucacucucucuucuuacuacccauccuugcucuuuucuuuucaaagaacaaacaaacauuuuguacccuagaauauaagacucauccaguacaggccugagaaguugucauccuauuggcuugucugucuccugccuaacucuaguucuaggaagagcaugggacagugcuugugcaguggggagcaagacacaaucagguuggcuuuacucucauggcugcuugaguuguguucuuucuggucucuggccccugguccuggucuaagcaccgggccuaggcuuacacugcagacccugcagagcccugggccucuggggagucuguuugcugccucgaaaacaaacaccugaccaaaacaccuucuucaucccagaucccugggccgagcagaaggcgauugcugacagccugaagggcugucuggccaagacacucagcccugcuuccaacucacccagcaagauguggacagcccuggugcugguguggauuuccucugugcucuuaccuagaagccauaugaugucugcagagccacguaagugagaaagcugucugaucaccagggaagcccccgggaucugauuccagaagggagcuaucuacaaacuccugccuucccagcacaggacugagauggguugccagucagagaugggguuagagagugcacuggugggagccacagcgugaccaggcaguagagaccugcagaguggccuugucuucuagggaucucgugcucguccgagcucauuuguuagcaugucagaacugaguauucuccugcccggccaggcucugcucaucuccaagaggccuucagccuagccuauaucugagccgaggcuguuuagagugggaaugucugugcagccucaggggcggguagaagggcugaggcuugcuuuguuuuuguuggcuaaucacaugugagccuucugguccuauucucugagaauugaauccaguuacaaaguucugaaguuuccacaggcuauagccucagaaugggcaaagggugcccuggguagcugugcuuagcuggugggggguguggagaagaagaggcacuggacucaugugucaccuccaucagcacccaggccucugguuggagaauaugguguuguacagcuagcacaggggccagcagcuaaggugacagcagguaacuccugcaugugguugaaaguguucuaucuuucuucucuucuuacuuucaggaaacauagucacuaacaaguggccuaaagcaguaaaucaaagcaugcugagggacacaguuccaaggacugauaauacauuuaccgagagaacagccauagugccaccugcuccugucacauugacaacagagaccugggcagccacccugaacucuaccagagugacagcagaggugacaacacacggaacaaacacgagcacuccaacaaccagagaggggacaacagacagggugaccuccagaacucuggcuguaccuacauccucgggccccucaucugcagagcagacuagacccaccaccauugcugggcuccccucccucagcacaccacaugcagaagugccaagaacaaaugccagcgugucaccaagaacagccauggcagcaacuguggccccccacacggcgacucuugcugcaggcaccguaaacacaagugauccucacacaaggacuccgaguccugccaaaagcacacccacugacacauccagcaagaaccccauacccaccucaggugcccaaauacaagguaccaccguccagcugaccacagaccagccagugcauagcacagcagguagaucagcacuuagucccucaaacgccacccuggagcccaccaccacccagguacaaaccaaggagccaucugccagcacagugccagcgcgugcuaccagccugagcccugauguagacgucauaucccccaccacacagccaagcccuacauuaccuacccagggcacaggugggccagguacacuccugacaacagagcagguggggaccaaaaccacaucugguacugccucugcugggccaacauccaggagcucaggggacauuaagguaccaaccacagacucgugccagccuagcacccaaggccaguaccuagucaccauugaugcccugaccccauccuuggugaacaagauguuacuucugguggugcuccuuguuggggugacccucuucaucgcaguccuggugauguuugcccugcaagccuaugagagcuacaagaagaaggacuacacgcagguggacuaccugaucaauggcauguaugccgacucagagaugugagggcuucucgggaggccagccucuaccauggccgccuguuuugccucagaccaaacuaagugcuuccagauccuuucggugcaauuucagagcugugccagaugcuagacacauuuaauagcugucagaucagcucaugaucauaucaugagaaaaccgccuuuucauauuuauuuuucuaacugaucacauacgcaggaguggccauggucgagagggccugacacacuuggcccucgauguaugaaaucuugaccagaauuaaaagcaaagacgucucuccuguccagcuugugugggucuguguguccugcccuuagucauuccuagugcagccuuuaagaugcagucugguggggcuugcuuuuguaaauauguaguaugaccugaguuccuggcagguugcuguauuacagccacuggcuuaggcuccuucuaaugcccaaguucucaguggaggcuccagccaaguccugagccauucuuuggugcugcccauuggcggccuggccucucauggcucagcucccuagaguacacucuagcuuugagagccaaauccaacaagauccaugaaacagcugggucuccacacgucagaggcaguauugcuguguauaugcuauaguacagccaccaucauccugugaauacuuguagcacacugagcccucaucccagcagaucauuuuagugaccucugaggcucaguagcauuucauucauccagggccagagucaggagaaagcuugccuguguuuugauuuggaucuuguuucuuggcaguguugggauuggaacccagacccuuuuguauucuaggcaaacccacuugagccauuaucccagcccugagcccugguucuagagucccagagucucuagaauccuucaucuauccuguuuaccagacugauggccuuucucuacccaaaugccugauguagcaaugagcuaaggcagccaagcuguucucagcugucuucuaggccaggucuagggcugcuaucuggucuagagccagcuaaugaauguccuggagcuuggcuucaugucggagacuacguuuguuccuccugacagcacgguggcuggcuggaccuggagagaugugguuguggucauggcuaaggcuggugucgucuggagucguuuucuuugccaugauggcccaaauucuuaccucaauucugccacauccaaaagggaggacagguggauuguaauacagaacaaagcacccacuaagcccuuugagaccuguacaggguggggugaagggaucagcacuguccacacagcucuugugccuuccaccccaccuucucucggauuacagucaggccugcccugccgccccgccugcuucccagagucaagcugucuguccugagggcagggccuucucccuuucgagcagagacaccuaacucgagagugcgugcucagucauugcuguuggcuccagccauggcugagaagguggcugcuuccagccucuggugaacucuaggccaguucgccacauugccuacuaccuaccaguaggaaccgagcucugggguaaaucugggucuuuugagcaugcccucugcucagccuuagauuggggcaagcucccccucgugguagcuaauggaauccuaaacccuggucccacgugggucgcguuucaaagcgcguucucaaagacuggaagcccugauccuuucuggguguggggagaaguggaccaaaaugagagucaguuuacagaaaggaggcaaacacagaaaggccaaguugccuuuucaagggcacccaccaggcaaguggccugcccgucagcguugugcacugagguggccggggagaggagguuucaccuucacgaccauacaaacacgcgcccaugaggacguaggggauaccugggccaaucgcaccuggggcggcacuggucgugguggccgaagcucucuggugcccgcuggcggccgc

SEQ ID NO: 9029 - RNA, 4115 nt, Mus musculus
cagguuuauaaugcccagcuaugugucugguuguacagcagauuuguggauagugucugagaagcuccguguccucaggagugcuuuuccaguggcuugcagaacagaugcucucagagaaaucauuaugauuccauccauuauuuugcuugucacaugugaacuuuaccuucucucuauucaccaaaauccuuuuuucuggucaaaaggucugggacuuuguuaacucuagagcauuuuuuacuuauaaaaacaagggacuacaugccaucccucugugggcucacauuauugguugccgagcacaaguugagugacuguagacacagcacaggggacuuguaucucagguggagguaguucuuggccuacacaccagcuuuauauguccaugcaaccuuugcuuucucugucuuuaauuacuuuguuuuuggaguggauagaacauuguuuuccuggcaugaagacugacugacugauggacuucagugcagcaguuugcaaaagcagcgucuuucuuggauaaguugucaguuuuuuuuuuuuuuaaagauuuauuuauugacuauauguaaguacacuguagcuguccucagacacuccagaagagggagucagaucucguuacggaugguugugagccaccaugugguugcugggauuugaacuccugaccuucggaagagcagucgggugcuccuacccacugagccaucucaccagccccaaguugucaguuuugaaaucuuaaaauaucgggcugcagaggcagcucagucagugaguucaguuccuaguacccacaucagguggcucacaaauaccuguaacuucagucccagggaaucugacacuucuggccucuaagagcaccuacacucaugugcacguaaccacacacguacacauaauuuaaaauaguaaaaucauuuaaaaaaaggcucauaucuugaagugugaauuaaaaucccugcugauuuuuaaauauauuagaaguuauguguaugaguuguugugcccgaauaugugcaucuggugccccuagagaucaaagaggacauccagucccuuagaaccuaaguuaccaaugauuaggagccacuguguugguuccgagaacugaauuugggucuuuugcaagaguaacaaguacuuauaaccauugaguuaucucucuaccucccaaacuuugaaguuaaauggccgaauuccauaagcuuacuguacagauaaggguucuuauugagcaggucaggaguuuuaacugggagauggggggggugucuuuuaaaauccauuuuccauaucugcauucuuccuucuacucuaauaggaaauuguuaaagacaguuuuuuuuaaauaguagaucucacuguaaucuucacccacccccgaaguaauuggaugcuuccuaaagauuagaaguaucagugagaggaaaggugucugaucaauaucuaaauuauuuuuuguucaguauaaucugaaauccacuuuuuccuagacacuuuucaaagugagcauaguggcuggcuuguacuuacaauccuagccuucuagagauaugaggcucucaaguuggaagucaguuuagaauacaugguaagacccuguuucaaaaagccagaacaaagucugguagugguagcacaugccuuuaauucuagcacuugagaggcagaucucuugaauuugaggccggccuggucuacagagcaaauuccagggcagccaggucuacacagagaaacacugucuccaaccccucuuccccccagaaaagaagccaaaacaaacaguuuacaguuacaaauauaacuuguuguaauccccaauuuuuaauuauauccauauuauuuuaaaugcauuguaggguuguuguuauuuuuuuuuaaagauuuauuuuauuuauagagaacauugucgcugucuucagacacaccagaagagggcacgggaucccauuacagauggcugugagccaccauguaguugcugggauuugaacucaggaccucuggaagagcugccagugcuaucaaccacugagccauuucuccagucugcauuguaggguuuuauuauagagacucagucuauacaauaaucacucuagccuauuuuuauaaguuuguguuaauuucuagugauuuuuuucuuuuuaaaaaauuuuuugagagcgauuucccauauuguauuguuuuuuuuuaauaauuuuuuuuagauuuauuuauuauauguaaguacacuguaacugucuucagacgcaccagaagagggcaucagaucucauuacgggugguugugagccaccaugugguugcugggauuugaacuucggaccuucggaagaguagucaggugcucuuacccacugagccaucucaccagcccccauauuguauuguuaaagccagaaaguucgaguaauugaauucucaugugccuaaaaccauuugcaaccuuccuuguaucagucuuuguugucuuaaauaguuucacaaaggaggaaaaauagcaccuacacucaguaagccucuaagugaccuuuuauuuugacauucucuuccuauggugcacagggacagcuaaaccaguuagcaucugcugccucuggccucaggcccugaguugaggcuagcuggugggaguggcaaaagcucagacaccuuugaacucuaggguuguguauacaacuguaaugcuccuuauaaauauaauucagcggcugggcagaggacuguuggcguaagaggcgguacuguguugaagucucugucacuguguuuaaggcauugauggggccagguagacauucucuucaaaguuaauucuacuccuaaauucuacuuuaucuuaccauuucaaucaugcuuaacauauccaguugguuuacucagcucaucuucaggcuucauacaguuuuaugucuuuuguagugucauaagagauuuuaccguccaggugguuuuucagauugauauaucagcaucagugguccaaaaaucuugguauuuaagccccauauggcuccuccuugccaguuccaucacugcagcucgucuucauuugagucucuugcugguggcucagccuggacugaauuucaacaagaguuugagacccagcauugccaccugugaucaaaauuuauuugagcagcgaaauucacuccugagucuucuuguuuguggugcuaauaucugcauaaugggauagcugagccaugaguccucagacacacaugcuagugugugaggacuagagcaccugggauaggugguaggucaccugcacucuguguuccuccuuaaaggagcaccaggccagcaucuuuccuaaucagcauuuuaaaacuuuauuuuauuugugucuguguguaugugaaugcagguguucaugaaguccaaaagaaaguauuggaucuucugaagcuggaauuaacaggagauugugguggcugaugugggugcuaggaacugaacucugguccucugaaagaacagcaagugcuauuaaccacugagcuauauuuucaaccuuuggaguuguggugacccugcuucuuuucugaagguggaagcucgugugggcccucuaguguuucauggccacaacagcuauuccagcaccaugaacagugccugaaggcucccagcagacuuuugcuguguuuguggaaaugaauggaucgaggccugcagaaugaaucauuucauuugauuuauaggacaagaugugucugaaugacucagugaucucugaagaauauuuuuauuuucaaggcaaugccuacauugcaucauguagaguauauaguucuaucaagcccccacacacugagaacagaggguccuugacccuucagccagugagcuaguguagucuggggcuagagagggccuaggacacccuuccccuuccagagagaagcagaugcguccucacucagggucuuagaaaguucaaaguuauuugguucuuaaaaauguggcacacgccuuuaaucccagcacucggaaggcagaggcaggugaauuucugaguuugaggccagccuggucuacagagugaguuccaggacagccagggcuacacagagaaacccugucuu

SEQ ID NO: 9030 - RNA, 4115 nt, Mus musculus
aagacaggguuucucuguguagcccuggcuguccuggaacucacucuguagaccaggcuggccucaaacucagaaauucaccugccucugccuuccgagugcugggauuaaaggcgugugccacauuuuuaagaaccaaauaacuuugaacuuucuaagacccugagugaggacgcaucugcuucucucuggaaggggaaggguguccuaggcccucucuagccccagacuacacuagcucacuggcugaagggucaaggacccucuguucucagugugugggggcuugauagaacuauauacucuacaugaugcaauguaggcauugccuugaaaauaaaaauauucuucagagaucacugagucauucagacacaucuuguccuauaaaucaaaugaaaugauucauucugcaggccucgauccauucauuuccacaaacacagcaaaagucugcugggagccuucaggcacuguucauggugcuggaauagcuguuguggccaugaaacacuagagggcccacacgagcuuccaccuucagaaaagaagcagggucaccacaacuccaaagguugaaaauauagcucagugguuaauagcacuugcuguucuuucagaggaccagaguucaguuccuagcacccacaucagccaccacaaucuccuguuaauuccagcuucagaagauccaauacuuucuuuuggacuucaugaacaccugcauucacauacacacagacacaaauaaaauaaaguuuuaaaaugcugauuaggaaagaugcuggccuggugcuccuuuaaggaggaacacagagugcaggugaccuaccaccuaucccaggugcucuaguccucacacacuagcaugugugucugaggacucauggcucagcuaucccauuaugcagauauuagcaccacaaacaagaagacucaggagugaauuucgcugcucaaauaaauuuugaucacagguggcaaugcugggucucaaacucuuguugaaauucaguccaggcugagccaccagcaagagacucaaaugaagacgagcugcagugauggaacuggcaaggaggagccauauggggcuuaaauaccaagauuuuuggaccacugaugcugauauaucaaucugaaaaaccaccuggacgguaaaaucucuuaugacacuacaaaagacauaaaacuguaugaagccugaagaugagcugaguaaaccaacuggauauguuaagcaugauugaaaugguaagauaaaguagaauuuaggaguagaauuaacuuugaagagaaugucuaccuggccccaucaaugccuuaaacacagugacagagacuucaacacaguaccgccucuuacgccaacaguccucugcccagccgcugaauuauauuuauaaggagcauuacaguuguauacacaacccuagaguucaaaggugucugagcuuuugccacucccaccagcuagccucaacucagggccugaggccagaggcagcagaugcuaacugguuuagcugucccugugcaccauaggaagagaaugucaaaauaaaaggucacuuagaggcuuacugaguguaggugcuauuuuuccuccuuugugaaacuauuuaagacaacaaagacugauacaaggaagguugcaaaugguuuuaggcacaugagaauucaauuacucgaacuuucuggcuuuaacaauacaauaugggggcuggugagauggcucaguggguaagagcaccugacuacucuuccgaagguccgaaguucaaaucccagcaaccacaugguggcucacaaccacccguaaugagaucugaugcccucuucuggugcgucugaagacaguuacaguguacuuacauauaauaaauaaaucuaaaaaaaauuauuaaaaaaaaacaauacaauaugggaaaucgcucucaaaaaauuuuuuaaaaagaaaaaaaucacuagaaauuaacacaaacuuauaaaaauaggcuagagugauuauuguauagacugagucucuauaauaaaacccuacaaugcagacuggagaaauggcucagugguugauagcacuggcagcucuuccagagguccugaguucaaaucccagcaacuacaugguggcucacagccaucuguaaugggaucccgugcccucuucuggugugucugaagacagcgacaauguucucuauaaauaaaauaaaucuuuaaaaaaaaauaacaacaacccuacaaugcauuuaaaauaauauggauauaauuaaaaauuggggauuacaacaaguuauauuuguaacuguaaacuguuuguuuuggcuucuuuucuggggggaagagggguuggagacaguguuucucuguguagaccuggcugcccuggaauuugcucuguagaccaggccggccucaaauucaagagaucugccucucaagugcuagaauuaaaggcaugugcuaccacuaccagacuuuguucuggcuuuuugaaacagggucuuaccauguauucuaaacugacuuccaacuugagagccucauaucucuagaaggcuaggauuguaaguacaagccagccacuaugcucacuuugaaaagugucuaggaaaaaguggauuucagauuauacugaacaaaaaauaauuuagauauugaucagacaccuuuccucucacugauacuucuaaucuuuaggaagcauccaauuacuucgggggugggugaagauuacagugagaucuacuauuuaaaaaaaacugucuuuaacaauuuccuauuagaguagaaggaagaaugcagauauggaaaauggauuuuaaaagacaccccccccaucucccaguuaaaacuccugaccugcucaauaagaacccuuaucuguacaguaagcuuauggaauucggccauuuaacuucaaaguuugggagguagagagauaacucaaugguuauaaguacuuguuacucuugcaaaagacccaaauucaguucucggaaccaacacaguggcuccuaaucauugguaacuuagguucuaagggacuggauguccucuuugaucucuaggggcaccagaugcacauauucgggcacaacaacucauacacauaacuucuaauauauuuaaaaaucagcagggauuuuaauucacacuucaagauaugagccuuuuuuuaaaugauuuuacuauuuuaaauuauguguacgugugugguuacgugcacaugaguguaggugcucuuagaggccagaagugucagauucccugggacugaaguuacagguauuugugagccaccugauguggguacuaggaacugaacucacugacugagcugccucugcagcccgauauuuuaagauuucaaaacugacaacuuggggcuggugagauggcucaguggguaggagcacccgacugcucuuccgaaggucaggaguucaaaucccagcaaccacaugguggcucacaaccauccguaacgagaucugacucccucuucuggagugucugaggacagcuacaguguacuuacauauagucaauaaauaaaucuuuaaaaaaaaaaaaaacugacaacuuauccaagaaagacgcugcuuuugcaaacugcugcacugaaguccaucagucagucagucuucaugccaggaaaacaauguucuauccacuccaaaaacaaaguaauuaaagacagagaaagcaaagguugcauggacauauaaagcugguguguaggccaagaacuaccuccaccugagauacaaguccccugugcugugucuacagucacucaacuugugcucggcaaccaauaaugugagcccacagagggauggcauguagucccuuguuuuuauaaguaaaaaaugcucuagaguuaacaaagucccagaccuuuugaccagaaaaaaggauuuuggugaauagagagaagguaaaguucacaugugacaagcaaaauaauggauggaaucauaaugauuucucugagagcaucuguucugcaagccacuggaaaagcacuccugaggacacggagcuucucagacacuauccacaaaucugcuguacaaccagacacauagcugggcauuauaaaccug

SEQ ID NO: 9031 - RNA, 3914 nt, Mus musculus
ugagcuuaggcuccgccuuccgguugaaccgcaucugggccagggaaggagccgcagcacuucaagguggguggccagggcaaggcggcgaagacagggucugggugacgcaacgacaggguugaacggggugucaccgcugaccuuaugaagucugggaucuagcgcuucggcucgggacccgcggcuugugcguccuucccgagcugcggaccggaaagccugcacccucaggcgcaugcgcugccucgccggcugccuucugcguucauagggucagaggucaaggggaaggucugagagaaagugguagguuggauccaggauugcuuggggucaagaauuggccgaccccuacaggucaaaggucacaagagggcgcuagagcguuggugaucugccagacucuuggucaaaauccccuuguuugcauacaucccuaauuuucgggaccccucuuccuacauuguaauccagaaacugaggccaggggacaucauuugcccaaggucacucugcagguuggggagaguuccaggagccccuuggguugaggagaggaacuugacccugguaauuauuuaaaucuuuaaggguuuucugcagguaucuccuggauuccuguccugguuccaaugacauuggguaauuugggagcaaucacuuaacaugacaggaugacagggucuaugacauuugacaugaagccuggcucagaguuaucaggacccacuaggaggacccaccagaagaaccauccaggcuccugaauacacuggugguggucagggagccuuggugugagcggaggaugaggaguggacauggggaaauggauuaaauagguugcuuaggaacugcagaaauagaaggaacuuggggugcccaggaacugugagucagcagagugaggucagauugaggguuaggggugcuggucuugagugggauugugagugaauggggcguaagguagagguucagaggagggcaguuuuagacccuucucuucccuucuccauguuccagauguaucgccugagcucaucaaugcugccacgggccuuggcccaggccaugcgcacagguagggcuagaggccuuuccugggggugggggagcagagcuuccuggugugaaaucaccucucuccuugcaggacaucuuaauggacaaagccuucauagcagcgcaguggcggcaacguacagugaguagccaauauucugacuugagcuuuucugaccgucgucacacccaaggcccgggaaauugcuuugcuagggacccucugugagcucuaguuuccacucugaaaaugaagguagcgaucaagagagacugugacucagucacuguaguaccaucaaaggcgggaggcaugugacaggaaagagcugcuagguuaucaggacccacuaggaggaccuaggucccucacucccugaacuugaaaagcuuugccugggugcgcuuccaaagccagcuuccauuaaccucccucccugaccuccugcagaguaugugaauaagaaggaacaggagucugagguggacaugaaguccgcaacugacaaugcagcucggauucugauguggacagaacucauccgagguggguaccagugaagaggggagaggggagagucaggcguggacggccggagaggagagcauccucuuaccagcucuguacuacucccaggacugggcaugacccuaaguuaccucuuucgagagccugccaccaucaacuaccccuuugagaagggcccacugaguccgcgcuuccguggggagcaugcacugcgccgcuacccaucuggagaggagcguugcauugccugcaaacucugugaggccaucuguccugcacaggugagucugccuucuaacuacuaggcccuaaaucugaucugaccccuaccuugauacacucccccgggaaagacccuucuuuuuucuuuuuuuuuuugguuuuucgagacaggguuucucuguguagccuuggcuguccuggcacucacucuguagaccaggcuggccucaaacucagaaauccgacugccucugccacccaagugcugggauuaaagguauauacuaccaccacuccuggcucuuuuuucuuuugagacagagucucacuauguagcaccagcugaaacucauuguguagacuaagcuggucuugagcucacagaucugucuaccucugccucuggaguacuaagauaaaaguaugcacugccacagacaccugacauuguccuuuucucgcuuggccuaacccugacccugugugggggacagugaguccuuaaugucaagugcugagucaggaagccggcuggggggcggcuccaucccaagcaggccacguggaguacucauauccuacccugggagucaauaaucaugugacauuugagccuagaggccauggcgugguuucaggagcccugucuguguggccauucuguguucaagcugaggaugugcaacaggaguggcugcuccccagagcuuagcugcuccccagagccuggcuuucaguuaugcuggugggugcugcacagaaugccggaggcugggacuauuuggaaacaggaaaaugcagugauggcuuuguugugucuaacaugagcuccagcagcugcagccgugagaccugcccagggacacuaccuagcccgccaugcguaacuccagcuccuagcugugccucagcagcucagugaugucuggcauggcuccuagguggugugcacucugcacagacaggcuaggcuccuuccccauauucucccuauaacgguaagaguagccaggagagauuuucuucccacuguuauaaacacaaaaggcugugugccuuugcuggacaugguggugcauaccuuuaauccaggccaaccagaacugcagaguucaagcuacacagagaaacucugucucgaaagaaagaaagauguaugccuccugaggcucuacugugaguagcaaacuugccacuagggaguaucaaguuccuuaaagguccuccuggccuguaguuuccaggccaucccuucuuacccuuagcuggcauauagcuguccccucagaaacugauaguuaagaauauaccuuaaaauucggucugugucccucauugcuaugugaauucaggaaaucuuucaaucucucuuaaguuucuccaacaaauggggaucguuagcaaaguuguucaacaugacaguaauuggguacuuacuauccaggggcccucuuagggccacaccuuuucagggagcagagcagaucauaaucuuuuccuugugggacaggagggucaccuggcagagacuaauggggccacgugagcgguggcuccuuuggagggcugaggaaaccaggcauccaugcagacuuccaggggucaguuugaacugugaugggcagauucaggaggggucugccauuaugacagugaccuguggccacuccuucaggccaucaccauugaggcugagccaagagccgauggcagccgccgaacgacacgcuaugacaucgacaugaccaaguguaucuacugugguuucugccaggaagccugcccuguugaugccauuguggaggugagcgggcugggugaaguggcucgcacugaggcuccugagaaggguucgcccugcucacuguccaccuucccacagggccccaacuucgaguucuccaccgagacacacgaggaguugcuguacaacaaggagaagcuacucaacaauggagacaagugggaggccgagaucgcugccaacauccaggcugacuaccuguaccggugaccagaccacuggugaccuuggccaccuggcucagccuuguggccccuuuagcccauaaagaaacuaugaucccacagcuac

SEQ ID NO: 9032 - RNA, 3442 nt, Mus musculus
cacauuaggccuguggccuagggaagcccaggcucguaccagcagguaagaggcucuggcagaggcucccgaccaguucagaggagggugcagagguggccugaaauccagacacuugcugcacagcuuagggggugacagucuucucccccuggaaagcuaggcauuggcuuuaccaucuauaaaauaguucuguggugacagucgugugggugggaacagucgaccuucugaaugucugagucccccuucucagcuuagguccucagagagaaaaguggggagagcgacacucacccucagaacauuccagaagagggacugagguugcaagggggaacaaaaauuuggcugcuggugucuugaacuuggcuucuggguacaggugggucacaguuggcaucccccugccucagacucuucuguggggagcucacccuacuguucaggcucuggauacuuagauuccacaucucuugugcaguucuuccccacacugggagauguccucccuaccugggucccgggagccccugcuccguguggcugugacuggaggcacccacgggaaugagauguguggugucuaccuggcccgguacuggcuacagaacccaggggagcugcagagacccagcuucucagccaugccgguucuggccaacccagcagccacagcugccuguugccguuaccuggaccgugaucucaaccgcuccugcacccucaccuuccuugggugaguacccucagccaggcuggccgguccacagccagguacuagcaucccuacagacuggucacaguggcuagcaaggcaucucugucuuuucucaaugaccauaugguuuagcgagauccagaucaaugucaccucuuccaggaagucugcccaguaggccagacucuuaccagcugaagugagacauacauggggaacaggaccaacaugucagcuucagguuacuggaggcacagaaaaagacuggggugaaggugggacuacauggagcauccagccugaccaagagaagucagggaaggcuucuuguaggagguggcauccagcuaaucuccccccucccccaccaaaggugagaaguuagccaaggaaagggagacugagaugauggggacugaugucccccauuccuuuccccacaguuccaccgcuaccccugaugaccccuaugaagugaaaagagcccgagaguugaaccagcugcugggucccaagggcacaggccaggcuuuugacuuuacccuagaccugcacaacaccacagcaaacacuggagucugccucaucucugaauccaacaucuccuucaacuugcaccugugccacuaccuacagguggucccuagggggcaggaaggagggcggggagggggcagagggaccagugccaccugagguacuccaggcucgccuuaaccuuccaaccaaggaaaagagguggggcaggguggacgacccugugccuccugcacacugcucuucccagcgucagugccucaguuuccccucaagaaggccuggguccugacuggugccucucaccccacagcggcagaacccggggaugcccugccgccucuuucuguaugagccagcugggacggagaccuucagcguggaaucuauauccaagaauggaaucugugagcugacgggugggaaggagagcaggaggaguaggcagggagggggaggagucaggaggggcggaguuaggaaggguagaaaauaagcagaauuggggggggaaccuccuaccauggcuaggccugggccguuugccugacaucuccuuuucuggccccccaggucuggagaugggcccacagccucagggcgugcugcgggccgaccuguucucccggaugcgagcucugguggcauccauucuggacuucaucgagcucuucaaccaaggugagaccccccaguagcuuuucaggaaaacugaggucugaggaaaggguuggcuucuggaaaccagagggacaaguggucacacacagccucuacacaggcauggacuuacccgccuuugagauggauaucuacaggaacuugggcaguguggacuucccacgcacugcagauggugaccuggcuggcacugugcacccucaacugcagguugguguugugggagccgggguggggguacccagaacauccgacugaaccccuaguagaauccugagcuggaccagaaguuggugcaguccacaccugcaccuagagccccgccccagccuggcauuuggagcagcugaaaucuucacaguggaguagggaggcugguggaugcugcccuccuuuaacaggagaagccaaggggaggagacaggacgcaagucaccugcuuagaaguacaaguauucuuuuuccauggaaaugugaaaagcuccaugccugggagcugacuguccacaaggggcgcuguuaaacaggcucuugugcaguccuguagccuuuuucuacagcagucuuaguaguuuuaaucucauuuaugacaucugggagagcauccuaagccagaccugcccauaugcuuugcaaaugauguguaacaacagcuauuuuagagauuuuacuuuaaaaaauauaaacauguucaguauuuuguccaagaagagagaguguauacaggagugauucugauaagauuauuucuuuucuuuucuuuuuuuuuuaagauuauuuaugugaguacauuguuacugucuucagacacaccagaagaggacauuggaucucauuacagaugguugugagccaccaugugguugcugggaauugaacucaguaccuaaggaauagcagucaguguucuuaaccgcuaagccaucucuccagcccgagaguauuucuugaugaugucauagccauuuuaauuugcauagaacacaccaugauguuuuugaaacaacaaaaucauccuggugacacauuccccagaacuaaucuugucucuaagcagugcuccuuggcaaggguagaguuacucccuccuggggaugggggugggggagaggucaugaccucuccuuggccuugccucuucucccaggaccaugacuuugagccacugaggccuggugaacccaucuucaagcuuuucagcggagaagacguacuguaugagggggacuccauuguguacccuguguucauuaaugaggcugccuauuaugagaagcacguggcauuccugaagucugagaagaucagggucacagugccugcccugcugagguugaccccccgcuccacccagacucccuaacccaaaucauaccuggccugaucucaguuuuccuaucugaacaaugggucccaagcccaggguccccuaucucacucuggacaccauaucccuuuccagacaacugaucucauuauauaaaauagacugugccccaaaau

SEQ ID NO: 9033 - RNA, 1005 nt, Mus musculus
agacaaucccaucaccuuuauaagucuccaaaagcuguacccagagcacagggugaugauaacuggcuacaccagcaaggcugcgguuaaccugguguguccccuauuuugugcacccauauaaggauggaagcagcucagagagguuucggcucacagucacacagcaaaguacagcugacacucaucauucuauuuaaaugcgaugcucuaaggcugguucugagagccgggggucaucgaagugugccuaauaugauagauagggaucacacaggccaagguagggauggguguauacuuggagaacuagagguaaaaggccagguugaaguccucucgguagucugguggaauaaggcugagggaggcgcguacucuucguucucuuggagugggcgcccagaggcaccugaugacuccgacugugcuccgacccagagcucuuccugugagacguucuggaaagcacggacacccaggagacgagagaaaaggggcccagaagaucuucagcagccagacaucccaacucccgaacccgaagucaggacccauucaauucagguuacucaagcguuccggagacacagaguccaaaccaacugugccacagauagggaagucccuggaaagaaacucaagcgaagcuggccggcuuuuccggacacgccuuccaucagcucuaagccaggucuuuccuuuagguggcgcucuggucccuguacacaaaaccgcuucugcccucaucuagcaaacuccgccccagaugcccucugucgcccaauagcagcaaaacccgccuuaagccacacccccgaggucuccgaggaucugcaucagcaggccucgucuggaacgccuccgagguuucagcagccacugccuuguccaucucggaggcucuaccugggcaggcuccguaccgccggcguccgaggcuuugcaagggcagucccaggccuguccgccucucauaccgggcuccgggaagccacgccuccu

SEQ ID NO: 9034 - RNA, 1005 nt, Mus musculus
aggaggcguggcuucccggagcccgguaugagaggcggacaggccugggacugcccuugcaaagccucggacgccggcgguacggagccugcccagguagagccuccgagauggacaaggcaguggcugcugaaaccucggaggcguuccagacgaggccugcugaugcagauccucggagaccucggggguguggcuuaaggcggguuuugcugcuauugggcgacagagggcaucuggggcggaguuugcuagaugagggcagaagcgguuuuguguacagggaccagagcgccaccuaaaggaaagaccuggcuuagagcugauggaaggcguguccggaaaagccggccagcuucgcuugaguuucuuuccagggacuucccuaucuguggcacaguugguuuggacucugugucuccggaacgcuugaguaaccugaauugaauggguccugacuucggguucgggaguugggaugucuggcugcugaagaucuucugggccccuuuucucucgucuccuggguguccgugcuuuccagaacgucucacaggaagagcucugggucggagcacagucggagucaucaggugccucugggcgcccacuccaagagaacgaagaguacgcgccucccucagccuuauuccaccagacuaccgagaggacuucaaccuggccuuuuaccucuaguucuccaaguauacacccaucccuaccuuggccugugugaucccuaucuaucauauuaggcacacuucgaugacccccggcucucagaaccagccuuagagcaucgcauuuaaauagaaugaugagugucagcuguacuuugcugugugacugugagccgaaaccucucugagcugcuuccauccuuauaugggugcacaaaauaggggacacaccagguuaaccgcagccuugcugguguagccaguuaucaucacccugugcucuggguacagcuuuuggagacuuauaaaggugaugggauugucu

SEQ ID NO: 9035 - RNA, 6633 nt, Mus musculus
auuccuagggaaagggcagacuccgagcuggcagaagcagguguuuauuuugcuuuguguuuggggguuacaugacuggaaggagacaaugcauagcagaugugauagcccagaccucuuuccagaugcagcagacaucuuggcuccugagcugguugcacagcagggcccugugcugugcugacuagucaccaaguugggggggcacgcuguccagcaggugccacaguuccagccgguggucacaguggccuaagcacucccgccaguggcgcaggcguuccccacuggcucugccacucagcugcaccccaccugccaagagauggcuuaguagcccucagaguuccugaggcucccucuugcaccccguguuucugcucaccaaugaaaucaucagcugugcccaggucauagucccacacagacaccagcagugccuucugggcuagcuccucccgaugaccugcauaaaagaauuccuguagggaaaggaacaguaaagaugugaguucuuuggagcuuaagaaacaggcucagcagguuugcuaaaucaagaggacacuggacuggggucucccagccaugacccaccucauugaacucaggguucagggucuuccuccgaacacuggucuuauauuuggauuucuucccagaacuuggaugcaggaaccuggauggagagaugggcugguuaggcauggucuggcagagccaaggacccgcucucacccuucaugcccaccugccuguuuguacucacaggcggacaaaggggucugaguagccauuggcauccaugggagcaaggugaacacagcguagcacacccaccagcaggccaccgcgcucggaacuguagcacagggacaguaggaugcggccacgcuccuccccaaacaccucugccuccaucuccuccugcaggugcaagcugugcucagacccuguccagucugaagccccccaccugcagaggccaggucccagugugagcacaagugccuauagagaaaccaggcugucaaguuuauuucccuagauagccauuuccccaguacucagugaagagaccuuauaguaacacucagauaucugaacccuccaaagcucaaaaaagguaaggaaggguuugcugcucaugucagaacaaguaaggggauugauggugagcauuacagccaugcuggggcuuccuuuucucuugucuuuuuuuuuuuuuuuuuuuuuuuaucuuauucugucuuuuuuguuuguuuuguuuucucuugucuuuuauuuuuaauuuuuuuccuggggcuuucuaaguggcugucuucaugcacuggaaguagcugagaggcuguccucacagagagacagguuucuuaccucuuaagcccaccuucacuuccacugccuggcagaccaucauauaaauguccucugcauauucuuagacacuagagcuccccagcugggaagaaggccugggguaggaugccuucuuucccaccuucaggguagaauugauggcagagauccaaacuuucuuaccauuggcggugcucgcuaucacaggagcgcucugccagcaguauguggccaggcgugauugguuaggguucucagugauggccacuauuucugugggccucacaggcuugagccuaccuaagaagacacuacagaaacuuggggcuccacuagaggacagggcaccuccacuguugccaggagcaggagggccugccucccagccuuguagauguccuuccugccgggcaaaggggcuccugggcaggaucucgggugggguugaguaagcgcugaagucaucuucauugccuccugagcggcgggcccagagguagccacugcccugacauuagcagcagacaagcaaccugggagcuuguuucuacccugcccaaucucccaccucuggccacaagcaccaccucucaggccugccuaccuauagucugagcccuuugcaggcuguuccuaguguuccccaucuuuaggcugcccuagcaaaugagucacugucaccucacccaguccugagacccuggaaguuguugaggacucacagaauuuauaagagagauggacucaaauuccucuaagcucuuaaaggccuggacgccugccccucuuagcccuaaucccagccugggauaucuagaucugccugucgccauacauguucagucaagcuuugauacccaccuccucauauagagacaugccacgagcuguguccaggcucuugggccucuuggucuaaaaaaaaaucagagcacuugaucacuuuaguagauauuguccaggaccccuccccgacucucccuguggcuccugguccuguagacccagcuugaacuucaguccacucaccagcuuccgcuucucuagacagaugucaaagcuccuggcucgguuuggcaccagcuuccucaggggcacucguagcucccccaggggggguccucgccgccggcgccgcagccgugaguccucacacacacauagucugguggccauccaggucaguccuggccacgcaagccccaccccuugccucccuacuggugcccugaucuggguccucaccucagggucuuccguccagcauccuggcauguaaagccaugauaggugagagucuccucccagacagguucccuggugccucgaacagugcguguccgaagcuggcuggccuggggucaggaaggcaagucaggcacccuccuggccugcuacccugacucuuggauccuagcaauugagauuuaguucuugggguaggguaaaguagaaucaauggguacccuaagcuggcccugcuaucuaagggccuggaucuuacccucaccuugcuggccccugguaguaaguuggcuuugacauagguguccacagagccggcggcugguggcuugagacccuggaaacaggaaauggauguagagauaccuguggcuugucccguccaaggaacucagccucuguccucaccuuugcacgaugggcugugcagugcagggcgcuguuguccucaucaaagagaagugugaauucuagggugccuagggcagcuaaggaggcaggcgguaagcauggucaccccaccgcuacacccacuugucccacauggccucugcccugggugccagagacaccccuggccccauccuagggagcaucccgauugucuccccuacucacugcugucauccgagucuccuucgggcucaggguugggcugcagcuggggugcagaggggauggcuggggccagcauugccugccgaucuggggcacgcagcaccggcuccaagaagggguagaaaugugggaaguaguuggaaaugaggcggaugggccgaauggggccagggcucacaucgauggccauguguuccugcaugcucacccgcugucgcccacuggcuggcccugcacaugccauggugguccagacauagggacucagagaagcucccaccuacugggggcaccgagcacacaccuggccaccaagauggaaugaagaggcgucaccaaggcuguccuaggacagaagacacuuugccccaccugcaaggugaaggcuggagucagccuucugggauccuuaccucuugagagcugugucacacugcuuugcugcugcuggcucuagguguagggugacagagccugaggugaaccaucugagcaagugugugacugagcagggaggggaucaggagcccugggggcccagccuugucuccugccucugcccccuccauuccauucacacucuguugaaaggagcuauuuuuaccaccaucaugugccugcugcuggguaaggaggcugcagggcuagaggugacaaaagggguguguugggggggguaggcaaggagaggaaauaggugagaagggcagaaauguggggggauggagagggaagagaaagggacaggggacuguggagguaugaaggggugggguccuccuguagaaauggguacagcaucugggagagcccugcauuccucaaggaaaccagcuggcagucacaccacacucccacccuguccccuggcuggcucucucucccaagucuguccccuugaggcucucuguauggugggacuggccucucgcuccaccuccguauggcucucuucuuccacuucccaggcagugucuucuacuugacucggcuucacccuggccacuggguacauuauuugagguguucugagcaggggagcucacuggcaggagcagccuagcaucccuuccccuucugcuccacaagucucacuauguaauccaacuaagaguggacuuuggauucuccauccuccugucucuaccgcuggagugcgggaacuacaggggugugucacaugcuuggcuucuucccccccccccuuuuuuuuuuccuuuuuugguuuuucgagacaggguuucucuguguagcccuggcuguccuggaacucacucuguagaccaggcuggccucaaacucagaaauccgccugccucugccucccaagugcagggauuaaaggcaugggccgccacugcccgucugcuucuuucccuucuuaaacccuguauguauguacaucugugaacaugccugucauggucagaggacaacuugcaggaguuggcucucuccuuccaccacgugggucuuaaaagaucaaucuuugugacaggugccuucacucaccaagccaucucaccagccucuaccauguuuuuugccuguuuguuuugacacagaaucuuucacuggccugugucccaccaaguagcccacacuggcuggccagcagucccaagagacccaucuguuuccccagggcuggaaucacaaggguugcuaccacgccccauggcucgcuuuccacacggaagaugccagaggagagcugucaaacacucuuuuaaucgguucuggacuagccuggccaaaugauggcagaggcacuuaaaggccaggcaggccucaaccccuaggcagcucaggaacagcuagggagggcugguagaagccaggggccagcagcuucagggugagcucagugaugacagcugugaggccccagacacggugugguccaugcaagaagacaggcaguguguagcugaaguggccacccuggcagaaguggguauaccccugguucugugucugcagcaagugggccagagacaucucaaauacuucauccaccuguaggcaagaaacagaaagaggguggacagaggacugccugugaguccccuguuaggacagcccaacuccccaguagucaccauucaccuccucaagguugggccuaaggcucugcagauccagugggcccacguuggcaaguacugggacuaugguugccuuuuccuggguaggagaagggugaagagucagaaggagcaaacuuaggaagcagacccuacccugccauccgggugucuuggguaaucauggugaagcccuccaguuccgguccuugguuucuugccaugcugccucacagguuccccuuaccuguauaccgccaggaaaccucccacuugccacucaagccuagagggaugcagccuacccugcaagccuuccuggacccuguccuggacugagcggggcuggcuuccccggccacuaggguuacugauugugauaggaugaggguggcucacccggucauacacuggcugcaggacaccccacacgugcuccuugggcaccucuaggcccagcuccuccugagucucccgaagggccguauguauuacaucuuggucgucgggaucacacuuaccgccugggaaacuaaaugggcagagggaaucuugggaccacaggucgucaggaggcaguuuagcucucugugccauuagaguaagggggacaggcacugugauauagauuacgacaugagggucuggcagcuggcuaagacuaugcuagggcucagacaccccaugucugccuauggugucccaguggugcagauaucguccccggguguucucaacuucugcugagggcgaagccaaagaaggggagccccggaucuccucucuccagucuacgguaaggggcagaguccuguuuaugaagggaaaaauucagagggguaugcgggccacagguagugcgccggcaaggccggcguaccugacuuccccuuugugucucccaaccaggcgacuagaacgcagcguguagagcaacgcggggaccccgcgcacgaggcacagcggcacaagcacugcggccgcugcgggccgcgagcguaaccgggcagugguccgugcuagcagcugccggcagcgcugcucguccuccgcggacaggccaucaggcagcaugucccagacguccgggacacagugggggaucagcccgcuagggagggaacgccgcagcgcgcaagcuccagcgcggggcggggaccuaagugggagccggaaggaggcguggcuucccggagcccgguaugagaggcggacaggccugggacugcccuugcaaagccucggacgccggcgguacggagccugcccagguagagccuccgagauggacaaggcaguggcugcugaaaccucggaggcguuccag

SEQ ID NO: 9036 - RNA, 477 nt, Mus musculus
caucuuggucgucgggaucacacuuaccgccugggaaacuaaaugggcagagggaaucuugggaccacaggucgucaggaggcaguuuagcucucugugccauuagaguaagggggacaggcacugugauauagauuacgacaugagggucuggcagcuggcuaagacuaugcuagggcucagacaccccaugucugccuauggugucccaguggugcagauaucguccccggguguucucaacuucugcugagggcgaagccaaagaaggggagccccggaucuccucucuccagucuacgguaaggggcagaguccuguuuaugaagggaaaaauucagagggguaugcgggccacagguagugcgccggcaaggccggcguaccugacuuccccuuugugucucccaaccaggcgacuagaacgcagcguguagagcaacgcggggaccccgcgcacgaggcacagcggcacaa

SEQ ID NO: 9037 - RNA, 5310 nt, Mus musculus
gcgcaccuuuagugggcgaggccgaggacagagcucaaaggaacggaggucccuggacacgccacuggcugcggaugugugacgcacuuccugugcgcuccccaccccguguguuucugucgcgccggucccgcgguucggaguugugaaggugacagccggaggugacccgucuggcucccgcgaugcuagcggcacggcauuuucucggcggguugguucccgugcggguaucugugcguuucagcagcggcacggugagcccgcccugauucaggcccacgccuauggcggaggaguggcgagcggcgagcgggauugugguccccucugcagaguccucuccucuccgagcuaccacccggucuggauaaaaacuaacggucccaacuccaggcugacgauguccaguccagcuacucuuguuuuaacaaccccgucuuggggugaggguuugcagguguugaggcgucuuagauaaucuguuauuucuuccucgcagcccuaccggguaucagggucuucgccccauuucaaaguucagaaaacaguuuugaaaaagauguguaucuccucaaccccccgacaguauuuugcuuccaguagugaccggaaaacgcuuuugugaauuuuuuuuuuuuuaugagauaggggcucauuauauaguucuaggcuguauucaaauuaguguugguccucuugucucagccucucugggugcuccugagaccacaggcauccaccacuacaccugaggagaaguacuuuuaaggagguaggaguggaugucaggucacuuucuaccaagucgugaaccauuccaguccacaccucuccuuuaucucagaccccaaauccauuuuguuccccagccccaaugaggcacuucucuuccaucagugaccacguacuaccucuucagcagaguuagggagaucaagccccuccuagccagguuuugcucuaguggaagagucagacaaaucuaugcuggucuuggggaagcaaugcuggugcugucgcugaagugugacauggcuccguggggaccaucugcuuuuagcuuuguggccuucccuaaguuccuuuuguuuagagcccccccccccuccuuuggaaaauggaggaaauauccuaucccaggaauguuacaaggaugaauugggaugaaacguugagaguguuuagcucuguaacuucuaaacaggaaggacugauauaaaugguggucgggagcuacaauguuucaaagacuuugaagccucuaccccugcuguggcccagcuccucauauguaggaaggcccaagaagcugaaaauucugccccaaucccucauggucccugagcucuggaccuccugaccuucuaucuccccagacagcacccaagaaaaccucauuuggcucacugaaggaugaagaccggaucuuuaccaaccuguaugggcgccaugacuggaggugagacagugcccauggccugcugggucccagagcaggacuucuccuucacaucauuuccuacucuguccaggcugaaaggugcccugagacggggugacugguacaagacaaaggagauccugcugaaggggccugacuggaucuugggugagaugaagacaucagguuuacggggccgugguggugcuggcuuccccacuggccucaaguggagcuucaugaauaagcccucagauggcagguuuguuggggaaauauccuaagcucugguugcaggauacaggaggggcugcuggaucacuggguuuuggggcugaugcugggaaacuuagcaggcuguaagagaggauauaucuauccuuaacuuaagagcuaucucuuuccucagcagagacuuaagauguuacaauccauacaagauuuucauuuaggcagaccuuauuauucaaauuccaccuuugccuuuuaauacuuagcaagcuuuggagaaucugguccuuuugaauuccucuuuuuuucuucuucuucuuuuucuuuuuucuuuuguauguguaugggugugugucugaguaugauaugcagaaguuaaaaagauaauguugguucaguuuuugaccugcaacuucaguagacaccuagacaccuagaaugcaaauuauaaaguuaaccacucgguuggcauaauggcucagcagguaagggagccuggcuucaagccuggugaccagaggucacuucuagaacccacaugaaagagagagagagagagcugacucccacaaguugaucccugaacuucacauguguuauggcacaugcugccaccaccaguaaauaaauguaauaaacagaaauauuguuuucaagauaggacuucucuguguagcucuggcuguccuggaacucacucuguagaccaggauggccuugaacucagagauccacccaucucugccuccugggugcuggggugaaagguguguaccaccacuaccugcucauuuuuuaaaaagucaaccacucuaccuccuguuagccucaaggcugugguagagguugcagaccucuuacgaccaagaacugaauugacucucaagggaagcccagggagagauguuggauuuguucucucaggagaacauggcuuaucuuguggacauacguggucacggaugaaauaggcagaguccugucaucggugugacacaaagagagccuuggguagggcacagaagaucaacugccuugaggcuucucugaguguagacggaaugaaguuugagaacuggguccuggugggucuguagccugacugaugugcaggaccccacaggcccaaguaucugguggugaaugcugacgagggagagccaggcaccuguaaggaccgagagaucaugcgucaugacccucacaagcugguggaaggcugccuugugggaggccgggccaugggagcccgggccgccuauaucuacauccgaggggaauucuacaacgaggccuccaauuugcaggugagaacaugagcgcuggcugauggugcaggcacaccucaccucacaugcugucgucuuuccuggcacaaccauucuuagaugguaguaccaguuuggggccagcaauuggguuggugggagguggggguggcauuccugcauccaucaacaacaugaccugggcccagaguucuuccuuuuugugcuccaaaguucaacuuaggaagucuucaaggguuccaugggcccuggauuggaggcugacucuugggguacaguagggcuggggaacuuagaccuugucccacagguagcuauccgagaggccuaugaagcaggucugauuggcaagaaugcuuguggcuccgacuaugauuuugauguguuuguggugcguggggcuggggccuacaucuguggagaagagacggcacuuauugaauccauugaaggcaagcagggaaagccacgccugaagccgcccuuuccagcagauguggguaagacucugcccagcccugccucuucccuaaggcucagcucugugggauccuggaucugaccaggugccuucugggugguucuugcaguauuuuucugugcccuuuggagaggaggacagguugaugaggaagguguuaauaguauagccucugccagugccacccacagccuucaguuaacaucagauacccauguccccucugggcuguguacuuucuuccugucccaggagcuagaggugugauggugaauaggagaugcugcccuggaguuggguacagugugggccaggagcgaugaggagacaagagcaggacaucccacuaacaagagucauguucccagugggcagguggugcaugccuuuaaucccagcacucgaaaagcagaggugggugaaucucgaguucaaggccauccuagucaacagagugaguucuaggauagucagguuaugcagagaaacccaguguccaaaaacaaagcaaguuuccuuuccuggaaauccaccagucucuuguuuuuccuugaaggaguguuuggaugccccacaacuguggccaauguggagacaguggcugugucccccaccauuugccgucgugggggcaccugguuugcuggcuuuggccgagaacgcaauucagguaccaaauuguuuaacaucucuggccaugucaaccaccccugcacuguggaggaagagaugucugugccacugaaagagcugauugagaaacaugcugguaagccuggagccaacucaggggcugugcuugggagagggcacggugggagagccaugacaauccuuuugcaaauugucacagguggugucacagguggcugggacaaccuccuugcugugauuccugguggcucaucuacuccacugauucccaaaucugugugugagaccgugcuaauggacuucgaugcacuggugcaggcucagacaggccugggcacggcugcaguuauuguuauggaucgcucgguaauggaccucaugccccauaaaccuccucccagccuggguguguucccucccugagccucucugaaaauucuccugccuggcucuuggcucccaauuccuacagacuaaaacccuguacagugggagagcaugggccagagcacuggacccaagucaggguuguugugggagggaggcuaagaugucugugcacuguuccuugucuccuagacagacauugugaaagccaucgcucgucucauugaguucuacaagcaugagagcuguggccaguguaccccgugccgugagggugagcuuccugggaagauugggauguaguugcugagcuguucuuaaccuucccccaugaggccugcaucccuucaggguuguccccuucauggugggaggcccucaggccccucuuguuguucugcuacaggcguugacuggaugaacaaggugauggcccgauuugugaagggagaugcccggccagcugagauugacucccugugggagaucagcaagcagauagaaggccacaccauuugugcucugggugauggggcugccuggccaguacagguacacacugcccugcugugucacacuaaggugggggcauugacagcccagagcuuuggaaauuugcaacucugguucuuacagagccucccucaccuucccagggucugauccgacauuucaggccagagcuugaggaucggaugcaacgauuugcccagcagcaccgggccuggcaggcagccucgugaguccacacccuagccugacaauuucucaucccuuugggaaacuggacaauaaacaagugcuguccacucuccaaccauagc

SEQ ID NO: 9038 - RNA, 2102 nt, Mus musculus
gcacuggcuccugccaucaguuuuauuggucuggggugggggcugggggaggcagguggacucacaucuuuaugcaagcagccaggggccgguucacaugcucaggagacuccaggaaggccuugagcuugggucgggauuugaggcgcgccacauaggcggagaacaggggaaagucauucaaguaaccaggaaacaggagcucgagauucagaagcacguccagcaggcgguaguccgcgaaagagaucuacaggacgggggagugacagggcuggagcugaggcaggacugggagaagcgccacagagcaaagcacuggaugcucccugcuucugccucugcaucuggccucaguuuaccccucugagaaaggaucuggcaaugaguggguggggaaaggccuacccaaugcucaccuggucaccaacaaugaaggacuggccaccccuguucugggccaggagaguuucaaauggcuucaggugucccggaagcuccuucugauacugguccuugcccuccuucuguggucagaaaugugcagccagagugaccgaagugaucucccuuuccugcccaccacgcuuggucacuagccuguggcuccuacauaccaggauauggcgauacugccgggcaaugcgucugaauaggucuuccaguccaucguucaccauguccaccagugcugccucuuguuggucuuugccauagagcccugggucagcgggcaggcagcaggcucagguucuguacuugucccuacauguccacucagucucagccugggucuacucucuaaccuuaauuggaggucuucccugccuaccucugggaugucauuagaaaaaugauacaaguuggaaacucacagcccuggcuguacagacagcgaccgcccagcagcacaccaguagccuucuggaaccugggcccugcaugauccucuagggugacccaggugggacauugguggcugcaggugaggcaauucaaagccccaggacauuuugaggaacaucucaggugucucucagggcuuggcuucuggacucaccgaaggagcggcccaggugccguaggauaguauuggauugguacagggugagcucuccauccuggaacuuggggaucuguccaaacaacugggagaagaucccucuguaaggggugcugaaccuggcugcccccaauccuagacacagcacccuaaggcugcgccccaaccgaauccccaagggggagagggagacaauuacucacacaggaagccuugaaugugccuugcucccaaacauccaaggucaccaccuccuccuuccagcucuggcccuggucagcuagaagcaugcgcauaaccucacagcgcccuguaugggggugcaggaugaggacacagcgaagagaucuacucucagagcauccugggagaguuugggagaguggaaagcugacaagaggacuacacuagcuugggagccucauagggaggggagauauguggugauagaggccauguccuaacauuaucuuggaaugcgaagacccagccccaccauggcacagggaaggaaggaaaagugacagacagugcagcuaucuacggaggcuaagagggcaguccuggccccaccaaccacaacuguaguccugccccaggucucugucccggcccggccccaauacagucuuggucacgcccuuccuacaccacuguuggggauucccaggaaugacccagaagacuauuguuugugcccuucgucuugaaagugcugaggccacaccucgggaagggaaauagacgaugguguaagguggcacuaggagagauagacaaaaagcacgaugaaggaggaccuugccugggcugcagggccaaggagcgguuaguagcaggggugagguggggguauaauugcccccgcccuugccuccagguuucuccuuacuguugggcggauacaguguggugcaagcucagcaggaagagaggaagugaucggggccuuauauugacaggaagacuccaccuccucagacaucccacacugccccagaaacagaccaaguccugguguucaguguaccagcuuccu

SEQ ID NO: 9039 - RNA, 2683 nt, Mus musculus
agaacaugaacuuucaccucggagcccacccccucccaucuggaaaacauacuugagaaaaacauuuucuggaacaaccacagaauguuucaacaggccagauguauugccaaucacaggauaugacucuuugguugaguaaacuugugguuguuaaacuuccccuauucccuccccauucccccucccaguuugugguuuuuuccuuuaaaagcuugugaaaauuuugagucgucgucgagacuccucuacccugugcuaagguguaugaguuucgaccccagagcucugugugcuuucauguugcugcuuuauuucgaccccagagcucuggucugugugcuuucaugucgcugcuuuauuaaaucuugccuucuacauuuuauguauggucucagugucuucuuggguacgcggcugucccgggacuugagugucugagugagggucuucccucgagggucuuucauuugguacaugggccgggaauucgaaaaucuuucauuuggugcauuggccgggaaacagcgcgaccacccagagguccuagacccacuuagagguaagauucuuuguucugcuuuggucugaugucuguguucugaugucuguguucugaugucuguguucuguuucuaagucuggugcgaucgcaguuucaguuuugcggacgcucagugagaccgcgcuccgagagggagugcgggguggauaaggauagacguguccagguguccaccguccguucgcccugggagacgucccaggaggaacaggggaggaucagggacgccugguggaccccuuugaaggccaagagaccauuugggguugcgagaucguggguucgagucccaccucguguuuuguugcgagaucguggguucgagucccaccucguguuuuguugcgagaucguggguucgagucccaccucguguuuuguugcgagaucguggguucgagucccaccucguguuuuguugcgagaucguggguucgagucccaccucgcgucuggucacgggaucguggguucgagucccaccucguguuuuguugcgagaucguggguucgagucccaccucgcgucuggucacgggaucguggguucgagucccaccucgugcagagggucucaauuggccggccuuggagaggccaucugauucuucugguuucuuuuuugucuuagucucguguccgcucuuguugugacuacuguuuuucuaaaaaugagacaaucuguguccacuccccuuucucugacucugguucugucgcuugguaauuuuguuuguuuacguuuguuuuugugagucgucuauguugucuguuacuaucuuguuuuuguuugugguuuacgguuucugugugugucuugugugucucuuuguguucagacuuggacugaugacugacgacuguuuuuaaguuaugccuucugaaauaagccuaaaaauccugucagaucccuaugcugaccacuuccuuucagaucaacagcugcccugccucccacuccaacuccagagagcagccagcgggucacaguggucccgcccauggaccuggagccuagggaaaaaugagcucggaaauccggagcaaaagaggaguggucccugaaaagucaguggccuggauguuguggcugcugaaauaaaaagaagaggaggcuguucgaguagccggccaagagcgccgcagguucccaggcagcuucucauuccccugucccucccaucccgucucuuguuaacagaaaaacugcuuucacuuuaagauaagugccgguugcagccagcugugagagcugcacucccgucucugcucuaaaguucccucaucucagaagguggcaccacccugaguugcuggcagugagucuguuccaagcuccagugagggaggcauccgcccacuuggggcuucuguccaagguaaggagcaccugugagucuaacugccagacucugaugggggucuccucucugugggacuagaaagugucccaacaaucugaccaagguaacagaaaguuacaaaaguuaagagaaggacaggauaaguugguaaaaaaguuaguguaaguagauaagaaagugcagaggaggagaaacaaaggaaggacagaggucugcaaagaaguaagcuaaaagcaaaucuucagcagacccagaagagauagguuaacagugaagagaaguaaaaauagagauaaaagagauuagagaggucuaaaaugagaaagauacucugaaugaaaaauauuuaaaaaaaaaaaacaguaaauaagagucagacaagaagaagaguuaaagaaacaugaggcugacaaagacagagaccagagucagaaucagagcugugcugugagacaaagagauaagagaaauaaaaugcuggucacaaaagucaggaaaauuaaaaaaaccuagauaguaccuggcaacaaaaaaaagcuuuuggcuaaagaucaauguguuuaagagauaacaaaaggggugcuaauacagaagcugaguccuuaaaagaguccgguggccuaccuguuaaagcagcuaaaaaaagagacuguguuucauacuccuccaccgaccagugcaaaacaagcuaaaaaguuccugggcacugcgggcuuuugcagauuguggauuccagguuuugcugaguuaaaga

SEQ ID NO: 9040 - RNA, 5765 nt, Mus musculus
cauucuggaagugagaguaagcugcuguguggugaguggcugcaguguggcaaggggcaagggucuguguggcaccuuuauucuuguuccuugagaagagcuuacaggucaggggggugguucacccaggagguggggaagcagagguggaaacagagguauccugggacuccagauggggaagagaggagcagguggcauacuuuuccagaaucuuggagcuguccugggaaagagaaugguggagggguggaaagggcaaacagguagagcaaaccgagaaagagccccuguaaaacagugaaagggcagagagacagauagauggacagacaagcacacacagagagacagacagacagacagagacagagaagcagagacagggaaacagagauacagagagacacagagacugagagagacaggaagacaaagacagagacagacagacagacagacagagacaaauagagagacagacagacagagacauacagacaaacagacaggggcagagaaacagagacacagagagacacacagaaagggcagagagacacaaagacacagagacaaacaggaagacagagacagagagaaagagauagagagacagacagagagacaaagacagagagggguugagggggacagagagagguuaaggcacagagagaaacugaggggaacagagagacugagagggccugaggguccugagaguacuggucuaccaagacauagcauaggccaagccaaagcagauggagagcaagcaggauacggagcaggaagaauguguuaggaccacgaaccagagaagugcaggcaggauaugggacugaaggaggccagccagcgugggagccuggccaccuggaucagcgaggagccccaggguggagucugugguccugugaagguugggaagcacucuaggagguaggugaagauuucaaagauggauuaugggagcagcaauggaagaagacagugaccuuagaggacucgggcucuucuaacccccagagcuagaaacaaaaacauagccacagcuugcacugagccaccgaccuacagguggaggagacccagcuggaacagaaaacguaccacaccuacauccauggcccuaccggagggcccaacagauggcagccucccugaaggagacuccaguccauccucaggcacugcaggacccagccaagaccuagccagccccacuacucgcagaagggcccuucuccgugagcuggaagcccaggugcaggcugccuacggacagguaaggggcaggaaauguucuuuucuaaaggaccccaaaucccagcuggcuauaaaacacaccuagaaccaaguccacauacaggugaccagaguggucaggagaaguuaggggauccgccugccaucucuguugaugcugagggagcccuucaugcaccaugacaagcccugaauggauacaggguuuugauaggggugcacaggaacuccagaaugggccaagauaaaagcaagcaggcucucucucucccugaggacuucaucucccagcucccaguugacacauugggagaacugggaauccaagcacugggugccuacuucuucuggagggauccaagccugcuucugaaggugcugauugggggagauuaguguaaggcugagagaggggcugauuggagggggggcugaucagaagacccucccgagggaagagcugggagacugugccuuccagggggccuuugcucugaguaaacccacacacacacucacagagauacucagagauaaucccggauuggauuagggcccaagccccgggcccagggcuccccgccugcccacccgcuccugaucuugcccacaaaaccccaggaaaauccucuccagugcucccaggcugucccuggaaacagcagggggcuggcagaauccacagcauccucccaggacuccgggccuggcaugguucagagacccauggggaacugugccaagacgccauggcaccgggggucuaagguaggaaggugaaggggagagacauaaggccagaaaccuggguggccaaugcacugggcagguaguacccagagaccugggguacugggcuggaugagagauuggcuccagaggagauggagggauaucugugugcuccccugcuaaacugauaggccagcuacgcauucugugcaggccugacucucucagcuuuaacccggcugaccagagcuagaggucaggucuuguucuccuccuugacccggcuaaggcucucacuccuucugcgcuuuaguuuaccuaacugagcaguugggggugaacucuuccagccugggauguuaaugggucuuguguaccuagaggccccucccccucugucaggugcugggcuccagagggaggagcagcugaugagggcuggagaggggcuacaagagaccgggcuaagugggcauugcuccggcucauggcucacuuugccacaggaacgcuggcaguggccuggauccccccuagggggcucccgccccagcccuggucccagaacugaggagcaggaggggacacagggcuacucagugcucggcagccugguggggccagcaugcaucuuccuucgacccagcaucgcggcuacccagcucguauguacaguuacucuucugccugccggcugcucaggucccauagcuucaucacucccaaguaggugugaaggccagagaggacgucagaggaaagacagcgacccuagggguggggcagagcuuggggaacucccacaccaggcauggaguuggguaugaacccaagaaacagccaccugagaguuggggugcaguccaguggcagaauacuugcuuauagcaagcccaggguuacaucuccagcacagccgaaauagaaagugcuuucaaggggaugaugcuagagaggugggagaguccucaggagagggucggggcaaugcagaccugcagugacagugaggccagcuggcuugaguaugagguucugucugacccugggguauaccucugucaaaaggagcuauguaccucagaagacugugggaacagggguccuggggucccauggcaggucacagggaaagggaucccuaagacacccagacagaugaccaggaccgggcagaaucaggcacaggccuuggguauguugugaggugggcuggaugagaaaccucaagacacagaaagagggugccgaggugugggcaggccaaggaacuccuaacuaucuguguacuuugcaggaucgagagcugagaccagaagagaucgaagguaauggguucagggaguggguaguugagguggagugugggguggggguuacaagaagagguuuggggcuagggccucugcaagguccaggaggagcgagaaggacauggggucugggcagggagggcuggcaaaaccucccuucuuugccaaccccuuggucucagugaccacacuggucaaggacugcuuuuauauuuguccaucuggcugacacuuccuggcuguccacugugggccuggccccuugcuaacccugcuaaccagguagauuaagggccccaucuucuggagauagcuacagcugcagcugcauagagcacucuuaggaaaaccaaugacugggcugacuaggaagaaaugggcagggaagucuuccugguagcuuuucugucucuucuccccucccaccuucucuuccuucucuuuuuaaucaccuagaacagagaugggcacaugacagaugcuucuuaagcauuggaugagagaacaaaauuuuaacacuacacaugcaaaggcucuuggguaacaacuaggaacugagguuuaacaacaagaagggacuggagcaaagggaaaagauggaccggccccaaccggcagccaggaaggggcgcucagaaagggacuaaccucacucuguccggcagagcugcagaucgccuuccaggaguuugaccgagaccgggacggcuacaucggcuaccgggagcugggugccugcaugcggacacugggcuacaugcccacggagauggagcucauugagauaucacaacagaucaguaugugcuucagacccaacagagccucaugccccagcccuggcccagcccugagguagacgugugcgcuguuccaaacgcccaggauauaaaguuguuauuaaagggagagcagggaggauggcuccaguaaagagacugaagcucagagaggugaaguauugucuagagucacacagcaggggcucagagaaaccaagaaacugugacuuaagauccuaguagaauggugacacaugccuuuaguccuagcacuucggaggcaggcagaucucugaguucgaggccagccuggucuacaaagcauguuccaggacagccagggcuacgaagagaaccccuguguugaaaaaccacaaacaaacacagccuagcugaggacaguucccaccaggaagugucaugccaucauuggcauacaggaaggacaguccaucuaaagccaugaaggaaggagccaggagccaaagggaacauaggucagacgcuaggcuaggcucucuaauggacggaccuucccgcagguggugggaagguggauuuugaagauuuuguggagcugaugggucccaagcugcuggcagagacggcagacaugauuggcgugagggagcuucgagacgccuuccgggaggugcaccuuggguggaagggguggagagggucggugagauugugggucugcagggagugagaggcugaguggauucagggcucagucagugaucccaugccaccaucaaugcuaccacaguucgacaccaacggugauggcugcaucagcguaggggagcuccgggcagcccucaaagcucugcugggggaacgccucagccaacgggaaguagaugagauacuccaagacauugaccucaauggagauggccugguugacuuugaagguaacacuuccccuacuuagccacauaugcccucaaggauucuaaaccaguggcccucaaccugugggcugugacugcauaucagauauuuaaaugacgauucauaacaguaacacaaaauauaguuacgaaguaacaaugagacaauuuugugguugggggucacuauaacaugagaaacuguaucaaagggucgcagcauuagaaagguugagaagcacuguuuguaaagaguucucaguuaucaugaaggaucgaggagggagggauguauccucccuacuguagagagaagaaauucaugucaguucucaggagagcucaagugcuuaccugggggaaggaaacagggagaaucaagauuguaaugugagcaacugagcccuccugccugaugcacagaugccuuggaaggucuccucaagcauccuuuagcccgcccuagggcaggcaggucugccucauuucuaaugggaucaggagggcagaccuaaaaccuuggcuuguccuguuagaauuuguucggaugaugucucggugagccuguguagaagcuggaguggaccggccuggaggaucccagccuccgaauugcagaggauccuauauguucuuugaaggucacuguguacaggacugugugccuccuccccaucccugccugggcacagugcccuauccugucaucaccccauaccucguccugguucucuggcaauaaaacaucuccaagcuuguugggaaag

SEQ ID NO: 9041 - RNA, 2128 nt, Mus musculus
cugagagaaugacuccaaagcaucuuuuauuuauacaaaaaggacauauuuaguaaaagacacaccaaaaaaagagucggcuguggccccagagaugaggcaggaaggucuucugcacuccuguugaagaggcaggagguggccugggcuaagaguuaaggaguaagugcugugugguggggccacagagaggagcaagcucccgucagaucagcacugugagcaggucauggaagggacucccaguggccucccagcacucccacagagggaggagaccaguuuguacagccaacuggacgaagaucugcuaccugguuccuggagggugcccacuaagggacacaggacaggaagcccaggauaggaagcaacuuggggcgcgaaggccagggagaagcaggcgcucugcaguggccagaaaggucccggcgaggaggucaaggugcuuccuguuacgugcgggcauugcguucugucucugccaagcacucucugacuagugcccgagcguggaugaugccuggggugcggugaggauggggaaguaauaaacagggccccagaaacaguccacagccacccuucagagcagacacucccccaccgcuccaugguucagcaagagcaccucuaaucuaaugaggauggaugggauuaaggguuggcuaauccgaguucccaggcaccuucuuggaaacagacucauuugaaaauggaaaaguucauuuaaaaccccuccuuagguacacguucuguuccaaucgaggcuggcccaaauguccuguccugacucuagauauccuccauccuuacugaacugucuuaaaguucagugucuguguccugggcagagcaagggcaggccuguggcuucacuuaccucucuucaggcgcuccauggcacucuugcuaccagcauaggugggccggaucucuuugcccaucuccucuaugacagacagcagguccguguaggugcucugagagcccugggaaccagguggcuucaucgccugugucaaaagaaaauacagacgugaucucagaccccgaggggaucuccuguccucagccauaagcaagcucuuggccacacucaccuguacauaccccauggagggcggaccaaagucguuaaacagcggucugaaaggugcggcagcuccuggcacugagcccgauggcgaugggacacucccggcugcaacgacaccagcaagaggucagagugugacaagggccucgucacagauuuccaagcccaggacuguucccuugacuaaccuccaacggcaugcuucuucauuccacucugaacaacuucggagacacacuccuccccccugcgcuccaccuacaagcucuacgugaccacgcccacuucucaggccagcaaacugaggcugagccaggcucgucuagcaggccccggauugcaaaacucgagcgguuucucuccaagaccucgacugcccggacaaggcgaacaaggauggaguuggagccucaccuguagggaccggggugccuggcccgggggugcuggagcccgggguacugcugggggcgggcgcgauagguuuguaggacaucccaacuccucagugcggcggccgccagccggccgcuccucugggguuggcuguccggcagcucagccgcacucugauuggcaagcgagcugcacgccccugguaaauagagcuccggccggaagggugggcgggcacgaucgguccucacucucgauuggcgcgcucagcugucacucgagccuccucauuggcugaaucuugcccccgcagggcgcaaccgcugccgauuggccuccaccuuccggaccucgcaccugucugccccggauugggcggugacagucguccuccucaauuggcgaguucggggcccggggccggcgcgcuuucaauccgauuagucccgagguccaagaggcggggccucggcagcgggccagucugguccccgcgguuugcuccggugguguguggcgggccgccgaacacacuucguccucaccgcuucgcgacuucccuccgcucagaacucccaaggccacggcucccacagugugagcacuccgcccuaccccgagcguuuuacguca

SEQ ID NO: 9042 - RNA, 7252 nt, Mus musculus
gggcgggcccugugagggcgggcccuguuuggugggcggggccguggcgggcucaaauggcggcggcgcugggcgccuaggccggcgggggccaugagcgccgcccggcccccaguuuagcaucgaugaugccuucgagcugacccuggaggacgcggggccugagcccgaguccagcggggucgcccgcuucgggccgcugcacuucgaacgccgggcucgguucgagguggcugaugaagacaagcagucccggcuacgcuaccaggugaacggcccugcucgucucacccucuuguccaggauagggcggaaccccaggccgggccccggagaauucuaacuccggagccucugccuagagaccccagcggagcggaaaauuguccccuagacgugucugcucauccagauuuauguccuugcccucugagcucugaguucgguuccagugcagcuguggagagccggaaacucggacuaggaacccaggccuuagcaacaguguagaacccaccugucuugaagacugacaccccaauaucacuccgaggaguuuggggaguacuuccaaucugaaccagaccuugucgauauuuacagcaucccuugagccccagaucacgugaccuauggagccuccgcauccccucugcuuugagaaucacccuaaaaguggagguccccacacaugauguguuugcccaucucuucauacuaaaccacaccauaaaucauugucucagguagcuucccccaacccuaucguucuuuaggacguaagacccagaggccugugcuaugcuauaccaaauccaaagucucuauguugggucccugaaaaauccugagagccucauuugaguggucaccugcuccugggauccaugcuggcagcccaccccugcuggauucugugcugaagcccccaacagccaccuacuuccuacccagguuuugguuucugaaucaucaaaccgguuccgcugggagggcagggagaggcaggagagcagcugccagaugugccaggcagaagcugucaggcugccuuucuccuccccccagagggcaguggaaaggcccauuccugaagcuuaucugaaccuuauguccuguaacagaaccuggaaaaugaugaggacggagcccaggccucuccggagccggaugggggagucagcaccaggucagggccagguggggacccacccuucuuaucccaggccccgugucucaggcuccugucugcaaggaccugcccagucccaaccagaugcacuuaccugucuuacagggauuccuagcccugcuucucucaugggaucugcuguccagcugggucaccuuaccccagugccccgguccuccaccuuaucaaugccaggcuuucugucuucuaggaauccucaguuuaauccaguccccacccucuuucauuccucuuaacacacacucuauucuguaauuccuuuucacccccuacccuugaccuccuucuggacccucuauccugcagggguuaaccucagucccuagauacaccuugaguuuaucucucagcuucugucccucucuuuaucuucccugcccccucaccauccuucuguccuucagggauucugggcacaugucuguccgcagcucgcagugguccuucagcaccaucagcagcagcacacagcgcuccuacaacgccugcugcaggugagagccuccucacuugggguucagcuuccaaguaccuucugcuucugccugccagccagccccagcucccugccugcuucaccuccuugaccuccgucuugcucuccugccacccagcuggacccaacauccuuugauccagaaaaaccgccggguagugcuggccuccuuccugcuucugcuguuggggcuaggugaguguccuaaggaccuaaaacuuccucccuccuaugagcaggcucugaagcaccuuagcacccuaggccucccuguugguacugagcauacagggcugugaggggauuagccccacucuccugaucaucuggccagagucacaaagggagggaaaaaaauggaaccugguucaguacuuuuuuaaguauuuccuuuuuuuuuuuuuuuuuaauuuuucucuauuuuuuuguuuguuuguuuguuuuuguguuguuguuguuugagacaggaguuucucuguguaguccuggcucuccuggaacucacuaucuagaccaggcuggucuggaacucacagagaucugccugccucugccucccuaguacuaggauuaaaggcguccaccaccaccacaaccacccagucuuuuuuugaaguuucuaaaaauuauuuuucucauauuuuuguuuuauguguauguagaugugccaugugugagcaguguccaaggaggucagaaaagggaauuggaucccuggagcuggaguugcagaggguuaagagccacugugugggugcugggaaccaacucuggguccucugcaagaguaauaugugcuccuaacccugagccaucucuccaguuccuuacccccuuuuuaagucguuuugagacauagcccagacaaugagguaugaucuuggacacuugaccauucuacccccacuccccaugcucuggaauuagaguuauaugccauuaugcccagcuuaccuugguuuuuguuuuuugguuuguuguuguuguucuguuuuguuuuuaaagguuuauuuauuuauuauauguaaguacacuguagcugucuucagacaccccagaagacagcaucagaucucauuacggaugguugagccacuaugugguugcugggauuugaacucaggaccuuugguagagcagucaacacucuuaauagcugaaucaucucuccagcccuacuuucuuauuuauuuaauuauuaauuuauuuauuguuuuuuucuaggcaggguuucucuguguagcccugacuguuuuagagcuugcuauguauacggggauggcucaaacucagagguccugccucugccucccaaaagcuaggauuaaagauacaugcugccugcacacccccgccccaguuguuugggugguuuuguuuguuuguuuguuuuaacucagccugaggaugaguuaggccaccagaggauggagagguaacaguuuccauugauucugugcugacuauugacagguccgugguuuucaccuuagagcggugagcagcauccagaaccuguucaugaaggcaggccaggugcuggggauacuagugucccugaggccagguaucagcuguggucugugaucagaccaggaccuuucuccacaucacauuguucagugaaggaaacugagguccagcguaggcagauuuaacagccacguauuuccgucuucuuuaugggacugagaugcagugucccagagcauccagaguugggaucaacauggggccaugaagacuaaccauggcugccucccuagguccucuucccuuccuucuccaggaaggucaaaacucccagccauccaggucuccuggccagaaaucuaaucuccaucucuagguguuugaguuuaggacacagagcugcuccuugcuggcaccacuucaggccaggcagugguggcaccuaucgcuagcuucuccucgacccagcaaagcaaguguugcuagcauccuggcuugggaaguaaggcacaagcucaggcaggagagcgggcuuccucggcugcaacuggaagacagauggccugcgauugagacccaacccaugaccgccaagcuuugggaucaccagaaagccgcaaaaggcucuagggaaugcuacucuaagagaaggauguuuacucuaagagaacagaacugaagcccuaaaccagggucaggcaaugagugugaaccuccuuuugggugcucuuuguagaacaugaaauauacaaaaguccaugguggccccuggcuucacccuccccagucagugaguccagcuaugaccucuccaccaaaggccauaucccugccugggacaaugugcugucccagauuucucuagcccggguucuucuuguucaguccaucaagugcuugacgcucuuagaaagcgucagguuccuuccagacucugaggcuuggcugugcuguucccucuauacugaauucucucuguguguuugguccaucuauggcugcugugucccaucgggucaugguugaguuuaucaagacauugcauguaugcuuagcucagggccugccagugacaucauuccugucauuccugccaggcuuagagguuaacugucuccugggcuaacuugaggcaguuguuucaagcucccacacauagaucguagcuuucaggaucuuguuggucuguccacuaaaaaaggccguggggcgggggccuacugcccuuccauuacauucuuucauuuguguguuuguggguggaggagggaauguaugccacagcucaaauguucauuuuugucuguguggguggaggagggcauguaugccauagcucaguguggucagaggguaacuugcaggagucaguucucugcuuccaccauuugggucugaggaauugaacucaaguagucggauuuuguggcaaacucuuuuuacccacugagccaucuugcuguccccauaugccuuuugcgggggggggggggggggggcggucucuauauguaaaccagacuggccucaaacucauggaaaucugucugucucugccuccugagugcugggacucaaggugcuugccaccaugccagaccccucucugcuuuuugggguagaauuuucaguaccagccauguggaggguauuccauaaguguuucuugagugauggaaaggucauacaaaauagcaguaaaaccucccauuuaauagcuguuucccagggcuguuucccagggccugccaaaguacccugcccuggaaacagcuuugugcgcauccugggagguguucugcccaggaaacaucaguuuaggugggagacgcaucgggccaaagccuggcugaaagacccugcccuuacccgcccccccccccccguccuuccccuccacaaucauaugugugcagugcuuauccuggucggcgugggacuggagguggcccccucuccaggugaguguccuuccugccuggguccucagcaaacccucccaacuccccacacaaggcacacaagccaccucccaggagaaaggggggccuucccaggcagccaucauccccagggaccccuaguccugagcuguccguuucuuucuaccuuaggugucuccagugccaucuucuuugugccgggcauccugcuguuagucccaggagguaagagugacaagaggguggggcauggguggggugggguggggccaggcacccucacugacagauaucacccccacagucuaccaugugaucuucaucuacugcgcugucaagggccgccggggcuuccaauucuucuaccugcccuacuuugagaagugagcugcaacuggccaguggcucaccagugauccaaggccucaggucaccuccacguguccacaggguauuccuccaaccuacaccugguucuguuccuuucaccuggaaggcagaggccccugggacccucacaaccaccaggccccuuugaauuugcucaggaaguuuagagcaugccagccugggaauauugccucuuaccugaugugugccuuaacuuauuccuggguucuggacuccuggguugguguaauuuugugcuaauaaaaggguaauuauuuccaacaaggacaguugcacuuuccugggccagcaagccuggcccagcacacuaacgaccacaguccccuccuacagagggacuguguguaaaggacccaccuagagcucuagaggaccaccaacuucccaaggacaaccuggauggccucaggugugcccauggucaccauuaugcccagggcagagcuggaugaaguagucccacccugucugccuucaucccugaggagauucaacacugcccccuagccaagggcaccaagaagugaugcaggcaccaggccuagaggcugguacccugguuccugccuggcucuguagcacuaggcagucaugacugucacuaaaugugggucaugugccccucuacacacccacugcccuauuuucuagacccagagguugggagaagcagggagaggaggggguaggaucacggcuucucagccgagcagcacaguaacaaggcgaugcuuagagccaccaacuguuugaaacaguucaaguucuuagaaaauuggggccgcuaauaaugucugaaacuuaaauaaacaaaaauaaacaaaaccgagaaucuuuaaggaaaucugagcucacagcaguucaugugcaacaagcugugcugagagcuccccucaagucaagccugagaauccucacugccucaguuccauuuccuagaugagacgcucaaggccccaguuguagguagggaccaacucaccaaggucaacagcacaacccaagcccuucuaaaacccagggagaggagaagagaaggaaaccaggcugacgcucucugcaggccgccacagaaaccuggcugaagcccucugcgggccacuacagaccagcugagugaguguuccaucuuucagaccacagcaugaguguccauagagaagcaacaggaugcuggacacccuagaguccugugccuuuauugaauaaguggacaccuagucuuugacccacccagaccuuccaaccucagagcugcaaucaaaccaccuuaaguaacuuaggacucugcagguagcugaggcugggacuauacaacuauaccauagaugucuuguaagaugacuccaagaauugaggcaagugcuguggagccugacagccuaaguucaaucccuggaacccacaugaaggaaagagaagacucccacguguucuuccugacccccacacacacuccaugggacacuugaacacaaacacgcaaaugugauuuuuuaaaaagccaggcugugguggugcaugccuuuaaucccagcacuugggaggcagaagcaggcgaucucuugaguucaaggccagccugaacuaucaagggaguucuaggucagucacagggccacacgggaaaacccugucuugaaaagggagaaguagccagugggaagcugcaggagcugaaggugggacaggguaaaugaagugcuugcugugcag

SEQ ID NO: 9043 - RNA, 7252 nt, Mus musculus
cugcacagcaagcacuucauuuacccugucccaccuucagcuccugcagcuucccacuggcuacuucucccuuuucaagacaggguuuucccguguggcccugugacugaccuagaacucccuugauaguucaggcuggccuugaacucaagagaucgccugcuucugccucccaagugcugggauuaaaggcaugcaccaccacagccuggcuuuuuaaaaaaucacauuugcguguuuguguucaagugucccauggagugugugugggggucaggaagaacacgugggagucuucucuuuccuucauguggguuccagggauugaacuuaggcugucaggcuccacagcacuugccucaauucuuggagucaucuuacaagacaucuaugguauaguuguauagucccagccucagcuaccugcagaguccuaaguuacuuaaggugguuugauugcagcucugagguuggaaggucugggugggucaaagacuagguguccacuuauucaauaaaggcacaggacucuaggguguccagcauccuguugcuucucuauggacacucaugcuguggucugaaagauggaacacucacucagcuggucuguaguggcccgcagagggcuucagccagguuucuguggcggccugcagagagcgucagccugguuuccuucucuucuccucucccuggguuuuagaagggcuuggguugugcuguugaccuuggugaguuggucccuaccuacaacuggggccuugagcgucucaucuaggaaauggaacugaggcagugaggauucucaggcuugacuugaggggagcucucagcacagcuuguugcacaugaacugcugugagcucagauuuccuuaaagauucucgguuuuguuuauuuuuguuuauuuaaguuucagacauuauuagcggccccaauuuucuaagaacuugaacuguuucaaacaguugguggcucuaagcaucgccuuguuacugugcugcucggcugagaagccgugauccuacccccuccucucccugcuucucccaaccucugggucuagaaaauagggcaguggguguguagaggggcacaugacccacauuuagugacagucaugacugccuagugcuacagagccaggcaggaaccaggguaccagccucuaggccuggugccugcaucacuucuuggugcccuuggcuagggggcaguguugaaucuccucagggaugaaggcagacagggugggacuacuucauccagcucugcccugggcauaauggugaccaugggcacaccugaggccauccagguuguccuugggaaguuggugguccucuagagcucuagguggguccuuuacacacagucccucuguaggaggggacuguggucguuagugugcugggccaggcuugcuggcccaggaaagugcaacuguccuuguuggaaauaauuacccuuuuauuagcacaaaauuacaccaacccaggaguccagaacccaggaauaaguuaaggcacacaucagguaagaggcaauauucccaggcuggcaugcucuaaacuuccugagcaaauucaaaggggccuggugguugugagggucccaggggccucugccuuccaggugaaaggaacagaaccagguguagguuggaggaauacccuguggacacguggaggugaccugaggccuuggaucacuggugagccacuggccaguugcagcucacuucucaaaguagggcagguagaagaauuggaagccccggcggcccuugacagcgcaguagaugaagaucacaugguagacugugggggugauaucugucagugagggugccuggccccaccccaccccacccaugccccacccucuugucacucuuaccuccugggacuaacagcaggaugcccggcacaaagaagauggcacuggagacaccuaagguagaaagaaacggacagcucaggacuaggggucccuggggaugauggcugccugggaaggccccccuuucuccugggagguggcuugugugccuuguguggggaguugggaggguuugcugaggacccaggcaggaaggacacucaccuggagagggggccaccuccagucccacgccgaccaggauaagcacugcacacauaugauuguggaggggaaggacgggggggggggggcggguaagggcagggucuuucagccaggcuuuggcccgaugcgucucccaccuaaacugauguuuccugggcagaacaccucccaggaugcgcacaaagcuguuuccagggcaggguacuuuggcaggcccugggaaacagcccugggaaacagcuauuaaaugggagguuuuacugcuauuuuguaugaccuuuccaucacucaagaaacacuuauggaauacccuccacauggcugguacugaaaauucuaccccaaaaagcagagaggggucuggcaugguggcaagcaccuugagucccagcacucaggaggcagagacagacagauuuccaugaguuugaggccagucugguuuacauauagagaccgcccccccccccccccccccgcaaaaggcauauggggacagcaagauggcucaguggguaaaaagaguuugccacaaaauccgacuacuugaguucaauuccucagacccaaaugguggaagcagagaacugacuccugcaaguuacccucugaccacacugagcuauggcauacaugcccuccuccacccacacagacaaaaaugaacauuugagcuguggcauacauucccuccuccacccacaaacacacaaaugaaagaauguaauggaagggcaguaggcccccgccccacggccuuuuuuaguggacagaccaacaagauccugaaagcuacgaucuaugugugggagcuugaaacaacugccucaaguuagcccaggagacaguuaaccucuaagccuggcaggaaugacaggaaugaugucacuggcaggcccugagcuaagcauacaugcaaugucuugauaaacucaaccaugacccgaugggacacagcagccauagauggaccaaacacacagagagaauucaguauagagggaacagcacagccaagccucagagucuggaaggaaccugacgcuuucuaagagcgucaagcacuugauggacugaacaagaagaacccgggcuagagaaaucugggacagcacauugucccaggcagggauauggccuuugguggagaggucauagcuggacucacugacuggggagggugaagccaggggccaccauggacuuuuguauauuucauguucuacaaagagcacccaaaaggagguucacacucauugccugacccugguuuagggcuucaguucuguucucuuagaguaaacauccuucucuuagaguagcauucccuagagccuuuugcggcuuucuggugaucccaaagcuuggcggucauggguugggucucaaucgcaggccaucugucuuccaguugcagccgaggaagcccgcucuccugccugagcuugugccuuacuucccaagccaggaugcuagcaacacuugcuuugcugggucgaggagaagcuagcgauaggugccaccacugccuggccugaaguggugccagcaaggagcagcucuguguccuaaacucaaacaccuagagauggagauuagauuucuggccaggagaccuggauggcugggaguuuugaccuuccuggagaaggaagggaagaggaccuagggaggcagccaugguuagucuucauggccccauguugaucccaacucuggaugcucugggacacugcaucucagucccauaaagaagacggaaauacguggcuguuaaaucugccuacgcuggaccucaguuuccuucacugaacaaugugauguggagaaagguccuggucugaucacagaccacagcugauaccuggccucagggacacuaguauccccagcaccuggccugccuucaugaacagguucuggaugcugcucaccgcucuaaggugaaaaccacggaccugucaauagucagcacagaaucaauggaaacuguuaccucuccauccucugguggccuaacucauccucaggcugaguuaaaacaaacaaacaaacaaaaccacccaaacaacuggggcgggggugugcaggcagcauguaucuuuaauccuagcuuuugggaggcagaggcaggaccucugaguuugagccauccccguauacauagcaagcucuaaaacagucagggcuacacagagaaacccugccuagaaaaaaacaauaaauaaauuaauaauuaaauaaauaagaaaguagggcuggagagaugauucagcuauuaagaguguugacugcucuaccaaagguccugaguucaaaucccagcaaccacauaguggcucaaccauccguaaugagaucugaugcugucuucuggggugucugaagacagcuacaguguacuuacauauaauaaauaaauaaaccuuuaaaaacaaaacagaacaacaacaacaaaccaaaaaacaaaaaccaagguaagcugggcauaauggcauauaacucuaauuccagagcauggggaguggggguagaauggucaaguguccaagaucauaccucauugucugggcuaugucucaaaacgacuuaaaaaggggguaaggaacuggagagauggcucaggguuaggagcacauauuacucuugcagaggacccagaguugguucccagcacccacacaguggcucuuaacccucugcaacuccagcuccagggauccaauucccuuuucugaccuccuuggacacugcucacacauggcacaucuacauacacauaaaacaaaaauaugagaaaaauaauuuuuagaaacuucaaaaaaagacugggugguugugguggugguggacgccuuuaauccuaguacuagggaggcagaggcaggcagaucucugugaguuccagaccagccuggucuagauagugaguuccaggagagccaggacuacacagagaaacuccugucucaaacaacaacaacacaaaaacaaacaaacaaacaaaaaaauagagaaaaauuaaaaaaaaaaaaaaaaaggaaauacuuaaaaaaguacugaaccagguuccauuuuuuucccucccuuugugacucuggccagaugaucaggagaguggggcuaauccccucacagcccuguaugcucaguaccaacagggaggccuagggugcuaaggugcuucagagccugcucauaggagggaggaaguuuuagguccuuaggacacucaccuagccccaacagcagaagcaggaaggaggccagcacuacccggcgguuuuucuggaucaaaggauguuggguccagcuggguggcaggagagcaagacggaggucaaggaggugaagcaggcagggagcuggggcuggcuggcaggcagaagcagaagguacuuggaagcugaaccccaagugaggaggcucucaccugcagcaggcguuguaggagcgcugugugcugcugcugauggugcugaaggaccacugcgagcugcggacagacaugugcccagaaucccugaaggacagaaggauggugagggggcagggaagauaaagagagggacagaagcugagagauaaacucaagguguaucuagggacugagguuaaccccugcaggauagaggguccagaaggaggucaaggguagggggugaaaaggaauuacagaauagaguguguguuaagaggaaugaaagaggguggggacuggauuaaacugaggauuccuagaagacagaaagccuggcauugauaagguggaggaccggggcacugggguaaggugacccagcuggacagcagaucccaugagagaagcagggcuaggaaucccuguaagacagguaagugcaucugguugggacugggcagguccuugcagacaggagccugagacacggggccugggauaagaaggguggguccccaccuggcccugaccuggugcugacucccccauccggcuccggagaggccugggcuccguccucaucauuuuccagguucuguuacaggacauaagguucagauaagcuucaggaaugggccuuuccacugcccucuggggggaggagaaaggcagccugacagcuucugccuggcacaucuggcagcugcucuccugccucucccugcccucccagcggaaccgguuugaugauucagaaaccaaaaccuggguaggaaguagguggcuguugggggcuucagcacagaauccagcaggggugggcugccagcauggaucccaggagcaggugaccacucaaaugaggcucucaggauuuuucagggacccaacauagagacuuuggauuugguauagcauagcacaggccucugggucuuacguccuaaagaacgauaggguugggggaagcuaccugagacaaugauuuauggugugguuuaguaugaagagaugggcaaacacaucauguguggggaccuccacuuuuagggugauucucaaagcagaggggaugcggaggcuccauaggucacgugaucuggggcucaagggaugcuguaaauaucgacaaggucugguucagauuggaaguacuccccaaacuccucggagugauauuggggugucagucuucaagacagguggguucuacacuguugcuaaggccuggguuccuaguccgaguuuccggcucuccacagcugcacuggaaccgaacucagagcucagagggcaaggacauaaaucuggaugagcagacacgucuaggggacaauuuuccgcuccgcuggggucucuaggcagaggcuccggaguuagaauucuccggggcccggccugggguuccgcccuauccuggacaagagggugagacgagcagggccguucaccugguagcguagccgggacugcuugucuucaucagccaccucgaaccgagcccggcguucgaagugcagcggcccgaagcgggcgaccccgcuggacucgggcucaggccccgcguccuccagggucagcucgaaggcaucaucgaugcuaaacugggggccgggcggcgcucauggcccccgccggccuaggcgcccagcgccgccgccauuugagcccgccacggccccgcccaccaaacagggcccgcccucacagggcccgccc

SEQ ID NO: 9044 - RNA, 8097 nt, Mus musculus
cggcuaucacuuccugauucccgcuuccugcuucccagaggccgggauccggagccgcccgaggucgccgccgcaguccccggcgccccuggggagcggagagcggugagcggugagcggugagagcggcagggacggacuaggggcgcagacgugggccuggggcagggggcgcgagccggaagagcgccucgccccaccuucauucccgacucccucccaccccccagccgccccucucucccuuucugggcugggaucuuuggaaguuggguuccugguucacuuggaccgugcuccaaggccacuuugaggaccuggcaguauccucgaccccuguucagccagggucccuaggcccgacuucugcagcucuuugcacaguccccgggacugagcugcggccuugcuagaccaaccaaccccuuuugcugccucuucuccccaucacccagccuucaaacucuggguguggaaagcgccuuggaaccaucugggaccuacagaagaucuaaauucugucucccuuucagcagcacacacacacucagaccccuagccagggaggggauggggaggcagagaguguuggucugcaccuaugagcccuuucuauaacuggggaaauagagacucccagcuaacgcuggaccaauuuccuggugacaugcucugugugucucuuuggagagcagagcugauucaggugucucugcccucacagacauguccuuccgaaaaguugugcggcagagcaaauuccggcauguauucggucagccggucaagaaugaccagugcuaugaggacauucgagugucccgaguuaccugggacagcaccuucugcgcagucaaccccaaguuccuggcagugauuguggaagccagugguggaggcgccuuuauggugcuuccucuaaacaaggugggccucagcgggucaggguggagaggacaucugaggacacucuggucacaccugugggcagggcaguuugugccacuucuuggcccguggcuacugauggauuguugauggaaguagaaaaaguguuuauugccaccaaguguggauaagaggcugcagcaggcauuuccucauaugcuggguggagcagacacaucugggccaccaggaaccagggcagucacauuauucuugcaccuuggagggcccauagauacugggaggaauggaggucgggacuuuggguucuucucugacugcucuucaugacuacagacgggccgcauugacaaggccuacccgacagugugugggcacacggggccuguucuggauauugacugguguccccacaaugaugaagucauugccaguggaucagaggacugcacugucauggugagcaaaggaccguucaagucagggucucaggguguggcugaaggaugcuggcagcaggggcaagcacaggccugagcccaugcuccgucucccuaccgcagguauggcagauuccagaaaaugggcugaccuccccucugacagagccaguaguggugcucgaggggcauaccaagcgcgugggcauuaucaccuggcaccccacagcccgaaaugugcuucucagugcagguuugcaccaucccauaccuaccccuugcucuccgcccuucuccaggaugauccuggaauguucagcagccucucacaggccagucuaacaggggaagugaugccugcaaagaugguggcccggaucaguucaagaggcgggggcagagugggccuagugggcugaugguccuacgagugcaugccuggcuaccugagcugaugaccgcuugcccaucagguugugacaaugugguacuuaucuggaaugugggcacugcagaggagcuguaccgucuggacagcuugcaccccgaccucaucuacaacgugagcuggaaccacaauggcagccucuuuugcucagcuugcaaggacaagagcguccgaaucaucgauccuaggcggggcacccugguggcaguagguauccccaaagggcaaauaugacaauguccagacucagggccuugaucugcacuguacugaccaccuguccauccuacaggaacgugaaaaggcucacgagggggcccggcccaugcgggccaucuuucuagcugacgggaagguguucaccacagguuucagccgcaugagugaacggcagcuggcgcucugggacccagugagugauguagcaagccuaaggcgggcaggcuugugaccugggccucacccuagcauauuccucccugggccuggcagacagauuagcauggagacgucugucuguacugcuuggauucucagccuggcucuugagacucccgggacguugccaucccucccuucccuguuuccagcucccuggcucucccuagcacucccccacugccucccacauccuuaguuuuugcuugcgcaaaccauaaagguacccuucuccuuagagcuuccagucccuggguagagagacugucccuuagcagugugcucugaggguccucuugaggccugggcugguaccaccugggcccccacccuuccuguggccagaugucuucaacacuugcccauuaguuugggaguagucuugaggccuggagaaggcugggaagugggcccuggagauggagaaaaccgcuagcaugcugaggaguguugcugacuggugugagaccggccgaggccagucuagcagugcucggaaggagaggaugcugacucgacccaauugucccucauguacuuaggaaaaccuugaggagcccauggcccugcaggagcuggauucaagcaauggggcucuacugcccuuuuaugacccagacaccaguguggucuaugucuguggcaaggugaggcugggugggcagcaaacuuaggcugagcauaauggaaggcccuggcuaagugcuggacuuccuuauuccugcagggcgauuccagcauccgguacuuugagaucacagaugagccccccuacauccacuuccugaauacauuuaccagcaaagaaccccagagggguaugggcagcaugccuaagaggggcuuggaggucagcaagugugaaauugccagguauuaaaguccucuggggcggucauuuguaggcagacuuuauucaaggaugucuuugugaggggggggggcguggggggggggucagacaaagaguaggagccagguuguccgcauccaagguggaagcucagaguguggcggcuaagcugggcaugguguccuacaccugucaccccagcacuuggggacugccagcacagaggccaccaggaccacacagaaaguucaaggucaguucaagacccugucucaaacaucaacaggacaaaggaaagggaugggcauguggcucuccauuggugcagcgccugcccagcagagcccauggcuuuaccauggcacuguaaagcaaaagcugcaaugcgugccugugauucacccgggagguagcccugggaggagcacaaguucaaggucauccuuagcucuguagugagcuuaggcucggggccagccuggaauauaugaaaccauguuucaaaaaauaaagagaguaaaauaaagagcacucacuccuuuaauccuagcuucuggcagaggcaggucgaacuccaugaguuuuaaacaaggcuggucuauacagugagacccuaucucaaaaagagacagagacagagagagaaagagagaauaagaaucacaauuguaagguugccuagggucaugcucuagggaggccaugaacucacaaggcagccuguguguguggucucaggucuaccugugggaauauccagguggggaaacuggaaaauugugggagguuccaccaugacuccccucccuuuuccagguucuacaaacugcaugaacgcaagugugagcccauagucaugacugugccaagaaaggugaggcugcugguaacccuguccacccacucccaucccuagcagaaggaccacaccaaagcggugggcgaggcugaugaguggauggaaccuaugggcuguacugauuccaggguggacugaguuguaguaaauuguuggaggaauggcacaggaugagcugaagcccugcagugacagaccaggcacuuaagagcaagaugggggaagagggacagagggccuccccuaggaggccagacuagcugugggguuggaaugguggucugugggaggcagggcuagaagaagggcaugaaggacaggggcucuggucaugaaacccauggggaggauccuggaacacagucccacuguccugcagcugguguuuacagucugccagccauggccugcagcaaagcucauaaucugugggccauagauauggcucccaggauuccacagagccacauagcugguccuugugguuugcuggagauggugccagcaagggcugugccaggaaggaucaggcauuuggaggauggguuggcaagaguacaagucaggaggguguugaggaugcagccacucagagaccagaugugagaccccugaucgucgggaccuccaacugauucugaccuccccuacgcggugcgcagucugaccucuuccaggaugaucuguacccugacacagccgggccugaggcugcucuugaagcagaggauugggugagcggucaggaugcuaauccaauccucaucucacuacgggaagccuaugugcccaguaaacaacgggaccugaaggucagccggcgcaacgugcuaucagacagcaggccugccaguuacagccgcuccggagccuccacagcuacugcaguuacugauguccccaguggcaaccuugcuggggcugguguaugugaccuacauuugggagugcugucccauuggcuaggcaccaggccucuucccuggggguggguuauggcugauagccucugacuuccauuugucuuuguaggaagcugggaagcuggaagaggugaugcaggagcuccgggcacuccggaugcuggucaaggagcagggagaacguaucagccgccuggaggagcagcugggccgcauggagaauggggauacauaggaccaccagggaccugcucccgacacugccuccuccaacccuucccaccuagcuucuguggccaggucacaccaggcaguuggcugcucagugccucuguggcaggucacagccaguuugcaccucuccacagccuggggcccagguuggaagcaccaccugacuuuuggaagauuuuuguaccaaggcaaauucccaaguacuuuaagggaccaucuccucgaccugcccaacccacugcccccucaccagaaaaagcagcagagauggggucuauauuuucauuccaaauaaaaugcucuuucuaaagccagguuugaccuacuguuguggaggauuaggaguggaugcuagaaagggaaacugcaaaccuuauauggaaaguagccccugcauaccagaauuccaccauacagagaaacugaggugaaaaggccagggaaaggugugggggaugggcuaguggguaaauucucuugcuaagcaagccugaagaccugaauucaacuccuggagcccacaguggaaagaggcaucugacuuccauuuguccccacguaugcaggcauguguacaguuuuguuguuuugguuuuuuguuuuaaggcuaaccagauacccacuuagucccaguaccccagaggcagagcuaggagcucagaguuccagaccugccaaagcuacauaauguauagguggcuguccugcuuugaguuagauagaugcacacuuccucccuuuggaguucuggucacagauccuguggccccagccucaccuagagagagaagaucuaauaccugucuggguaauccugaggcugagacccagugaggguccuguaauagacaagaguggguggggcauuuugggcaggaaacggaaguguaacuccuacuagcuacucuacugagagcuguggggcucacuucucacuaaacagucagaggugggugcccgugcaaaagccaucggaucaauggugagcugugggacccucugggcucuuggggcaccgugggcuggggauggaauaucaagguuccaggaguuaaggaagggucuccuuccguagccugagacccaggacuagaauggguuggaauuuagcccucaccucagaucugggcucucugggauuaaagguagguccucuaguuccucacccugggcacagcccuauuccaagacccuugggacaguccuccaccugguccccucacgagccgaguuuagguguaacucuuucuccagagcuugguaugcuacgggggagccuugugcccagcacccuuccccccacccccugcuaccacccccaccaccugcuuuguuccaaccgcaggcuuccucugauagcuacacaugcugcccccagaccgguggcccugcacgccugaggcccuuugggguagaguggggagcugaacaacggaaacccugcagcuggggcagccccauggucgaggaggggcuucaaagaccccucauucuaggaccagucaaccucugagcuggucuagauaucuccaucauggccuccagagagcaaccugccacuagccucucagaccccuucaacucccucuacugcaaggcaggccaggccacacagccagcuaauauccacugagcaucuauguccaugguuuuaagugcuccccaccccaaauccaggcgcuuauucuggugggaaauguaacacaacuggaucaagauuauucucuaguguaggauuuggugggaaaagaguaaucaagggaccugaggucggugaaugggugggcugaggucugacaaguuagcuguagaagucuugcaggugugggagggggugacccggaggggacagugaccagaauguaaagugaguaaguuuaaaaaaaaaaaaaaacagccgggcaggaccucaucaucagccaggccuagccaggcuuggcaagcaugucaccaugaggcugugaaguagugucugagcaaagggaaggccaacgcacaggccucugacaggcacaggccucaggcagugagaagugaguuacaggguuggguugaaggugagcacaauagcaaaggccuaaccaaauaugggcuggugauuuucugcuugacugucucuauuuugcuugaggcagcugaggucuuuguuagaauucaguuggucucaucaggugacaacuccucccuacugucucccacaggcucugccugguacccucagauuuggggugcugauggcccugccaggggcacuggccucuggggcagacccagaggacggugugggcuccaguguggucaccauuguccugcugcucuugcuccugcugcugcuggucacugcccuagccuuggcuuggcgucgccucagccaugccucagggggguacuaccacccagcucgccugggugcugccuuguggggccacaccugccgccugcucugggccagcccugcaggccgcuggcuucgcgcccgcacugagcuggaauccccagaagaaucagggccgccggaggaugaagaggaugcagaagauuuugugauagaugguggccccgaggaagcugccgccaaggaagaggagcagcggugucaagcagagcagacccgagauccacgugacacagacagugacgggggccugggccugagcucucaggguccugugggcucaggcagcagcgccgaggcccugcugagugaccugcaugccuuuucugguagugcugccugggaugacagcgcuggaggagcagggggccagggccuccgggucacugcacuauaggagucagcuuguccuguuccugccccagccucugacuuuucccaugcauguuauggugaaacacaagcugcccuggaccuucgucaccccacccuuacaucagcuucuuagacugacaccccaaccaguuccccagagugugugugugcaucccagacaggcacugggcaaacauuaaaaauaaaacuuuguaagcacuga

SEQ ID NO: 9045 - RNA, 8097 nt, Mus musculus
ucagugcuuacaaaguuuuauuuuuaauguuugcccagugccugucugggaugcacacacacacucuggggaacugguuggggugucagucuaagaagcugauguaaggguggggugacgaagguccagggcagcuuguguuucaccauaacaugcaugggaaaagucagaggcuggggcaggaacaggacaagcugacuccuauagugcagugacccggaggcccuggcccccugcuccuccagcgcugucaucccaggcagcacuaccagaaaaggcaugcaggucacucagcagggccucggcgcugcugccugagcccacaggacccugagagcucaggcccaggcccccgucacugucugugucacguggaucucgggucugcucugcuugacaccgcugcuccucuuccuuggcggcagcuuccucggggccaccaucuaucacaaaaucuucugcauccucuucauccuccggcggcccugauucuucuggggauuccagcucagugcgggcgcgaagccagcggccugcagggcuggcccagagcaggcggcagguguggccccacaaggcagcacccaggcgagcugggugguaguaccccccugaggcauggcugaggcgacgccaagccaaggcuagggcagugaccagcagcagcaggagcaagagcagcaggacaauggugaccacacuggagcccacaccguccucugggucugccccagaggccagugccccuggcagggccaucagcaccccaaaucugaggguaccaggcagagccugugggagacaguagggaggaguugucaccugaugagaccaacugaauucuaacaaagaccucagcugccucaagcaaaauagagacagucaagcagaaaaucaccagcccauauuugguuaggccuuugcuauugugcucaccuucaacccaacccuguaacucacuucucacugccugaggccugugccugucagaggccugugcguuggccuucccuuugcucagacacuacuucacagccucauggugacaugcuugccaagccuggcuaggccuggcugaugaugagguccugcccggcuguuuuuuuuuuuuuuuaaacuuacucacuuuacauucuggucacuguccccuccgggucacccccucccacaccugcaagacuucuacagcuaacuugucagaccucagcccacccauucaccgaccucaggucccuugauuacucuuuucccaccaaauccuacacuagagaauaaucuugauccaguuguguuacauuucccaccagaauaagcgccuggauuugggguggggagcacuuaaaaccauggacauagaugcucaguggauauuagcuggcuguguggccuggccugccuugcaguagagggaguugaaggggucugagaggcuaguggcagguugcucucuggaggccaugauggagauaucuagaccagcucagagguugacugguccuagaaugaggggucuuugaagccccuccucgaccauggggcugccccagcugcaggguuuccguuguucagcuccccacucuaccccaaagggccucaggcgugcagggccaccggucugggggcagcauguguagcuaucagaggaagccugcgguuggaacaaagcagguggugggggugguagcaggggguggggggaagggugcugggcacaaggcucccccguagcauaccaagcucuggagaaagaguuacaccuaaacucggcucgugaggggaccagguggaggacugucccaagggucuuggaauagggcugugcccagggugaggaacuagaggaccuaccuuuaaucccagagagcccagaucugaggugagggcuaaauuccaacccauucuaguccugggucucaggcuacggaaggagacccuuccuuaacuccuggaaccuugauauuccauccccagcccacggugccccaagagcccagagggucccacagcucaccauugauccgauggcuuuugcacgggcacccaccucugacuguuuagugagaagugagccccacagcucucaguagaguagcuaguaggaguuacacuuccguuuccugcccaaaaugccccacccacucuugucuauuacaggacccucacugggucucagccucaggauuacccagacagguauuagaucuucucucucuaggugaggcuggggccacaggaucugugaccagaacuccaaagggaggaagugugcaucuaucuaacucaaagcaggacagccaccuauacauuauguagcuuuggcaggucuggaacucugagcuccuagcucugccucugggguacugggacuaaguggguaucugguuagccuuaaaacaaaaaaccaaaacaacaaaacuguacacaugccugcauacguggggacaaauggaagucagaugccucuuuccacugugggcuccaggaguugaauucaggucuucaggcuugcuuagcaagagaauuuacccacuagcccaucccccacaccuuucccuggccuuuucaccucaguuucucuguaugguggaauucugguaugcaggggcuacuuuccauauaagguuugcaguuucccuuucuagcauccacuccuaauccuccacaacaguaggucaaaccuggcuuuagaaagagcauuuuauuuggaaugaaaauauagaccccaucucugcugcuuuuucuggugagggggcaguggguugggcaggucgaggagauggucccuuaaaguacuugggaauuugccuugguacaaaaaucuuccaaaagucagguggugcuuccaaccugggccccaggcuguggagaggugcaaacuggcugugaccugccacagaggcacugagcagccaacugccuggugugaccuggccacagaagcuaggugggaaggguuggaggaggcagugucgggagcaggucccuggugguccuauguauccccauucuccaugcggcccagcugcuccuccaggcggcugauacguucucccugcuccuugaccagcauccggagugcccggagcuccugcaucaccucuuccagcuucccagcuuccuacaaagacaaauggaagucagaggcuaucagccauaacccacccccagggaagaggccuggugccuagccaaugggacagcacucccaaauguaggucacauacaccagccccagcaagguugccacuggggacaucaguaacugcaguagcuguggaggcuccggagcggcuguaacuggcaggccugcugucugauagcacguugcgccggcugaccuucaggucccguuguuuacugggcacauaggcuucccguagugagaugaggauuggauuagcauccugaccgcucacccaauccucugcuucaagagcagccucaggcccggcugugucaggguacagaucauccuggaagaggucagacugcgcaccgcguaggggaggucagaaucaguuggaggucccgacgaucaggggucucacaucuggucucugaguggcugcauccucaacacccuccugacuuguacucuugccaacccauccuccaaaugccugauccuuccuggcacagcccuugcuggcaccaucuccagcaaaccacaaggaccagcuauguggcucuguggaauccugggagccauaucuauggcccacagauuaugagcuuugcugcaggccauggcuggcagacuguaaacaccagcugcaggacagugggacuguguuccaggauccuccccauggguuucaugaccagagccccuguccuucaugcccuucuucuagcccugccucccacagaccaccauuccaaccccacagcuagucuggccuccuaggggaggcccucugucccucuucccccaucuugcucuuaagugccuggucugucacugcagggcuucagcucauccugugccauuccuccaacaauuuacuacaacucaguccacccuggaaucaguacagcccauagguuccauccacucaucagccucgcccaccgcuuuggugugguccuucugcuagggaugggaguggguggacaggguuaccagcagccucaccuuucuuggcacagucaugacuaugggcucacacuugcguucaugcaguuuguagaaccuggaaaagggaggggagucaugguggaaccucccacaauuuuccaguuuccccaccuggauauucccacagguagaccugagaccacacacacaggcugccuugugaguucauggccucccuagagcaugacccuaggcaaccuuacaauugugauucuuauucucucuuucucucucugucucugucucuuuuugagauagggucucacuguauagaccagccuuguuuaaaacucauggaguucgaccugccucugccagaagcuaggauuaaaggagugagugcucuuuauuuuacucucuuuauuuuuugaaacaugguuucauauauuccaggcuggccccgagccuaagcucacuacagagcuaaggaugaccuugaacuugugcuccucccagggcuaccucccgggugaaucacaggcacgcauugcagcuuuugcuuuacagugccaugguaaagccaugggcucugcugggcaggcgcugcaccaauggagagccacaugcccaucccuuuccuuuguccuguugauguuugagacagggucuugaacugaccuugaacuuucugugugguccugguggccucugugcuggcaguccccaagugcuggggugacagguguaggacaccaugcccagcuuagccgccacacucugagcuuccaccuuggaugcggacaaccuggcuccuacucuuugucugaccccccccccacgccccccccccucacaaagacauccuugaauaaagucugccuacaaaugaccgccccagaggacuuuaauaccuggcaauuucacacuugcugaccuccaagccccucuuaggcaugcugcccauaccccucugggguucuuugcugguaaauguauucaggaaguggauguaggggggcucaucugugaucucaaaguaccggaugcuggaaucgcccugcaggaauaaggaaguccagcacuuagccagggccuuccauuaugcucagccuaaguuugcugcccacccagccucaccuugccacagacauagaccacacuggugucugggucauaaaagggcaguagagccccauugcuugaauccagcuccugcagggccaugggcuccucaagguuuuccuaaguacaugagggacaauugggucgagucagcauccucuccuuccgagcacugcuagacuggccucggccggucucacaccagucagcaacacuccucagcaugcuagcgguuuucuccaucuccagggcccacuucccagccuucuccaggccucaagacuacucccaaacuaaugggcaaguguugaagacaucuggccacaggaagggugggggcccaggugguaccagcccaggccucaagaggacccucagagcacacugcuaagggacagucucucuacccagggacuggaagcucuaaggagaaggguaccuuuaugguuugcgcaagcaaaaacuaaggaugugggaggcagugggggagugcuagggagagccagggagcuggaaacagggaagggagggauggcaacgucccgggagucucaagagccaggcugagaauccaagcaguacagacagacgucuccaugcuaaucugucugccaggcccagggaggaauaugcuagggugaggcccaggucacaagccugcccgccuuaggcuugcuacaucacucacugggucccagagcgccagcugccguucacucaugcggcugaaaccuguggugaacaccuucccgucagcuagaaagauggcccgcaugggccgggcccccucgugagccuuuucacguuccuguaggauggacagguggucaguacagugcagaucaaggcccugagucuggacauugucauauuugcccuuuggggauaccuacugccaccagggugccccgccuaggaucgaugauucggacgcucuuguccuugcaagcugagcaaaagaggcugccauugugguuccagcucacguuguagaugaggucggggugcaagcuguccagacgguacagcuccucugcagugcccacauuccagauaaguaccacauugucacaaccugaugggcaagcggucaucagcucagguagccaggcaugcacucguaggaccaucagcccacuaggcccacucugcccccgccucuugaacugauccgggccaccaucuuugcaggcaucacuuccccuguuagacuggccugugagaggcugcugaacauuccaggaucauccuggagaagggcggagagcaagggguagguaugggauggugcaaaccugcacugagaagcacauuucgggcuguggggugccaggugauaaugcccacgcgcuugguaugccccucgagcaccacuacuggcucugucagaggggaggucagcccauuuucuggaaucugccauaccugcgguagggagacggagcaugggcucaggccugugcuugccccugcugccagcauccuucagccacacccugagacccugacuugaacgguccuuugcucaccaugacagugcaguccucugauccacuggcaaugacuucaucauuguggggacaccagucaauauccagaacaggccccgugugcccacacacugucggguaggccuugucaaugcggcccgucuguagucaugaagagcagucagagaagaacccaaagucccgaccuccauuccucccaguaucuaugggcccuccaaggugcaagaauaaugugacugcccugguuccugguggcccagaugugucugcuccacccagcauaugaggaaaugccugcugcagccucuuauccacacuugguggcaauaaacacuuuuucuacuuccaucaacaauccaucaguagccacgggccaagaaguggcacaaacugcccugcccacaggugugaccagaguguccucagauguccucuccacccugacccgcugaggcccaccuuguuuagaggaagcaccauaaaggcgccuccaccacuggcuuccacaaucacugccaggaacuugggguugacugcgcagaaggugcugucccagguaacucgggacacucgaauguccucauagcacuggucauucuugaccggcugaccgaauacaugccggaauuugcucugccgcacaacuuuucggaaggacaugucugugagggcagagacaccugaaucagcucugcucuccaaagagacacacagagcaugucaccaggaaauugguccagcguuagcugggagucucuauuuccccaguuauagaaagggcucauaggugcagaccaacacucucugccuccccauccccucccuggcuaggggucugagugugugugugcugcugaaagggagacagaauuuagaucuucuguaggucccagaugguuccaaggcgcuuuccacacccagaguuugaaggcugggugauggggagaagaggcagcaaaagggguugguuggucuagcaaggccgcagcucagucccggggacugugcaaagagcugcagaagucgggccuagggacccuggcugaacaggggucgaggauacugccagguccucaaaguggccuuggagcacgguccaagugaaccaggaacccaacuuccaaagaucccagcccagaaagggagagaggggcggcuggggggugggagggagucgggaaugaagguggggcgaggcgcucuuccggcucgcgcccccugccccaggcccacgucugcgccccuaguccgucccugccgcucucaccgcucaccgcucaccgcucuccgcuccccaggggcgccggggacugcggcggcgaccucgggcggcuccggaucccggccucugggaagcaggaagcgggaaucaggaagugauagccg

SEQ ID NO: 9046 - RNA, 10476 nt, Mus musculus
caacagagcgagcggcugcugucgcggagaaaugacguaggcacagcccggugcugucagucagaguucugccugguccgggccaagggucccgcgggaccggcggggccauggcggccguauuugauuuagacuuggagaccgaggaagggagcgagggcgagggcgaaccggaguucagcccugcggugaguguuucucuccgggcgcgacuggacccgggagcccggcugguuaaccaaaacccuggcgcucccaacucugagugguuugugaccccuacaaacccagauccagccccaaccccaaccccagccccagccccuggacccaaucuuuccuuuucuauccuuggucucuccuucccaaccuuuccccaucccugcuccugucuucuauccuugguccucuccccugggccaagcaguugagccuagguugggaggagguauucuggcaccucccaugguucuuauuacuugguuucucacaggacguguguccccuuggcgaauuaagggcugcuggccuggagugagugagggucuugcuugggggguggggguauggaguaggggucgggacuuggaguacacuagagccuuucccucauuaacuuauucugucuuuaggacagugggacacuaugaagaaguagagcugacagagagcagcgugaaccuggguccugagcgcaucgggccccacugcuuugagcuacugaguguacugggcaaggggggcuauggcaagguacuaacaucccucucucccuggcgaccucagcucuagccugagacagcauacuauccuucacacccaauaggcuuguaaauguacggagucucugauggaauucagagcuggagaccugggggaaggaagggcauauccuuucaaaaucugauggagaucuuuacuguuccacccuuaagcugaguuuagaccuuuuggucccuuuaggguggggcaaccuugaaggugggguguggucagagaaguuaauccugucuccccugcccuacagguguuccaggugagaaaagugcaaggcaccaacuugggaaaaauauaugccaugaaggucuuaaggaaggugagucacucgcuuagccagcagagacagaguagcugccauccccaucagccugugccaggucucgggaagacagccggaaacaugauaaagacaguccuuaucuugacacuugcugacuuagcaucuauugucauacauacgauuuuggaguaauucuuggauggaagaagcuggccugcuagggcacauauggcaagcuuugauugucaggacucaugaggacaggcaguacuguuggcauucugugaauagaagcccaggaugcagcgcaacaggaacccacgacaaagaauuguguggcucagugugucagcagggucaaguugagcugaacuugguaggauacuguguagucucaggacuugaauggguaaagccggaggaucugaguggugguaggccagcacaccaggggcuacauaaugauaccuugucucaaagaacacaagaaaguaucaagggugagagacugagaggauaaaccgguuccggaaaaguuuacuguuuuuaagucacuuccucucaggagacaaggucucacugaagcugggcuggagacccaguggugcuucugugccccucccacagggcacaggcacgcacagccaucguuggcuuuuuauauugcuacugaagauuugaacucagaucuuuaugcuuucauaguucacacuuugaaccucugaguccagugcccaguccucccauugucuuugucaugaucagaucuuguggagggcagacuggagaagcuucuagaaagggggcucuuugugauacuguuccacccuugguaccccgacucuauggguugguuacugucaggaugauaucacugcacagaccuagcaucuagacacuuacauacccaaguuguuucaauguuuauuugaaacaagagacguguacuggaacacuggcuccuccucaguauaguugacucuugagguugcgcauucuauugagguggcagucaauccgcagagcagaaaggcaagcacucuggaugccuccccuucuaacagacuccugcaucucuaggccaagauuguaugcagugccaaggacacagcccauacccgggcugagaggaacauucuagaaucugugaagcaucccuucauuguagaacuggccuaugcuuuccagacagguggcaaacucuaccucauccuggagugccucagugguaggugugugggcuaagccgagcaggguguggcagggagccagcccaggaacacuggguggggacuuagggacucuugagagguaucauggaggauggcuaggaggcucacauaccaugccuggccguguguccaucugucugucucucuaucuguucauucauucagcaaacauccauccagugccuaguguuugugggguggguggggcuggugggaguuuauauagaugugauguccagagaaaauuucauccacuuuuuccugccuguccucugugugccaggcacccagucaggucucaccuagcuacauccuucuucuuggaagucucaugagugguuacuguuucuauaggguuuaauuuuuuuguuuuguuuuguuuuggggggaggguucaagacaggguuucucuguguagcccuggcuguccuggaacucacucuguagaccaggcuggccucgaacucagaaaucugacugccucugccucccaagugcugggauuaaaggcaugcaccaccacugcccgggguucguuuuuuuuuuuuuuuuugguuuuucgagacagaguuucucuguauagcccuggcuguccuggagcucacuuuguagaccaggccggccucgaacucagaaauucgccugccucugccucccgagugcugggauuaaagacaugcgccaccaugcccagcuucguuuauuuuuugagacaaggucugcuuauguaguccuggccugcuuagaacuuacuauauagaccaugcuggccuugaauucaggagaucugccugucuuugcagacugaguguugguauuaaaggcaugugcuacacacuuucuuguuuugucuuuuugaggcagggucuuacuauauaacauuguuuggccaggaacucauuacauagaacucaaaagacauucccugccccugucugggauuuaaauuaugugccaucacaccuagcaggucuguuuuuaaacuagcuuugagggucuagcuucccugggcucuucaccuccacuaauugcgaaggucaucuuccuggagcacgugucucuaaacacccaaacaaggccuuggucuuuuuggucaugccauuacucaccaagagugauugagagccauuccuucucccugucugcccaguaccagcugaacccuacagcgacuuccugcaugcuuggcgucccgucccacucuauccagacagagagccacaccgucacugccccuuccccaucacuguguugagauuagcuuccuccgcccucuaucaugaggcucuggaguucccagagcuaugaccugagccuggcauccuagagcacuguccacaugucugucuucccauuagacugagcauccugagggcaauggcugggucuccucaacucugccccagcuucucgcagcacagggccaggcaccaagugcguaggcgacgguagauguuugcugauugaauugaguccccacggcaucucugggaggcagguagggugggaucuacaagucccauuuuucucuagaagaaacugacgcucagacaguagcgaggcugggcccgagugcacagcugcugaugugcuugugucacagguggugagcucuucacacaucuugagcgagaaggcaucuuccuggaagacacagccuggugggugucugggggugcugguccuugccuacaccccaaccuuugcccugccuuuaccuuguccugucuuugcagcuucuaccuggcagagaucacacuagcccugggccaucuccauucccacggcaucaucuaccgggaccucaagccugagaacaucaugcucagcagccagggugagcacgcugcgugcacgcaugggcguuacaccccuggccuugccagcgucugcagggcagggcugaggagcccacaaguaggccuggccauaugucaucccagggcuucucuuuuaacauucuuccucaggccacaucaaacugacagacuuuggacuuugcaaggaguccauucaugagggugcuaucacucacaccuucuguggcaccauugaguacauguaaguaacaccuggcuggccagggucugggaggauuaccagagagggccugcccuuaacugacacuuccaccugccucccagggccccagagauucuagugcgcacuggucacaaccgggcaguggacugguggagccugggagcccugauguacgacaugcucacuggaucggcaaguccagcuuccuugggcgcaggguggguguuggggagaucccuuccagguuggggcaggacugggugggaggaccccuaggcugcccucaccuucugccuucuccagccgcccuucacugcagagaaccggaagaaaacuauggauaaaaucauuaaagggaagcuggugcugccccccuaccucaccccggaugcccgggaccuugccaaaaagguggggcuccuucucauccagggacuuauuucugccucuucccuaaacccugucagcaacucugcaugucugaucgacugucccuaggcucuggggaaggccaugccuuaacccccugccugugcaguuugucucuggggauggcagacacauuggcuuuggaaugagaacccugaguuuaggccugggcuccgagagccugagcacugucccugagcaggacugaaucucugucuuuaucagcaggguguucuugugaguuagcccugcuccaucagaaaggccacgaccagccuccuaagggaaggggaaugccaccaagguugcaugaagagggcacuguugacccaacucugaaaggauugaggggugcaucgggcagaggccauguucuagacccuauuucugcuugccugguccccauucuggaggcugggcacacaccaucuacuucucuccacccuuaccuuacccuguucaguuucugaagcggaaccccacucagcgaauuggggguggccugggagaugcugcugauguccaggugagucugguuaugucacagugaacuggggccggaggaugacguggauauagcagggagauaggcaaggggaguaauugacauauucccgggcgcccucuacccucagaggcaccccuuuuuccggcacaucaauugggaugaucucuuggcccgccgcguggacccucccuucaggccaagucuggugaguauaugggggucauuuuggccacauggcauguggagguccuguccuuuggaguccuuuaauuccccacacggauuuucccacagcaaucagaagaggaugugagccaguuugaugcacgauucacacggcagacgccgguagauaguccagaugacacagcccucagugagagugccaaccaagccuuccuggugagggccuggggguuauggggaccgaaggauuguagcuagggauuggagaugccagcaucaccuggccuggccucuuccccacagggcuuuacauauguggcaccuucuguccuggacagcaucaaagagggcuucuccuuccagcccaagcugcguucucccagacgccuuaacagcaguccccgcacccccaucagguacccaggagcagggcaggcgugugccuggggcaggguucccuagcauggacuaguaccugugggcuacucggccaagcuuuccuuuaaaggcuggccucaggccccugcucagugugggaccccaggcccuguacaucuguaacagaggcugcuaaagugguaguuuguggaccuacaacuugugugcccaaguagauaaagugccucaccucccuucccugcugccaguauuacugaccaggcccggaggcucugacucagccuugcuuucucuugcagcccccucaaguucucucccuuugagggguuccggcccagucccggcccaccagagcccauggagccaucucuaccuccacuccuaccaucaccaccaucaccaccacccacaagcacugccccccuucccauccguccucccucaggaaccaagaaguccaagaagggacggggccgcucagggcguuaggagaauagaggaagagagggcagcugugagaacccggcucguuccgaccugcggauagucaagcgaucagaguaugucuugugugugagagugagccuuacaaucauguccacugaagccacuggcaguggcucccaacccccaucccauuagaagggacuuggccugcccuuuggaacugugcccuuguagaagaaguaaaggacugaaucauggcagaguggcuuuugccggacuccgggacacaagaguggcauguuuagggagaggaggggauccuaaaggaccacggaccucagugcuuacaaaguuuuauuuuuaauguuugcccagugccugucugggaugcacacacacacucuggggaacugguuggggugucagucuaagaagcugauguaaggguggggugacgaagguccagggcagcuuguguuucaccauaacaugcaugggaaaagucagaggcuggggcaggaacaggacaagcugacuccuauagugcagugacccggaggcccuggcccccugcuccuccagcgcugucaucccaggcagcacuaccagaaaaggcaugcaggucacucagcagggccucggcgcugcugccugagcccacaggacccugagagcucaggcccaggcccccgucacugucugugucacguggaucucgggucugcucugcuugacaccgcugcuccucuuccuuggcggcagcuuccucggggccaccaucuaucacaaaaucuucugcauccucuucauccuccggcggcccugauucuucuggggauuccagcucagugcgggcgcgaagccagcggccugcagggcuggcccagagcaggcggcagguguggccccacaaggcagcacccaggcgagcugggugguaguaccccccugaggcauggcugaggcgacgccaagccaaggcuagggcagugaccagcagcagcaggagcaagagcagcaggacaauggugaccacacuggagcccacaccguccucugggucugccccagaggccagugccccuggcagggccaucagcaccccaaaucugaggguaccaggcagagccugugggagacaguagggaggaguugucaccugaugagaccaacugaauucuaacaaagaccucagcugccucaagcaaaauagagacagucaagcagaaaaucaccagcccauauuugguuaggccuuugcuauugugcucaccuucaacccaacccuguaacucacuucucacugccugaggccugugccugucagaggccugugcguuggccuucccuuugcucagacacuacuucacagccucauggugacaugcuugccaagccuggcuaggccuggcugaugaugagguccugcccggcuguuuuuuuuuuuuuuuaaacuuacucacuuuacauucuggucacuguccccuccgggucacccccucccacaccugcaagacuucuacagcuaacuugucagaccucagcccacccauucaccgaccucaggucccuugauuacucuuuucccaccaaauccuacacuagagaauaaucuugauccaguuguguuacauuucccaccagaauaagcgccuggauuugggguggggagcacuuaaaaccauggacauagaugcucaguggauauuagcuggcuguguggccuggccugccuugcaguagagggaguugaaggggucugagaggcuaguggcagguugcucucuggaggccaugauggagauaucuagaccagcucagagguugacugguccuagaaugaggggucuuugaagccccuccucgaccauggggcugccccagcugcaggguuuccguuguucagcuccccacucuaccccaaagggccucaggcgugcagggccaccggucugggggcagcauguguagcuaucagaggaagccugcgguuggaacaaagcagguggugggggugguagcaggggguggggggaagggugcugggcacaaggcucccccguagcauaccaagcucuggagaaagaguuacaccuaaacucggcucgugaggggaccagguggaggacugucccaagggucuuggaauagggcugugcccagggugaggaacuagaggaccuaccuuuaaucccagagagcccagaucugaggugagggcuaaauuccaacccauucuaguccugggucucaggcuacggaaggagacccuuccuuaacuccuggaaccuugauauuccauccccagcccacggugccccaagagcccagagggucccacagcucaccauugauccgauggcuuuugcacgggcacccaccucugacuguuuagugagaagugagccccacagcucucaguagaguagcuaguaggaguuacacuuccguuuccugcccaaaaugccccacccacucuugucuauuacaggacccucacugggucucagccucaggauuacccagacagguauuagaucuucucucucuaggugaggcuggggccacaggaucugugaccagaacuccaaagggaggaagugugcaucuaucuaacucaaagcaggacagccaccuauacauuauguagcuuuggcaggucuggaacucugagcuccuagcucugccucugggguacugggacuaaguggguaucugguuagccuuaaaacaaaaaaccaaaacaacaaaacuguacacaugccugcauacguggggacaaauggaagucagaugccucuuuccacugugggcuccaggaguugaauucaggucuucaggcuugcuuagcaagagaauuuacccacuagcccaucccccacaccuuucccuggccuuuucaccucaguuucucuguaugguggaauucugguaugcaggggcuacuuuccauauaagguuugcaguuucccuuucuagcauccacuccuaauccuccacaacaguaggucaaaccuggcuuuagaaagagcauuuuauuuggaaugaaaauauagaccccaucucugcugcuuuuucuggugagggggcaguggguugggcaggucgaggagauggucccuuaaaguacuugggaauuugccuugguacaaaaaucuuccaaaagucagguggugcuuccaaccugggccccaggcuguggagaggugcaaacuggcugugaccugccacagaggcacugagcagccaacugccuggugugaccuggccacagaagcuaggugggaaggguuggaggaggcagugucgggagcaggucccuggugguccuauguauccccauucuccaugcggcccagcugcuccuccaggcggcugauacguucucccugcuccuugaccagcauccggagugcccggagcuccugcaucaccucuuccagcuucccagcuuccuacaaagacaaauggaagucagaggcuaucagccauaacccacccccagggaagaggccuggugccuagccaaugggacagcacucccaaauguaggucacauacaccagccccagcaagguugccacuggggacaucaguaacugcaguagcuguggaggcuccggagcggcuguaacuggcaggccugcugucugauagcacguugcgccggcugaccuucaggucccguuguuuacugggcacauaggcuucccguagugagaugaggauuggauuagcauccugaccgcucacccaauccucugcuucaagagcagccucaggcccggcugugucaggguacagaucauccuggaagaggucagacugcgcaccgcguaggggaggucagaaucaguuggaggucccgacgaucaggggucucacaucuggucucugaguggcugcauccucaacacccuccugacuuguacucuugccaacccauccuccaaaugccugauccuuccuggcacagcccuugcuggcaccaucuccagcaaaccacaaggaccagcuauguggcucuguggaauccugggagccauaucuauggcccacagauuaugagcuuugcugcaggccauggcuggcagacuguaaacaccagcugcaggacagugggacuguguuccaggauccuccccauggguuucaugaccagagccccuguc

SEQ ID NO: 9047 - RNA, 676 nt, Mus musculus
cgggggcgggcuggggagggcggaaggagagccaggccggaaggaggcuguaagagggcgggaggcaggagagggcccggagcuggugggccggagcggcggcgccgccauguccgacagcgagaagcucaaccuggacuccaucaucgggcgccugcuggaaggugggcagggguagggaaggugcgcucgcgccgagcccgggccccucgccgucuggaaguggcgcgcgggcggcccgccgcucccgggggcuagcgucgcuugggcggggacaggccgugaggauccauggccacggcaccccccccccccgcgggcgccugggcuuuggagcgcgcucagaggccgggggugcacgagugcccgggacucagggugaggcuccugcgaagcuagcugggaagggaucccgaagcgaggaagcuucggcugacaggcugcugagcacaggcguuucucuggaggcccuccggguggcuaaggggucggaucuugccuuugaaggccugacgcaaagguuucggggugagggggugggggcucacuugcaacaguugccccuguuaggggggcgcgacaccuacccucguccggucugcgaggucagggucccaagacccuauuccguacucagugcagggcucacggccugggaagaacgugcagcugacag

SEQ ID NO: 9048 - RNA, 6745 nt, Mus musculus
aagaggcugcccaauagacgccuggcucaaccccaggacccugaugaguguuuucucuuccagauccucaagcccgcugauaagaauaagggcaaguaugggcaguucagcggccugaaccccggaggccggcccaucacuccaccccgcaauucugccaaagccaagaaauagccuccaugugcugcccuucugccccagaucguuuguacagaaaucaugcugccaugggucacacuggccucucaggcccacccgucacggggaacacacagcguuaagugucuuuccuuuauuuuuuaaagaaucaauagcagcaucuaaucucccagggcucccucccaccagcaccugugguggcugcaaguggaauccuggggccaaggcugcagcucagggcaauggcagaccagauugugggucuccagccuugcauggcuggcagccagauccuggggcaacccaucuggucucuugaauaaaggucaaagcuggauucucaccauagccucugucucucuugucccgucccagacagugggccagcaguucuuugguacaaagccaccugggagggcagacugaguggcugaacaugggcccagccagggcaacaccagugacacacaaucagguccagaggcuauuaggauucuaggccaaggcccaaguguuaggaaagagaaacaguuccuuuggcccacaggagggucuggcggggaguucaugauuggcagaggguguucaauacugaucuuccuguuuuagaggcaggagacugaggaagcuaaguuucuggcuuuggccagaauuuguauucuagagccucaaaguaaaggaugagggaucugucaggugacaggugggcaccagagacaugauugguauaggcugaauaaauacagaacacagaccaaacaugguuccuaggcagcucugcagcagacagccaagugggguaugccuuuuuccauuuccauguccaugucuaaggacugacgcccaacucagugggcgggccugcuucugguccgugagccuuugaacacagacuuuaauuucucaaauucacccuucaccaucacugucuucagccagcacaggguugggacccugcggggaguguacaggggccaggauggagccaaagaacagugaacgaaacuggaaagagaauagagagagcccaguuagucuuggaagcugcuuccuuccuuccuucccucccucccucaguuccuaucccaacauccagcuuuuaccuucuugggugggggagucccaggcacuguacugggcucagcuuccuccucugaggugggggcaaggucaugggaggccagggagacaggugggagggauguggaaggcugugccccggagcccucauugccuccagugguuuccauggcaaucauguaacagucaaugucaucacugguaaagucaucuaaguggggugugcuguaggcagagauaauaucaacaugguacagagaaaaaagggauacagaggcaaaccccacuuuggagggcucugaggagggcuugaggucuccagacugcuggugagcuagcuuuugauuuuauuacuuccugauuuggcugggaggauaggaugcagggguuaagugggagcuuccuggaggggguggaacuggaacccuuuugaucagaguucagguaggggccugagggaggauccuggggccaauuuagcucagcugggggaggaaagcaacaaguccugugaacagggccacguggggcccaaccccucaccuucccaagggacaggagcuggagagcacaagagcccagggaugugcugggccgagagccagaccaaacuuccucuguuucuacuacacgagcccagccucccaacccaccugcccucgcagccaccugcuucuccugcaccaggcagcucccugccucccagcagcccuuucucuccgagucuggaaagaggcucagaggggaggccucagccagagaaggaagccagcaggaccuaggggaugccucuauggaugggaggggucucaguacagcugaccauuaaggcuggaagcccuguugaggcugggccugacaggaagcauguaugggggaggugcagaagcuacaaguagcaagcucaaccugaguguguagaaauagagggaaugcgaggaagugagacacuuaccugugugccugcuucugaggcacuggcuggugggguuuuggggaacacgggcccugggaacaugagucuugcucuaagaguguggccaagacaaagugggcauccagcaaggaauccucaauaguaaagaugacuggccugggugacagaaagggguuaagcuagguuauccugcucugggcaucccagagcccugccucuccccagucuaaaagccuggaauuaccugccuggaacaucgaaguggauaguaagaggcaaauucgcugacucugcaaagcucaggagccccugggauggaagaagcagguagugagagccuguguuugguucaaagaccaggugcuagccauaguaaacucacccgaaauuccuugaggcagaaggugacagcuaucccuucuggggcaugcagcugcuggaaguccucauccccaaugcuggucucagucaccauggcuuugcuggugcugucuauguggcaggcacaagaggaguuaagguccuggcuucacuccuagcucuuguucccuccugggacaggucuaacucccucaccugccuccucuuccugguagcugcgcaggaugacccgccggccacggccaaugcccagugucaccucagucaaugcaaggggaaaggacagaacagccucugccagaacccugugacaaggacagaugcgcaugaaaugcuuugucuacucuuuucgagacaggguuucucuguguagcccuggccgucuuggcacucacucuguagaccaggcuggccucgaacuaagaaguccgccugccucugccucccgagugcugggauuaaaggcgugugccaccacgccuggcgcuuuguccacucuuacauguuacuugccuggucaaaagcuuaaggcaauggaagcccagacacagcagagaggagcaggcaacacuggacaggcuggggacaaagggcagcacuagcugagcacagcagugggggaggaagguuggcuauagggggacacugcuguugguuccagcuacuuuuugugggaugggguggggguuguucuuuauauguagcccuagcugacuucaaacuuaacuuuaagaaaauuauuuuauuuauaugaguacaauguaacugucuucaaacacacccaaagagggcaucaggucccauuacagaugguugugguugcugggaauugaacuccugagccaucucuucaauccgacucuuaaacucuuaaagagcugggaucaccagugugcacuaccacacccaagccagcugcugagcccaggggcuuaacaacacccuguguaaaacagcaauaccccgcaccacacacagaaauggacggcagaguuuugguuguuuuuugagacagggucuaucuaggacuggccuugaacucagagaucugccuaccuuuucuucccaagaucugggauuaaagguguggaccaccaagccaagucuuggcuuccaccucuaaggauauauguugcugaacauuuacagaaaaguaacuccuagcuuugccucaagaucacagucuuuggguucucucccuagcaugggguggggggugggggcagcuggcaucuauauuugaauuuuuaaaaauuauuuugugugggugugugugcuguggagagaagugcgguugcgaugccuuggugcacauguggagacugacaacagcccacuggguccauucuaccacguagguucugaggauuuaaaaccugacaacucaacugggcaggcuuaaagcaacggccuuaacugcugagcuaucguacugacuucuauauuugaaaccguaugugagaaagagaagcaguuagggcugggaauuuagcucagagauacagaguaccuagcaaauacaggguccuggauucuauugccaguauuuaugggggaaaaaaaggaauagccccuccaaaaaggaacucuuaccacuauuaacagacccugccuggggaagcuaacuuugggaacugaagggacuuuuauucugagaaaugaaugggaccuugggcuacuuggaugcaaacagugucccgcacaggcaggggagaguccacugcauccugggcuuaucuugagugaccuuagucucugcuggaagcacauuccccuugccacgcugugucuugauacugacuggugggcugugcagcagcccuccuagacuccagccuccuugcccagguucuuuuggcccaaagucuagagcccuggcaauuaggaagaagccaccagaagggggaauacuaccagaagaaugagaggucagagugcuuugaacucuauaacacaggguccaggacaggccuucaggguuuuccaggucauacaagagagcugcaggcaggucauaggcucucuagaaaagcaguuggagcaggccucugggauacagauggcaggaccccacagucaguggaaaugacagagaggcagcagcuccugcuuuugaagagcaagguaaggguccaaauauguacugaguuguguggccucgacauagaaacccugaguccccgucccuccugcccccaaagacaaaggugcuuuuguguuuugugugaacugugaacaugcacgggcagaagccggaagaugugcucagugaugcugcgucucagggcuguccaucuggggguuugguuuugugccccccccccaacacacacacuuuuuuuuuuuaaagacaggguuucucucuguagcccugccuguccuggaacuugcucuguugaccaggcuggccucacagagaucugccugccucugccuccuaagugcugggacuaaaggcauccaccaccaccaccacccaauuaauacacauuuuuauauaagugggacucaaaaccaggccuucaggcuugcacgucaaccauuuuacugaguuaucucgccagcacaugcacccuuuuuuugagaaagagucucacugcuuaggcuaccuagaaacucaauggccuucccagugaaguuuccuagaaacuucugauccucccaccucaaucuaagaacugcuacgaugacaggcauaggcuagccaggccugcugaaaauggagcauuccuagaaugacauuaaagcccuaaagguaggagagacucaggcgaaguuugaagcaggggugcuuaccgugcuggggugcgcaauaagugagggcaugaggcugggucgaagacagccugcagggacucacaguccuggaaggagagguugugugucuucuugaccccuggauaagggaaauggucucagggcuuggcaaccuccacugccacugccuccacacccacagaggaacucuuugggcaggccgcuugcucaccauacuugcaguggagcuggaccaccagguggcuguggcugccacugagggagauacagcacuucuccacagacuucuccacaauugccagagagcggaagacggacaggaaggccugggcaggguaggacaucagucuggcacacugcuuccacggcccagcucuacaucccauguaggcccuggccccaucacuggccccacaaagcuguggugucugcacacucccaugcugccuugcccaugcuggucucuuugcugggaagggccacuaaccuuuucuugaccaaugucaccacccucuccacagaucuuagauagcccucuacggucuaaacaucuuuaccucacugcauguugcauggaauagcucccauaugagacuaacucccuagucaaacucaucauuuacugaguaccuggcacagaggcacagcuguggagcugcuucagguggcccuuaccuucaucaggaucuuacagcgcagcagguccugaccaggggaagccgccugguacugcuggaagaagaguggggcaaaaaggaagcaggcauaggcagaacgggacgaguucacaguccguagggagagcugagacacaaaaagcaggcaaaauugcuuuucccuuaaguuacuuuagccccaccuugccugccacuaggcguucuaggaagagcaaguacccucuguauagacaugcagccucagaagacugggcccaagccgauguccgaacaacccaagagauaauaaacugcgccggaauaucuguccaccaucccuguaaggccgaaugaacaccaagccuaggcuccccauucaccauugaauccgcccccaucccugcgucccagucccuuaccccguccuucaaggguuccagauagagcucguccccgauucgggauagcgaauggacagccuugcccagcacugcggggaggagaacagaaagugguuagggggacuccuggggcuugcucacguggucugcugcaagguagguccaaacuuacccuucacguugcccccggugaucaggcacuucauaguacauaagcacaaaaaucgagcuuguuuugcacacgaaccgggacgggauaggacauauaaugagucccagcagcuacuacgacugccuaaaguucccuucccgcgcaccguccccuccccgcugccggccuggccuccgcuucc

SEQ ID NO: 9049 - RNA, 1464 nt, Mus musculus
ugcuccuguguccuuccucaggucugauucucccacccgaacccgagcccugcacacccugcagagcucugcagcuccacugggcugcacugggcauaggugaagggcauacuagauggaggagcaaggugucugcaccaaggaucgagcucuggaccagagcccuaacgugggaaguguagacccucccgggucgcuaacuuuagugugugggguuacagggucaaaucaagauaguccgcgcucaaucugggcuggggauucuguuguggcagcaaccaccagcuccccucaaaaaacguaacucgcuucaagagcgaugagaaggggcuguucauuuugcuuucaggauccuucacugaccuucguaaauacauggaaagaugagaagguucugggacagaaaaggguggaaggauggacuugucagaaggaggggcagaagcagaagcacaauggggguaggcgaauaugggugaauggggugucccgagccuugugcgguaagggguggggaggcagagcugaagggaugaacugggaagcccugggaaggcuuaaguacuacgcgggguuugguuuauguacauuuuaccaauuacccagacaguguggaaggaugaagauuuucagcugggacgcauucaccuugcucugggagguaguucaaaugccuagagcaacccuugcccaucccccugcgggccuguggguaguggggaggguguguuuguuaccuagccccucuuuguuuuucuaggcuccucucccucuccaagugcuucuuuccuagagccuccggggaggaggcggcuuucccuuuccacauccaaggcaagcugcauacaacgcagagguguccaguucucuguuagacugggaguuaggggauuaccagcauccucuccuccucacuugcucacgucuucgguggauucuggcugcuucauuucccaaacagauggcaaaguggcccuccuucugucuccacuguccuccuuucacuguccagacacaguccucagugacccgcccccccccccccccccggugggcuuaacucuccuggcaaaguccagucucuugaucaggaacuuugaggauccaggucccacagaggucuucacugucuccuaccccacaugaucaccuaucuccauagcccugccaggcucuuagcggccacucuggcugcuuccaaggcuguagccugcuucucccaugcugacuucucuuccugggcucaacagcaaagguucccucagcagagaaaacccuaggcuuugagccauggugugucccaguuuccucuguguuuaauauuugugcuuccugcuguuguggcugcugcaugugggcaggaacugcuucuguuuuguuuauugcucuguguacuucccacccagccuaggaucaauaaauagguguugagccagguaugguggcucaugccuauaauccuac

SEQ ID NO: 9050 - RNA, 7568 nt, Mus musculus
cuuugucacaaauggaaaaugucuuuuaauaugaaaaugucuuuuauuucucaauacaaagccaaauacuauacaacuaugaaaaacuugccuggccagagaucuucaagaacaagaagacucucagugcugugacccagugaggggcaugggggaacugagggcagcagcagagauucgggucaguugggugggugggugggugaccugugagcccccucagagccugugggacuggggacugaaagugcuaucugccuuuguggccacuaguccccuggccuagcugucuccaggacugcaguaggagaggguggaagacgcaggguggaauggccacaagucgagggcaagggagacaugaacuagaaaacccacccuaaaaaauucugguuuuaacuccauggcuguacacaauguuaagugagugaguguacaaugaaacuaggguguuauuacccuaaaggcaccuuaaacggcucuaacccagccccuauguagaaaaaggauugagcccuuaacagguagauaugggcugagaccuaaggcugcaggaaguggcaaaggucugagggcagcugggaaggagcugcagggcgugugcaggcccauaggucuaaagaccacucaucugaggcgcugugaccagucgcgauuagugucugggggcggacacagcaugagggcuuaggccuuguccuccucccugcugucaucuacacuggccugccucaucaccuuccggagccuagggguagaagacauaccaggcucgcucugcucuugcccuugccccuguucuuggaaggcccguguccugcuggccaccagggcagcacuaugaagggcaaccacagacugucgagacuucagggcaggccaaggccccuugcggacccgcuggccaccuuuggcucuugaaagcugagagaauggaugaagaggcucuucaucugaagagaaaaccugaauaggggaggaaagagaggcacaggaaauggguaggugcaaccaggggaaaaccugcauccuuccccuguuccauggcuuggccggcuugagcuuccuucuagucccuagaagccuuuuuggcccagugaaccugacuuuaacaccuucucuucucgccucucugccuuugcacauucaaucuggugagccauagccgaaacucugccaggugccagcccugcaaagggcucugugaagccagugucucgugccucacaggacacuugccuuugacaauaaguuuaaaauggucuguuuguaucgacuccuuuugggcuagccaugugaccucaugucacaugcggggccuggcuuccccugucgagggccagcuuccuguccuagcuugugucuuaacaguucucagcauacaacaugcuuuucacuuagucagaggguggacugugugaguccaagggcuccuuucugugcuguccuuugcugugugacuccucagcuuuaagagggcuucaggaauguugucuugcccauccucucuaggacguuucucuacccgucagcuggcagcggagcucauggccuggggagugugugcucacuccaagcuaggagccaagcuccuuaggaaaggagccacuuuguuaggcuggaaccugcaagugucuagacccugggauggcugcugucaccuagccugggguaaaagggaggauccugaaggugguccccaucucagauacucaggacggucuugaguggccuugugcaaaaaggugucaggaggucaguguggcgggagcgaggcaguacccgacugugaggggccugccagccuuagugacccuuguuuggacccacaugcucuucugcacaacgacugcagggagagcuccccagcccagacucacuucuggcaggccucccgccucugggguacucucugacucugagggcuccaggagacugauggagcgcaugaccccucgaagguugaugcggggccgcaguccaaguucuucuuuugggguuuccuggcuuccuuccaggcccauuaccaucaccuccccacugcccccugguucugguggaagagguggcaaugguguagaaacuucaggcgccaggggcuccucuggggagaccacacccacuuucugcucccagacguggcucugccggcugugaggagguggcugugagucagcuuugagugacauagcagccaccccucaguauacacaacaccgcccuuguccccuccccuuauaccuggcagucagaaugcccugguagguccguagcuggcgcaggaagccgugguuggggcguacaaugggccggagcuccugcacguggaucagggcuugcuccaggucccagccauacuguuucauggcauaggcuaguaccguggcggcagaacggcugacacccaucuuacaguggacuagcacccgagugcccugugcucuauagaggugggauauggucaguccauucccuuccaaccccaguagccuguagacugggaaggggcaaguagggcuuaggacccagcagugagaaggaagugaggguagagagggcaaugaaagaaacacagggcaagaugggcaggaggaggguaccagccuccacuggaagcuggggcagcagaagcugggaguagcccaaccuggcauccucaaugaaucgaugugucuccuuccaguggggcagaagcugugccgauuccucaucccagacacguacauuguaauaggugaagcgcucagggaagaaguugucaaucucccgggccauguucaagaugugacuuacucuguaccagaggguccaaaaccagacugauguggcaaaggaaccaggcucccuggccauuucuguuggguucuugguucugagagucaggggaagagagcugggccagcagccagcggcugacuaaccuugggagcauguuguuuuacucuguugggcaugaguuucccugaugaggagucaauacuaacucucccaugacucugugauugcaguuagaugucaagcuaagcugagaugagggagcucucagcagcagguuauaaaggcuucacugggucucccagaagcccaugguggaggggugacagauaccuuucagaaggggcaaccacaucccuaugagaagaaggcauuuccuucugccugaagaggugauggccaaguggacaggaaccucuucggcuuggcaaguggcuaccaccaucccuuaucuuggcacaguugagaccucauuucuauacuauagugugugcuuaguggggcagaugcccuuggagcccaccugaguacagcauccccaggacuggguuaaaagcagaaacagcagugcuggaggugagcuaagguuccagaaacuggucaggccaucccacagaaaggcugagagaagaagcggcagucccaaggcuggaaacccuaccuguuuuucugaaguuccuccagguuggcagcauuccacucagagcccuguacagugggaguggauagaggcaccaggcucccauuucucccauggcucccauggcuuccauggcuugccucugcuagaggacccuucauagcagcuacauugaugaucuggucccuaccuccuacagccugcacucaccaaguagaggugggggaagaugcgagaggcccggucuugcugggccaugagcagcaacaucugguugucaauaaagucacgguacugcuggagaggacaucccagacgcagcuccagggccugacggaucuucagggguggaagugggucaggcaagagaagaggcuccaucgugaagccucugaggacaguacccugacccaucuacacagaacugaagucagggauugggacuggcuuagugcuagaggaaagcagggugagaaaggccccaaggaaaggcgagucucaggcucugggcccagccacccugcccaccucuuuagaagugacacuguccaggucacugguguccaacaccugccacaauucagccaggaucgccugcuccaucuuuuccugcucugaagcccugguagugauccuuuaguaagaggccauuucacugagguaccaccaccaccaccaccuccuccuccuccuccuccccaucccccaaccccugcccugguacugacuguccaggcucagcauuagguggucgaaaggacuccaggucagacauggccauccacucauugaggcaacccuggucagaguugaguuucuccugguaguaaguagcccaggcaagggcacugccaccaggcacaaggccacugccuagagcuaccucacaugccuggugcaauaccugcaguguggcccugggacaagaaagaggggcuaagucacucaguccuacuugguucccucuccugggccuggcugccaccuaagagccuggcccaagguuagggcucugcagcgcuuaccacauggucuggauagagacaggcuugaagauucggcuuugaccaccagaugucacacugaagccccugcaggagacccagggaggguggaaccaaauaccaggcucucagagaaccuguucauuugccagauauggggaugcugaggcccagaguuaggugacuugcccaagaucauaacguauaagaaaguaggucccagcaccgccccacuguucaaugccugccuccccauucuucucucuccccuccuguugcugccucuuacccaucgccguccagguacaccuggguaucacuccagaggggcaagaccaggcccagggugcagcugugggaacuggcaggggacaggagagccauuguuccucagcaccucacagccuuggcccaacccuucucucccugcuccuaccugcugucagggaaguccaccccaagcaggauggccuccucacucaguucuucucccguggauacuaccagcagguagcgaagucuggggggucgggcugccuccagcugggcugccuagaaagauggaagaggcccugaauuauaggagcuccaggaucuguuucuucacuccacauggacacagcucacaucuugacagccccuguaccaccaauuccuagacagaagaucaguggcuacuggagaauauagugguacuccuuuuuugcaguuugugacucaacaaacugucuuuugaagucugacccccaaaacugugcuacuucuggcaguuuccgcaagagaguaucugagugagaaggcggccauccuucuugcggccuucaagagacaacugaacuaagggucuucuggaagaacggucagaacucuuaaccccugagccaccucucuagcccugcuacuagcaaauauuuuauuugagaaaugccuccuaccacagauauuaaucuuuguuuuuguggugcuaggaauuagauguagggccucacacaugcuagaaagauuucaucuuauaauggcuuagaacaacauuccuggggcuggaaagaugacucaaugguuaaaagcauuggcuaaucuuccagaggacccagacucaguucccagcacccacaugacagcucacaccagucuguaauuccaguuccaaagcuucugauaccuucacacagacauacaugcaugcaaaacaccaaaacauguaagaaaaaagacaaacaacaaaacccuagggcuucuguucuaaacagcuuuuccaaagcucgaaucuucuucauucuuugcugccaacaagaagugucugccuccacacacuuucuggagcuggcccuuagguuccaggggaucccagacuucuugggugcucuggucgccugacuggcacuuagcugccaaggcguacuacacaacccugggaguaugaguccaucucugggcaacucacuaguaucaacagaggccuccuguggauuaacagagaccucccucauauaaccccagcucuuggcucacaggggacaaaccucccuuguccauucccagcccuccagagacagauaugcccuugccuugcugucucuagaugaaguggcagaguuguuguggccccagaucucauagcacugaucuuagauagacaugagcuccgggugguuccuuaccaggcggauaucauccugcggccucagcagcuccaccaugaggugcaggugccgcuuuugcacuuguuuccagggacucuggaguccuugcccuuugucagucugguccucggugggcuguuccucaccugaggguuccuccauuggcucagagucagccucagaugcaacauuacuguccccuccauccugaagucccaggacagccccucggagcaccgcaaaacucugccuggcagagcgauggggacaugguucaggucauagguuuucaaacuuuagggaggcugaguccccuggcuggcggaagugggcugcuggcccgcucuccagagucagaugggccggagugaggcacaguuugcacuuuuguaaccaggacccugauagcgguaggcaccuagagccagccuugggcucucaggcuccuccucaccuuguuuugcaccuuuggaauguguuccuuuucgggguggacucagaugcuauaaacuuguuuaagcacuuauacuccuucaggucccauccugcccuugguccugggauuacugggcgagccaagguccagguaaugugugaaagcaucuacuggccagggcuaaguuaaccaugcugguucuuccacaagccagagaugugauguuugccagcuccacccacagcaucugccucccaccuaagcaugaguuuaucugacaauacuuaagugaguccuugguccaagcaagacaucaggaguccacaauggcagcagcuaggccacaggcuauaaggaagcauuugucagacagaacucaccugcgcuggagccggccucugcgucuuaccacucgguccugcugagaaagcagcccgggaauagaguaagagagcagcuuccaggacaggaagcacccaaaagccucuccucuuccuacaagggagcgcuagguggaaaagaaaucucuuuccucugaagccgcuccccuccaacaggccccagagaaacccggccuaaguccagguacagcagugcugcaaggauaggggguugcagagugugggagguauuugggcagaucugggcuucaacagacccgggcgguucucaggauuccgcaucuaccuacgucgagcuccugggagccucagggccucccaagugccuuaaaacgugagacucaaggucccccuccgccuacucccagccgucugcuaggggcaggacuugcucccuaaggccuaccuuggcagccaacuguaagagcguaaaaccaagcuaaacucaccgugggucccacaggcguggaguggccacuugccggcggcgagcgacucacugugaccagcgccauaagguaggcaggcccggaacaccugggcgaacacccggcacgaccccucccucagccuuacggucagucccugccuucgcacaaccaggaagaagagauuggagccaccagggccuggcaccuccucgggagcggcccuuaaagggcccgacuc

SEQ ID NO: 9051 - RNA, 4016 nt, Mus musculus
gccaguccccuggccaagcccucaggccccacccgcagaagcccuguugggggcgccaccccagcccgcacccccccccccaaagggcccgggccugugggggauucuucacgugacgcggugaugcagaacgguugugaccuucagugugugucugcgaacgcgggggucccaguaacagugcggguuugcacccggcccugcccgugggugcggggacgugugggugugugggcauaugugggcguguuggggagggugcccagagacaugugacaaagacccgucucugggagaugguaaagaggccuagagcuggcgcuuugucugguugucugcagagccgcggcgcccgccugagcgguugcaggaugcuugggcgccaggguggccgagggcgcgcgcguccgugccagggugagugcgcugcggcagcgccguggggcagagcggaggguuuggcugggccucgggcgugacugggcgccacccgugggcgcugcaguggccgcguguccccgugaccucccgagcccggcuggggcccggguggaucccugugccccucccgguccaccuuccacgugcguguucgcggcgcgcgcguccgccagcgcgcacccgccugccugucgccgccgccgccaccgcgaacggcgcggagaaaaggugccgggagccgagagagccggggccgagggcccgagcgccaugggccggagggcgcgcggcuggcgggcccggccucgcccccgcgagagagcggccuggagucggcaggggccggcuggguccgcggggaggccagcccgcgcccccugagcgacggacaccaggugagcccccccucccccgccccgacagggcucagagggaggcccgcccggggaggagccacaguccacgccagggauuugggggacgccauccucagccacgaagaggaaggcagggaggggggagggggcuggccauuccagaggaugccagaaggaaguucccggacccucccugcucuuggcccuccuccacuuccugccucaggccucaccuuguucccaguaccuggacucccuucaacugcuugggaaaugugaccuuuacucuggggggcccuagucugcagccccagccaucuuuucucccugggguccucugugagccucuuacccaaaccuuccccaguucagacucuggaaacugguuccugggacugugcccugggcacaagugggcacgugcccuagccccaccugugccuggggcugcggcccuuucccacagggcacucaccauggccccgccgcuccuauugcugcugcuggccaguggagccgcugcuugcccgcuacccugugugugccagaaccugucggagucacucagcacccuuugugcccaccgaggccugcuguuugugccacccaacguggacaggcgcacaguugaacugcgccuggccgacaacuucauccaggcccugggaccaccugacuuccgcaacaugacagggcugguggaccuaacauugucucgaaaugccaucacccgcauuggggcucgcuccuuuggggaccuggagagccugcgcuccuugcaccuggauggcaacaggcugguggagcugggcagcagcagccuacgggggccugucaaccuccagcaucucauucucaguggcaaucaacugggccgcaucgcccccggggccuucgacgacuuccuugacagucucgaggaccuggauguguccuauaacaaccuccggcagguucccugggcuggcauaggcuccaugccugcccugcauacccugaaccuggaccauaaccucaucgaugcacuacccccaggugucuuugcucagcucagccagcucucccgccuugaccucaccuccaaccgccuggccacccuggcaccugauccacucuucucccgaggccgggaugcugaggccucaccuucuccccuggugcugaguuucagcgggaacccacugcacugcaacugugagcugcuguggcugcggcggcuggcccggcccgaugaccuggaaaccugcgcuucuccaccaacccuggcaggccgcuacuucugggcagugccugagggagaguucuccugugagccuccgcugauugcccggcacacacagcgccugugggugcuagagggccagcgggccacccuacggugcagggcccuuggugacccuguaccuaccaugcacuggguuggcccugaugacaggcugguuggcaacucuucucgagccugggcuuuccccaaugggacccuagagauuggggugacgggcgcuggagaugcaggagccuauaccugcauugccaccaacccugcuggugaggccacagcccgaguggagcuccggguacuggccuugccccauggugggaacaccagugcugaggggggccguccugggccuucggacauugcugcuucugcuagaacugcugccgaaggcgagggaacuuuagaaucugaaccagcagugcaagugacggaggugacugccaccucuggccuggugagcuggggccuggggcggccagcugacccaguguggauguuccaaauccaguacaacagcagcgaggaugagacccucaucuaccggugaggaugggccuugcacacgcccuucagccugcuuuguucacugcgccucccucccugcucaaccuguauccccagggucugccuguucccccuccaggccugugccugcuccucuacuuuaaacucuuggcuugggcagaggaauguggcugcuuuuaaaaggggucucagguaaggcugugugugccagccuuccugaccaucagugauagcagcuugggugucugcuaaagcacccgacccccaccccgguauuucugccucuguuugguuccauccccucccccuaccccucucaccugaggccuaugucugcacaugccccgcccaucucugcccugacacuggugugcacauggaugccugccauugcuucugcuuuccugagggagcacaggccuguguguauggacagggccuuacaggccucaggggcuguccagggcaaaccugaaagauggggaugggggcuguaccccacccuggggcucugaccaccugcccuugccugcaggauuguaccagccuccagccaccacuuccugcugaagcaccugguucccggugcugacuacgaccucugccugcuggcccugucaccugcugcugggcccuccgaccucacggccacuagacugcugggcugugcccacuucucuacgcuaccagccaccccccugugccaugcccuacaggcccaugugcugggcgggacccugacuguggcaguggggggcguccuaguggcugccuuacuggucuucacuguggccuugcugguucggggccggggagcugggaauggccgccucccacucaaacucagccauguccaaucccagaccaaugguggcaccagccccaugcccaagagccacccaccacggagcccuccaccccguccucagcgcagcugcucccuggaccuaggagacaccggaggaugcuacggguaugccaggcgccugggaggagccugggcccggcggagccacucuguacauggggggcugcugggagcugggugucgggggguggggggcagugcggagcggcuggaggagaguguggugugacagaaagggcagccucuuaugugcccugaggaaggagcagugccacuguugggcccagguggcagcacccagccugggugggcagcacggcccugggucccacucugcuuuuuauccucaguaccucaggcccccauguacuuggugggacagcaaacccuuuccuugguuuuggccuccagacuaaagggacaggucccaccaacaggugcucagagccaccaaggcaggggcugcagccaccaagagggagucuuguuucuauuuauaauaaaauuguuggggauacuucag

SEQ ID NO: 9052 - RNA, 11374 nt, Mus musculus
cgcacggggggcggacaguugugugcggccgcaggauuggucgccccgcuccugcgagggggaggggaggcaggcagcgcgcacucgcgcgugcgugagcuggcgcgcgagaaagcgcccggucgcgccgaggcucgagcggccgucgccauuuuguaggguucucucugacgcgggacccgccgccaccgccggcaccacccggagguaggagaggaugcugugggugugugggaagcccuggagcggacugggccggaccucggagggccgggaaggcucggguuuggggccacucaucuucugaggaaggucccgggaagacaaggaaaggaggcggggccgggucuccggagggggcggggcaggggucgggccgagucuuuguugggauguugcagcggagguugggccgcugaggauagggguccaguguugggugaaagagggcuuucguucuuggaguauggugggaggggauaccgcgcuguggagagguacacagauuucccuccaaaaacccguaacuagggacauucagauacuucaugccuuccacuugucuuucaucccugugcuaaaccgugaaggagcuaaccuuguagagucaaugugccugaccucacggauauauaucuuagaccuuguugugcauucugacccccgaccuucuguuggcauugucacacagcaguuccucucucaaaaagaacugugagggucggggugugcuguagugucaguuucucacuucacaccugacuuuuaaaaucuuguuucuucucugccaggcucuugucaggauggugaagcuguucauuggaaaucugccccgggaggccacagagcaggagauccgcucacucuucgagcaguacgggaaggugcuggaaugugacaucauuaagaauuauggcuuugugcacauagaggacaagacggccgcugaggaugccauacgcaaccugcaccacuacaagcugcacggagugaacaucaauguggaagccagcaagaauaagagcaaagcuucaaccaaguuacacgugggcaacaucagccccacuuguaccaaccaagagcuucgggccaaguuugaggaguacggcccagucaucgaaugugacaucgugaaagauuaugccuuuguacacauggagcgggcagaggaugcgguggaggccaucaggggccucgacaacacagaguuucaaggugaacuguucuggggauuggguggcagaccuucguggagucucuagcucaaggcagagggaagaacacaagaccacagggcuucaagaguggcuucugccauucuuuuaaaugcaaagaacagguuauguuuacuacucuuagcauaauucacucuggggaaguaagccuuccccauuguauucgccaagcuccuucuccacaacugcaugggcuccugccugccugccuuuggucuucauucacuugaguacugucacaagucuuaaguugccuaggcagagaaguaguuagguagugugagaagggcuagagguuaggacuuuguugcugguuugugguggacccagaagccuuugagaguuuuuacccucugcugcuuucgaggauggcuggugguaguaaagaggaaaaagggaaucuagaagaagcgcaguaugagaaucuguggugagucugguuggguagauggguaucuuugagguguucaaauuuguucagucugugggcuacuacaggcaaagccaggaaacaggucauagguucuucugcuccaucuauuacuuuaacaggcuaggaaaacagcuuuuuuucuuuagaaauuggauaggaaugauggucuugcuucuagggaaauuucaucaaggacauuauagagcuuauuauauugcuuauauugaucauaaguauuaucaccaguaccauaggaucuugucugaaaauacuugcaaucguguuacuauaguaaccacuaguuacaaguggcuacuaaauuuaaauuaauucaaguaaauuuucaaauuagauuuuuccagugugggcaagaaugagagaauggcuacuguauuaggaaacagaucagacccacauugcaggaaguucauugguuaguaguuauccaagucuuuuauugacacggucauguuggaccacaaauucaagucuacuuuucuaguuccuaagucaacaucuuuuuguggccuaaaaguuaaauauacaaagguccucuuauuagaaaacaaugaauugguggagaaaagguaaacuuaaaucagaaaaguguaaauaugcaaauagugaugcuuacuggaggcucacuauuauguauucuagcuucaccacuaauacccuggccuuuaguuauugaaagccuaaacguuguagcugauuccuguccuuaaccucaaguugacaaguguauucccuaugcuuuccccauuauaaaacaacucugugugccucugugaaaggauggcagggagguaauaugugcauuuugacaauaaaagcaauauuaauuaaaguugaaugcuauuugcaaccacgauugcuucuacucugguuaggaaaguacuuaaaaucugacaguuaaacuuuaaacauuccuaauucucacuugauguggaaagaggucauaaaugcgcaggggagcauaaggaaggaguuccugccccagcccuuugguucuggggucauccaagggccccacaaauacugcucuaccaugagucuguauguccccaucccugaagaagguaacaaaaugggaaaaaaaaaaaaaaaaaaaaaaaaaaccuaaauuugcaacugaaauucucaguguauaguauacgcccuuuuacauuuaacucaggaaaugaguuaaaaggaugagaaggaugaguacaugggaccuuuuuuuuucuuuggugcugacuauuggacccaggaucuugagcaugcucuguacacauuuccacugaguuaugcugcuuaucccuuguauuugcuuaauaacagauauaauuacaaagaaacagggaacugaauaaugcaauggauguauuuuuauuuuauauauauauauauaaaaauauaaauaaaucacuuccauagaaaguacagacaauaaacugaguugaaaaagaaucauuuauuaguaucacauucuuuuucuggcucuucugaagagugauuggcucuugcuuacauaugcagguauuuuuguacucagcuaauuuuuuucuccaugauguaacaaaguuuaguacuggguaauuguuuuuugauuguuuguuuguuuguuuguuugcugagacagcccucacaaucacaaucccgcuucagacucuaagugcuggcauuauacauaagccugucaugugucuucuugaaauuauaaucuagaugccaacuuggcauuuuguucaacuuaaugccuuuuugguugauaaagugccacuuugaacaucuuuugaauauucugugcauuaaugguugucuaguauuuaaguuucugcauuguguaacuucuaagcauagacuaaguuuaccuggggcuuucaagaugucuccucuccacaggcagcagugaaugcaguuugaauuggaaccacaaagaagcuguucccaaguaaccauccggacagcugaauugggaaggaugugcaagaccuuagggguguccuucuagugacaaagcaauggagcauuaucaugucaccuacaucuccagucuuccgugaacccucaccuaagauagaccuucagaauuaggauuaacuuuuuagcauuuuaauagucucucuuguucuaguuuucaagagaaaaugcuuuuucugggcugauuuucugguaaauauuguaaaauuucaguaacuuagagauucuaaagcacagaauuuuauuuuacagguguuucuagcucuaaguucacaacuguagaaauggauuuugccacacuagagcauucucauccucuacacuaaaagcaugacuagugcagggcagacaucaaguaaaaucacuguaguucaauggaaaaugaacucagucagaaucuaucaaagucaacaaauucauugguuuuuuucccccuuaaaaguagacuuguagccgggcaugguggcacacgccuuuaaucccagcacucgggaggcagaggcaggcggauuucugaguucgaggccaccuggucuacaaagugagcuccaggacagccagggcuauacagagaaacccugucucgaaaaaccaaaaaaaaaaaaaaaaaaaaaaaaaaaaaguagacuuguagauaucugggucaaugcagaguguucccuuucuagacuggcaugguuauucugacucgugucaguuauacagcugucugucugaaaguggcuuauccucucaaauauagagagccuuacauaggagguauaagugaguauguguagcacacgauacuuucauucacaccaucuaucuauugacagcaucagugguaugaggaagacuaguagcugggguccuaaauuagaacacuuuuguuuugggacaggguuucuccauaguuaguucuggcugucuuggaacucacucuguagaccaggcugaccuugaacucagagguucaccugucucugcuuugaucucugagugcugggauuaaaggugagcaccaccacagccuggcuaaagcaucuuuguucucacuaaagaugguuuacguugaagacaacaagggucccuggauugggugauaacauaaacucuugggcaaaagaguucuuuucuuagcuauuucucagugguaauuuucuagaaacauguauauguguauugcuugaaugggugcucacaguucuuuugggcaacuguagagaaauuauguucugcaugguaggaauaaaauguuggucauucuuuuacaugagaacaguuccuaaaaaacgagugcuguuuuucauuuuauuuuuguuugggucccagggaucaaacuugguuuuucauacaguagccaaguguuaaacuauugagagagccauguccaaccccagaacuuggucauuuuuaauaccuacuguaagaggcuauguucaaacaguucugcguaugagaaaaggaguugaaaucuagaaacaugguggauagaagauugcuguugaccauguugucauauauacaugcuaaggggcauauucagagguggaaaagaugucuucuaaaacuucuauuaguuuuauuaguaguaagguuuuguuagaugucuagcuugauuuggagguaguaacagucacaguaaaagguagcaaucuuugcacucugcauuggggaaggaaauaagcuguggagacacaacuaggagagagucuccuguguugcugguauaaacagcaucugacuccaauuuuaugggucuuacuucuguugaaacaucaauuuuuuuaaaaggauugcugaaugaaggggcccaggagcguguauguccauauauuuuacguuuacuuuuauuugagugaaaagaguguuaaugaguaauaauuuuaaucuguuuccucaaggcaaacgaaugcauguacaguugucaacuagccggcuucggacugccccugggaugggagaccagagugguugcuaucggugugguaaagaaggacauugguccaaagagugcccaguagaccguacagggcguguggcagacuuuacugagcaguacaaugaacaauauggagcagugcgcacaccuuauacuauggguuauggggaguccauguauuacaacgaugccuauggagcacuugacuacuauaagcgcuaccgcguccgaucuuacgaagcuguggcggcggcggcugcagcuuccgcauacaauuacgcagagcagaccaugucucaucuuccucaaguucagagcucagcuguacccagucaccucaacuccacuucuguugauccuuaugacagacaccuauugcagaacucuggcucugcugccaccucagcugcaauggcugcugccgcuuccucuuccuauuauggaagggacaggagcccacuacgucggaaugcggcugugcuucccgcaguuggagagggcuaugguuaugggccagagagcgagaugucucaggcuucagcagcaacucggaauucucuguaugacauggcccgguaugagcgggagcaguauguggaccgaacacgguacucagccuuuuaaaaacuggaggugagaguggggaggaugugguugaaauuugcacuuaguucccuacaagagaccucugcuucacugaggagccaaaucaccaaacaggaccuuaucaaaaagcaaaaauuacauguuuugaguauuuucuauaaguuuaugccacagguuuacuuggccuguugaugaguuagugugauuccaauguguuucuucugaaacaugaacaugcucaguaaaaauauuauuuaaccaguuguaaaaagauacuugguaugaagaaaaaaaaggcagggagagcuaacaugcuggcccuuuguuuguguaguuacauucucauccaggaaaacuaagacucagagagcaucaguacuuugccuaugauuaucucaugauagagccaaaauucacucagcugacucuuaaauucuggccaguaggugguggcacacacccaaauccuagcacuugggacacaggcagguagguagagcugaguaaggcuagccugauauacaaaguuccacgacagccagggcuacacagagaaacccugucuuuaaaaaccaaaauaaaagcauacucuucacuacuacacugcugugaugguuaaggugaaggguaccauuugggagcuaguaauggacagcacagugaguuuuaacuaacuucuuggguuuccaguuugcuaauacuucuuagaguagcacauaccuuagucucucucaguaccagagaaaaugaggugggaggacuaugaugaguuagagaaaaaccuaggcuacacagcaaguucuaguaaaaucuaggaaauauagcaauacccccauguuacagacaacaaaacccaacuauuuauuagccuuuaucaaaggaaaagugugcuacuuugugcaucagauaaagcccuaauauuccaagacacuuccguauugcauguuuucauguuuguauucuaugaaguccuuauuuuagcccaaagcauccaucuguuugauauaggcacuuacacccuauuucuucauagccuaugauaaaauucuuguuucucugagauaguuuuguguuauaagggaacauucaaaggaauuagauaaaacaauuucugaugugccaaaaucuuauagauggugacacaggaaauucaguguuucccuauuucaagaaauguguacaguacuggaauggcaagaauuggagauauccagagacuaguaaaguaaauuuuacuagaauggaaauggcauuuguaauuuacaauucucucaugguuuuccuuguacacugaaaucgagcaucacuugaguuaaagccccaacagugugguuaccacugacacuucaauguucucaacuuauccccugcauccauauauguauugagaaaagaauggcaugcauguuguuaaguuuauaugcuauacacuugugucauugagacuugggauuucuuagaaccaucauucagccauguguucaacaugugaauggaguuugcuaauuuuacaccugggucuacuuugugagauaccucugauaaaguuagcauaaaucuguuagauaacuuuuuucucucaaguauaaaagcuaaacauguuuaaguuaguauauuauagccuuuaaggguguuuuuaggacauuuuaaaagugaauuuaaacgucagucaguaggugcucaacuaaccucuuuuuagugaugacuuuuaaagaaacuuaccuuccaggugugaaccucaaauggacugaauaacccugaguugguugcagucccaggagccugauguuaaugaggcugccaggaugaaauacuccacaacuguuggggauccaaauucgggucucacccuaacagaacugauccaagaacaucacagcuuuugaagucgauuggcacagaucaagaccaagauuuggcccugugucuguauuaaguagaggagcuuggugugaguuaauuuuuuuuuucccccugccauuggugucuggaguucccaccaucaauggaggaauuacaguccuagcaguaguuucuuuugauuugucagggguuauuuggucaauuaggaaacuacugcaacuguggcucugaccugacuguauaacaugcagauagauaccuuaaaggguaaaugaccaacuguucuuuaacaguauucuuggugacuaugcuuuuugaauguuuucuuuggaacaucuguaauaguaaaauugggcugggcaugcaugggugguggacaccuguagucccagcuacucagaacagauguuuaugcucauacugggcaacauacuuagaucccaacucuuaaaagaaagaaagugacuguuaaucugauaucuuagccaucuuuugcuuuuuuucuggacccccaaauuaaucuguagcuauugaagauuuauaccuuccuugaagcuuucuacuauagagggguuaccugaguuaaaagauaggaaaauggugggcuugcggguuuauacuaucagcaguuuuguaucuugagcagcauuuagcuuaaguagguuccuagcuguaccuauuagaauuuggggugacuuugugggauauacauucaacccaaaaccugacuugauuuuguuuuguucuuugugucacccccuccccccauuggcauacaggacgggaccagggcccuuguacucggaaccagacugcacuccaggcauuguguaagccucuuguguucugcuuucuuucagguaggauaauugcggacugaacccucgggcugcggucauauaugagaacuugguccucgcgguccccuuugccaggauguuuccauugcuucauguuucaguaaacaaaggaauuugugaccaacuauguuuucuuucuuaauuuaauucuucuaaguugacuuuucuuuccucgaugcuaguugucuguagcuuuucacuguuccuuauacccucagccucugaacagcccuagguaaggguuaugcugacaucccuuuuccuguacaguagaagccccucuuaaucuugcuuuucuuaggaguugagcccuucucccugccuuccugcagcaucuccuuucccuuuaaaaugaccauguaguggcaagcaaccuuuaacucuucugucagugcuggacucuuagcauugaagcuggucuucugaagucgcuaggaccauuggguuuuguuguugucuugguuugauuuuguuuugguuuucgguuuugucugaccugugaucgugguacagcauuugcugaaauuuagccuuguuuuauuccacuccucccaauuuuuuuuugaaaaaaaaaaaauaaauguuucuaauacuuaaucuuuucuuaacugaguggccauuauuuaccacuagugucuucugauucguaaguugugcuugagcuacaaaacuccaaugugugaaugaaugccuaaaauguacagagaaacugagcucagcaaucuaugguuucaggugagcuagaaucuucaaacacuggacuaccuggacaagcucauuucuccgaaauaauuagggcuauaaugcaguuaaaagguuaaccaacccagaaagccaagguacuagugacagacgccccauagaaaauacugcuucauaaaaaggcugugcuaggguagcuccuaaauccugucacguggacucaauuuaacaacacacugcucugggccaguguaaagaaugaacuuuuuaggggcuggagaggugggcucagugacuaagagcaagcagaggacccaguucaguuccccacacccacaugauagcuuacaaccaucuauggaacuccaguuccaagagaucugauacccuccaggcacuaggcagacacauuaguguacacacacccacacacauucagguacucauacccuuaguugguaacacccucccucauagguuugauagacacucucucucacucuucuguguauuuugagaaaaacugucccuauguacccugguggaccuagaacaugccauguacaacagaccagucucauacuugcauugauacuccugccucccaaaucuugggaguggacauaagccaucauucuuaguuuauccuuuguuaauugggguuggagauggcuuagcagcaaagagcauggacugcucuuccagaggggacagguucaacucccaguacccauacugguggcguacccauacugguggcucacaacuaucuuaugauuucaguuccaggcaggucaauguccuuuucugaccuccaaggguaggugcaacaugcauguggcagaacaaacauccagauacauaaauuuaaaaucucaaaaauaauaaaaaauaagaggcuagccauauagagcacaaagccuggggucaguucccuagauuuuucccaagugcauguaaauucccuuaucaacuuuuuuuuuuuuuuaagauuuauuuauuauauguaaguacacuguagcugucuucagacacaccagaagagggagucagaucuuguuacggaugguugugagccaccaugugguugcugggauuugaacucuggaccuucggaagagcaguugggugcucuuacccacugagccaucucaccagccccccuuaugaacucuuaugugauuucuucucaaaguguuaauauuucugcuaggguuaggcauuggcuaaagugagucagaugggucuguuuuagggggagcuaauuuuuaaguauagcucacguuggucuugacaucauuauguagcugaagcuuuccuugcacuccuacugaucuuuccccuuuaaugccucacgggcuaggauuccauguauggaucaccauaccugagccacuaaccgcaguaaugcaggaucagagaaaaaguacuuucuacagagacccaacuaugcuggguccauggcauacacuguuaaacacucaaaacagagucuggauuauuaggagcuggaggcuagccuggacuaugagacccaaucucagaaaaacugaaccaucucugcagccccucucuuuaauuuuuuaaguguguauguguuuguaugugccaguccagaagcacagguggaggucagaagaaaacguucagagguuguuugcuccauccuggguccuaggggacagcaaauauuuacuuaucucaccagcucuucuaaaaauaucuugcgugcgugcgugcgugcgugugugugugugugugugugugugugugugugugugug

SEQ ID NO: 9053 - RNA, 11374 nt, Mus musculus
cacacacacacacacacacacacacacacacacacacacgcacgcacgcacgcacgcaagauauuuuuagaagagcuggugagauaaguaaauauuugcuguccccuaggacccaggauggagcaaacaaccucugaacguuuucuucugaccuccaccugugcuucuggacuggcacauacaaacacauacacacuuaaaaaauuaaagagaggggcugcagagaugguucaguuuuucugagauugggucucauaguccaggcuagccuccagcuccuaauaauccagacucuguuuugaguguuuaacaguguaugccauggacccagcauaguugggucucuguagaaaguacuuuuucucugauccugcauuacugcgguuaguggcucagguauggugauccauacauggaauccuagcccgugaggcauuaaaggggaaagaucaguaggagugcaaggaaagcuucagcuacauaaugaugucaagaccaacgugagcuauacuuaaaaauuagcucccccuaaaacagacccaucugacucacuuuagccaaugccuaacccuagcagaaauauuaacacuuugagaagaaaucacauaagaguucauaaggggggcuggugagauggcucaguggguaagagcacccaacugcucuuccgaagguccagaguucaaaucccagcaaccacaugguggcucacaaccauccguaacaagaucugacucccucuucuggugugucugaagacagcuacaguguacuuacauauaauaaauaaaucuuaaaaaaaaaaaaaaguugauaagggaauuuacaugcacuugggaaaaaucuagggaacugaccccaggcuuugugcucuauauggcuagccucuuauuuuuuauuauuuuugagauuuuaaauuuauguaucuggauguuuguucugccacaugcauguugcaccuacccuuggaggucagaaaaggacauugaccugccuggaacugaaaucauaagauaguugugagccaccaguauggguacgccaccaguauggguacugggaguugaaccuguccccucuggaagagcaguccaugcucuuugcugcuaagccaucuccaaccccaauuaacaaaggauaaacuaagaaugauggcuuauguccacucccaagauuugggaggcaggaguaucaaugcaaguaugagacuggucuguuguacauggcauguucuagguccaccaggguacauagggacaguuuuucucaaaauacacagaagagugagagagagugucuaucaaaccuaugagggaggguguuaccaacuaaggguaugaguaccugaauguguguggguguguguacacuaaugugucugccuagugccuggaggguaucagaucucuuggaacuggaguuccauagaugguuguaagcuaucauguggguguggggaacugaacuggguccucugcuugcucuuagucacugagcccaccucuccagccccuaaaaaguucauucuuuacacuggcccagagcaguguguuguuaaauugaguccacgugacaggauuuaggagcuacccuagcacagccuuuuuaugaagcaguauuuucuauggggcgucugucacuaguaccuuggcuuucuggguugguuaaccuuuuaacugcauuauagcccuaauuauuucggagaaaugagcuuguccagguaguccaguguuugaagauucuagcucaccugaaaccauagauugcugagcucaguuucucuguacauuuuaggcauucauucacacauuggaguuuuguagcucaagcacaacuuacgaaucagaagacacuagugguaaauaauggccacucaguuaagaaaagauuaaguauuagaaacauuuauuuuuuuuuuuucaaaaaaaaauugggaggaguggaauaaaacaaggcuaaauuucagcaaaugcuguaccacgaucacaggucagacaaaaccgaaaaccaaaacaaaaucaaaccaagacaacaacaaaacccaaugguccuagcgacuucagaagaccagcuucaaugcuaagaguccagcacugacagaagaguuaaagguugcuugccacuacauggucauuuuaaagggaaaggagaugcugcaggaaggcagggagaagggcucaacuccuaagaaaagcaagauuaagaggggcuucuacuguacaggaaaagggaugucagcauaacccuuaccuagggcuguucagaggcugaggguauaaggaacagugaaaagcuacagacaacuagcaucgaggaaagaaaagucaacuuagaagaauuaaauuaagaaagaaaacauaguuggucacaaauuccuuuguuuacugaaacaugaagcaauggaaacauccuggcaaaggggaccgcgaggaccaaguucucauauaugaccgcagcccgaggguucaguccgcaauuauccuaccugaaagaaagcagaacacaagaggcuuacacaaugccuggagugcagucugguuccgaguacaagggcccuggucccguccuguaugccaauggggggagggggugacacaaagaacaaaacaaaaucaagucagguuuuggguugaauguauaucccacaaagucaccccaaauucuaauagguacagcuaggaaccuacuuaagcuaaaugcugcucaagauacaaaacugcugauaguauaaacccgcaagcccaccauuuuccuaucuuuuaacucagguaaccccucuauaguagaaagcuucaaggaagguauaaaucuucaauagcuacagauuaauuuggggguccagaaaaaaagcaaaagauggcuaagauaucagauuaacagucacuuucuuucuuuuaagaguugggaucuaaguauguugcccaguaugagcauaaacaucuguucugaguagcugggacuacagguguccaccacccaugcaugcccagcccaauuuuacuauuacagauguuccaaagaaaacauucaaaaagcauagucaccaagaauacuguuaaagaacaguuggucauuuacccuuuaagguaucuaucugcauguuauacagucaggucagagccacaguugcaguaguuuccuaauugaccaaauaaccccugacaaaucaaaagaaacuacugcuaggacuguaauuccuccauugauggugggaacuccagacaccaauggcagggggaaaaaaaaaauuaacucacaccaagcuccucuacuuaauacagacacagggccaaaucuuggucuugaucugugccaaucgacuucaaaagcugugauguucuuggaucaguucuguuagggugagacccgaauuuggauccccaacaguuguggaguauuucauccuggcagccucauuaacaucaggcuccugggacugcaaccaacucaggguuauucaguccauuugagguucacaccuggaagguaaguuucuuuaaaagucaucacuaaaaagagguuaguugagcaccuacugacugacguuuaaauucacuuuuaaaauguccuaaaaacacccuuaaaggcuauaauauacuaacuuaaacauguuuagcuuuuauacuugagagaaaaaaguuaucuaacagauuuaugcuaacuuuaucagagguaucucacaaaguagacccagguguaaaauuagcaaacuccauucacauguugaacacauggcugaaugaugguucuaagaaaucccaagucucaaugacacaaguguauagcauauaaacuuaacaacaugcaugccauucuuuucucaauacauauauggaugcaggggauaaguugagaacauugaagugucagugguaaccacacuguuggggcuuuaacucaagugaugcucgauuucaguguacaaggaaaaccaugagagaauuguaaauuacaaaugccauuuccauucuaguaaaauuuacuuuacuagucucuggauaucuccaauucuugccauuccaguacuguacacauuucuugaaauagggaaacacugaauuuccugugucaccaucuauaagauuuuggcacaucagaaauuguuuuaucuaauuccuuugaauguucccuuauaacacaaaacuaucucagagaaacaagaauuuuaucauaggcuaugaagaaauaggguguaagugccuauaucaaacagauggaugcuuugggcuaaaauaaggacuucauagaauacaaacaugaaaacaugcaauacggaagugucuuggaauauuagggcuuuaucugaugcacaaaguagcacacuuuuccuuugauaaaggcuaauaaauaguuggguuuuguugucuguaacauggggguauugcuauauuuccuagauuuuacuagaacuugcuguguagccuagguuuuucucuaacucaucauaguccucccaccucauuuucucugguacugagagagacuaagguaugugcuacucuaagaaguauuagcaaacuggaaacccaagaaguuaguuaaaacucacugugcuguccauuacuagcucccaaaugguacccuucaccuuaaccaucacagcaguguaguagugaagaguaugcuuuuauuuugguuuuuaaagacaggguuucucuguguagcccuggcugucguggaacuuuguauaucaggcuagccuuacucagcucuaccuaccugccugugucccaagugcuaggauuugggugugugccaccaccuacuggccagaauuuaagagucagcugagugaauuuuggcucuaucaugagauaaucauaggcaaaguacugaugcucucugagucuuaguuuuccuggaugagaauguaacuacacaaacaaagggccagcauguuagcucucccugccuuuuuuuucuucauaccaaguaucuuuuuacaacugguuaaauaauauuuuuacugagcauguucauguuucagaagaaacacauuggaaucacacuaacucaucaacaggccaaguaaaccuguggcauaaacuuauagaaaauacucaaaacauguaauuuuugcuuuuugauaagguccuguuuggugauuuggcuccucagugaagcagaggucucuuguagggaacuaagugcaaauuucaaccacauccuccccacucucaccuccaguuuuuaaaaggcugaguaccguguucgguccacauacugcucccgcucauaccgggccaugucauacagagaauuccgaguugcugcugaagccugagacaucucgcucucuggcccauaaccauagcccucuccaacugcgggaagcacagccgcauuccgacguagugggcuccugucccuuccauaauaggaagaggaagcggcagcagccauugcagcugagguggcagcagagccagaguucugcaauaggugucugucauaaggaucaacagaaguggaguugaggugacuggguacagcugagcucugaacuugaggaagaugagacauggucugcucugcguaauuguaugcggaagcugcagccgccgccgccacagcuucguaagaucggacgcgguagcgcuuauaguagucaagugcuccauaggcaucguuguaauacauggacuccccauaacccauaguauaaggugugcgcacugcuccauauuguucauuguacugcucaguaaagucugccacacgcccuguacggucuacugggcacucuuuggaccaauguccuucuuuaccacaccgauagcaaccacucuggucucccaucccaggggcaguccgaagccggcuaguugacaacuguacaugcauucguuugccuugaggaaacagauuaaaauuauuacucauuaacacucuuuucacucaaauaaaaguaaacguaaaauauauggacauacacgcuccugggccccuucauucagcaauccuuuuaaaaaaauugauguuucaacagaaguaagacccauaaaauuggagucagaugcuguuuauaccagcaacacaggagacucucuccuaguugugucuccacagcuuauuuccuuccccaaugcagagugcaaagauugcuaccuuuuacugugacuguuacuaccuccaaaucaagcuagacaucuaacaaaaccuuacuacuaauaaaacuaauagaaguuuuagaagacaucuuuuccaccucugaauaugccccuuagcauguauauaugacaacauggucaacagcaaucuucuauccaccauguuucuagauuucaacuccuuuucucauacgcagaacuguuugaacauagccucuuacaguagguauuaaaaaugaccaaguucugggguuggacauggcucucucaauaguuuaacacuuggcuacuguaugaaaaaccaaguuugaucccugggacccaaacaaaaauaaaaugaaaaacagcacucguuuuuuaggaacuguucucauguaaaagaaugaccaacauuuuauuccuaccaugcagaacauaauuucucuacaguugcccaaaagaacugugagcacccauucaagcaauacacauauacauguuucuagaaaauuaccacugagaaauagcuaagaaaagaacucuuuugcccaagaguuuauguuaucacccaauccagggacccuuguugucuucaacguaaaccaucuuuagugagaacaaagaugcuuuagccaggcugugguggugcucaccuuuaaucccagcacucagagaucaaagcagagacaggugaaccucugaguucaaggucagccuggucuacagagugaguuccaagacagccagaacuaacuauggagaaacccugucccaaaacaaaaguguucuaauuuaggaccccagcuacuagucuuccucauaccacugaugcugucaauagauagauggugugaaugaaaguaucgugugcuacacauacucacuuauaccuccuauguaaggcucucuauauuugagaggauaagccacuuucagacagacagcuguauaacugacacgagucagaauaaccaugccagucuagaaagggaacacucugcauugacccagauaucuacaagucuacuuuuuuuuuuuuuuuuuuuuuuuuuuuuugguuuuucgagacaggguuucucuguauagcccuggcuguccuggagcucacuuuguagaccagguggccucgaacucagaaauccgccugccucugccucccgagugcugggauuaaaggcgugugccaccaugcccggcuacaagucuacuuuuaagggggaaaaaaaccaaugaauuuguugacuuugauagauucugacugaguucauuuuccauugaacuacagugauuuuacuugaugucugcccugcacuagucaugcuuuuaguguagaggaugagaaugcucuaguguggcaaaauccauuucuacaguugugaacuuagagcuagaaacaccuguaaaauaaaauucugugcuuuagaaucucuaaguuacugaaauuuuacaauauuuaccagaaaaucagcccagaaaaagcauuuucucuugaaaacuagaacaagagagacuauuaaaaugcuaaaaaguuaauccuaauucugaaggucuaucuuaggugaggguucacggaagacuggagauguaggugacaugauaaugcuccauugcuuugucacuagaaggacaccccuaaggucuugcacauccuucccaauucagcuguccggaugguuacuugggaacagcuucuuugugguuccaauucaaacugcauucacugcugccuguggagaggagacaucuugaaagccccagguaaacuuagucuaugcuuagaaguuacacaaugcagaaacuuaaauacuagacaaccauuaaugcacagaauauucaaaagauguucaaaguggcacuuuaucaaccaaaaaggcauuaaguugaacaaaaugccaaguuggcaucuagauuauaauuucaagaagacacaugacaggcuuauguauaaugccagcacuuagagucugaagcgggauugugauugugagggcugucucagcaaacaaacaaacaaacaaacaaucaaaaaacaauuacccaguacuaaacuuuguuacaucauggagaaaaaaauuagcugaguacaaaaauaccugcauauguaagcaagagccaaucacucuucagaagagccagaaaaagaaugugauacuaauaaaugauucuuuuucaacucaguuuauugucuguacuuucuauggaagugauuuauuuauauuuuuauauauauauauauaaaauaaaaauacauccauugcauuauucaguucccuguuucuuuguaauuauaucuguuauuaagcaaauacaagggauaagcagcauaacucaguggaaauguguacagagcaugcucaagauccuggguccaauagucagcaccaaagaaaaaaaaaggucccauguacucauccuucucauccuuuuaacucauuuccugaguuaaauguaaaagggcguauacuauacacugagaauuucaguugcaaauuuagguuuuuuuuuuuuuuuuuuuuuuuuuucccauuuuguuaccuucuucagggauggggacauacagacucaugguagagcaguauuuguggggcccuuggaugaccccagaaccaaagggcuggggcaggaacuccuuccuuaugcuccccugcgcauuuaugaccucuuuccacaucaagugagaauuaggaauguuuaaaguuuaacugucagauuuuaaguacuuuccuaaccagaguagaagcaaucgugguugcaaauagcauucaacuuuaauuaauauugcuuuuauugucaaaaugcacauauuaccucccugccauccuuucacagaggcacacagaguuguuuuauaauggggaaagcauagggaauacacuugucaacuugagguuaaggacaggaaucagcuacaacguuuaggcuuucaauaacuaaaggccaggguauuaguggugaagcuagaauacauaauagugagccuccaguaagcaucacuauuugcauauuuacacuuuucugauuuaaguuuaccuuuucuccaccaauucauuguuuucuaauaagaggaccuuuguauauuuaacuuuuaggccacaaaaagauguugacuuaggaacuagaaaaguagacuugaauuugugguccaacaugaccgugucaauaaaagacuuggauaacuacuaaccaaugaacuuccugcaaugugggucugaucuguuuccuaauacaguagccauucucucauucuugcccacacuggaaaaaucuaauuugaaaauuuacuugaauuaauuuaaauuuaguagccacuuguaacuagugguuacuauaguaacacgauugcaaguauuuucagacaagauccuaugguacuggugauaauacuuaugaucaauauaagcaauauaauaagcucuauaauguccuugaugaaauuucccuagaagcaagaccaucauuccuauccaauuucuaaagaaaaaaagcuguuuuccuagccuguuaaaguaauagauggagcagaagaaccuaugaccuguuuccuggcuuugccuguaguagcccacagacugaacaaauuugaacaccucaaagauacccaucuacccaaccagacucaccacagauucucauacugcgcuucuucuagauucccuuuuuccucuuuacuaccaccagccauccucgaaagcagcagaggguaaaaacucucaaaggcuucuggguccaccacaaaccagcaacaaaguccuaaccucuagcccuucucacacuaccuaacuacuucucugccuaggcaacuuaagacuugugacaguacucaagugaaugaagaccaaaggcaggcaggcaggagcccaugcaguuguggagaaggagcuuggcgaauacaauggggaaggcuuacuuccccagagugaauuaugcuaagaguaguaaacauaaccuguucuuugcauuuaaaagaauggcagaagccacucuugaagcccuguggucuuguguucuucccucugccuugagcuagagacuccacgaaggucugccacccaauccccagaacaguucaccuugaaacucuguguugucgaggccccugauggccuccaccgcauccucugcccgcuccauguguacaaaggcauaaucuuucacgaugucacauucgaugacugggccguacuccucaaacuuggcccgaagcucuugguugguacaaguggggcugauguugcccacguguaacuugguugaagcuuugcucuuauucuugcuggcuuccacauugauguucacuccgugcagcuuguaguggugcagguugcguauggcauccucagcggccgucuuguccucuaugugcacaaagccauaauucuuaaugaugucacauuccagcaccuucccguacugcucgaagagugagcggaucuccugcucuguggccucccggggcagauuuccaaugaacagcuucaccauccugacaagagccuggcagagaagaaacaagauuuuaaaagucaggugugaagugagaaacugacacuacagcacaccccgacccucacaguucuuuuugagagaggaacugcugugugacaaugccaacagaaggucgggggucagaaugcacaacaaggucuaagauauauauccgugaggucaggcacauugacucuacaagguuagcuccuucacgguuuagcacagggaugaaagacaaguggaaggcaugaaguaucugaaugucccuaguuacggguuuuuggagggaaaucuguguaccucuccacagcgcgguauccccucccaccauacuccaagaacgaaagcccucuuucacccaacacuggaccccuauccucagcggcccaaccuccgcugcaacaucccaacaaagacucggcccgaccccugccccgcccccuccggagacccggccccgccuccuuuccuugucuucccgggaccuuccucagaagaugaguggccccaaacccgagccuucccggcccuccgagguccggcccaguccgcuccagggcuucccacacacccacagcauccucuccuaccuccggguggugccggcgguggcggcgggucccgcgucagagagaacccuacaaaauggcgacggccgcucgagccucggcgcgaccgggcgcuuucucgcgcgccagcucacgcacgcgcgagugcgcgcugccugccuccccucccccucgcaggagcggggcgaccaauccugcggccgcacacaacuguccgccccccgugcg

SEQ ID NO: 9054 - RNA, 4268 nt, Mus musculus
agagaggguggugauaaccugggucugcacccuacccuaccucuuccucucucucccuuccuguggugccccauccccaggauggcccuacaugcggcgcugguagccagagugcaucugagcugcccgcagguaaucauuauaggagcccgaauagcgugcguaaucggaaugggcaucgggcaggcgacgguaauccagcgaggacuuugucggcgagcggcggaacgaaagcugcgacucugauaaacggcgguaaucagagagcucggcuaaacgccggucggaaccauaccuagucgagagaagaagacaguuggugaaugagacaguugagggcagggcuccagguaggccuaggggagaugccauuggggacagggaggguauaccagauuugucucaaacaguuggugucccugucagaaggcucaucauacuauccaggucaaggaaccaaccuggguucuucaggucagugggaaaccaagcccucugcugaagcucccuuccaaaccagccaaggugagucuggucuacauucccaaacaagcuauucccacucaugggcccugcacaaaaagaccuugguuuaucaacagaacgacggacgaaaguaggguccccaacuucccaggguggacgcaccucauaagcuugccuucagccagugagugccaaaaggacuacuuucuuucacauccaucccaccaaaaccagaacaaaggagugaguuuaaggauccuucagacagugggaaaaaucuaugagccaauccugcaaaauguggcuccaucgguucauaggggccuccuagaaugaggacccuaaguuuguugguaucaccccaggcugagcacuaugccccaccuaaaucccaauggccagaacuguucagacacucacccucaugacuuuuggacaucccauagaaguaagaucaagggaggggccaauggcuccuguuucccucccaugccaaccucagccccuugcccuaagccccagcuaggggcugaggcggggggggcauacaguaccuuuuugacauggcgacagccuuuuuguagggaucgucguagcuggcccgggguggggagaggcggguacgcucauagggcggcggggugcuguuggcguuggcaacggcccccugggacauagacagguaggcugcugauggcuggccugucccaucguaggcacugcccggcuggccacgguaggaggcagcagccuggggaugcugcugggcagcauaggaagcagccaaugaggcugaugacugagugcgguaaggagcugccaggguggcagaaggcugagccccguaagcagcugccgccccauaggagccaguggccgcagcagcagacugagcuccauaugagccugacaggccaauagaugcuugagccccauagcuauucagcugggucugaacaacugguugagccccauaggaaccagccauugggguaguggcuugugcagcauaggcagcuggcuggcuagcauaggcagcagcuguggcugguugugccacauaagcagcaggcugggaagaauaagaagcagccuguugugcagcauauggggcagacugggcacuguaagaggcugagggcugggcacuguaagacgcugccugggcuccauaagcuagugaggaggcugcagacugggcaccauaggaggcugcuugagccccauaggaaccuagggaagaagcugcuccuuguguguuauaggaagaagcagccgcacgaaccccauacgaagaggcagccugggcgccauaagaggauggcugguuaccauaggaagcaagggaggagcccugagccccauaggaauuaagcgaagaagcugcagcugccugacccccauaaguggaaagggcugaggcugagggcuggacuccaccauaugggccaagcgaggaagcugcagcagacugggaacuagggcuagccagcugaccccuguauggggccccaagggagacagagggcugagcacgguaagaagcugccugagcugccaugggcugaguccgauagccaacacccaaagaggcggaaggcugggcccuauaugcagcucccagagacacugaggguugggcccgguagguggcuggcugggccgucagaggcgccacauaagaggcucgaggaggugaacggcgcagggggcugcggucgcgaccaaagaaugguggugugggcugacgggcuugcccaucaaagccaccagugcuguugccaaaagccugcugguagucgaagguggcagagaagccaccaguuccagggaaugcuguguccccagccccugguuucuuggucuuguccccagacuggauagccagggcaggccccuucuucugccccuugguugagaguuccacguugaugcgcuugcccuucacuucuuugccguugagcugcgcgauggcggcuuuggcaucugcuuccuucuccaugugaacaaacgcguagucugauaaagcagcagacagaggguuagcaauuaggggggcagggcaugcuaccuagugggucccaaacuggacacacaacagcacccagcuguugccagcuacauccaggucucucuaagcccuccucuauguaugccaugaaauguggccgaugugucaccaaacguuugacuguuucaagcagucagccaccuuuaacuuuggccuucuguuccccugccaccucaaccaacuaacuuucuggugagaaaaggaaaaagcaaagacgaauucaggauaaaaaucuucacagcggcuauaaauaaaaccagcaagcaaacagaaagcauuccuagaugacucaauuacuccauuuucucaauucaagcacaucuaauacugcuuacugcucaccucuaaaucuaagagcauaaaacacuaggaaccacucacauuuuggcaugacucacuucucagucuaggugcauuuagaaaaaagagugacuacgagaagcagucacaaaucccuccaguguaaccuuccccuuucacauuacuuuccaguuuucacggucacuucauacacaagaagucucaacaauccuguaaggaaaagaccauugucuucucuuucaggcaaguaugaucaauguuuuuauguagcuugcuguaaaucaaucaaugccaacguccagcuaacucuuccauggcccuuuguuucaucggucuuuauccugagaagucucuguaauauuucuaaaaaugcuaccuugcacagaagcuagaagauaugagaauagauauaaucccacauuauucccucuauuuccucuuuuagggacagaagaauaccuucgccuuagaagacuauuuacugcuuuuucagguuuaccuuuguggcaugcuugggggaggggaggggggaggauuagcauaggaagggucucacacgugcugggcaugacugaguaauaccaccagccaccuaccuaggcucucucauuaaagaccugaguaaguuguguugggagaaagucaaagacaugauacugaucugagaacucuaaucacuuacaacauaggaaaaaaacuuuaaaggggaagaaauucuugguaccauccauaccacaaacuacaauagucccauaagcagugucugaggagcaaugaucaggaccuaucugagaaagaagguucugcacucaacuccacucgggaccuguggcuacuuuaagggauucaacagcuaggauccaaucucugucacaucaauuuaagaaguaaaaaaauuauccggauggacuaagguuccauuuuuauaaaacagauuauuagagaugacacccaaacgccuccaaacaaauacccuccuuuuagggcccuuauucugagaugccuuaucuaaacuguucacuuacaacaagucaucuccuaaguugaagacaaugaaaccuccaaagaaauaaaagacaaaagccaagugcaguauaaugugaaugaugcuggacuaaaaauucaaaggccaagcuguauuagauccacccaucacugacuauuuaggugaccuuagagaacuuccauuuauuucccuacaggaaaaguuuauccugccaaccucaaguuaaaaguucaaguaagaagacagaaaugccuugugagguuuaaauugaugaaggaugauaauggagucgugacaguucuucaaaccuaaacuaaccagagguuuauuucccuagaaaauauuauuuuuaaucucuaauaaagcauaaugcuacauuauaac

SEQ ID NO: 9055 - RNA, 4268 nt, Mus musculus
guuauaauguagcauuaugcuuuauuagagauuaaaaauaauauuuucuagggaaauaaaccucugguuaguuuagguuugaagaacugucacgacuccauuaucauccuucaucaauuuaaaccucacaaggcauuucugucuucuuacuugaacuuuuaacuugagguuggcaggauaaacuuuuccuguagggaaauaaauggaaguucucuaaggucaccuaaauagucagugauggguggaucuaauacagcuuggccuuugaauuuuuaguccagcaucauucacauuauacugcacuuggcuuuugucuuuuauuucuuuggagguuucauugucuucaacuuaggagaugacuuguuguaagugaacaguuuagauaaggcaucucagaauaagggcccuaaaaggaggguauuuguuuggaggcguuugggugucaucucuaauaaucuguuuuauaaaaauggaaccuuaguccauccggauaauuuuuuuacuucuuaaauugaugugacagagauuggauccuagcuguugaaucccuuaaaguagccacaggucccgaguggaguugagugcagaaccuucuuucucagauagguccugaucauugcuccucagacacugcuuaugggacuauuguaguuugugguauggaugguaccaagaauuucuuccccuuuaaaguuuuuuuccuauguuguaagugauuagaguucucagaucaguaucaugucuuugacuuucucccaacacaacuuacucaggucuuuaaugagagagccuagguagguggcuggugguauuacucagucaugcccagcacgugugagacccuuccuaugcuaauccuccccccuccccucccccaagcaugccacaaagguaaaccugaaaaagcaguaaauagucuucuaaggcgaagguauucuucugucccuaaaagaggaaauagagggaauaaugugggauuauaucuauucucauaucuucuagcuucugugcaagguagcauuuuuagaaauauuacagagacuucucaggauaaagaccgaugaaacaaagggccauggaagaguuagcuggacguuggcauugauugauuuacagcaagcuacauaaaaacauugaucauacuugccugaaagagaagacaauggucuuuuccuuacaggauuguugagacuucuuguguaugaagugaccgugaaaacuggaaaguaaugugaaaggggaagguuacacuggagggauuugugacugcuucucguagucacucuuuuuucuaaaugcaccuagacugagaagugagucaugccaaaaugugagugguuccuaguguuuuaugcucuuagauuuagaggugagcaguaagcaguauuagaugugcuugaauugagaaaauggaguaauugagucaucuaggaaugcuuucuguuugcuugcugguuuuauuuauagccgcugugaagauuuuuauccugaauucgucuuugcuuuuuccuuuucucaccagaaaguuaguugguugagguggcaggggaacagaaggccaaaguuaaagguggcugacugcuugaaacagucaaacguuuggugacacaucggccacauuucauggcauacauagaggagggcuuagagagaccuggauguagcuggcaacagcugggugcuguuguguguccaguuugggacccacuagguagcaugcccugccccccuaauugcuaacccucugucugcugcuuuaucagacuacgcguuuguucacauggagaaggaagcagaugccaaagccgccaucgcgcagcucaacggcaaagaagugaagggcaagcgcaucaacguggaacucucaaccaaggggcagaagaaggggccugcccuggcuauccagucuggggacaagaccaagaaaccaggggcuggggacacagcauucccuggaacugguggcuucucugccaccuucgacuaccagcaggcuuuuggcaacagcacugguggcuuugaugggcaagcccgucagcccacaccaccauucuuuggucgcgaccgcagcccccugcgccguucaccuccucgagccucuuauguggcgccucugacggcccagccagccaccuaccgggcccaacccucagugucucugggagcugcauauagggcccagccuuccgccucuuuggguguuggcuaucggacucagcccauggcagcucaggcagcuucuuaccgugcucagcccucugucucccuuggggccccauacaggggucagcuggcuagcccuaguucccagucugcugcagcuuccucgcuuggcccauaugguggaguccagcccucagccucagcccuuuccacuuaugggggucaggcagcugcagcuucuucgcuuaauuccuauggggcucagggcuccucccuugcuuccuaugguaaccagccauccucuuauggcgcccaggcugccucuucguaugggguucgugcggcugcuucuuccuauaacacacaaggagcagcuucuucccuagguuccuauggggcucaagcagccuccuauggugcccagucugcagccuccucacuagcuuauggagcccaggcagcgucuuacagugcccagcccucagccucuuacagugcccagucugccccauaugcugcacaacaggcugcuucuuauucuucccagccugcugcuuauguggcacaaccagccacagcugcugccuaugcuagccagccagcugccuaugcugcacaagccacuaccccaauggcugguuccuauggggcucaaccaguuguucagacccagcugaauagcuauggggcucaagcaucuauuggccugucaggcucauauggagcucagucugcugcugcggccacuggcuccuauggggcggcagcugcuuacggggcucagccuucugccacccuggcagcuccuuaccgcacucagucaucagccucauuggcugcuuccuaugcugcccagcagcauccccaggcugcugccuccuaccguggccagccgggcagugccuacgaugggacaggccagccaucagcagccuaccugucuaugucccagggggccguugccaacgccaacagcaccccgccgcccuaugagcguacccgccucuccccaccccgggccagcuacgacgaucccuacaaaaaggcugucgccaugucaaaaagguacuguaugccccccccgccucagccccuagcuggggcuuagggcaaggggcugagguuggcaugggagggaaacaggagccauuggccccucccuugaucuuacuucuaugggauguccaaaagucaugagggugagugucugaacaguucuggccauugggauuuagguggggcauagugcucagccuggggugauaccaacaaacuuaggguccucauucuaggaggccccuaugaaccgauggagccacauuuugcaggauuggcucauagauuuuucccacugucugaaggauccuuaaacucacuccuuuguucugguuuuggugggauggaugugaaagaaaguaguccuuuuggcacucacuggcugaaggcaagcuuaugaggugcguccacccugggaaguuggggacccuacuuucguccgucguucuguugauaaaccaaggucuuuuugugcagggcccaugagugggaauagcuuguuugggaauguagaccagacucaccuuggcugguuuggaagggagcuucagcagagggcuugguuucccacugaccugaagaacccagguugguuccuugaccuggauaguaugaugagccuucugacagggacaccaacuguuugagacaaaucugguauacccucccuguccccaauggcaucuccccuaggccuaccuggagcccugcccucaacugucucauucaccaacugucuucuucucucgacuagguaugguuccgaccggcguuuagccgagcucucugauuaccgccguuuaucagagucgcagcuuucguuccgccgcucgccgacaaaguccucgcuggauuaccgucgccugcccgaugcccauuccgauuacgcacgcuauucgggcuccuauaaugauuaccugcgggcagcucagaugcacucuggcuaccagcgccgcauguagggccauccuggggauggggcaccacaggaagggagagagaggaagagguaggguagggugcagacccagguuaucaccacccucucu

SEQ ID NO: 9056 - RNA, 5792 nt, Mus musculus
ucggugcccauuggccgccccggcguucuccaacguuguagggaaacucucuguggccucugacagcaggcuccgccucgggucucuugauccguguguuugugggucagugaauccgggcgagcagcuucgaccucgcuauggcgccccuacugcagcuucuguggcugcugacacugcucucgacuguggcccugagccccguccccgccaagcccugggcagaugacgagcaggccuggaacuugucgucccaggagcugcuggcccccgcccgcuucgcgcuggacauguacaauuacggccgugcugcggggacaagggccgugcuaggagcggugcgcggacgcguccgccgggugaggacgcgcggggagcgggcgcggggccugggcccaggaauggugcaagguggaguuuggcuuaaauuugggaugauggccaggacaggggagggaaggaccuguuuagaccuguauccgguagggaggcacagaugggcaauggucuccuaagaggaguaaagggggaggggauggcugggccagccccaacuucuucuccauccaggccggccagggcucucuguucucccuggaagccacacuagaggagccaccuugcaaugauccccuggugugcccacugccugagacgaagaaaacaguggugagugaagaggucagcuauuguuggcccuagcuggcaaacaauuggaaugguggguccugucgaggcauugguuacuccugagauaccaaguuagagaccaagaugcucugaaaggguggguguuggggugcugggugucugcugcuggccucccucuuucaccaaguuaugacugccuuccauguggcucuccuuugaggaacuucuagcugcucuugccaggaccuuguuucaaacugucccaagaccgucuucuuucuaugccuccagcucugcaguuuugaaguccuggaagagcuaaaagaacacuugcugcugaggagggacuguagcccagugaaugccaaggucacaggugcugggauugcucaaggagacugggagagcccagaccauacuugagucagaauccagccuuaauuacuucucuguuccgacccuauccagaguuuagaaaugcgacuuucagcucauuccuuccauuguuggacaaggauccccugccccaggugaagacccugugucgaggagagacaaaggccccuuaauccucuuucccuucucuucucuuucucugcacgccccuucucucucuucccccucacuuccucuucccauagugacuucccugucuugguccuccaggguagagcucagucagcucacuggggucuggcuggacuuguaagugaacauccuuccgccuuccuaggacuucucugugaagauggcuccacucuucaaggacuucaugaccaccuauaaccggacuuaugaaucaagggaagguaggccccagccuugucaucugucuccgucaggccugggccuucucccgucacggcaccuugauacuaaggagauaaaguacacagugauaccuuauuuccccggugguaaacugagccagaucaaggcagauaagaugauauuaacugcugguuuauugggaagcugcucucuggcgaguucacuggccccagugauuaggccacggaaaucaccaugggaagaggagaugagggagagaaggggagaaagggcccacacagagagagaagaaaagaagagaaaagggagagugaggagaccaaaaugccuggauugugucuggaagagcuucuggguaugccaggguagggacugaggggugcugggagaagcuggaggccaggucugccuugauaugaaacauaugcaccucagucccugguccagggguccgaaaccaaacaaaaaggauccugugucucucaaggagcccauaucccuaggguccuauccagcuuucuaggcagucaucuugucaaggaguggccugguuuccuccuuccguuuugucuuccuaaccggaaaccaugggcuucaucccucuaggcaggauggguaagacuuagaccagauuuucuccuuuggauuuccucugucauggccuuuccgguaaccucuccugggugacacccuucggucucauuuagauuacugguuuuauauucaacaagucauuguuccaauuugggcccccaaaguugagcaugucucucacuuugaagucggcuucccucaugucuuauucugccggccccagggaucuauccuuacaaacagcuucagggacuauggcagggacucaguuaauaaagcccuugccuuggaagcgugaagaccugacuucaauccccagaacccaccaaagaagcccgauauggcggucuggacuuguaaccucagcaacagugaaaaaggagaaagaaauagacuuaucgcagccggucuagcucacuugagcuccaaaccaaaaagagaccguuugugccucaaacaaaaguggaaggccuugagaaaugacgccaaagguugcccuuugaucuacacacacacaccacuuacucaacacacgcauguauguauacagaaguauacacaaaggcacacacucgucuaugcacauauacaaagguacacacacacacaccacacaugugcacacauguaugugcauacaugcauacacaaagucacacucucaugugcgcacacacacuaauccacacguacacucauauacagaaucacucacacucacauauacucaaacacuuacccccacuuauugcuccuuuuaugaucugguuggguucaagacccucucccucucuuugguccucagaagcccaguggcgauugacugucuuugcaagaaauaugauacgagcacagaagauucaggcccuggaccgcggcacagcucaguaugggaucaccaaguucagugaccucacagguggggauggugaccaaagcugacacagaacuugugcugcucaggcuccucaugagggcuggcuucaaauucucaucucugccccgcccuucucuacccacagaggaggaauuccacaccaucuaccugaauccccucuuacagaaggagucuggcaggaagaugaguccagccaaguccauaaaugaucuugccccgccugaaugggacuggaggaagaaaggggcugucacugaagugaagaaccagguuggagucccagaaguaggaauaggaaggcagacugcacggggccugaagagagagccuugaccgugaccauugucuugcagggcauguguggcuccugcugggccuuuucugucacaggcaacguggagggccagugguuccugaaccgggggacucugcucucccugucagagcagggugagcauccugcucuaguccccuuucuccagaccagccccuucagagggccccuuggaaccagucuucugucuccuagagcucuuggauugugacaagguggacaaggccugcuuggguggauugcccuccaacgccuaugcagccauaaagaauuuggguauguguuaaucugguuuggaggggcagcagguaccaccucuuugcaagaggacgugagggucacaccaaacuggguucuggucuuuaugcugacccuuucugacugaagaccuacaguaagugagagccucaguuuuccuagcugugaaaugggauauacaauguugucuccaauggcaagugagguagugaaucgauguaagauucugaugcaugacaaggacccagugaaucuugguguuuucacuuccuggcagucuguguucuuauuauuccaccaaacuagacagcaacucaucucucuccugaggggagguauuaaauucagucaugggcugcgguaguagaaggauggcaagcuaagagccugcaguagcuuugaaagaagcugguccaggcgccuccaagggugugagcuacagcagcaguagacugucagaaggacaagcagcagagggcagaggugccaggcagccugagauaaggccucagcacggaggcagaggugggaguggaggccugccuuuguugauagacacuguagcuucuuucccacacccucucaucccuagaugugucaucacuagucugaggagauuuccucagagggguaccggggcccugggguuauguaaggagcaugugaucucaugucugugggaugcucggcaguccucuaucugggagaacgugaguaagucauaaacagacgucuacuuauuccccaggagggcuggagacagaggaugacuacggcuaccagggccauguucagaccugcaacuucucagcacagauggcaaaagucuacaucaaugauucaguggagcugagccggaaugaaaauagugagugggggucccuguagguggguccaggucgauacugcugggccaagguaccacuggcacugccuuccccuuucagagauagcagccuggcuggcccagaaaggaccuaucucaguugccauuaacgccuucggcaugcaggugagguccugaccucucugucccuccccaucucgccagugccuuccucccuucuccuugacgcuggcccccugcuucguuuucuucucaguucuaucgccacgggauugcucacccauuccggccccucugcagcccuugguucaucgaccaugcuguguugcuggugggcuauggcaaccgugaguuccgcuggccuccugcuucccuuccgucuaccucaggccccagucagaggcuagauagcagccucuuaggccuucugagggggaucacccuggucaugccugagaaccuuguccugaaccccagccucagaaaaacacccguguauuuuguaggcagagaagcuggggcugggggagguuggaggguuguucuagaggcaacuggacaagugcuuucucuaagccuuguauguacaugaggucuccaugaggaugguaggugggccuuacaggcgcugcuguuuucguacuucuuguuacaccauaggcccacugacgauauuuaaagggugcaguguaugaaucucugaguggagaagggucucugacuucuuguacuccaucuuguuccccaggcucuaacauuccuuacugggccaucaagaacagcuggggcagugacuggggugaggaggugaguuuugcccgguuggccucugaccccccuccagccucucccuuacccaagcccucuaaccaagcccacugucuugcaggguuacuacuacuuguaccguggaucuggagccuguggugugaauaccauggccagcucagccguggugaacugagaguugcuggcucaggaccuauguugucacaguggccccuuccuuagcccgacucaugcccaggcccuuccucacgagacagagcugguuggcugagggccgggcacuuuggaccucacggugagcccugggcccugggccccuucgucccucuuuccucuagugcucaucugaaguuccccagcugcaccuguguccgauugugguagcuaggaggauccugaggugcaggaggcuuucauggaagccagcgccggggcaagaaccuggcuacaguaugaugcaggaugaaaauaugcucgucauaaaacuagaucuguccucagcaggcucugucuuuuugcuuuggugcuccucggucugaugcugucaguuuucuggucccuuuccacauccaggaaaguugugaccggccuucucuaagggcaauaaagagguagccugcucuccuugu

SEQ ID NO: 9057 - RNA, 16696 nt, Mus musculus
aaacagaugggagaggcccacagccugaucuuuauucagaagcauggcacuggaugaccugaaggccuggcccugagggacagcugaauccaccacaggaagugcccccucuccuuuuccacggagaaugucagaggucacucucuccauagagggcacuagagaaagccacguaguccagagcuccagauggagccccagaucccuuguagggcgccauccgacggaugcaguacucagccugcucggcugggagcucucuccgcagcuccucugggguaauguaguucuagaaaagaggagacauuaagggaccaugggucuugggucauguccuagccuugcagccccuccaccgagugagauucaccuugucuccugccaggauuuugaaggaggcuaccacuuguucagccgugucugucucggcagucucucgggucaugaagucaaugaaggcuuggaaggucacaaccccagcugcauugggguccaccauggucaugauucgagcaaacuccacuucucccugcagagauagacaucaggcacuguguccauacaugcuaaaggaaagaggucuugcuccucauguccccuccuggggauuuuucauacuuggcuuauaucaccccagugacaagauauucucuucccaagacaacauucaguuuggcuuuagggaguccuucaugcuaggcagaaagaaguagccauuugccuguggcaauucccucucuugcuucaugguucagauauuuugcaacuuagcauuguuucuuagagggggaaaaaugguccaagcuaaggucacacuggacuaguuaauuuaccucucaguaucuuagauagccuuugcgugagugugaugagcagaaaagguaauuugugugaggaggcggccaggcagagggaggggaccugacgaugcuucugaaguggccauggcacucaccagaucguaacccauggagaugagacaagcucggaagucgucgggcuccaucaucccauuccgcuucugucaagggcaaauggauaucaggucuggucuccaaaucccacccgcccucaagucugucagcccacaggaguuagcccccaccgacccggucaaagugguugaaggaggcgcggaauucguugagcugcuccuggcucaggcccuuggcaucucgggucaguaccugguucucgaccucauugauggugcgggcaauggaggugagcaacugcucccagcccacacgaaugugcuggaaagugagagacagggcagucagggaguagccaggucucgggucagggucucuauguagcccuggcuguccugagacccucuauguagaucaggcuagccucaaacucacggagauccaccugccuuugcaucucaaaugcugugauuaaaaauacgcacaaccauaccuggcugucuaguuaacuguauucuuaauucacuguguggcccugggcaaauccucccccuuauuggaccucuuaacccuaccuaagguucccuuaagagacucuagacuuuuuuuuuuuuuuuuuaaguauugacuguucagcauggccaauccugaguuuagaaugcuuugugacuuugaacaugucucuuuucuccuucucucuuuccuuucuugcaccauaaaguccaagcugaccuugaacuugcuacauagcuaagaaugaccuugaccuccugauccucaagcaucucaagugacggcauaagagaugugcaucaccacaccuagacuagacaagucacuuuccacugcgggauagccagauugccagagggacauuacaaaugguugccaggcugaauuggcgacccuccugggacacacaggcucucuccagcugucaucaggccaggcuucccuucccuuuuucccaagggugagacccuaccuccaugcuguagacugugugcuuguugucaaagacuaggcucuccugcagcagcugguggucacccuccagccggucgauguugcucuuguaauugaugauguucuguuccugcugccgcagaccugccaucugcuccuccagagagccggccagcccagcugccagccguccuacuuccugcaaggguacccaagaagaauaagcacucucaccucccugugggccagcccucaugccaaucccuguguuggcccagcucucccagcccuuaccuccacuuuucccuggauccaggguccuauggcauuagccugggcugcaaacugucgccggagccucucguucaccugcugccgggccagcuccuccugcagugucuggucacggcuggguaccagcuuucugaccugggaaggagaguggucauaucauagccaacugugggggccagaagauggugcugaggcaagauguccuucaggcccucaaaccucaguuauuauucucaugagucaaaaugggauauguggguaaacucugagggaaauggcuuuauauuuauaggcuucagguuccucaucuguaaaauggggaccagugacaaauagguggguuuguggaugguacgcaaacaauauucuuucuauaugccugucaguccugauagaggaaugauguuggaggcuuaugagugccacguguuaucuauggcaggccccagauggaugggagugggcuauaguuacuccccauaucuugggacaucagaggccucauugaaucaaaugugcgagaacaaguggggaccacgcagggcugcugguuacacucacuguaucccacuuauuguugauguccugcgaacugagggugauguagggguugccggacuuuggccguaguccguauguuuggcaaaucuucuggaucucuccuuggaugcccaggauggcgccucgcucucgaucagccucgggcaacguugccuugaacuguucgugugcuguuagcaggcucugggggaacaggaagaaucagccaguauacccauuuaucacaggccacagggacagaacacggagcuagaacaccuaguaguugguucaggacucguccaaaacccuaugccuuuugccucucacccagcacucuauaacugggugguuuccuccugcuuccuauuucuauuauccgggaacacaaagguuugguugaugaaaugugagaccaguuuuccucucaucacauccagugccucccaaacuuuucccuaaugccuucacucaccugggucuccuccacagagugcacgagccacacauccugcagguccucaauagccccauccagccaguuauugaagggggcugcccgccgagcaaacuccagcugcagcuggucaauggucuccaggagcuucuccauccucuagaggccagagggaccauggaucagauccuucccagcuugcuggccuuaucaccuugcccucagcucccuggcccuccugcccaccucuagugcgucccuccucuucugggucaguguacccaaguuaucccacuggucacagauggcuuggcagcggcuguucacggaggcugccucaugguagucgagcucacugacgggacaaaaguguagaguguagaguguagagucagacccuggugggacccaaggcaggguaaggguacaggaguuauggggcuagguagccagagcaagcauggggcagaggagcuauucuuccugggcucucucaguguguuccuucaggaagaccggcacucagaauccucagcuccagucccuggagcugucccaguguggcaccugcuguuucagaagcaggguugugggagaagggaaacuggagguugugguuggugaggccaaggcugacuggggugguaggcuaauauccugcgguggacaggguuuccagguugugggugacagguuuccccauggcauggggacaguggaguacaggcagcagaguggguaaagggcuggggauggcguuucaagaagggcacaguaauggugugagaggaaaggaaagaggaugcaaccacuuguuuaccaagggucugagggagaaguagggcggggcucaaugaggaggggguggggcagggucucuggccacgccuacuugaguuccugggccagggccgcgauguguuccacccggucuuggugcgcagccaggucgcucucaaaggccucaugacgucgcaagagcgcacgcaccuccugcagcgaggcugacucguagucgugcugguuuaacauuuccucuuugccugcucggggagaaaacaggguccugccacccagaggccgccacagcuggaguguuggguuucccagcacacccuaaggugccagccugaucuuuugcuuugcuuaccgaugauguuaaguauucccugacccagcaccggcuaggaugaccuuugcuacaaggaauuucuugauauugagccccccccuuuuguuguuaguguaugguuuuuuuuuguuguuguuguuguuuguuucuuugcuugcuuggcugguugguuugagacugggucucucuauguaguccuggaguacuggaacuugcuauuuugaucagccugaccucgaacucgagaucggccagccucugccaucaccggguaccccgccuuugaacuacuccauuccucugugaagcccucugucuucugaucuggcuucguuuacacaccuuucacauuacagccccugugacauuguuuuauaagugauaauuacuauaguuuuacaaauaaagagcagcaucagcaacaguggugagccuuccuuagaggcuccuucauuuugcagaagguggcagguauaaauguucagagauugucccagggucaccuaagcuguaaauuucagaacuucucuuuuuauuuguuuuugagacagggucucucuacugguuguccugaaacucucuauauagaccaggcuggccucaaacucaaaagaucugccuccuucuguauccccauguugggguuaaacaaguguggcaccauaacuucagaaguucuuauaaaaauguccaagcuugcugagcgugguggcgcacgccuuuaaucccagcacuugggagcagaggcaggcggauuucugaguucgaggccagccuggucuacagagugaguuccaggacagccagggcuacacagagaaacccugccucgaaaacaacaacaaaaaauguccaaacuacuguuauucccuaugccacaaucaucaugaauguuuuagcugagcagacugguccuuaaggaguuguucuuuuuuuuuuuuaaagauuuauuuauuuuauguauaugaguacacacuuuaguuguacagaugguugugagccuucaugugauuguugggaauugaucuuaggaccucugcuugcucuagucaaccccacuugcuccggccaagauuuauuuauuguauaaguucacuguagcugucuucaaacgcaacagaagaggguaucagaucucauuaugggugguugugagccaccaugugguugcugggauuugaacucaggaccuuuggaagagcagucggugcucuuacccacugaaccaucucaccagcccggagucguucuuuuuaacauuuguuuuuauguuuaugaguguuuugucuauacauuauauauauauauauauauauauauauauacacaacacguacacgucuggugcacaggaagaguguucuggauguccuggaacuggaguuacacauggcugugagcgaccaucugggugcuggccauugaauccaggucuuuugcaagagcagucaagcucuuaacuacugagcccuuccuccaguccucauccuuuuguaggacugacagacuccagaguggauaacguuauggggagcgauauauuugacuccugcaguagucuguaucaauauacuuagaauacagcacugauguugagauuagggacaggguuaucuuuggacaccuguuucauauacagaagcuaagcaacaaauuagucaaaaguacagaggaccagagccugggacgagggagguuaaguuuauagauaacaaaacuagucccaagaggagcccggauggauugcauagcaacaagucaggauggaaugaaaaaucucaucuccagccagguccaguagcucauguccuuaaucccagcacucaggaggcagaggcaggugacucugccuggucuacauaaggaauuccaagcuaguuagcacuaauuauguagcaaggcaauuucugaagugagaguuggggggagaacauuuugucuccaguuucccgcagagcaucugcccauguccugugcauuuugccccaugaacuguaccuaccccggguccaagcuucaugcagggaagccuucuguuggaacuucucagccaggugcugaagccucugcagacgccugaucuccgaaagcagccaauccucauagcccuucucuaccugcuccaguccccgccacgcauuggcuauguccugaguggaaaacaaagguggccuccaucacgguucacccguuaugcagaugggaauccagaacccaaggucacccaggacauaugggcaaagcuagagcacccucaugcccagccgagcucaccgaaaccagcuugcccucggagggcaugaaagcgggucgguggcucaggcgcaacuuggucugcagcguguugaaguugaucuccagcuggcacuucuccugcacacggggaggcuugugcaggcgucgauagucucggaaguccuccagcuugcgcugcauggcacucaugcuggguucgcccacgcgguucucuagccaugggacagugcggcggauccacuccaacagcugccaggaucagagcaaggcagagaguucugagcugaccucauccacccaucuccacuccacacauagaugguggccauagggucgggucucaaauacauggaaggaacuuucaaaacuauagagcacagaacaggguacucuguccuuacuagucagagaaggaauaggaugugugugugugugugugugugugugugugugugugugugugugugugaguaagagagagagagagagagagagaggaagagagagagggagggagggagggagggauggagggagggagggagagagagagagagagagagagagagggagauugggauuugaauccaggguuucccauagucuagagaagcacucuuccaggacaaucucugaguccaggggccaacauaguuuggcauggagacaaaggccuuauggcugccuaaauacaagggaaggaagggaccagucaaugaacaaaugagcaaugaccaggugaguuuugguugacagagggcaggagaugguaaggaggcaggccagagaaaagccagaagggggcucugcagacucaugucagaggugagaggaguugggaggaucaguggggagaggugaggcauacaguaagggacaggugaggcgcacagugggaaggggcccuccggccccagccucaccucacuggccaguuucucauacuccuccaucagcuucucauuuuccugguucacagcuaagaccuugcagauccuguuggcagcagucucugccugagguagagagcacaagagggcuuaggacaagcuacccuggacaccccaaccuuccucccucucaguaaagcccuuaaaagccuggcccaugaacaaacugagaaggacaucuuuuuuuuuuuuuuuuuuuuuuuuuauuauauguaaguacacuguagcugccuucaaacacuccagaagucagaucucauuacggaugguugugagccaccaugugguugcugggauuugaacuucggaccuuuggaagagcagucgggugcucuuaccaacugagccaucucaccagcccgagaaggacaucuuuaagguaagaagaagcucucaggacaaaggcuucugccacccccagccccacccccagccccacccccagccccagccccagcucccugaaaacucauugucuaaaacggagacaguagcccccccacacuuauuugccuuggcaccuccaaauguugggcuaacaccaagguugggccaucagccccuacauaggcagcaaugcccucugugaggcagccaugagguuuuccuuuaccugcucagccccagcaaacgcaugguagaagcaggaaacauaggucaugauggcuuucucaucugguuuggggguguucacgauaucugggggaggacagaaaagugguguuuguuuguuuuggggcacugggaaucaaacccagggcuuuucucaugauagguaagugcucuacuacuuagcuacaucuucaacucuucccuuguaauguguguuuugaccaaagccagaguggggaaugaacugaagauuccccuccaugcagagaauauccucagaaugacagaaugaugggaaacucuaagauuaccccagguccuggugugagaucauucaugagugugcagccacugaggcccuccugagggaucugugcacacugccuggugcucccagccagucugcaacuuagucucugucuuuucucuaagucuuaugguuuccuugggguggggguggggguugaaagcuguagggggagaagcugauacuaagucugguucccuaauugguucuugauuuggucaauaaagaaggugggagccaauugcugggugaaggguaaagguaggacuuccaggucccaagaggaagaggagacccgaggaaagagaaagggcuuuuuugaccaggcuuuagaacaaggagcacccaccaaccauguaacaucuugggguagcuagaacuggcagccuccgccacuaguggauggcugauauuggcuagcugauaagguuagggcaggagauucugugcccagcaguuguguuaucugucaaguucaaggauaauaaagcugucugaguguuuuucauucugcaaagcaaagacagguagaaacaguagccgggccacagauggcaaguggggaguguggcuaauggagcuagccaugaagaacaaaagaaaaggagcugguaagugaggggacagcagcucccagcuccuggcuuucccgggaaccaggagaggccagaggucaggacaaacucccaggaaagacagaagcauguuuuuaaaauuacacacaacagaaagcaguucuccaugguacacaggcauccaggguaccaugcagcaauugcucagaaaauauuugaugcuucauugauuggacauugcguggacccaggauccacaggcagacugugccccagagaagcuuccagucaugggaaccaauguuauucuggauaaucagggagcuuggauauaugacagagugaaucccuuccauagaggaaagccaggagaaggaaggcagaggagaguguaauggaaagcucauggagaagaggaaugauggcaggaaacacuguagcacaugucuauaauuccagcacuuggguauaguagaggcaguaaagucaggaguucaaggccaaccugagcuacaugagguucugucuaaaaaaacauaagaccuugaaaagaaagaaggggauagaguaggaggcaggaguaaauaucauagaggaggggagaguaggcgacuaugugaagguuggaccggaucaagggaguacuuaaggcugcucucauucauugaccuaccuucugcauccagcaucuuaggaauguccagguauuucucugccaccucgaaggcaguguucagguuuccaauugggucauccuagauaggcaugagggggaacggugaaaggucagcugaaggcagagacugcagaguugggucugugaguuauagaggcccggcccaccuugcgaagcuuggcauagucaaugaggucuggccggugacgguggaugagagcacagagggccaggccauccuuccagcuggacagagagaaaggguugacaggcccugguucaggcugaggccaugucccacccccauccuagaaguacuucugcaggacaagccuuuucugugagaagcagucaaguccaaaguccuuugcgcccauugccagcuucucccaggucuucgugaucccuucccauuccuagggccuacacuagaccaauuucuagauguguaggcucucccuaucuucucuggcugaaauauauuuccagggaugucacaacugcuccuugccccggaaguguucugcaaccccuuuauuccgucucauucacuuccauagauccugaguccuuguuucagaggcuguucaagaacugaaccagagccccugccaacugcugagguuugggguggggccagucuacacccucacuuguguccccuggaggccaucaaacagaccugguauggaaguucuguacguugacauugcgguacggugcuguuuuccgcugacaccagagaagcaagccuucuuuggcugaggucucuggguggcgaagagacagagguguuagcugggaagugggaaagagucugagcuggcccucuccauguggcuccuccucuccucaccuucuacagagauguccugaauggcaaagcggaggaugaugguccagaucaugcccagggucaucuucagguucccgucaacaauuucugccagggagagaggucaggguuggacuccagaccuuuguguccaggccuugguucacaauccucuggcucagccucccggcccuugugucccucccaagaccggguagcuaguagguaaauaccuaagaagcacacggcagucagcuagugaugccuaagaagcacacggcagacagcuagugaugccuaagaagcacacggcagucagcuagugauauuuuaggaugauuuguuggacaccugcuaaguaccaggugcugggcuagcauuuuugguacauuugcuucugacagacaggaauaauuaucuccacuguuucuuguagguaaaagaaaccucuugacuccccugaguccuugccucuuguccccuccucaccuucagcaccgauggacacuagcuuaacuccuuugcuggcaaugaagucuagggcuuuauugacauuggcgauuuuguggaagcgcaucuugccuuugucgggccuaggcagccucucuccugaguauaaaaggaguggaaagggucaaaggucaugagagggagcccgggauguaccucaguaguagaguauuuguuguucccaagcugucccuuuuccaauacaagacucucccagcacucugcugccaccauucccauaggucuccgauuccccugaccacaguguaugccggcccucaccggaaaugaccuccaggagcagcaugagcuucaggccauugcggaaguccucuucaauguucucgaucugcgugccugccuugcgcagaugugaguugcaccaggcagugaaggucuaaaggcagaggacagugauuggacuguaggacuggcucuagggacagggaugccugggacugagucugguacacacaggccuagcuccuccgcuaggauaggucuuagaacccaaggcccugaauguaaauccugguucagccucuggauucuacguaaucuucacuccuuucccuccuggaguuuuaguuucuggagaaaagagaaauggcccuggggccucuguggguaccagucuggauuugggaccuucuugugucagcacuccaacuuuaucuaaucuuaaucacuggagaugggacuaggaaacauuaacacacuuccaaguguggcauucaagguucaggcagcguagagaucggucucuaaacugagagauacucaggggaacugcaucuugaugagaagugggaaucaccugccagggagacucuggagggaaaagcauugcaccaaugaucaacagucuauuguuguuucagaaugauuauccccacagggucucaaagaaguggccuguugaugccugccagguacugcaauucacaacaaccagccucagcuuccaccugagacaaggggaacugggguacaccugcgucugucgggaauggggguguucuaugacuacacauguacuugccaaccuaccaggucuucagacccugagcacuaccacuaacuggauccuccaaucccagcugccaucucucuccaugaucuaaggcuaccccuugaucucucuguccuuagguuuccguauucguccaaguaaggggcgggggagucagacucuauaaugucucuggccauucuuccucuggccuggaaguguccuggaagucagagaacagaugcuccugagaggugcccuagaagccaauuggaauucucuccucagccagauuuccaggugugcugggagcuggagucaaagaggaugcuauaaauacuggacagcugugguugcuaagggaacuuggugagcuucuguuacaggggguguauaaguggguccuuaguaauaggguccaagcacaagagacugcauucauaguuacugcaguugcuuccacugcuggagucugagugcccugggucuacaaaugguagggggguagguaacuggggguggggggaacaugaguuuuuuguuuuuuguuuuuguuuuuuuaagauuuuauuuauuuauuuauuuauuauauguaaguacacugucgcugucuucagacacuccagaagagggagucagauuucguuacggaugguugugagccaccaugugguugcugggauuugaacuccagaccuucagaagagcaguugggugcucuuacccacugagccaucucaccagcccccgaguuuuuuguuuuuuaagacagagacuuauguaucccaggguuucauauauuuuuuaacuuaauggguagccagcagugacaaugaacuucugaccuccugaguccugggaugacagaccugcaccaccauacccaguuuaucugaugcuagggauccaagcuaggucuucacucaagcuaaacuaagucaaaacuuuauuaggaacugagcuacauccuaggucucaaaugcaaguuucaauaagauguagcccuguccugaagggguucacagccaaccagagccauguuggucucugagguguacugacagagacaugcagaggaaccugagguggaggaggaaaaccugaggugucucacuagguggaauuuucuugauguaggcucacauuggaucagagcagugauggaagagcaggagcuugugcaggcccaggaagggcagacaagggcaugccaggcagggcagacacaggggaaguguguagugaaaacaguuguucuguuuaugggacugcacuguggcacugcuggaaugaagcuggggguguugggcuaucaguggugagagacagaccggaggguuggcaggggccaggucaugcaugauccugggugcuaagcuggggaguuugaacuugauccugagaacuacagagaguuggcaaagcuucaggcaagagggaggcaccagaacuuaauuaauuauuuuugagacaagccuuuccaugcagcucuggcuauucuggaacucuuuauguagaacaagccaauugacagagaucugccugcuuuuguuucccaaauguagucuagaaugguacauuuaaaagcucacucuggcugggcagugguggcacaugccuuuaaucccagcacuugggaggcagaggcagguggauuucugaguucgaggccagccuggucuacagagugaguuccaggacagcuggggcuacacagaaaaacccugucucaaaaaaccaaaaaaaaauuuuuuuaaauaaaaaauaaauaaauaaaggcucacucugguugcagagcagggacgaugguugucagagcagaagggaaaaauaaggaggugggauggauacaagggguagagagagaugggagugggaaugaggaggugggguuugucuuuguuuccuucugccacacuuccuauggccuacuuaugggacuugagcggggguaagauugcucagugguaagauuacugguugcucuugcgaagaacccagcuuggauucccagcacccaugucaggaggcuuagaacugcuguaacuccaacuccagagaucugacauccucuucucucuccgugggcucccauguauauacacauagauaaaaauaaaucuuuagugggaguucugcgauguagcuggguugguagaggagagauggcucagugguuaagagcacugauugcucuaccaaagguccugaguucaaaucccagcaaccacaugguagcucacaaccaucuuuaucaggaucugaugcuacagcuacaguguacuuaucauauauauaaaauaaauaaaaucuuaaaaaaagaagcagcagccccgggcuugacuccuagcaccacuuacagcuugaugugggagugcauaucugcacccuccacuuagaaaggagagaaagaccuggagaguugcuaugugauuaagagcacuugugcucuugcagaagacccggguucaauuccccacaucuguuugacgucucauuaccacccguaacuccagguccagggaaucugauacccuauucugaccuccgcaggcaccacacauggaaguaaggcacauacauauaugcaggcaaaacauacauaaaauaaagugaggaaaucccauaauuuuuuuuuuaaaguggaggcuggggaucagaauucaagaccaucuuggguuacgugagaccuuuuaaaaaugccuagaaauguuuaugaaccaauuuuuuuuaauacugucaaccacaguggacucugguaucaggggagaacagaauguuccgaagcugggaaccauagauauuggagucacugguaagugaagaugaaugcaggagcagggauggauggggcagggugguaccugcuguaccacaggauguuacagcuuugagauaaacaaagcggaccgagggaagaaaacgcacauguccacccacacacagggcaugcuaacugguuuucagagcaucugccccguucuguugauggauuaaugguggacuuggguuggugguggagaucguugauggacauggguggcuagaaauuggaaugaaaggaugguucugauacuuuagaugacaaaggcaagaaagagacugccagcuguuguggugggaacacacagacugugaucugggagggggagggagagggggagggcuguugaggagcaaagggcagcuggagccaggggcagggaugacaucacccggggauugcaggaacucagggaccacagccaugcuuggagacaggugcagggggagggggagggggcugggggggaggguggaucaucccaggccucauuccauucagcucaggcuucucaccccccccccccccccccgcagucagcuccugucaucuaacacagcggaaacgaucugcuuguaaauucugggguucucaggucugcaaugcccucuacuuuccuaaaagcacgcacaauuggcaaaaggcagguuccauggcuucauggugcucacccuaagccuggccuucagaaccccaaaaauuccucaguucggauggaaucauuuucucuucagggaacccagguguccugcucccuccucuugguagccaggggugaaaugauccagggaaggagggggcagugcccugcaaggcugagccugggcaauggcugcccucauggcccucuugagcucccacaaaggcgcugccucagcacaaguguccaugugggagccuggguuagguuacugguaaggggagccggggcuccccuccuccugaccuucuggccuuuucagcagacucagggcuucuagacagggaggggaaucuugggaaagaguggggugaggcaaggaacaaagacccucagaugggggcauucuuuucuuccucaguacacaacaggcugccugccuaucugugcccuuuucugggccucaauuuccuccauugucaagccaguagagggauccacccauagcagaagacagaguagaggaugggaaagaauaugagacagcuguucucuccuacaccccaaauccacugguugugugucuggcauguucuccucaggauggggucuagggauacuuaacuggagacuaaaggaacauaacuuucugagaaccccucaccucccauccaagaaugaguugggucucuuggaccuuguccaaaauccacuuucaccaacacaagaggggcagugggcuuaaaguuauuggggagucacugagggacuccacgguguccuugauauccuaaaucccuaugagaacucuucugaucuuugaggacagcauauagcuggugggcagagccugguuuggggagcugcacucuagauuacagccaggcucugaccuugaacugcccagaugcccgagaagaacugccuggccucccagccucaguuuuugccuuugggaaaugggugagcacucacuuuccgcugcuguuucucccaggccggguccaacagcaagucgcggucccaguccuccuccuguuccauguacucgccgcccccaccgccagagaagggccccuccccggcccccagacccucgggcugcauaaccaucaucaucuugcucaggcucuuggcuccgcucugcuucacugggcgagcuccugcacacucag

SEQ ID NO: 9058 - RNA, 6732 nt, Mus musculus
aucuuugucagaaaaaaaaagcuuuauugaaaauauugaaggcuggcaugguggugcacauauuuaaucucauugcuuaggaggcagaguuugaggccaaucuggucuaaauaguaauuucuaggcuaaccacagcuacaaagugagacccugucucaaaaguaaaacuauucauugaggagauaaaccauguucgugaucugaaagguugacuucacagacgcuuacuuucuacaagcuaacacggucuacuggaucccgcuuauuucaaggugggcuuucauuggugagaucugaggagcugauucucagacugguauggaagagcaagggcuccuagggcgugauucccacuacguggggggaguguacauggggucggggugagguaggaaaaugaccaguggaagaaaauaaaaaagauuugguuaagguauauucagaucuccauguggaagagaaaaagaggaccauaucacuacaugcaguaauuuggacacaucucagaaacaauaucuuguugccaaugguacccacacauuacauguccaugcauacaccaugcucucucucucgcucucucucucucucucucacacacacacacacacacacacacaaacaaauguuaaaauuacccuucaugaacucuggagugcuuggaagcuaguuauuuuggcccugauguuccuuuuucacuucagcugugcaaaaguaaagcagauucaaagaccaaagaccaaagaccaggccucucugugaagggugugcaaggccaucuacagccacagcagagcccccaagggacacagccugagacuccuguggucuggucucucuguccaggccuaagauuggguccuuuuuaauucucuuuacaauaauaaauagaauuucauaaugaauuuauuuaauaaaacaaucuagcuggaaggguucaaaucuaaucucuuaggccagucaugguggcaaaugucuuucauccuagcacucagaaaggagaagccaguggacuuccuugaguuugaggccaguaaggucuacauuucuaccagcaaucuugucacauggccuagcagggcuuuucuauuucuuacagaacaaagauucuaacuguggucccgcauacgggugagcugcuagagcucccucacccccugcuguagacauguuucuagugcuaaucucuagagcacgucuggacucuccuugccuggaucccaccacacccuuccagggccagagguggcagagcccuggcccauugggaucucaggccuucuguagucuccaggccugacaugggaccugggaaacagcaaccaaaacaacaaagugagguauaggaacccagcaaagauggaggaggccaagaaccagguuggcacuuuacuacccugcagaggggcagucggucaggccaaguagcccccuugcuagaccauccucugccaaaagggccaacuacagagauagaagagcccacauugggcagguucaaagaaggagcuaaagcugcccacuacacacaugaaggggcaaucgggccuuccuccugcggcuggcaugaagcuaaaaaguucucaguucgauccucugcccuguucaguucuggcucuaccuggacucaggaagucacaagacccacaucaccuggagucuggaaagagaucccaucuccaggcaaaggagaggcuagaaaaggccagaaccagacuagggcccagcgaggccccagggcugccugcagguuguggcaggugcccaggucauagcaguggugaccccgagcccacucccagguggucuguccccgaagcagcagcaucccauggaaaagcagcccagcaccacacaacagugcaccugccacacacguguccaccacaaaggccagggcaaacugggccagagacacuuugccuguggggagaaaacagaaaggggcucagggaauagcaguuggcuggccuucccaaaccccaauccugcucuccucccaccaaagccuccauccuguaaacucaguuacuuagucacaccugggguccggguuacaugggaaaguacaccauuuaccauccugaccuuagcaggcagcuaguuccugcucaauaauucauugacuuccagaggccaugaaacacuguguuaagggaaagacucgaggcauggagggccguggguugugggauaugcuugcugugagcugucuugaaugggcaaacgcaugcacagaaagcacacuaaugaugguuggggcugagggaaucuagggagccaugacagaggcucucacuggacacagcauuucucuuuggagugagaauguucugaaauuagauaguggugaugucuguacuaaauacagacaucuaguauauuuugaaauauacuaaaaccugcugaguuguacacuuccaacuggcuaaaaugauguguuuuguuaucaauaagaguuguugaucugacgaaaugacgcaugcaguaaacugcuugccuugcaagcucgaggcucugauccacaagacccacauaaaaaucuggauguggugacauaggccugugaauccaucgaugacuggaugggaggaggacaccgguguaucucuggagccugcuggcuagcuggccugaccaaugagauacugccuuaaucagaaggugcccaagauugucuucugaccuucacaaguacauacauucauacgcaugcacacauccccagaucauggcagaagugcugugcaaaaaauacuaauaaggguagagaaaauagaccgcacuauuuugauaagagagagagaacaucccguccagggacucuccuaggagucagugucaagggucuggcagauuguuccaggucuguaugcacuggacccugaagggaggggcuccaaaaacagcaggaagugccagagugagggaagaggugcccuacacucaaguacaaguuaccaagccuguggagaccagaugaaaggaagcccaaaacagaaacgagagauggaaauaucaaaaccauguagaugaugccaagggcaaaccaguuaagaauguggcacuggaagcaucugagcccgagaugccccuaaagcaaggagagagcuggguuuaucuagacagucccuaaagcaaggagagagcuggguuuaucuagacagccuggcuugugccaccccaggaggaagggcagagcggagaccaggaggaugagcaagaaagcagcugugagccugcacacauccuuugaaaggagaaggcaaauuaaggagguguaggggaacccccaagaacaccaaugaagagagcugggcacacgaacaggaguagacaaacuaagcagaggccuccagcaagggggacaccagcuuuccaaagccccccaccaccaccaccccugggggagagcugaacacaggaacauugcuguuguuuuguuuuugagacaaaaauagcucaggcucaucuuuagcuccuagcuccguaauaacacagauuaccuacaaauacucaaugccccugucaaccuggguuucauacggagaauaaggugaaccagggugugaacauggcaucgugcauaucugacagcccucagcagccagguagggaggcugagcuaggaugcugagauguuggcaggagaaaguggacaugaagggcccugugcuaguuaaaccagagcaguaaagacagacaggcaagguaaagagugaccugacccguucugagugcugacaagaaguagguguggauguaagagcuggggaaaugaaacacaggccaagaaauggaagccagaagugagcacaugccuguaagcccaauaucuggagaguuaugaagcggauuaugaguucaaggcuagccuggacuacacagcaagacuguauaggaaggcaggcgacaggcaggcaggcaggcaggaaggagagagagaagaaaggaagagaggaaaauccaagcaagccuucuggacauggguaaggccgcuggcaguuggugcuuuuggugcaacagauucugggguugagaggcugggagcccaagucagugucuggggacagugggauaagcuaugauaacugcaggaaagcacccagccucagaaaacacagacccaccaagaagagcgcuugugcacgugugugugcgguggggguggggguggaggugggggcagcauuugggacagaggugggauucaauaggauaaggaggcauggugauuucucagaauggccagggagauugcagaacaagguuaacaggaacaguggaaaggucgggagaaggauucaggaaacacguccaaaguguucuggccagaagggacaaagaauacacaaauccaugggacuuuuacggaggugucagaggaaagaggaguacucacaccaucagaagccagccaguaacacaaccaagucuccucccaauuuccaaaggaaaggacuucccugccuguaacuuucacuggcuccccucgccccaucaaaucagaccgguaucucuccccagcauucaugccuucuaccacccaguccugaccaucauucuagcccucauucucauggugccugugaaacugcguugguuccuuucaggguuuguguacauguaacggcacucauucucuguguuuagaguggggauauuuggaccauuagguccaccuccccuaauaaccuucuagcaccccaacaacccaugggcucucaaaucagccuucccucuucuguagcaagcccugggguccuucuugacucugggagccagaacucugcucuugucuuggagcaccggguaaaguacaguacuuaacacucaacuaaguggcaggcuucccucuuuccuuaaaugacccugggacuggguccccaaaacauuggccaagagaaccagcuagacaccacaccucccauggaaagggcccugcuccccaguccagugcaagggucucuggcucccaaaagguucagaaagcuccccaccugugaguagcaugagccagggcaacagcaggagagccacuguguagagggcugagugggccugcagcaaggcugacagggcggggccuagcagcacugagauguggagcaggacaccagcagagugaagcaggagacacaggaagggccgguaauuauggaagcccacacagcagcccaauaggcgacagugauggucacgacguaggaugcacacacggcaggcagagcagugaccacuacgagguggcaccuggcuuuggcacugguaacaguaacugcagggggugggagcaaggacacaggucagugccucaguagcucucagugucccagaccaugcccaaccgcagccucagagaccaucuugggaaagcaggaacagucccugucuucaccaggcaucuccagcuagugguuacugccugugacacaccuucugaaaagcaaaguuugcaaaggccuggcaguacuuccaccacuaacaucuuucucccucuccacuccagucgcugaccuugugguucuggaauauucugggcauacuguggcuucugccuuuucuuggucugcuucccucucccagaaaccaguucaaaauuucccaaguggcugacuccaccgcaaaugccugagugauguccaccuauuuauuuuuaguuuuuaguugcaaguggacaaguuagucuuaauauauuuguggaugcuauggcuuuuuaguaaaauguaaauuaauuaaucaagcuaauuaaccuaaagcuaaucaccuaaaagucuuguacugaaaauugaccaucuauuuaaaauugaaacuuuaugcuggagagauggcucagugguuaaaggcauuugcuucgcagacuugauggccuguucacucuucugaacccacgugguaggagagaacaaacucccgaaaauuguccuccgaccuccaccuguguaccccggcaugcgcgccugggaccggacacacaucacacauacagacacaaauaauaaagauaacuucucgccucuuuuacccugcucuguuuuuuguuucuguaucauucuugagcaucuaguuuacgcaauuugcuuuuuuuuuauuggcuuauuauuaucuuuauuaucugcaccuuccgccacugaaaucaacuccaggaggucgggcaucuguuuucacuugaguccuaggaacaguggcugcucaauaucugaaugaauaaguagcgggugccaggcucuaaaggaguucuauggcucuaacaacccggaugcuaacgucaucugguuacugacaccucaaguucuggguccuuucuugguaccagcgaccaccagacccccugcuucugcccgccgacucccggagcccaacacucacgcccagcccugucccaggccgcggccagccagcaucaccccccgaaugcugggauccgagcggaggaagagcaccacguugcccagcagauugagcagcugauaagcagcuagcgccaguugcaaggcccgggccaguggucccagcggggguggcccaggccccagcaccaucacguaggccagcuccaggaccacgacggcggcccacagcgcggugaguaccaguggcauccgcgcgggcgcuccuucugcgccccgagcugcccaggacucccccauggucggacccaccggcuuuccgaucgcugggaucccacugcuuccgcauuggggagggccuagcagcgaacugacgucuccu

SEQ ID NO: 9059 - RNA, 21062 nt, Mus musculus
gagaugguggucgucauauuuauuuuucuggcuauaaaaguaauacacgaagagcgcuggauuuggugagaaugcuuugagcccuggcucugucacaugccaccugccgggucuagaacagucacuucucagaauugccaccuucccauguggaaaaccggacuaggcacccuguugagcuccggccauagauggcagugcagauccagaaacugaggacauacgguaaacugcaaagugcugacaaauggaagggguucgcaucaccacccucagcugagguagcaccaaaguccaagcuccugccccucccuccccugacuccuaaucacacacaacucagagcuacugacagcccugguuugacaaagaggggagagaccacacagaucuucucaagccuggccagguggggccuccugggccugguuccuccagaaucgggcaucugcugcagccagcuggauaagaaccuccuccaacucgggcccauccucgggaaaccgcucacagaaggagcggaugagaccagcggcugaggccucauacuccacaaguuguacuucugagccugggggauggagagaaaacagcagcacagaaagauguaguuaggggcggcgaguucugagcgagcuccggcacaaacugucaauguucaggauaguuaucuaauuaccuacaucagaauaacccugccaggaaggcagaauuacauggggggagacuuagacuuaaaugaauugccacuugaccucauccuucccucaagucaagauuuaaaucaugucuggcaugguagcacacaccauaaucccagcacucaaggaacugggggaaaaggauuauuaauuuuaaggcuagccuaggaaauccuggucucaacaaagccaacauaaccccaacaaucacuaauaaaaaugacugauaaaagcacucugucagggcuggagugauagcucaggggguuagaguacgaguggcucuuguugaggacucuggcugcucuuagccuggccucccgcacccacacuguggcucacaaucaucuguaauuccagccccaggggauccaaugcccucuuguggcuuccaagggcacugcaugcacaugguacauacauacaugcagguaaaacacacaucaaauaaauaaauccgaaaucaaauuucaagugcuauguuagaucaaacaagauagucaaguuagaucaaacugcuucauaugucuagaucgugggcaaguuucccaguugcucucagccucagugccuuguggguaaaguggggcaugagcacagaaccucuccucuugugcgacggggacugcgugggacagagcgucaguggggugcucaguagccgcucugcacaucugugcaucugaccuguuaaaugagccugucucgaggccccuggaucaccccucagcugcucaaccuuugcacucugugaagccuguggcacugagggguacacaguggcuaacauggccuaaauuaaguccuggcucugugaagaccacuuguguguauuuuaguucccagaugaaacugaugagggguauuguaaccagucuucaccaggccuggggacuucauucuugaaaaguuccuuucuuuucuuuucucuucuuuucuuucccuuuuuccuuuccuuuccuuuucuuuuuccccccaguacuggggauagaaccugcaccuuauuuggcagugcaaagcaggcuaccagugagccacagcccggccuauugugagaacacuucacccaguacccuagggccugcaagcccucugccaccaccauuaccaccacuaccaacuaccaaagcgcuggggguggaacccagggccucuuaaauauugggcaaauguucuaccauggaccacaccccagcucgccaguaccuuugaaaacuccaaccuguuccucaggucuggucccuuccaccacuuccccccaagaccuccuggacacucugaagcuacaggugugauuuuuauccaaguguucagagcacgguuuguccuuuaaacaugugugauugauaucucuguugaguuuuuaucccuaaugggcucugaauuagacaaugaccucagcuccgugcacugccccaucccucaguggccucccugaacuccauguugccaaagcaccaagaaagugaagcugagagauaagagacugaagggauuauuucguguugaggggcuggagacagaaugucucaggaaggugccauuuaacggggaccugaccaaccagaagaaucagacagacacagauuugagggacacugugccaagcagaggguacagcguguacaaaggcuaucgaguagaguggccuuggugcauuggagagcuagggcacacaagguacuggcaccaugcaggcagggucagggauucugaaaauggaaguguuacuugagaagggggaacgauccaggacaucuccaucuugaacguugcugauucaaauucucuuagguccuaggaggccugaggucugucugaaagaacguggcagagggagcccuccccgaaccgauuacaucaucugcucucuggagagaccucagguagguccagcagaugguguaacauccguuaccuucaaggcgaguguuggguugaacaauaagcuuccgggacuccuugcgcagcaguaccguaucccuuaggguaaggaagcacucuggaggugcgucagugacugcugcauagcccucguacagggcccgccccgcgaccacgucccccguggacuucagcaccugcaggaaggaggaaucaagugccuacgaugggaacucaccuugcacccacaggacucugucagcagccguggccagugguaccuagcccuggggaggacgugcuacaguuuguccuuuauaaaauuucagagcuaccaaucuaauggcuaagcuggguaugguggcaccuauaaucccagcacuuggaaggcagaggcaggaggaucagcaguucagggccauccuuggcaacacagggaguacagccugagcuacaacauccuaggugacucauuuuuuuuuaagauagagucuccauauauagaccaguuggccuugaauucacaagagacuugcucccuucugccuccugagugcuaagauuaaagguaugcgccagaaugucugacagcuacauuuuuuucagaaagcuaguguauauugagaaguugggcuuugggguuaagagauggcucaguggguaagaaccacaagcaugaguucaaauccugagcauccauguuaaaagcuaggcacugacguaugggccuguaaucccagugcugaggguggggauaugggacggucauaaaggcuugcuggcugccagucuugcuccagguucagugaaagacccuguuucaagggagcacagcagagaguaacagaacaggacacgugugcauaugucacacauaagucacacucaaacacggacacaaccccccaaaaugaauucaauggaaaauggaagagguggggcuuuuaaaagcacccaggcuccuccgcuguaaaugggacuaaggcccacacagaggcagcuacggaagcaccaccuuucccuucaaccagagguucuacuccuacacugucuucucucacagucucuuuugcaugcuccuuaacuuuggcuauagcagacuuucgcacuuucauggacgucauucaacuucucuucacgguguagugcgcaccuccuaggacugacgcccgaggcucagucccuaauccugcuugccccaccuccaauuuuguaggagacuauucucuuccucugcuaaguggauccgggguucaucucucucacuucuugguaauauguaaucucuucauacaugaucaucauaccaacaagccagaccuggggagcucaaacuggagaguuagcuacauggacgccaacgcagccaggagcaucagaagugacugaggcaggacaggcuacuggggacggguuuccaauacccucaauggaucgcagaaucggaaugucuuaagucucuaauccaaaauggugugcuauaugcaucuucugguacagcauauuuuacaucacauuuguuuauuacacauuuuaaacauuuauguauguguuugauguaucugcacauguguguuugcuguguacagaagaaaccagagagaggcuccuauucuaccauucuccaccuuauucccuugaaacggaguucucacaaaucuggagucagaaagcuccagcgauccuccuacccccguggugcugcagcugcagaggaaugcaaccaggccugguuuuuuacaugaggacuggggauuugaacucagguccuuauguuuauguggcaagcauuauuauccacugagccaucucuucagcccuucuuuuuuuuuuuuaaagugaagggugacccuaaacuccuaauccuccagcaucuaccccugagugcuggggucacagguacgagucaacacuuuuauccaguggugagaacaggacccagggcuccauguacacuacgcagauacucugccaacugcccgauagcccaggcccuuagauuacuuauaauacccaaugcaauguuauggaauuaguucuuaauccauauuguuuagggaaugaugacaaaaaauuguggauguccaguacauaugagaugacuccugaauaucugugugugugugugcacacaugugugcgguuggcugaauuuauggauguggaauugggggcuccagaauggggacuauaagaauaacaggaaucagggaaucucugggcaaaacaaagagccuaugccaugucugaacauggggcugccacaguugcagccagcuagacacauagguauugagcccacuguugccagaccuuccaagaagccacaaauacauauucaaccuaaucuuugcuaacaucagaaagacaaaaaacaaaaacaaccaaaaaaccccccaaaaaacccauggcuaacacuauaaacacuaaacacuauaaacacuauaaagagcuggaucaaagaugaugucaccuucugugucuauaacauacugcugaggagacugaacacaaugagguaagacugccauguacaaggaccaaacugggccccucacagugcgcaugccuugaucccagcaccagggagacagaagcaggucagucuccgugaguuugaggccauccuggucuacacagagccaaccagggcuauagagugagacccugcucaagggacugauucaauacugccugggaccugguagacuugguucuuauucuuaaugcucuaacaacagcauuugccauuugcagaaaaaucuuugauucauagaaauguugcaaagacggcagagugagcuuccagagucugccagcacagcuugauugccaccaacucaucaucaaucagauggucacuaccaagaagguugcagagcccacccaggucugucccaucagcuuugccaacaguggcccugccuaucucagaguccaucaaggacacuguguuucucaucuaguggcucuuauccuaauuuacauuuuugguaguggaggaugaaacccggggucucacauuuauuaagucauacucuucuauccccagccccuaauuuaauuuuauuuaacuuuaagacugucucaaaauauuaaaaauauuuuaaaaagaaaaacuaaacaaaaaagaaaaacgaaaaucaacaaacagggcuggugagguagcucaucagauaaacaugcuugcuacacaauccugauaacuugaguuugccccaaacucuacauaaaagcaugaaagaucaauuccacacguuaucucugcccuccauauacacacuguggcacgugcacaaccccucaauaucacacacacacacacacacacacaauuucaaaagcaaaaagacccaaacucccacacauucuaccuaaagauguuuucgauccuuccuggaaacagaugggcacagaaucacaaagacacacuuugauuccuaauccaaacaaccauaacuuuaggacuuaugauaugugaauuguugaacagaguccuguucuuguagaaagugcuacaccguaaagacaaguuuccucauggagcuggagagauggugcaguggcugagugcucuuccagaggaccugcgcuugauucccucgacccacauggcggcucacaacccuauguaacccuauguaaccuaugcaagggacucagugcccucuucggccccugcaagcgccaggccuuccuuuccagucuugcucgccaucacccgcagcaguguuacugccacucagcuccugucguggucugaaggcgcccugcuuacuuuguuucccuguuagcugucugcauucccacaugcccaugugagaaacugcacacagcuauucugucacuagaaagacuugcuggaugaaggaacuguccaggagguuaagagauauugacaggugggagagagggacaggaaagaggcugguggaagccaagacaagagaccaucacuuaccuggagucuccgcaggaaccgcuccaaggcaggucugcccacugaccggaucuugcugcgguccaggcggacccgggcaucagggcgcccaucagagccuguggugggagugacgguaacgaguccuucgccagcuuccagcaaaacccgcaggaucacaaaccgggccugcaugugggccugccaggggaaagaggccgcguguaguggauauggagugcuuagugcacaacuugcugauguuuucaacaugccaaucgucagaugacaucaucuguuuauuccccuguacccuggggguccacucugcucacuccucugcccucaauuucuuccuuucuccaguguucacugaggcgggcugugugcagaacauggugcccuauucgcccucaucacuugccacaccucugaaugcuucaggcagcagcuacucauggggccccucacuaaagacccugaggacucgcucucaucauccuuuuugugcccaacaauggaacugaguaggcaccacuaccccacguuuauauaugacaaaacauugaggcccagagaaaugaagugacugguuuggagaaacaacaaaaacugugacugaguggcugaguccaguggcuaaggaaggaagacuacauaaauuugaauccugaugcucuucuuccagcuaagaugugauagagcuuucccuacaguggagucugggguuagaguuuaaguuuaucuggccuugggggaugcacuugucccaucccugcacccagaauccugacaguggccacauagcaggcuccucgccugucucaccugucgccaguuggcugccucugggguguagaacuccaaagccaacaagccagcccgaaccauguugagccaguucacguagauuacaucuucugcaucagcucccucaaagccaaagauccugguggagcggagacagggaugaugagauuagccccaugcucugguaccuucagagcggcccagcgugggggcucagcccaccgccccuccagcccacgguucccuacuccagcacuuggggguugagacagagguagaggcccacacucucggcccggcacucuucguagcuggaggcaauggugcugaauuugcuaucccacgucucuccacuccgguaccagcucuggaucuagaaggaugacccaggacccaagaaucagggccugccugugucccccaucccagcugccugacuccacaggggcucucuuaccuguuccccagucucuggguugaucacagucuccuugucaaaguugaaagcaccuuucucauccuguagaagaaaggcggcauccucagagcucggggaugccaacuacuccuucagaucccucagcaguuaggaaucacccaugcacuucacuguacgggggagacugggguccagacaagggagggaccaccugaaacuguacgggaacucacucuccagagcuguggaagagacaccuaauaugugggccacugagcauggcugcuucuccccaugugccucugcugcuaccacucaugcugccaacacggcccuccccgccaugccaagcaucuuccacagugaccuccuggggaagccucugucaccaacacacaucaccggugggaagacggagggaggcucagagaccaagagccccagccugggucagcccaaguagccucugugccucccagauccuaacagguuggcuaaaaccccacugugccagggcugauaccucaccuccccuucuuuucuucacaggagcucacagaauggcgucagagaccccacuguacagauggguccacuggggcccagccggaagaaaagacguauuuaaggccauggccugaauauaagacuggaugagacaccaugccgggugugccccuucagcugcccucuggauucuccggauaaaccagaggcagcuccgucccucccucaucuagggaggcagccccaccagugagaacaagcccagcccagaaccccauucucacugaugggccuuacucuccuagaguucggcuaugugucuccauguugggaaccuucaagucucgccagcaugcuauaaagacuaucagccucuccaugauacccaaguacaagccaggggggcacgugcucuggggagacagccccuuaggcagaagagacgugacuugaccucccuacagcaugcuccaggagcccagagaaacgaaugggcagacaggguucucugagaaagcucaacuaguggcugcugacugagagggauugcugggcucaggcuggggaagcuccccuugaagugugacucagguggccccuagacagagaccgggaggggccagugucugccacugccugugccaaggccgcaggcacugucugccucugcaccuugagccuguauuuuuccagauacugaagggagccauggcucccuaggaaugaaaggcuucaccuaugcgugggacaggucagguggucccugcucaccuguacaaagagcuugccgcugccauggcccaacagcucguguaaccccaccugcacaucaaaggacggccccuuccagcggauauacagguccugucaagacaaacaaggacaccacugaccgccaccaccucauuguggucacagugcgcaccaguccucccagcaaggcccaugugggcaaugugcucucuggaagccaagcuuauucgacgccacacauguggagugacccaucucaccccacaaugacccuccacugugcacccugggaggaacggaagcuucccagugacaaaggguccgucacaugucaggaguggcuaagccagaacaaaagcuggacucugauuucaccacaggacugguccuuuccagacuagcguagcuuagccccgggcucgggagccagcgcccaccuugucuuccuccuccaagaacgugagcuucucccgcuuugcggcauaggccacagccagcacauuccccagcgauacauucuuaaagccuucugucugucucaggucaucgucuagaagacaggggugagagcugacagagggaagggcagaggucgagaggcacugagagaaggcugaggggagggacucacaguuggggauguugaugcccgcaggaaugccagagccagcaaaggugaggacguccagggaggugaagucaggggugaggaacuuguccuucucgaaggcaagaggccagggcagcuccuucagcagcugcucagcacucgcgaccagccgcucgaacuuggcacucauggcuuuguuuaccauggccacgaagccuguuggaggguggggcugugguuugccagcauccugggauccaguugcacgcuccccaguuccuccaugcaucauauuuauacugaacacagcugucugcagcagccuaugcuggcuacuggggaccacaagccccaaguuccaggccccagaccggcaaacaagaggcagaacuccuucauguuccuauggccucaggucugagcuccuagguacggcuggcacuuuccuucuuccugccaggcuaagcucuggauuuagcaacucuauauccagccucucuauacagaauggggagagcaagaguaggcagagaccagccugaacccuccagcaaugacgugccugugggaugaggacugaggcagccugcucucgcuagggaugaaagcuuccacaucagucucacaggcguggcugauccacuccuaucacugcacacaggacucugugaugcucagaggucugaccacuuggcuuauggucacugaauggaugaugggcaaauccaggcuaagaaaucauguuugccuugucagguuagccacaaaagguauuaacagccaaauggcuccaagucaggguaacugggcucagccaguacuauggucaauccacagguuaacuuggugcuacacagugccugggacauuaaguaagcugacccaggcugcugucauuacuucuaggagaauggacagaacucucaaggaagaaugggagagugaacuuggaccugcacaaagggauuuucacccaaccuccccacuccacaagaaguuaccuucaaacucuccucgggagccaaaggggucacgguagcucucaaugaagccaauguaacuagaggagaaaagaggagagaugagggcaaccuggcagaaggcaugggagggggguuggggggggggaagcagaggcuggcaccucaccucucuacaauggggccuuuguccugaauccagaagcgggagccccucuuaugggccucaauggagcccugggugaagcucuccacguacugagccagcauuugcuccugguggcuguuggcugcauaagccuagaggugagacgguuuuggucaauccuggaccauccaccuuugcuguccagagggguuuugaguggcccccucagucuccagccagccuuaccuuagcuuucuccaaguguucuaccaccuucuggaggaugggggcauaguccccccgggugaccuggaaaugguuccccuggaacucauaucucuucagcuuggaggucaauucagagucgagagcagggucuaaggaaugaggcaacacucaggaacagggcaccucugcaggcauuucgcucuagcccacuaagaacuuuaauggcuucccacugccaacagaaauuaagauaaauccucuucuucaaacaugcauauauuagaggcucaauugacagggugcuugccuaacaugcacaaagccccagauuugauaccuagcacugcauaaaccagguauggugauguacuccuguaaucuuggcgcuugggagguggagaugggauuacacugaguuugaggucagccugacuagaguaagaccuugucucaaaacacacagaggcuggagauauggcucagaggguucagguucuaaccaucaaaccugacagccugaguguagucccuagguccuccauagggugaaaggacagagucaacuucuguagaucauccucugacuucuauuucaggacauuugugcacaggcuaaauguuuaggagggagggagggagggagggaggagguaagggaggaagcacgcacgcacgcacguucggccagcagaguaugauccugcacacugcaccaccaucaguugagagguaaauuaggaagagagggaguucaaggucaucucagauauauacucaaggucaucucagguaaguacacaaugaguuuagggggccccaaagacugcagaagaugcuaucucaaaaaacaaaaauaauaaaaagauaaccuccacagaaacccauuacuccagcggguagcauugcaugucuuuaaucccaacacaacaacaaaagcccaauacuccauacauacacauaccaagaguugugaugggcagcucucugaguccaaggccaaccuaguuuacagaguuccuagacagccaaggcuauacagagaaacuaugucuugggggauggggguggggaacacauuuuguucuugcaaaagacccagguugaguucccagcaucugaugugggcaccuggugucucacagucaucuguaacuccagucccacaggagcugacacccucuccuggccucgagcaccuucaaguacacagaaaaauauacacagaaaaauaaaucuucaaaaagacaaacgaggaagaaaucaaucuuggaaagaaacaaaagagcaggggcuggagagguggcucagcggguaagagcaacgacuccucuuccaaagguccugaguucaaaucccagcaaucacaugguggcucacaaccaucaauaaugagaucgaaugcccucuucuggggugucugaaaacagcuacaguguacuuagauauaauaaauaaaucuuuuuuaaaaaaagagucacaucuuaaaaaccaugagagcugagcacaacuggggagcagaaguccgugacuccugacugugagagacaaggcagggaccaugagccaaggacgacagacgcugaggccaucuucuagaagcuggaaaaaggaccguguuucacuauguggaacagaauccagggccuugagcacucgaggccagggcucuaccucugauucacauucccagccccaaagccaccccuggccaccccuuaggcuguguuacaagcaugggaucuauuucaacuugcacuguaacaggaucccuucuguuuuccggaccugugucccuuuucuuucuuucuuuuuuaaagaguugggguuuuuuguuucuuuuuaaagacaggguuucucuguguagcccuggcuguccuggaacucacuuuguaagccaggcuggccucgaacucagaaauuugccugccuuugccucccgaguacuaggauuaaaggcgugcgccaccacacccagcuaaagaguuguuuuuaucugguguauguguaugaauguguauauacgugugugugugugugugugugugugugugugugugugugugugcgugcacauaugugcaucacauucaugucugauaccuaggguaccuaacccagauccucuagaagagcaggaagugcucuuaacugcugaaccaugucucuaguugaugugucccuuuuuugucaaaacagacuuugugcuguccccuaaguuuggcuauccccuguugcagcucauacugucccccucugucuggagugcauauggcauguucauuugcuauaugggaauacccaacauuuacacguugacuaccugaguauuaccaagcacugggcacugggaaagacugacagaaacacacagcccauuuuagcagagggcuugucaucaagacacagaccaacaaggacacuagugcgaguguugguaggaucccugaaaaggagccacccacauccagcuguagaauggagaggagcuggcuggguaagcaagaugggcucgcaguuguucugggcaggaaguaggcaacaaccuguauaaagacuuggugacgagacguaggaaccagaagcuauagaacgaggcggaacgagcggaaugcuggaggugcacacugacuagggaugucgauggaugaaaacgagugagcagagggugacacagaggccuaaauauauucgcuauccuugcuuuauaaaccaggcagagccaaucacagacccaugaccgcccacgaguauugguucacauuaauaaaggacucuggagagucaagagcuguaugaagcuguaugaagaagcaacugacaccaaagagcucuuuccacugggacaaccaggcugcuggccugagccacaugggucauuagcuggcugacgucggacauuagggccccagcgcaccuguguugaggacugaagccagccgcaccucauagugggacuucccuuccuggccaacgaccuugaagagccgaguguuguaugcacugagguucugggggaaaaaaauagagcaggguuugaaggauggugagaccaaagaaacugaggagaguggaggaguggccauccuaagacagcgaagcaaaguaaccagggccucucuuaggaaaaucccuaagcccacaguggagggcaagggaugacugccauuacgugcaccgcacacuaaacgcuaacuuaaaaaaaaguuaguacacgccuuuaaucccagcacucaggaagcaaaggcaggcagauuucuguguguucagccagccugaucuauauagugagacuuugucucaaaagaauaaaccaauacaauauacuagggcugagagguggcccggcugagagguggcccggcugagagguggcccggcagauaagaugcuuacugcacugcucuugcagaagacccagcuuugguucgcagcacguaaacgggcucacaacugucucuaacuccagucucagguuaaccuugggcuccuacauacaggggugcauacuacauacuucagguacacacacacacacacacacacacacacacacgcaugcuaaaauaaacagacuuucuaauuuaaaauauacauaucuaggggcccacacaugugccacagugcuugcguggaggccucaauagcuucgagagucaguucucuuuccaucauggagaucccagaagaucaaauuaaugucacugggcuuaccggcaagcacaucugcccacugagccauucaucagcccccugagcacuaauguucacaagcuuggcugugugaggcacagaaccaccucaguuaacucuuagcugugugggaugaacuugggagacagccacggagcugucauguggccaaggaacacaggacaggguggauguauccugguacacaugugacaucucugucuuucugauuggugcaggcuuaccucucacacaaagaauccuuuaagucuuguccuucucaaggaccuaaggugcccauaugucuuugaguucaggcugggacccgagagcagguggcaguagugaagggguggagacaagaagccccaucaaacuagugucccaaauugccaauucccaaaccugagaguccagaaaguccugggccagcuuagcaucuuccaugguacaauccccagagaaauagguggugacucccuguaggggaagggacagugagagaaaaggugcacagagagacaagagauggcguuacuaagggcgcagagugacccugugaagcagcugauggcuuccugcccaggcucugcauguccucccagcaccuccacccugcccuguccauuucuagggggaaagguuguaaaacagauuuucuucuuagacauuuuccguauuuucuucuuugaggucggaucucacuauguagccccacuccggccucaaacucacacuccugagggcugcgauuacaggugacuccaggugugugccaccaugccuaacucagucuuucuuccacccauccucucuagcuggcccaccucuaaggcuugccacggcuucuccccacgcaguccaagcaacucccagaggcaggaacccuggauccccccaucauucucuccuagacucccuuauccuccaagcucuucucaccuucccucucuaugcacccacauccugccaggccugaccuggaagaacauucuagacacauuccaugcaguucucuguggugccaaguggcuucaguucaagaguagggaagagccuccugccucccaucaucagcugcccuuccacgcauaccaagcaaccucaaggaugccuccacuuuaccaaguucuuggaggaaggggcucaccuccuuccccagcccaagaugucgaagccucgguuccagggagaacauaagguccccacaggucugccaaaggucccugacuucuucuggccgcugcugggcagccuuacuccccaggaucacacgucccagcuuguccugcaaggagaaaggagggcauuggucugccuacauguccuucaaccucccagagccucccucuccuugaaccuaagaccucacaauguagccccgggaacagcagcagcagcaagcccugagaagaguugaaccucaggcuaccacagaacuaacuacucaaucagacacugcauucaacauuaccaguacaggcauuaacaucugaggaacgacagugcauggacuuugccuauucuagugaugaccagcaggcgucuaaccgcucccauuugcacaaccuaaacuugcuuggcucucagaucagaaaggacugugcuuuuccuuuauguguccaucuguagcaccuggggaugccaagugacaccacagucccagugucccagugacagggcuaggggucgcucugcaccuuugacuccaacaagggucccuucuuuauucucuaaccacagcccacugcugccuccccaacucaccuugggcagguuaggaacaaacuuggugucaccaaaggacuuguaguugcccauguuggaguagaccccugcagcguagaccaggaaugccugcgcaguggagacagcauagcaucaaacauaugagacgacugcuuuuucccuuucaggaaaagguggauuuuuuuuuuccagggcauaccagugugggagaggcugagaaaucacagggcagaacccugacucuaggaggccccagucuggccgaauuuguugucacagaugaauuuuuacccccacccuacuggguagcaaaacugguuucagcagcuaccaaacacaccuaccuaggcuggugauagcaagaagcugccucccacagcuccaaggguaggcauguaagcuggcuaggccagucagagaaucaccuucucuugcuauaggcugacugagaauggcuugagaaaacugagagauggagaucacaucucaagauagcaugcaauaacugagucuaacugcaccugaagccuccucuagcccugguccuugcaauuaugugagcuaaaaauucuuuucuuguuguucuuuugcuuuguuuuguuuuguuuugugagacacagucucacuguguauuacuagcuauucuggaauguucuauguagaccagacugaccuguaacucacagagauuugccucugucugccucccaagugauucagucacaggcauaugucaccacacuaggcucauaauucucuuuaagccacuuuguauugggucucuguuacuuaccaacaaaggcaucccacuaaaaauaguuaacacuuggguaucacuuccuacuuacaggcauucccacagagauuugcucuuuuuaacaguagacgaaggcccacagacaggacgcaauaagcaaaaauuccaaagauauggaagaaauaguaaccuuggcucagaaauaaacaaucugaucaauuucacagaaaacuaggucacauuuccauauauuccucaugggaauguaauguguugaaccauuuuuaauaaaaaguucucacuauauagcccuaacucgucucaaacuauguagaucaggcuggccuugaacucacagagauccugcuacccuugacuccagaguguuaaaauuaaaggugugcaccaccacauguggccuuagaagauaauuuaacacaaucagaucauuauaaauguucaaagccuucaacccagcauuccuaucucuacaaauaguucccacuuacacgcuuacacacuuacacgagaaugagcauuguggcauuguuugaaagaaaagcuagaaaccgggcuggugagauggcucaacagauaagagcacccgacuguucuucugaagguccugaguucaauucccagcaaccacaugguggcucacaaccaucccuaacaagaucuggcgcccucuucuggagugucugaagacagcuacaguguacuuacauauaauaaauaaauaaaucuuuaaaaaaaaaaaaaaaaaaaaaaaaaaaaaaaaaagaaaagcuagaaaccaucuaaaauauucagcauuuaaaaaaaaaaaaaaagaggcaaguggauuucuaugaguugaagccauccuggucuaccgagcaaauuccagaacagccauggagagacccugucuugaaaaaccaaaaaccaaaacaaaauaaaacaaaccaaacaaaccaaccaaccugaaccacccaaauacuuauuugauuacauugcacacugcuuuagaguguuucacggccaauaaaugaaguggacauugccuuucccgguccuacaggauauacacccaauggagauucuccaggauacagggaucugcaaaaugggcaguauccagaacaccgagaacaugauguaagaggucaaacagggcuggggagaggcucagugcguaagagcacuugcugggcgagcgcggggaccugggucugagcaugcagcacucacaucaagaagucaggcacacgugaccaugcacacgugaccucagcacugggaggaagguggcuguguacaccgcccaucaugggagcuugaaagccagucagccuugccagaacaagcuccagguucacuguaagccccuguuuggggacugaagaaauggcuuaguaauggagagcuugguagaggacccaaguucaguuccuagcacccaugucaaauggguccuaugccucuugccucugugggcaacacgcacugacaccacauacacauaagaaaacaaaucuuuguaaaagagauccugccuccagggcguauacuuuucugcuggugucuauguuugacacuugcacauguacacccaagacugucauuucacguuuuaaaaaaaagugaguuaagccaguggugguucaccuuuaaucccagcacuugggagacagaggcaggucgaucucugugguuaaggccagccuggucuacagaaugaguuccagguaguuuaaaugggggccugauauacugugcacauacaaguaucaguauccaaugcacucacacagaauggaaaaggaccagccacagugccugccucugaaaagacugaacaagugugaccuuuuguguuucguauguuucugaauugaugcaauauaauaagauucaaguaugguauuuggcuaauacauccaccaacaagaacuaagagacaaacagaacauucuacccuugguaucuacccaggcugccuuccucugucccucaguaucagguguacagucauggcagacugcuaagaacuaugguaucuaggcuggccucagacucacagcaaucuuucugccucagccucucacguaugggaauuaaagaugugugccaccaugccuggcuuguuucccuguaucuugaagcaggcacuacacuaauggcagaccauaugcacauucuacagaaaacaagccugaagcuacagggcugugugugugugugugugugugugugugagcuagcacccuuuagucuaauccucuaccuaguuggagagagagcccuaugccccuuguuccugguccuucgcacaucuccagaagccccucagaagccaggcgagccugugagaacugaccugguacucuucuucaguaagacccucagccagggcauguuggcgcagcuggucaggguccugggcacggaagaggcggcuaagcagggcauagauguagggggcuucaggggaugucuggagcagcacugccaggcccccauaccaagcagcucuagacaggugaugggcauagaggcgcucugugggugacagcaggcggaaugccucccugcaguccaggcuagacacaccaaugucauugggcaggauguacuggguaucugccaugagcccugcaagaacacaucacagucaucucagagagcgcagcaucuucgcggcugcucugaaagcucaugagcuaacuaacuucuuccauccagaaguccaggagggaguaauccagucgcauccauucaccugaaaugcugggauucaaagacucaaauacuugcgggccagcuuuggccuguggccucucagacuuaaaaucugaauccaaucacuucauauuacagaugaggacacuaaggcccaggaugccaaguguacgaaggaagaaccggcagaacacagccucauuacuagacucccagccccagccacucccugccucaucuccaccuucucagauguccuagucucuguucagaauuucccaacaccucuagcucaucacaacugcugacaaaggcuucaugcuggauauccaccccaccgucccaaccccgcuccaccaaaaggucuaaaacccagggcagccgcuucaccucccugcacugcucuuugcuccucugcaacacugacugugaguaugacaccaagcucaacagcuggguaugaaauccaggacagggaugugacccaguugguagaguuugucuaaccaacaaccaggcccagggucagauuccaaggucagucugggguacauaaaaccuugucaaaaaauaaaucaaaaacagcaaugauauuuugucccagcuuuucccuccuagcaucugccccagucucaugucuuucuucagcccuucacuauccuguuuucuucuguugcucuguugggaagccauauaagggcacaacccauuuuccagauaggaaccauaugacauuuggaaagcaagcaacuuauccaaagcuuuucagcucaguugggacccaaggaauuccgaacccaccacauucuccacgcuccgccccuggcuaaggacacguuuccacccucuguacuccuuauuugcgcggcuccgccccaucuaccccuucgcucggaaagagguguuaacucuuuacugccuggaaauucuccuugcccaaaagcugggagagauuuggaagaggcacugaaggguggacagaaaggggaugaucuugcaugcacagccaggccucgcucugaucuccugaagaugacacaccgugaccccaaaaccaaggcgcuguaccucaccugcugcagcugcuccguucgcaaacucacuuccugcuuccggcuccccgccccauucauugggacaca

SEQ ID NO: 9060 - RNA, 13413 nt, Mus musculus
cuugccauauagaauuucauuuaauucuugcaaaaacccugagauaacauaucacuguuguaccaauugcacaggugagaggaccuuugauuuuauaagaccuuccacuauacaguuuccacuccugcagcaacacacacacaacacacauuuucucucucucucucucuccuucucuuucuccucucucuuuuucacacacacauucucucucuccuucuuucucucacucacacauauucucucuuccccccaccucucucucacacgcacacacacacacaccccacauucuguuuuaaugggucauggcuuuucuguacguuugcauccaucugguaaugaaaauacuuuuuguuuuuguuuguuugagacagggucuugccauguagcccaggcuagcauugaacacagcccuccuuccuuaaagccuaccaaaacgcuggaauuaccagcacaugccaccaugcuuggcuuuagagauugucauuccauugaacaauccuggaaucugaagcuccgagcucuggcuucuaccaccagccugaguucuuccuagagcccagucaaguacguuuuguugguucuuucucccagagucugagauucaacaccagaaaugagaucggaauguguucccgugccuggaccccaacaugauuguuagcaagaacuggguagaguuccauuuccaguguuucguggaaggguugaaauauccccaacaguucugccaugcuucgcacuguagccauaugacacuuugacuacccuuugguggcucccuaucaacagcccaucuggucuuuauggccucaaccagcagcuguguggcuuuagguacacuccuguggaaucuucgucucccugaggcucuggcuucugucuugcucuaaggacaucaguccuacacucagagccacuuccuuuuuuuccccucucuauuuugucuaccaguuuuccugguuuaguuuuccuuguauggucaggggaaaaccccaucuuagcccuuggcucaaaggaagcccuggcucacacaggaggcacagggagggacucaucacuaacuucacucucauagucaccaaggcccaccaggucccagccuaacccuggucccuucuccuuuuuucugcugaccugcauguuggcugugaagccuucucccugccgucuuauguuaguucccucacccaggcugcccuccauacuccauccuaucucuacagugucugccauucauucgcacagcaaccccagcagguacagauggccagcaggauguuguaauccuagucuggcaauaguccccuaggucccuccucugaccggaagcccuugcucaucgccggggcucuuaugacccuaggcacugguugaguggauagcuaucucucuguuucucagcuuucccaggaaacagacccuaaccugccuugccucggucuugcccagccuuaguaugaucugagaggggcgguuguggcuuucaauaacagcuuccagcuagguuauaauucucgcucuaagaacccaaguagggccaaucuccuuucccagaucacuggauuaaauaacaacaucuuggggaagcagagcccuggugccguggaugcagcugugguuccuguuaggcuggguggggcacgcagugaacauucagcagugguagcccuuguuucagagacggugcuggggagcaaugagcugcccauaaaugagggucugaauucaccauuaugcauagccacaccccgugcuccccuuaaucuguuucuccaccccugcuucuuuacccugaaccuacgcgaagaggguacagaccccuuaccuugugggccuguaagauuccaagccaccauggaggcugagcuccuguuuuacccaccuccaugaagccucuuacuuucccaaacccagcaagggcugcucccaagcccuagaauuccccgauccaaacaaacaugaagcuguccacccuccacuagguagagagccugacuguccaugugucccccacuugucacuauccugccuguacuggaagucagcaaaagcugaucucagccugccugccugcccacuuguuacuuacucacuaggggcuggagguauugcaugcauucgggacacguggaucuuuaagggcagcugagcagcaagguuuauagaguaacccacggcagcagcagcaggagggaggaauagcuguuccugcauuggcagguucagggcacaaccagucuaagcuggaggucgggggccauggccccuucauucccccaggggcacaguguaugcggcaugauguaggguacuccagggagggcagaggcauggggugcccuccaucagccuggggcagagcuggugcuaaagucccuaucaguaugccugggaucgagaucucagugacccucugagaggcgagagccgaggggagggccacagcccauccaaugcuuccaacuggcgugguuauugccagcaggcagagucccacaugcagagcucccucugaacagcaggagaugggggaccugggugggcaggcgagcauggcagcaagggucccggagagccuaguccaguggccccuggaaaaugaggcggacacagccaagcucaccggugagccaagcuccacagaaggggcaggcagcguggaaagcaugggugccgugcggcagcggugucugagcccaguagcgggcagucuucucagaacagacguggccacagggugcaaaagcguggcuggguggcccaggguccaggcagagaccggccuccugaccgagccacaggggcacauagggucccacaaggcggcagagaggacacucucgcuccugggggccuuguucccuccggcagccccagccgugauagccauggacaugaccacaacggacguagacccaggguugcuguuugucgggugcugugcggccacgggcugggcuggggaaggccaaggugcuaaggcccacggggcacuggggccgugcugcguuggccuccugucgcugggccucuaguuguuucagugugggugcccucagcaacccagccggagugcgccacaacaguguggccccacacaggucgaugagcgaaccgucuugcaggacguuggauucguuuuccaccugccggaggcagcagaaggccuuagcccaagagcucucuggcccugccaacgggcagccucaccccagagaagccaccuaucuggccagugacauucccugaagagaacacccuaggccagcaggccagcugagacaaggaaggcagaugcccccaaauacauacagccccuuacucucagcagggccugggcuuugguaucuccacaggucaaaucaggaggucuggcccaaagcaagguuuuuuccgaaacguuuuccaaagcucucccagaaugucagaaguaggauaugacaaagaaaacaaauacuuuccauggagaauauggguacugagcccaaagcgagugagugucccacaggccaagaaucaaagcaagaacucuagagccagagagccccaauuugaaucccgaucucgccauucacuuacucaggguuaccaagaaaauaauuuaacuucuguaucuuggucuccuggaccucaaaguggcuuccauaucucaagugggccuugugaauauuaaauaagucaacugaaaaaacauggaccaaucgaugccugguaaacagugggcacauaacaagcauauaucuguguuacauucaugugcgugguucguuuuguuuugucuuuuucauuucuaacuuuaugggugucuugccugcacauaugucugugcguuacaugcaugccuggugcccauggaggccagaaagagguguuggauccccaagaucuagaguuauggauggcuguaagccaccaugugggugcugggaauuaaaccugggucuucugaaaggacagccagugcucuuaccacugagccaucucuccagccucugguuugauugugagacaggcucuugcugugugugcaggcuggcugagaacucauaaucuucccaugugcugacaccuggggagaauucuguggcccagucaaugaacagagcuauacggcccuauguuuuuuccuaaaacuuacucccagcucccaacacuagugcuccgaguagcaucaaaggggcacuuccugaccagcaguguaagaauuacucccaaggcccucuuacuccugcugggagagauucacacccuccccaaaugugagcgacacacuugagcugccagcacucugggauacacacugcucaugcacaggccaagggucacccuuggaaaacgcugugauguucuaagcugcuggcagccucagagccauuugguuccacacagugcauuugcauggcucuguuacauaucaccugcugcauccccagcagucucaaagcauuccuagggaccuugcugugguccugucugugcaguaggugacaaguguggggaacggucugagccuggagcucaccgagcagagccugguggaacucucucagagagaagcacuguagaucaucucccaguguggaaaggcaaggaacugaugcugggggccugggaagaguggggagaaauggaggaggccaccuaccagcuucccccgcugcugagcugaucggcuaucccgcagcguguacacauucccgcagacagaaaucucccuccagacaccuggggcagaguccucggagaagccaccugcugggugcaucaccagaaccccauugguugucaagccguccaucagaccauccggaguccuccauuuggcugcccgcuccuaggaccacaugaaggauaagcucacaacuccaagaguucccagaagguugcaugauagagaugguguuaaaccacccccacccccacccccaccccccacccccggcuuccaggucugggguuucccagagaguauuucagguccugggcaccacuugaccucuuuguucuucccuuugcuucuucaaaaaaaaaaaaaaaaaaaaaaggcugcuaagccuuacgggagaguaaacaggaggauggcuauguacugguccaucacuccaggaugcagcaucuccccagccucccuccccucagcucucuguugaagggcuagccauacuggggggaaucacucacuccaagaaagauguugcuagaggcaucaaagccagcagcguagauucgggcaguauaggguggccggcggucacagagaauucugcaggcauagcgggagaugguacuuugggcagaagggcccucuguagccccuccaccaggagaugugucuguuaccacaaagucaaucauguuuucaguagagcggccaaucuauaaggaaggagggccagaacacaugcacaggcaaauuucacagugcucucacccauugucacccauagcuaccaaaaaaugaagaugcuaguccuaaagagaacagugcacaacucuagagucuagacccugugggcuugcgugcaggucucugugguaugaaccaacuucugcucuguggcccacagcucugagacacacccucacucugccucugccuccauguccugggauuaaaguuguguauacaacuacccagcucuuguugcuguugcuuuuauuaagcagggucuuacuguguagccugcacuggcuacgaaugugcuauagauagcagguuagcuucaaauucacuuaucucuaccucccaagugcuaguauuaaagagguaagcuaccauacucugcuucuuauguuugcauauguauguguuucugagugacuuuauugcacuacaugugugcaagcaccuauguaggccagagggcaugggcucccugggaacugagucacaggcagcuauaagccagcagauguaggugcugagaacugagucugaguccuuugcaagagcaagaagugcucuuaaccucuaaccuagcucgcuaggccuaagcuaagcauuuuagguacaagaccucagccacucauggggugagacuacuaugggccucauuuuacagaugaggaaaacaauauucagagauguuaaaugacuccugcccacagucacccaaugcuaagugcacagagcuagcaccuaacuaggcaugauggggcuucccccuuauacucugaacugcaaagcccuagagccuccuacucuuuagaagucuugacucugagggcugcugacuugguauugacugcaaagucagccaccccgucuaagacauccuacuuuccaucugaagggcguuccacuacacugagugcucagaaacaucuuucccaggcccuuugccugugaccugauccugaacaccugcagagcagagguuggggggcuggacauaccuggaacaugucuuugucgcugucauguguguacuccacuaugacugagugacuccgggacagugugaaugagaugcugugcuggccucgguuacucagggccugguggagagaaggcagucacuucucaggguacaggagagguguaaacuucugauccagaggccugcucuaggccaauagccacucccaggaagggaaggcuccggccuauacagaggagacuuguauaaaaggagcucugaacugguucucuuguuuaauccuucaguuaccucagaaaaaaugugccuacugucccauuuuuacaguuggaaguuacacgucagagaggagaacuggaccucagucacagggcugcagacagaggagauuuaacuuccacacuaacucucugaagccaaagguuucucugugguacuguguguaggagcuguccuuaguugucagugucuggaaugaacuaaaacccaaugaaugggcgggcacaccugugagggauuuuugcuucauuaaaucauuugaaguaagccggacgugguggcacacaccuuuaauuccaguacucaggaggcagaggcagguggauuucuaaauucgaggccagccuggucuacagagugaauuccaggacagccagggcuacagagagacccugucucgaaaaaaaaaaucauuugaaguggugagacccacuucuaaucuggauauuugagguaggaagacaaccuuuaaucaagaucuuaucaagggggaaaauccaccuuuaaucugggcuacaccuucugcuggcugccuauccacaaaggacauagaggaagaagcucucugccugcuugcuuucccgcucccuagcagguccauuccuucacuggcauuacaguccacuuuuuugggauucaggugaagaucagcugaaacauucauccuuauacacugaacaucugcuggcuucuuggacccuccuuccauuggcagacagccauuguuggauuagcuggaccacagccuguaagcuauucuaauaaauucccccauaggccaacacaaacagagaaagacauacaggcagacagagauucauucuauauguuccauuucucuagagaacccuaauacauugugugacaucacaucccacucuuggagcguuggcuaccucuagaauaaugcugauaggugcuagagagaugacucagugauuaggaucacuggcugcucuugcaguggacccugguuugauuccuaacacccauauggcagcuuacacggguuuguaucuccagguccauaccuucuucuggccuccacaggcacugcaugcuuacagugcauacacauucaugcaagcacucauacaucuacaaacauaaaaauaaauuuuaaaaauguuaauaaguaaaacaucuaaccaacaaauggggcauggcagccaagaaguauuugaaaggcuguuagggguugggcacacugcagaggaugucuauuaucaccauuuugggguguaucuguucugugguacacgugcaugcaugugcaugggugugcccacagaggccauugggugccugccauuaucccgauuuaugucugucacugaacccggagcuugugguuuuggguuaggaugagagccagcaagccccagcuaccuuccugucuucgcccucaacaguccugggguuauagccacacaugcuuuuaauuggcaagugcugggaauccagacucaaauccucgugcuugcacagcaagcccucuuacccuacugagccaucaucucuccagacccaucagcaccauuuccugagugaguaaugacccagugggcuccccugcuccaaagaggccauggcagguaaaagacugaagaccuaggucugggcacaaaggacaggauggcguucagucuacugggaggagcggcuugccuuggagacgagugguguggagauguggugcaugacaucuggcuucacuccguuggcauguggccggcggcucagugccaggcggcuucggcggcggcccuugucuccacuugccagacacccauuguagcuguggaugugguggugaagagaugguggaaggagagaaaggagagagugagcccguaagagacccgaaggaaacugccaacuuggggcagacccuaccuugaugaacaagggcuagaaccaucuaaaccuagaaaauccccgaauggcaaauggcuaaauugagggguagcaggugggggucccuccuuuaaagggccaaguguucccugcauaccucagcuguaacagcaggugcuaggguggcaaagcugaugcaccacggccaugcucaguggaggaaaggacugagccucagcuucucagggaacccaggcaccgccugccaugacccaggcacaagucaagcacacacaaggcccagugggaggaggugggaauaaccccagaaucaggauuccgggagaggaaacaccuauguugggccuugaagaacuguaaagacuucaucugcagcaaaggagcuuucaucauacggcguccgaaaaugaccaagaagaaaacaccuucuaauuccuccucauuaucuccacacgugucuaauuuccaccuuucuuuccagcuuuuauucagggggaaugaccaugagaaucaaggcugaggugagccauugccuugauugcugcuggggauggcugccucuuuuccugauccuucguguuuuuaauuaccuaauggaaucugcagaauguccugccaggcaaauggcuuucuuccuacuuuauaaauuagacaagugaaagcccagggagguaaaaugaguugucucaagcuaagaagcaaagacaauaacagcagcagcaacaacaacaaaaggcuggacuguggucacuggacuguagucacacucaccuagauuugccaaaaauuauuggguuuugagccaaggcccugaggacuaagauuuagugacuugggugguauagugauaagaauaacaagcuaagaaugcuuuucucuaagaaguggggaggcacagaaagcuuuggagaagaauaucagaaguggcugaaccuagggcuggggguggagcucgguggguagaguacuggccuagcaugagcaacacccugcguuccaaucccagcaccacagaccgaagucugcuggcucaugccuguaaucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccugcagucccagcaccacagacugcagucugcuggcucaugccuguaacuugggaggaauacagaucaggagcucaaggucaucuucagcuacauagggagagugauggaagccggccugagcucugugagacccugucucaaaaagggagacaagaagaugccaaauauaggaccaauuagaauuuccuggugaguuuguuuaaauucauauucgcuagacccauccagagauucugccucucgaggugugggguucuucucuauaucuccuauuuucuuuucucucaucucucuccuuuauucccucucucuucuuuuuguugauuuugggggcaaccaugguugcucccucgugagugcugggagucaggugugugcacuacgccagccucugugauuuccauguguucccucguagcacugugcacaguguggcuucccuccuccucuuaggacagagagcugccuucacccagauagaaauacagcccuucccucugucaggacgugaagcagcugcuuuucagauauacgcuccuccaugaggaacaucucauuuacccuugugagcacuucucacguaccagcaguggcaagccuagagggagacaggccaggauacaggcugagggcucacaggagccuggcacacauccacucuucaacucaucacacaaccucuauaaaauggaacucaucugucagaaccuacuuggaauauugauuuugagaacuaaacaagauaaagugcuuuaaaaugcuugauagaguuugcuacucuuauagcaaggucuugauaugaguuggcuauuguggguauuugaaaaaaggcaagguggcacauaaaagugaccaagugacagccagugcuacauaguuaaucuucaccaugaucugacagcggaucagcagagggagacacaucugugucugggggaaggguuucauggaagaugcagguguccaggcaggcaaagaccagagcaagccccaucgauuucucuguaauaaccuccacuuucucgucuguaaugcgaggaggagcugcagcuuaguguagugugcuagaccuacaauuaagaagaucuggguucaaaucccaacccucccacuuaugagcugugugcuuuuggaccagucacuuccccucucugagccucauuuacuucaccuccuuccucgcagcaucuuugugaggguugagaugaaguaauguccacaacuucguacuaccugccucccagaugcuugguaugugcugaguaccagucuauguacuuuacaaaaaucucuuccaccuuucuuucuuucagguaagcuuugggaggcuagaaucaaccuugucuucaaaaugaggacacaagccgggcgugguggugcacgccuuuaaucccagcacucgggaggcggaggcaggcagauuucugaguucgaggccagccuggucuacaaaguggacagccagggcuauacagagaaacccugucucgaaaaaccaaaaaaaaaaaaaaaaaaaaaaaaaaaaaaaaaaaaaggacacaaaagcacaggaaaguuugacaacuugcugaaguagaauuggaaccuuuugugcagaaucagaauucuuuaucccacacuuacacacaguaggugcuuuacagacucuuuuuuugcuauucuuuuucuuagcugauuacaaacuguggugagcagcuuuaagaauugccuccggcugcugguugugguguauaccucuaaucccaguacuugggaggcagagacagguggaucuccgaguucaaggcuacccuggucuacucaucaaguuccaggccaaggcuaugagaaacccugucuccaaaacaaaacaacagaaauggguuugaucacuuuugcucuucuucugggaaaguggcaagaagcagagaguccugggagagcagccggugcacacuguuaucuuggcugaccugagggacaguuacccaagcacaucacuccuggacuagggaggcucaccccagaacgaugaguucaccauacuugaugggcuccucgccugccagugcuucuucaccaggacaagacaggaugcaagagcccuggcuccccgggugcuggaggucugagguccggggggaucccacgucaggguuuccuuccagcaccauucugagcacagugggagaagagaaaagaaccuugcaacuucccaccccagcuccucucaggcucuggcuagacacaaggcaagaaugguccgucaacacuuguuauuauaacuacuuccuuucccccaaauggugagguugcugggauaccaaggagggagacuggugagacaagaccaagaaacaaauggcaaaaucagagucagaguguuuggucgguuagagcaauauaccaacuuuggauggaauguguuuggcagaggggcagccaggacuuaagagaccucuagacucagacuuaauuccuggcuuaagcucuuaaccccaagaccucaguuaagcucucugucagguucuugggugucugucuucauucuaaucuuauugcccuuuuugcagcaggucuaggccucugucagucugucuguucucaaugacucucuguccucccagcacguccuuuucugccuguucucgccccacuccggucccuacuucuauccuuccucuaucugucugccuuugucuuaccacccaccugacucagucucccuaucuuagccuggcaaugcaggcaggccuccagaucccucccucccucaggugucugucugugguccucaggccgcuuaggucucuggaggccugugggggcggcgcuccccagucgggcaccuccugcagcagagucagucgcccgcaggcuguuaacagccccaacguuggaaggucugcgcagaggcaggccugcaccccgugcucgggaagggcacaaugacagcauacgcagauacacaccaggcggccccucacaaauacgcgcgcgcacgcugucagucccgcgggcagugccuagacuggcacagcauacccaagaacuccuacggcagagacgcgccuccgcgcuaacagccacaggcgccagcccucagacccgcucucuuaaccccgccacccccagauacucaaacacgcccccaacgcacgcccaacacagccccccgccccccaccucgccagccucaccuggcggcguucuggggcucucugugugcugcuggcccccacccgccucaccucuacugcgccccgggacugccgcggcgggaugggcccggcccgcggcugcucggugcagccucgucacggggacacccgaggcccggaggagggagggaugugcacacaaaccuccacgccccaccccuugccccacg

SEQ ID NO: 9061 - RNA, 4937 nt, Mus musculus
ugagggauuguguguacugaaaccauauagguucucguccugccuucagagcgcaaaguucaauuaauucuuaaauuccguaauuggucuuuaguuggagagcuguaugccugaaacaagacugcucuuuuuuggucucauuuacccuagccgaacacgagggcccuucaccucugacccaaaauggccgcgcccagagcguaguucuuugcuucuccgaggcgagcuaagauuaaaauccuacaucauguccaagcuaagccgggccacucggacccucaagaagcccgaggccggcggcgugauccgguccaucgugcgagcaggccaagcuauuccugggccuccacuaggucccaucuugggucaggugcggugugcggaacccggccugggagacgugggagagugcgcuggagccggggaagucuccuuuauaaacguugucuccacuauucacaccuucaggccuuauguccuuguauuacuuacggagccucuuuugaccucagcaccucugacccccaaguuggcuaguugcugauuaagugguaccuuguggacgaauugccuggcacccaaagcuauagaaccagaguagaagaaauauaacaacacacacccauacccccgccccccccccccacacacacaaagaugaaaggacaggggcuccugguugguagaaagccuucagcucccauacuuaacuuuguguaugcguuccuuauagcgaggugucucuaucaaccaguucugcaaagaguucaacgagaagacaaaggacaucaaagaaggcauuccccugccuacaaaaauuuuuauaaagguagagagacccauucucccauauauuuccuuggcccuugaaacuagucacucugguugcuucucugacucuuaacuugguugcuaccuuccacuuaucauuuaaacagaagccuagaccauaauuucucugaacuggcuugauccugccauauugugguucuuaccucucaucucacuggggcuuccagaggagauuugggcuaggaauaaaaauggcagggaugugugcuguagauuuguuuuucugucuuuuguggugugcaaguuggugggagaaggaaagggacauuagaaaugucuuggacuggauagaaaaccaagaaauucucauguaucuuugucuguuaagcccgacaggacauuugagcucaagauugggcagcccacuguuucuuacuuuuugaaggcagcugcugggaucgagaagggggcccggcauacagguaaggacuagagugggcaccugagagucugauguauccagagaaauguaguggcacuugaagaauucuuugcuccuucuucccagggaaagagguggcaggccuggugaguuugaagcacguauaugagauugccugugucaaagcuaaggaugaugcuuuugccaugcaagaugugccccugucuucugugguccguuccaucauuggcucugcccguucccugggcauucgaguggugaaggagugaguaucuugagaggaauccaaguaaguucuucauuugggaggaaagcugagaaggcccauuacagugaggugguugggcuuuauuuguucuucuuaauuuauagccuauguuaguuaugcauauuaagcuucauugugacauuuucauacaugucuagcagauucuagcagaaggauauggguugaagccucaucuuguuuggaauauauuucauaagcaccuguucuguccuggacauggaucugggcacuggcuagaaccaggaauggccaguagugccuggccacucuggagaaauguguaguccuaaaggccgacccauacauagaggccuagacuagcaggugucaauguuauaaaaucaauggaugucaugcaagcagagaggagauuuccugcuuuuaccugaugugucauugaggacucugagggaggugacauggaaacugcccaggaaaaggaggguaagagagcguaagauuacaaggagagggaaggagcugaagcuaaguucacucuggucgaggagucuugucuagaggcauaugggauguggccugagggagggacgagucagaagguucccuugucaaguaggagagcauuugccccagagcgcagcagagacaggagcagggacagucaucacuggccgcuugcugcuggugucauucccuacagcaagacuggcgucaguuguuccucacgggggugagguuagagcacaguuuuccuggaugguuuaaauccuuaaaguauguagauuuguggcucaaaggaaggccuaagaaaucccaaugguauaauagaggccacagguuagguaggacuuuaagacagagucaaggcagaggaagguagcgugugugaguugugguuccaggaagagaaaccacagaugaguagagguaugacaguuggaaaguccagggaggggaguggacagggcagcugggaucugcgccaggacccgcuccucacugacugucugucuccuucuguagccucagugcagaagaacuggaggcuuuccagaaggaacgagcuguguuuuuggcugcucagaaagaggcagauuuggcagcccaggcagaagcugccaagaagugaccccaacuuucuacacucugagaauuugaagugagaggcugagaaagggggccacagaggaagcugagccaaaggacuucauggcaacccgauuucuaguuuccugacauguuucuguacauuugcugugccaggggaucaagccugaauaaauauccuuugucaucaacucucagcuucucuccugagaccccagagauggggaccaauacugacaguucccagccuucacaggugugagcugcccuacaggugaacgcagccucaaccaagcaaauuaucaugcccagugccuuggucagccuuguauuauaucaaaauaaccaaagcuuggugcuuuauaaagaaaagguauugauuuggcuucugauucauggugcuggaguauggcaaggcucacuugcuguaugacagcaugguacaguggaaacagucacauacauagggccaucugugugagguagccucaccuggaccaguccccgccuuaaggccaacauuagugaagguuggacucccagaccccuccgccagaccacacuuugauuuauucauuuuauaugugacuguuuugccugcauauaugugagugcacugugugcaugcuuggugucugucagaagaggguauuggauccccuggagcuggauuuauggguaguugugaaccaguauguggauccuggaguugaaccuggguucucuguaagagcaacaaacaagugcucuuaccuccugagccaucucucuacucuaucccccuuuuuugagauaggaucucuggauauccuugaacucacggagauccaccugccucugccuuccacauugcugggacuaaagcuugcaccaccauacagggcauagcccccacuucuuaaggauuccaccaccuuccacacugggaagcaagccuucagcccaugagccuccggggcacgugucguaacauucaggcucugaguagguacaaguggaguagagcccagggagaaauccuauguucaggguugaagauguuguuuccugauggagcugcuccuuacacaaagccucaacuucuauucccaacacuucagagcacauaagccugugcucuucccucggggaugagagaaggcacagucgaugggguccacagacacuaaggcuuggcuguguugcuugucuuuucuuaguauaacuguuggggaguuuguaucugagaagcaggagccugacagagaauucagaccacagauaggguuauccuuuauccaggggcagcuucaggccucccugcugaguugacaugauuguuucugaggcagaaucucauuauuuagccuuggcuggccugaaacuggcuggcuaggcuacagccugaccucucagugcuccaguuaaaggugugcauuaccccacccggcuccuuacuaaguuugguuauuugcuuuuuuaaaacuugccauuuggggcuggagagauggcucagagguuaagagcacuagcugcucuuccagagguccuguguucaguucccagcaaccacaugguagcucaucaccauauauagugagaucuggugcccuccucuggcuugcagguauacaugcaggcaaaacacuacguaguaaaucuauaaaacaaaacuugcugguuuuuuuguuuuuguuuuguuuuguuuuguuuuaaugcuguuggagaugaaacccagggccucauucagccagagccaggacugugucccucucagcucugccucugccaagcuugugaaucuacccugggucagggagaacagccgaaucacagcccagaccuacauaagugaaauuccaguagacaccugccugagaaguccuuguggacccuugaccugccugagaaguccuuggggacccuuggucugccugagaaguccuuggggacccuuggucugccugagaaguccuuggggacccuuggucugccugaaaaguccuugggggcccuugaccugccugagaaguccuugggggcccuugaccuccuguuuucccauucuacaaaacaucaaguguucucucagaagagaggcagaauugacaggaaagaugaagucuguguuugccguguguugcaugcugggcauuauuuuuugcuuguuaacauucugaacaauuuagucaaauuuucacauaguauuaauaguucaacauuguuuacuaauacaauuaaaacuuuuauuacguguauaaucuauuauauauagguauaugucuuuacacacuauuaccucuuacuguugagacuauaauauaauuacauuauuucucccuccca

SEQ ID NO: 9062 - RNA, 1433 nt, Mus musculus
ggaggaugaagaggagcccugggaggacuuugauggcaccuggacagaggaacaggggauccuauggcuggcaccuacacauccaccugacuuuggccugcccuauaggcccaacuucccacaggauggagagccucagagauugcaccuggagccuaccuggccacccccacuuagugcccccaggggccccuaccacuccucaguggugucugccacacggcccauggugaucucugccacucgacccacacuaccuucugcccacaagaccucuguuauuucagcuacacgcccaccccugagcccuguccacccaccugccauggccccugccacaccuccagcuguguucucugagcaccagauccccaaaaucaaggccaauuauccagaccugccuuuuggccacaagccugggauaaccucggccacucacccagcacggucuccuccguaccagccccccauuaucucaaccaacuauccccaagucuucccuccccaccaggccccuaugucuccagauacccacacuaucacuuauuugccuccaguccccccucaccuugauccuggggauaccacuucuaaagcccaucaacacccuuugcucccagaugcuccagguaucagaacccaggccccccagcuuucugucucagcucuccagcccccucuuccuaccaacuccaggucuucuguccaugaaacuccugugccugcugccaaccagcccccagccuucccuucuucuccccuccccccucagaggcccacuaaccagaccucaucuaucagcccuacacauuccuauuccagagccccucuagucccaagggaaggaguucccagucccaaaucagugccacagcugcccucggugcccuccacagcagcuccaacagcccuggcagagucaggucuugcaggccaaagccaaagggaugaccgcuggcugcugguggcacuccuggugccaacaugugucuucuugguggugcugcuugcccugggcauuguguacugcacucgcuguggcucccacgcacccaacaagcggaucacggacugcuaucgcugggucacacaugcugggaacaagagcucaacagaacccaugccccccagaggcagccuuacagggguacagaccuguagaaccagugugugauggggugcagaugccccuuugugggauagaagaaaaggacuugcuuuggacacauggcugagaccacaccaaggacuuaugggggcugcccagcugacagaggagguucuguucuuugagcccagcauccauggcaaaggacacaccaggacuccaggaccucaaggggugggugcugggaucuucuccaauaaauggggugccaaccucacccaaaguucaucauccccacugaugccugagggaagggucugggagg

SEQ ID NO: 9063 - RNA, 1433 nt, Mus musculus
ccucccagacccuucccucaggcaucaguggggaugaugaacuuugggugagguuggcaccccauuuauuggagaagaucccagcacccaccccuugagguccuggaguccugguguguccuuugccauggaugcugggcucaaagaacagaaccuccucugucagcugggcagcccccauaaguccuugguguggucucagccauguguccaaagcaaguccuuuucuucuaucccacaaaggggcaucugcaccccaucacacacugguucuacaggucuguaccccuguaaggcugccucuggggggcauggguucuguugagcucuuguucccagcaugugugacccagcgauagcaguccgugauccgcuuguugggugcgugggagccacagcgagugcaguacacaaugcccagggcaagcagcaccaccaagaagacacauguuggcaccaggagugccaccagcagccagcggucaucccuuuggcuuuggccugcaagaccugacucugccagggcuguuggagcugcuguggagggcaccgagggcagcuguggcacugauuugggacugggaacuccuucccuugggacuagaggggcucuggaauaggaauguguagggcugauagaugaggucugguuagugggccucugaggggggaggggagaagaagggaaggcugggggcugguuggcagcaggcacaggaguuucauggacagaagaccuggaguugguaggaagagggggcuggagagcugagacagaaagcuggggggccuggguucugauaccuggagcaucugggagcaaaggguguugaugggcuuuagaagugguauccccaggaucaaggugaggggggacuggaggcaaauaagugauaguguggguaucuggagacauaggggccugguggggagggaagacuuggggauaguugguugagauaauggggggcugguacggaggagaccgugcugggugaguggccgagguuaucccaggcuuguggccaaaaggcaggucuggauaauuggccuugauuuuggggaucuggugcucagagaacacagcuggagguguggcaggggccauggcagguggguggacagggcucaggggugggcguguagcugaaauaacagaggucuugugggcagaagguagugugggucgaguggcagagaucaccaugggccguguggcagacaccacugaggagugguaggggccccugggggcacuaaguggggguggccagguaggcuccaggugcaaucucugaggcucuccauccugugggaaguugggccuauagggcaggccaaagucagguggauguguaggugccagccauaggauccccuguuccucuguccaggugccaucaaaguccucccagggcuccucuucauccucc

SEQ ID NO: 9064 - RNA, 5490 nt, Mus musculus
ugguuuauacguuggugagcuucuaagggggaagccggccagggagcaagcccagaacggaccggacgccugugcacccccagcccugccccucuggccacagaggccucagcccuggggagggaggaggcacuggugccuccagccucuccaccccccaaacugcugcugcggggacccccgccuucagagcucuccccuucugacuagggccaggcaaagcucuaaacgggugggggcuucucugcuagccugcagcuaggcauggcaguuguccuggaagggguaggacuuccgguuuuguccgcuccaggggaauuugggcccugccaacaggcagaccuugauccuggaaauacugggcagcccaccuuggcccucacccugaagcuccccgugcaggugggggggcaccuacaccaggaaugagcaggcucaacaugggggcagccccaucccuagucugcccuccccccuccccaggcucucucuccaacccagucucuacuuaucccaaauccaaccuacccugucccuuggaccuauuuucuauguugccuggaggaguccagcaccccauccccugacauuugugacaaaauaugaauaaacuacugaaaacacacaagccccaauucugcuucuggaaggcuugaacacauaggguuagguggaauauucuagaggugacaacccagagcuaaaccccagcacugugagccuugcccuacuugcucugggcuuuucuggaacccucucggaugaaucugaagccuuggaagucuccuuguagccacccuuccaucuucccuuuccagcuguguccgaugcgacccuuccagcuguuuuucaaagcaguauaaaagaugccucgaggaugcucucccagaauccgcuuacccuucucuuagaagccugaagccuaguccccugggcaaagcagauaccuauggcuuccccucaggucccaggaaccagggucaagccaaguuaaggaaaccaaaucuucaauguauggaaaaaugagugccaccuaaggaccagggaucaccggaccagguggaaggucagccaguauaugaugaggggcuggaaggcagcugcucccagggucagguagagcuggagacgcugccgaggggcugggccccccaugcugucagggccugaagcugcaguccgcaaagaucguaccuggaagagaggagagcugagugggcuaggaaggggaaugugucccagaggagagggggaggggccgccccacacucacaaugaaguacauaagcgcagaugauguccaggccagggccacguaguagccaucacugccgaagagcagccccgugagcacacuaaggaucauccugggggugcaggagugaagugggaaugaacugggggugcaggagugaacuggagguuccugagguuggagccugagacuagccccacccaccagggccuacaacuacccaguaccaugacccacaacacugggcuguucccuacaaagaaccagacuccaaauagaccugcaagguucaggacucagucccagggccuaaacuccccuucccuucucugggcuccccaagguaacuaacaaauccccagucucuuuaaagucacuggcuccaaggggagacugucagaaacagccaccaacucacagcguagagcuggcgguugagacggaguagaacugucucuagcaucacagugaaggcuguugcuacauaggcccaaaaccuguagccugagacccuucaggcuccucucagccugcaggcacucaccccacauauuuguaaccgcuguaagccaagagguggaagguacucaguucacugcguacgguggccagguagaggcccagaagcagagccaacaccuccaugaacacccacaccagugcugugcuugcacacaggcccaacaccucuggggagaaccugcagccaugggagaagguaggucaggguaggcccaaggugggugagcuaggaccuggcacagauucccuacagaggaagggacauaagccaggagggagaagagaauacuaaccuuugcugaaugccuagcgccauuccagccagcagcacguaugugaugaaggccauggcugccaagagaagagaagagaggaaguaguuccucuggcuuccucacccagagccccucauuaggcauucaaguccacuagugcuccagccucucccauccuucccucccugcauaucccaacuucacucuccaauguccuguccccggugcgccucucgacugccccuuccagcugacuacuacugggccucccaggaccauagccaucaccuucccucccauuaggaaacucaucagcucccugcaauaucuccagaauuaacaccacggucaagaccucugcucauccuagacagguaccagccugauuucuggcaagacuagaaccaaaaagaaagcuucauggacaacauaggcuguccuaggguccaggauucugggaauagggucccucuccaccaacaauuaugaguuugaccacuggccaugcagaaaccccugguuaacuaugagcuguuuucacaggagcucaaagauguagggagccaggcaggcuucagcagcaauuucaacuccccagacaccagguugauggagccaccagaaggcacaggacugcuaccuguaagcgauggggcaguuaaggccuuauagccuugacuucagcauaugacaaaggauggcaauaccagcuuuguaacagaucaugagaggaacagaggauggaacaaccuuagcggcugcccuuccugacagcuccuccagacagcucugcccuaguauaucugcuuuccuugugugugcccugagccugaaccuucuuagccaacaggacagagugaagugcagaggcaaguagguagccugacaagcgccauggggacgcaggcagcugugaggauccaaagucugaagcccuacagcugggaacugcugggccgagugaaacccugagcuccaggcuggagagagacaggguccacuuuaaaagucaggaaagugccgggcgugguggcgcacgccuuuaaccccagcacucgggaggcagaggcaggcagauuucugaguucgaggccagccuggucuacagagugaguuccaggauuccaggacagccagggcuacacagagaaacccugucucgaaaaaccaaaaaaaaaaaaaaaaaaaaaucaaggucauucaggaaguuuccuacuggucauccugucaacuuagugucuaguaacagucccacguggaaagcuccaggaaugaacgcugggucauuaacagaaucgucuuccuaacuaugcucaaggcacaaguccccuuuguggccaagccccacaucagagacucacuggggauauagaggucaggggcauugagaucuuuccgcgggggcagaggcacaucauggcuguauugcauuuuccaguucuggccguggcgagguggucggguaaacaggagcagagagaaagagagagaggguugagaucugaugaucagucagguuauccgcgaguggggagaggcuggccagcucuccuggugggaagcucaccugauguguguaugggaagaccaauagcccuagcuucuuagcgacauaggcuguguccacagcaaaaaaauacuugaguuuguucacggacacaaaacggugcagcuggaaguaaagagaagaggcuauggaugagcccuaccgugauccuuccuaaaggaugccuggggaguaagaugggauccugugacaccccaacccuggccagaagcccugccucccuccucccgggagcccagggcacaccucuuugugcacuauguccuucccuugggaugcuauggaggugccauaggccauugccauauuggccacugggucuccaagcagguuguugacacugaaggcuacaucagcuccuggggcuggguauccgcccaguuggcuggaauaaccaccacuuguaucaucgaagaguggaggagggucuggagcugcccggguccuaugcuuggaaccugcaggugugagaggaccaaaguagauuacagaauuacagagcaagaacccagaccacugcccuuuccccaggcugggaagcugugcauagguccuaaggcaccgaacaauugaggaaaaggcaggaugaguuuuaaagucgaucuccuauccuucggggggucagggugggggaucauuuacugcaugcagugggaaaggugugccuaaacauggcuacccauuugggguuucuaggaagucucucaagggaaaugaucucugaguacuagcgagugaaaagacguuugcuugggcacaaucaccgcaaagacauuccuugacuuaacacagguagaaaaggcaauauuggcuauucggagucccuggacaguggucaggaaugcugcccgaguuguaagagggaaaggaaguucuggaggcaaauucgguacaagcaggauuagacuugaggaucccaguagugcugucgcagccugaucucaggacuggcuaguaagggcgaaguccaggacacgcugcaguguggcagggcaggaacccgagagacacucuccccgcccugggcagcggucacugcagacccucuccaacagaaccagugggucucucagcguauuuggcuccccgcugccaggccgcgccccgcccuccccacuccucacgcaccguggacuccauaugccgaaugguaagccauggccgugacguucgcucuacccaagggucguggguacuucgcugagucguggguacgaacacuacugaaacagcuacuucucuugccugguccugaccgaaguuacccgacggcccgacacgucccagggcuguccgaucgcggccgccauguccuuggcgucacacuucgcugucuaccauuggcucgucggaagagcugguucucccccuuuacacuuucaauuggcuacuggugagcucucuuccaaucggguuuugucauauucaacuuccgacagauagggggcggagcuacucaagauguucucggauugacuaguaggcuggcuaauuugcggcgcuaccagccaauaggugagaaggaguuguaacuuaguuccgcgucugcgccaagaggcgcuugacgcuccuugccacgacuacgccaauaggaagauuaaaguccugaccgacccaacuagucagggcacaaagcuggcuccgccgcaaugcaguccaagaggaaugcggcggucggucaagcucugacugaucccugccccuacucugugcucuuuccuccaauucacuccauccuguuuuggagcuccggccugcuagaaauuguuguuguugcccgcaccgggagagugacagcgcggcccugagcccuggaacgcugacuccuccuccgcccucccacuccuuucagaacuggugcuguccgucgg

SEQ ID NO: 9065 - RNA, 1271 nt, Mus musculus
cgggaccgcgcccccuccccgcgggccggucggguccucccacaggccgcgcccacgaccacgacgacuccuccucuaggccgaccugcaaccgcuccucacuguccggcuugacugggucucccggcccaaccggccggcgccgaccugcaccuucugcuuuggcccggcuccggcuccugcuccugucccgcuucacccggauccucgaccgugagcucgucucgcugccuccaucccgccggccuucccagcaguccccgcgccgccuuaaaggugaagccgcuaccucggcggcgucggagggggcgaaacacgcuccagccggccagcucgcugccuuaaaggggccccgcaggccuggccggcuucgggguggggccagcccagacgggacgcagaggggcguggcuggacucgcccccucggaccagagcuuccaggucugugcgcucugcggagcuccgaccccggaccagagugacugaggagcaagaaggccgaccuccucagauuccagagcgagucgguccacauugauugacugucaaguguuuuugucgaugucuuagugcauugacuuaaugcucacaaagggcuggugagguggguguugccauuacccaccucucacacaucugaccccccagcccccuccgcgcucuagagacgcaccucuuaccggcuucggaggugacugugccuguagggaauucucagcaucuagguuugcuuugugagggaacagaaggaggcuucugguuaaaaaggagaauugggugggaaggagcguguggaggucgguggagaagggagaagauccacgccccugaggggaauaucuggguggauacugcugaccagauaaggaggucagacgagugccuuuggauugugguggugucauuggggggccucagauugggugucaccaacucggaaggaaagaccucugugcuagauaguuuuaugucaacuugacacaaacuagggucauugaacagaugggaaucucggcugagaagaugcugccauaggaucgggcugcaggaaaaccuguuuucuuacugauuguugugggagggcccaggccaggguaggugaggccagaaggcaguucugagcaaguucagagggcaagcccagaagcagcacuccuucaugggcucugcaucagcuccuuucucuggguucuguucucucugggugccuguccugacuuccuucacuggaugaagagugcaccaaauaaacccuuuuggucacugugu

SEQ ID NO: 9066 - RNA, 1271 nt, Mus musculus
acacagugaccaaaaggguuuauuuggugcacucuucauccagugaaggaagucaggacaggcacccagagagaacagaacccagagaaaggagcugaugcagagcccaugaaggagugcugcuucugggcuugcccucugaacuugcucagaacugccuucuggccucaccuacccuggccugggcccucccacaacaaucaguaagaaaacagguuuuccugcagcccgauccuauggcagcaucuucucagccgagauucccaucuguucaaugacccuaguuugugucaaguugacauaaaacuaucuagcacagaggucuuuccuuccgaguuggugacacccaaucugaggccccccaaugacaccaccacaauccaaaggcacucgucugaccuccuuaucuggucagcaguauccacccagauauuccccucaggggcguggaucuucucccuucuccaccgaccuccacacgcuccuucccacccaauucuccuuuuuaaccagaagccuccuucuguucccucacaaagcaaaccuagaugcugagaauucccuacaggcacagucaccuccgaagccgguaagaggugcgucucuagagcgcggagggggcuggggggucagaugugugagagguggguaauggcaacacccaccucaccagcccuuugugagcauuaagucaaugcacuaagacaucgacaaaaacacuugacagucaaucaauguggaccgacucgcucuggaaucugaggaggucggccuucuugcuccucagucacucugguccggggucggagcuccgcagagcgcacagaccuggaagcucugguccgagggggcgaguccagccacgccccucugcgucccgucugggcuggccccaccccgaagccggccaggccugcggggccccuuuaaggcagcgagcuggccggcuggagcguguuucgcccccuccgacgccgccgagguagcggcuucaccuuuaaggcggcgcggggacugcugggaaggccggcgggauggaggcagcgagacgagcucacggucgaggauccgggugaagcgggacaggagcaggagccggagccgggccaaagcagaaggugcaggucggcgccggccgguugggccgggagacccagucaagccggacagugaggagcgguugcaggucggccuagaggaggagucgucguggucgugggcgcggccugugggaggacccgaccggcccgcggggagggggcgcggucccg

SEQ ID NO: 9067 - RNA, 21543 nt, Mus musculus
caaguaguuagccaguacucuggaacaauugagauuuuauuuagagacagauguucuccaauagguaagaaaucggccuuucugccacaaggucaaugaggaaggccugaccuggccuacuucccuagccuacaguuacuucccagccuagccacggugcuaagcuggcuauuuuuauuccccacggacaaagcaguaaggucagaccagacccaaagguaccuucagcagagccuucacacacaggagggguagggauagugaacuacccacaaguucaguucagaacuacagucccauaguccuaugggccaucugugauuacaggcaagaaguagaugcuuuugcagaagcuaaaagagagagagguucaagagcgccuguauucauccuuccuugggaaacagcuuuauuuacaaaacaagucuaaaauaagaacaggaagugacgagccuagggaguccagaucuagcuuuagggagccacagagaaagcccagacauacaaagagccuaaaggcaggccagcuaugcgagcaggaccuaaaauuugaacuccuuguauuucuugcugcccccacggcuguccuggggcugagcuuuccguuucuuuugcuguaggagagagagagagagaaguuacaauagguuagacaaccccagacaggaggcagccugacccagacauaaaauuaagguaaaaagcacugaaaccacacucuccucucccccugagagcuaaaugacuuccuuccucuuccugaacuuaagagacugccaccaauggagcaucucggagaccuucaggcaccgaguccacccgccucucccuccaccagaaaggacagcccuccuccuaggcccacagguugcucccaccuucugcuuagcagcaugcucagccaccaugucgcugaagucuuccuucucuacuugugccugcugcucccgaacgugcuccucguacuucugcgucauggccaugggguccaacuccaauuccucaggcgccagcgcuacuuccacaccuugcaauucaggggcugggcccuuccggcucauaaccugaaaaauucagaaccuuauuaucuccagacucucagaaacgcgggcuccaucucaguuacaaaacaauguucuccaaugcuuaccguggacaugucauaaauguggguggaucccaucauggcucccccaacaguggcuguucucuucucuggcaauacagugaauaacugaggugucucacuucugcaaaggacaagaaaauaaaacccaauaaggggcaaaagggucuccugagucaaaagaaacauaagugacacuugaauucuaagagaaucccaagauaacuacggcugaagguucugccacugaaggaggcccauaagaaacgcugggugagggguguggaguggggucaguacuggccccacaggacacaaucuguaagggguacagagacuaagcuaagggauccuuuaagccaagacucauaaggaagcauuaguggacaaagaggcuaaagcuucauagaaagcuuuccaacagagaagcugucaaaagaacaggugagggccagcaaaauagcacagcugauaaaaauccuugcuguacaaaccugacugagucccaucccuggaacccacauaaaggagaaaagagaaaaccaauuccacacacaggcgcacacacacgcacgcgagcacacacacacacacacacacacacacacacacacacgcccccccauacacgcccacaugcgcaugcgcgcgcgcacgcgcacacacacacacacacacacacacacacaucaaguaugcacacacaguaacguugauugcuuuucuaaaagaucgaagucaggucuggugcuguacucagcacuucaaaggcuaaggcaggcggauauuugugagugugaguaagagaccagccugggcuacauacugaauuccaggacaggcagaucuauauaggaagaugaucucaaaaaaacaaauaguagagguguuucacaccauuaagcacaacacuuuguauguagacagaggcaggagaaucuaugaguucgaggccagccuggucuacagagugaguuucaggacagccaaggcuacacagagaaacccugucucaaaaaacaaucaaaaacaaaguuaccucuucgaugggaagaguuagagagcacauggucuagagugguaguaaugagcuugccauuugaccuugacugugcuagucuaugcauaauugaaaucagugguugaaggcccuuuuucuuugggagggcuagaacauuagaacuucaggcacuaccucugagaaugucuauuuuauucauuuauuuuuacucuuugguuuugguucugauucccuaauuugggacagcacugcuuuagagcccuugucuuuaaaguuuaccaaaaaaauuaaaaauaaaauaagauaaaauaaaauaaaaaugaaccuuacaaugguacugaguuuccaggccacagaccagaggauacccauacagagcugagaggauucugugaauugagaaucagggucaaaaucuaagaagagcaaugcuuucagagucugcaggacacagagagagcucaagagcuccuucuucaagcauugggggagaagagcgaggaaacaugcaugugagaauucccaacaccaagcaguuccuggaaggaugagcaacgacagcagccacuguucagccaagaugcaaaacagcaccaagucccacugaucaaauggaaaacccuccaaauucacagggcuugggggugagaacagagucuccugagcacugcccccuagugaggaggacuauuucaguccuacuaagaaaaccaaaaaaccaaguuucagaauaucaaacuguuucuaaacaaccauuaauaguagucaaagguaaagauggggaggaauauaaaaugcucuaacccaguaaauuucacaaagcuaaacugccuaucaggagcuaucaggcacaugugaggcauagugaugcacaucuauauuuaacccgagauauaaaagcugagauaggaccggcggugguggcgcacaccuuugauccuagcacuugggaggcagaggcaggcggauuucugaguucaaggccagccuggucuacagagugaguuccaggacagccagggcuacacagagaaacccugucucaaaaaaaaaaaaaaaaaaaaaaaaaaaaaagcugagauaggagaaccaugaguucaaggccagcuguaguucaaaaaucagggcgggggggcgggggggggggugagaacacugcucuuccagaagucccaaguucaauucccagcaacuacauggugacucacaaccaucuguaaugggauccggugcccucuucuggcauauggauguauaugcagcagaauagucaucaaauuaaaaagaaaaaggccagucauagcagugacagcugcacauggcuuuuaucccaguacuuaggaggcagagacaggugaaucuuugugaguucaaagaaagccuggccuacacaguuccacaccagccagggcaacacaguaaguaaggccccaucuuggaaagggguggggaagguuacaauccacaguaacaaaaauagcaaucaaaaucaacccagagagcccgaauaaguggccuacacuuguaaucccagcccuuaggagguagaugccagaggaucaacaguucaaccuagaacugguaaauguuguaauaagcaagcaaauauauaaaauauuauuacagggccuagggagauuggucaguaggcuauaugcuugcugcaaaagcaugggguucugaguuuagaucugcagacaaaggugucucuaaacauagcaccaagccaguggagacaagagcaagccuguacagguucugugagagauccaaucucuaaaacuaagagggcaaccaagagaugaagacucugguaugcgcauuuacacacacacacacacacacacacacacagggaggguggguaggucagaaaaaauggugagagaaaaaucugaaggggaagaaaacugucaaccucgaauacucuauauagucaaaauuacucaaaaaaugaagacuuuuaaauauuacaaaaucugaggcugagaagaugacuaagucacuaacccgcugggaaagcacaaggcucugaaguugauacccaagaccuacauaaaaagugggcacagaacacacgccugcaaccccaggucuggguaagcaggaacacaaguaagccugggauuucuggcuaucuagcuuagcaagguucagugagauccugucuaaaacaguaaugcugagcacaaugggagacaccugacagcugccuccggcuccuacaccaguguaucacaugcacaccucauacacaugcgcacaguacaaauaacacaggauaaagggguguguagguugguuuucugucaucuugacacaaacuagagucaaguuggaagagagagccuugcuuggaaaaauauccccagcagacuggccuguagucacacccaugaaacauuucuugaucaauguuugcuguaggagaaccaaacccaaugaggaaugugccagcccugggcaggcgaucguggguuguauaaaaagcagauugagcaagccauaaaagccagccagcaagcacauccauaaccucucuucaggcccugccuccaggccccgccuccagggccccgccuccagggccccgccucgucuucauaacggacuguaaacuguuagccagguaaauucuuuucucccaagguucuuuaggucaugguguuuaucacagcaagagaaagcaaacuagaaaagggaacaaugcuacguucucaccuaaaauagagguauaucaucugggacaaugcaaaaagccggccucagggaccaccacuggcugauucuuuccuaauauuuagcucaaauaccccucuucaaugaggccuuccaagaacuucuccaucauucagcauucuucucaaaccaacuacucagguuuccucagcuucgucacugcuagccagacucacaguuaauuuauucugaccacuaguauaccucaaccauccacccugcugauuucccauuagcacaaaguugguguuuaauaauuguuaaaaaaagaaugaagaggggcuggaaagaugagugcuaaugccuucuucuagcaugcagguauacaugcagauagagcacucauauacauaagguaaauauaucuuuaaaggggugggggaacacagaaaaauagaaagucagccaaccaauccagaaaaccaacugaaguaaaggcccucccaucacugcuggugacuucucucacccauccaucgccucuucgaucuucuucuuccucagcucaaugaguucaggggucuccaucccagcuggcacggaugagaauccuccgggagugaugaggccgcugugcaggaagaagcaaagcuccacugugaagagcaguccccacagacaaagccacagacagacaggcugcucuggaggaaacaggcuccgagacuaccugucugcaggugugaugaagccagucucaucuggcuugucuucaucgcuuuccuccuccuccuccucuucugaggauucuucaucagaugguuccaguuccccccacgggguccggucaauuucuucuucuuccguuuuggucuaaaagaaauuccucauuccuucaacaaguacuuacugcgucugucaccccacccugcuguucccugagacaaucuucugugggaaagcggcaucacaccucaagaacacaugucccucuucagacuggaacaguaccacacuccgcucccugacaaugacgguuuagaccaacuauugcuaaccuuucuagcacggaguaaaaugaaacuaaacagucuacccauaccugaaacucagcagcauugguuccaaacacguccccauagagcggcuucccagucucauccacuggggguuugccccagccaccagcaugguauccaaaggagcagcucugcaagagaggacacacgaaugcgcugaagcccgagaaaaaagcuacacuaaagguacacaacuuacacagaaacuaaaacugcacaacauuaaaaacaaaacaaaaagcagagacucaagagaugguuuaaucuguacuagugguugcuaagcaacacucagacccaaguuuguaacuccagcccuggaaagucagaggcaugaagauuccuggggcuuacuggccagucuaacugaaugggugagacccagaaguugaggaaacaagggagaaaauaacugaacacacucacuguccaccucuggccggccuccaggugcacaggcaccagaugcacaagcgcguacacaagggaaaacacgacaucucccccaugccccgucacacacacacacucacucacucccucccucccucccucccucccucccucccucccucccucccucccucccucccucccaggaaacauuaaaaaccuaauaaagcaccaaaacucaaggcuacaggaucagcaaggacaggggcagaggcugggugcauguccuccucugggacauagugugaacugccuaaauccaaaacaaauucuuuaaaaaccaggauucuaauuuauucuucccaauucuuccuaaauaggaaaauuaguugguuagcaucuaucucaugaaauagaaauuaaguuugacaauauuuucacugcaauaacuugucucucaguacuuuucaguuaaguuuauuuaaaaauaauuuaaugcuugggcggcagaggcaggcggauuucugaguucgaggccagccuggucuacaaagugaguuccaggacagccagggcuacacagagaaacccugucucgaaaaaccaaaaaaccaaaacaccaaaaaaaaaaaaaaaaaagguaaugccacucuugagcuggaauuaucuauccauguauacaucagagaccuccuuacaguuucaccaaagacaaaauuuaguaacucuugaguacugaaacuguagcuaauuccaguaucaggaggcagaagcuggcagguuucuugugaguucaaaaguaggcugaucuauaugguaaguucaagaccagccaggaacaacauagugagacccugucucaaaauaaaaaguugugaauaaccugucuucuuuguaugguauaaaaaugaugaauguguguacgugugcaugugucaaauguacagaaacuagagaacaacuuuugagaguuuuuuggcucaccauggggguccuagggauugaacuugguucucaggcuuagccacaagcuccuucaccugccugaguuauuuaaucagcccaguacuuaguaaucaugauugaauauuuuaucacaaguaugcuguaguuuggcuuuuuuuuuuguuacauauccaguacguugguuuuuuuuuuuuaaacuguuuguuggcuccaccaccugccccuagaauuuaaguuguuuuuguguguuuuguuuugauuacaaugaauugacacucauaaaguacucuccuuugccauguggguccuagggaucaaauucaagugagcaaauucgguggugagcacuuuuacccacuaaaccaccucaguggucccauggcauuuuucuuaaaauaaaaacugcucgggauaaaaagaugccucagaaguuaagagcaugugcuccugcccccacagcagcuccuccugucacagcuccacucacagggaaccugacacccuuuccuggccucugcaggcaccaggcaaacagauguaugcaaaacacccauagacacaaaaaguaaauuaguaaauaaaaucuauuccuccuuuuuaauuaauuaauuuauuuauuuauuuauuuuugguuuuucaaggcaggguuucucuguauagcccuggcuguccuggaacucacuuuguagaccagucuggccucaaacucagaaauccgucugccucugccucccgagugcugggauuaaaggcaagcgccaccacgccaggcacguaaccuggcauaguauuaauuuguuuauguaaguacacuguaccugucuucagacacaccagaagagggcaucagaucucaucacagaugguugugagccgccaugugguugcugggauuugaacucaggacuuccggaagagccgucagugcucuuaaccgcugagccaucucuccagcccaaaucuaucacuuuuuuuuaaaaaaaugguggauccagcucaaggggagaucccaaggccugacacuuuaaaugaagcuauggaacgcucacaaaaagggaucuagcauaacugcccuccaaaagacccaacaagcagcugaaagacuaagaugcagauauuugcacccaaccaauggacaaaagcagcugacuccugugguugaauuagggaaagcugaaagaagcugaggagagggcaguucuguaggaggaccagcagucucaauuaaccuggaucccccacacacccugagaucuuucaaacaauggaccaccaaacagauagcauacaccagcugauaugaggcccccaacacacauacaguagaggacugccuggucuguguuuauucagagaugaugcaccuaacccucaagagacuggaggccccagggagcuuagaggucagguggagugggggaugagggcauccaugugaagacggggugggguagggaggagguguggguaggauguagaguaguuggaggguggauggagagggguggagaauggaauaugaagguuaaaaaugaauuagaaauaaaauuaaauuuuuaaagaauuuagaaauuuuaaaaaugguggcucagugguaaggaagggcauuguucugcaaggguaaggaccugaauuugaaucuuaagcuacauauggcugcuaaugucuacgaauccagcauuagggaugaagacagauggguccaagagcucacugcccauccagccagccuagcuaaaacaacaagcuucucacucagugagaccuuaucucagggaagugacagagagccacgaggaagacaguccagcacuccauauucugcuccacaacauuccugugcacacaacacacacacaugcccacacauuccugugcacacaacacacacacaugcccacaacauuccugugcacacaacacacacacaugcccacacauuccugugcaugcaacagaaagagagacuagaaaaggggagaggaaaagaagaaagagaucuagacaaggaaaaaacaaaaucauccccuauuaaaacaaaacaaaaaaaccagcgggacaguggcaggcauuuaauucuauuacuugggaggcagagguaugcagaucucugugaguucaaagccggccuggucuacagagugaguucaaggacagccaggaauauacagagaaacuguuucaaaaaaaccaaaagcaagcaaauaaacaaacaagagcaaaaacaaaagaaccagaaguugaccaguaugccuuuaauccuaucauuggggaagcaaaaccagauucaucucagaguucaagaucauccuagucuaugagaaagauuucuaggacagccaaggcuacacagagaaacugucuuuaaaaaaacaaaacacacacacacaaaagacaaaagacaaaaaaaaaaaaaaaaaaaaaaaaaagaggcagccaagaaggcaaacaggcucacugcucaccucagggauaggugaauucaguccagggauuuucagguuuggguaggauggggguggcccguaucgcugcauggcaaucagccacggaggagggacuuugugggcauucuguaagaaaagcagaccaggauguuaccuaccuuccccuacccugccuuuccuuucugcucauucucccccucuccagcuuucccaagcacucagccaacacucacagguccuacuggcauuccuaaggaaauccuuagcucaucagauaaaucuccaggcuucuucuccuucagccgugucucaaacuccuuccccugaagaaaaagcagagcuugcuuuaucggggcuucuagauauacugagaacgcaguggcaugagaacaugagaacaggcaagccguccuaaucucuaucaguuacaaagucccgugaggguugucuggcucccgcuuagauucuggauagaauaagaaaagaaggccagacucugugcugcuaacgcacugugagaaacaggccgaacgaauauggaaccugcucuuucacgugacaucgaggucacuggacagaaugaccgucagcauccuccucgcacaaacaucaagugacgccauggugauuaacauuucaaagaucagggggaaaauaaaacuuuuucugcuauuuaaaacaaaaugcuuggccaucuugugccuaaaccacccaccaaccaucacuucaaaugcaucacuucaaaugcuugagcuauagauuuuuuucaggggggaaaaacuuguuuggagaaaacaaacaaacaaacaaaccccaacacauccuaucucaacgaauggcaggcaugaacaauuuuaaggcugaggaccgcuguaccagcucugaaauggacucuaaccaaagucaacacuaagacucagccuugccccuccuccagccuccuccccaaccucauaauaaagguccccauggauggugaguuucggcuuggucugccacuugaagaaggcaucguguagcuucugguagucaaugucgaucuuccccaucuucggccgaaccuucucucucauuuuugacuucaugguuuuuuguucuuccuguaaagaaggcagaagagaugaauuacuggguuaguagucaagucuuuaguagaagaccuggcccaacucaagggaaccucauuuaucucacucugaaaaugcaacucagcaccagcaaguuccugagcucaacaccaacaccgaagauucaaauggcacaaccuaugcugaacacagacuuacuguaugacagcgccuuggcuuucugugucagaacugcguaaucaaauaggaccggaucagggcuggagcgcugucucccugguuuaaaagcauuugcugcuugcagauucggcuuccagcacuaacagggcagcaucacaauuccaagcccagaaggcuaggagacccagagguuccugagccccuccugugaccucugcaggcaccaggugugcacgcaaacaaggaacauggacacaggcaagccacacacacacacacacacgugacaauaaauaagucagaaacugaacagaggacuggagaacugaaggcucaacggaaggcgcuuuucgcuuaguuuguuuuacucacagacaacuaguacuaaccacauuaaaacauuuaggacaugauucacacacacacugcacuagauaguuuuaugucaacuuaauacaagcuaaagucaucugagaggaggggaccucaauuaagaaaaugccugccuaagaccuggcagcacacagccuuccuaaugcucucacccucuaaaacagugaccccagccuuaaaauuuauuuuguugcuacuucauaaauguaauuuugcagcuguuaugaauaauaauggagauauccguguuuuccugauggucuuaggcuaccccugugaaaguuugguucaauacccaaaaaggggccucaaccugcagguugggaguggcugcuguaguguauuuccuuaauuagugauugagaggaaagaucuaaucacuguggguggugucagcccugggcaggugguccugaguucucagagagcaggcugagcaagccauggagaguaaccagcagccuccuccauggccuccgucagcuccuccuccaggucccuggccguccucgcugcuuuugcuggugaacugcugcuacgcuggggcugugaguaaaguaaacccuugccucuccaagcugcuucuggccaugguguuucagcacagaauuagcaacccuaaauaagacaagcaucauuuccaccucuaacuacaaguucauuaaaaaaacaaaaaaccaaaaaccaaaacaaaaacaaaaacaaacagcagucaggcaaaggagaagaaaacugcuauuuaggaccaggaaccucaacaugacaaaggagugacacucuaacagacccacggucaucacacagugcugacuucugaacuggaaaaaggcuaauuuguaccaagcagguaguccagcucugaggcaagcugcuacaaagggucgugccccagccuugucucaccuucuccugcagggccucucucauuuccugaaugccugugcguuugaugaagucuggcagcucaaaggggggcuucucaaugccccguuugccuugaagguacuugcgcuuaaaacaccaguggcguggcacagggacggaguuccggguggccuugagguggaccaagagcuugggguccugugccgucacgucaugcaucuccacaacaucaggccgggccaccagcugaaaagcacaguggguuugcagaaaggccaccucuggguuagagcuguguucucuuucucaaugacccccagaccaagccugccuuauaaaacaucuaacaaacuggggcugagucccagcgaggcugcagagcugacucggccaucccagaucuaaccugcuugaguucugccacaguaaaacgauucauucggcgcaacuucuucuucgacaguuuaggggcuuccggcuucuuuuccuaaaagagaauaaccucuuagguggcaucagguagcaaucaaacugccagccguggcaaugcuuaagccacgaaagcccuuuaccauggucucugaggaaaacacuccaccucccugggcccugcaucucucucccacggagggggccugaccugcucaucaucacugcugucaucgucacuguccuugugcuccuccucaaagcccuucuucuuggggacugcagagcucuccaucuugucaagcuucucuggcuccuuuucuuuuuccuucuucacaucaucaguuagcugaggagacagaccauguggagauuccacucuuggcacaccgccuuuucugacuccgguacugugugcccccgucccccucagcaagguaggcuacucagagcacaccacccucuguaccuugaaagccucaaaaauccucuugaagaagaugaaauugggcucguagaucucaggcuccucggucacauacucaaucuccacgucagcagcagggggguccgagccgcgggaccgaccggaguccuucucucgguccccagagcucucugaugaggcugcccgcacccgcuguggcuuuuucuucuucuuucgguuccgacgcuuucgguuuuucuaucgagacaggaaaacuaccuaagucagaggaucugcaucccacaccugcccucacuacuucccaacuuaagucuucauccaagugggcagaugucagagcgcugcugugcaccccggagccccagccuuuucaguuguaaauguauccacaguacuuggaacucaaagggcuuuguggcaauugaaagauagccaagaagcucagaggauauuggcacgcuccucccagacaagcuucaucaccaaccucuuuuuuggauauggacaccguguccuccucagucucugaugcugacugucccagagaugagcgaguaucugucuccauuuccuccuccucuguuagggaagaauacaaccaucaacucuccuaacuguaaccaucccaggcuggucuaaaucguauauggaaacaaggaugacuuugaacuucggauccuccugccucagccuuccaagugcugggaucacaagaauaugcuaccgcacccugguuucuccauugcuacaaaguagcugcucgcuacacuguuuccucagggacugagacgggaggaaggaccaggccucagcuuauauggcucaguccuguguugcagcaucaagauacaauagcacucacccugcugagaguucaucucuuccugccggcucuccuucagcugaagaaucuuuuccaaagccugggggaucuuggggcccacagaaggaucauccaucugcaggaacacccagucggaagggcugacacccaaugccuuccuccucuaaugccagcucuuacuggaggggcuacuggguggugauaaauacaacacaccagguucugcagcccucagaauucugcccaaaaugucucaagucccuaacccuaaaaacucacuuuagcuaaguguggcuccuaccuauacccaagaauuuaacccagccccacuucacagacaucccugagauucuaaggcagcccccucuaaacugcaaccucugaccauaggaggaagucagcagucucucaccucucuguucucaucuccaggggguggggggggaccccgagggcgaggaacaggugcccccaugggcaaaaccguaggcgugggaaccacagggccuacuggagcagcuacugugaaaaggaaaaaaagaaauccaaugucagaauucucucauuggugaugggugcccugcagggcaaggggugaugaaagggucaaguacuucuggggugccggcaacguuuggcuuuugguucacaagcuggcuacaguacacaccuuauaugaaaauucaugacaugccauauucuuguuauaguuaaguuuuucuucuagauuuauuauuuuucuauucucuucucucauauuucauauguguguuguagccacagaagccauaacagcaagucagauccccugaaguuguaguuuccagcggcugugaggcacccagugcgcgugaggcacccagugugcauggcagggucaaaugcagcuccuuugcaagacuagcaggcgcucugauugagucaucucuccagccucuucuuuuguuguuuuucaauuuuuauuuuauguauaugacuguuugucugcacauacuuauauacaccacaugcaugccugauaccugcacgucuaaagagggggucaguuccccuaaaaauguaggugcuguuuauaaaccagcaugagggaacugggaacugaacgugggcacucugcaggaguagaagugcuccaaacagcugagcucucucuccagccuuucuuuggguuuugggagguagagucguguugcucaaacucaggauccuucugcaacauccugaccacuaggguuacagguuacagaugugcacagucauagcugacacaaguaaucauuuuuuuuguuuuuguuuuguuuugggagacagagccucacuacguguagcucaggcugucuuagaacuugcuuuguaaaccaaguuggacccaaccucacagagaucagcuccuuaagguauguaccaccaagcucagcaaguaacuuuuuauagauccgauggguuuuuugucuucauggauguaugugcaccggucagaagaggccaugcauccccaggaagaagcagaguuagaggugacuaugaccgcucagguaggcgcagggaacagaccugggaccucugcaagagcagcaaaugucuuaaccacugagcaaucucuccagccucaguaacacacacacacacacacacacacacgucucuugguacagagaaacuuuguuucaggaccccacccaaauacuggaaucaggauacuuaaggccuucauaaaaaacaggauuuacacagacucuauaaguacuuuuguauuuaaagccaucuggaaugcccacuacaaugcaaagcuaugugaauaauucugcugaggcuuaggggaugacaagaaagucuguuaauguuguaaauagguauuuuuuaauuauauguauguguaugugggagaauaugcaggagugcagugccuacaagcccaaagaggacguaagaucuccuggaguugcaugcagcugcaagccacccgauguggaugcugaacuuggguacucugcaagagcuacuuacaaaucucuccagcccaaauacaacauacuuguuuuacuuuccacuuaguuauaugaaaugugcuuagcuauagauccacaaucuacugagggcucauuguauuuacaaguuucugaagugcugagaauauagccaaaugccccagcucaggcucaguguguucagagcuuuaaguucaaacccaguagaagaaauuuuuguuuuaagacuuuuaauaacuuacuauuuuuaguuuguuuuuuguuuuuguuuuccacgcagaguuucucuauguagcccuggcuguccuggaacuggcucuguagaccaggcuggccuccaacuaaagagaucuccuugccucugcuucccaagugcugggauuaaagacauaugccaccacugcccagccaaguuuauuauguuauguguagggauucugcuacacaugucagucauguccucuggaagagcagccagggcacuaaaccaccuuuccagcucugauuguuuucuuuuuuuaaaauuauaauaugugucuaugucuguggguauacaugagaggccuucgaagccagaacauagugcuggauuuucucuggcugcaguuacacugugagccaucuaauauggguacugggaaccaaacgugugucuucuuggagagcaguuaaguguuccuaacuacugagccaucucucuaggcucugggucuuuucaaaacauuuuuucaagacaagguuucucuauguaauagcccuggcuguccuggaacuugcuuuguaggccaggcuggucuugaacucacagagauccuucugccucccaaguucugggacuaaagguguucaucaccuugcccagcuugcuuuuagucuuucuaagauagguuuucaagccaggagaugguggugugugccuuuaauucgagaacucagcaggcagaggcagguagauuacugaguucaagggcagccuggccacagaguaaguuccagaacagccagggcuacagagaaacccugucuugaaaaacaaaaacagggcucgagagauggcucagcgguuaagagcacugacuguucuuccagagguccugaguucaaauuccagcaaccacauaauggcuuacaaccaucuguaaugagaucugaugcccucuucugcugugucugaagacagcuaaaguauacucacauaaaucaaucuuuaaaaaaagaaaaaacagaaaaaacaaaagcaaacaacaauuaagaaaagguuuaaguggcccagacaucuuugaauuuacuauaaauucuaggaccaccuuuucccuucugccgcugcuuuggcagcagaauuacaggcacgugccaccacacagagauaaaggaaacguuuuaagaacaacuucuuugcucugcccuuccacuccagggucuuaccgcgaggccccagaggaguacggacacccagcugccccauauccugaggcggccgagggacugcagugcccaucuuggcgaucuccugcugccguuccugcuccauuaacacagcugccuacaagaaagaagugcggacucagcuuggaaaagaauuuggcgcauagcccugacaaauggguuccuucgaaggagaauaacagggacacugagguggucaucuuccccacaccuguuugcauguuaacuagaaacuuaucaugauggaaaguuccuaaaaacaaauaugaaaaagccuaggaaguuucugguuucuggaagagauuucuacuuuucaaugaguuuuaauacacaaaaaugaaaccauuagaaagaaccaugagacauuuucuuagagcuuccucuauguuuccagcacuuccucuauguuuccagcacuuccucuguuuccagcacuuccucuauguuuccagcacuuccucuauguuuccagcacuuccucuauguuuccauguuguguuugauguucccuuuccuuuccuuuccuuuccuuuccuuuccuuuccccuuucccuuucccuuuccuuucccuuucccuuuuccccuuuucucccuuuuuuucccuuuuucccuuuuuuccccuuuuuucccuuuuuuuccccuuuccccuuuccuuucuuuugguugugucagacaggguuucucuguguaguccuggcuguccuagaacuugcucuguagaacaggcuggccuugaaauuacagagaucugccugccucugccucccaagugcugggaugaaaggcgugcgccaccaccagccagcggcuaaugcuuacuuucuaauauucuugagucacccacuggguaaagcugaugcggggaaggacaccccuacagcauuccucaaucuguaccaucauaguuuaaauucaacucaaaugguaugccagcauucuccacaagccaccuaaauaacacacauaaaacuagccgcaaagggcuggagagauggcucagcagguaagagcacugacugcucuuccagagguccugaguucaauucccagcaaccacaugguggcucauggcuauccuuaaugggaucugaugcccucuucuucacauaaaauaaaugaacacaucuuuaaaacaaaacaaaacaaaacaaaacaaacaaaaaaaaaaaacuagcagcaaaguauuuucuauaauggauaaagaguaaaauuacauguguuacuaucauaggaauucuacaauauacuugguuuaaaauguuugguuuucuuucuuuuuuaaugacaacccuccaaaguuugaaaaaaaaaucauuuuuaguuuauaggccauccacaagcagggcacacauagugugcuaacuccuggacuacagaaaagauggaagcacuagaaccuauuugguuaucagguagccuccaaggcaaauuugaaugaagcaucuugguuuggacauuaaauaauguuaaauggcauccucuggauagagcaagaugucaagucagagagaaaaacaucaccgucuuccaguaccccaagaguucauguugcuucagugaaucucacacuagcagcaauagggcccaggccaaucugccaaaauacuggcuuccugggagucuaacuauaccuacguucuagucuucaaccaagaccuuccuaaaaggcuuggccucagggucuagcuuucucaggcuccauuuccccgucagggaccuaaugugucccagguacagguuuccaccuguccuaccugcuuggcacgcuccucuugcugcaucagcaaagcugccugcugcugugccagcuucagccguucuucuucugacagcgccacaggcucacccacucgaagagguggugggggccccagauuuggugggugagccauaggaaagccaaggccaaggccugguggaggugguggaggugguggaggaggcuguagagggggaagucccauagguggugguggcauaggaaucccagacagcuauggggaaaaaaauacagcuaugaauuagaaagcauuuauucaauuuauaagcauuugcuagagaccuagcaaaagagccagauacuagaauuugaagucuaaugacguaggauucaagaaaauacaccauaaaagaaucaaaagaugcuaacuuuagcacacugaucaaagcuauuagcuucucugaaaaaauaugaggaacauucauauuacauuuugcauucaauuuaaggagguacaaggacaccucuaaaauccauacaggaacuucacaaaacacacauacacaaacacaccaauaaacuccaggucaaagccacaacuuuagaggaagagaaacaaauacuagaaucagaaaggacuuaaagaaauaggaacuagggcuggauagauggccaagcaguuaagagcugcucuucuauaauaucagggcucaauucccagcaccccgauggaagcucacaguucuguaacuccagccccagaaugacccaacgcccuucaauggccuccuaaaacacugcaugcacgugacgcacagguagaaacuuggacaaaauacaaauucagacaaaacacuuauauacauaaaaauaaguuaaaaaaaaaguaauaaccaacauuccaaggcauaggauaucuacguuguacuagaugcagggaguauauuauucaagucagggcauuauccuuuaccguuucaauaacuuugggagcuauaccuggcaggagaaagcaugaccacuuccagcugagaaaggaucaaggaacauuuccagauauucuaguggaaucuugagugauaagucaaauuuggaggaguagacauuggggauuaaaacaguagcagcacuaaaucagaagugaagaggucacaauuuugucuccuuagaccucacccuuaacuuacggucccaucugcuagcucaacacauggcuauccugagcagaaaagauccucgaagcaaucucuuaccugugcugacauaggaggaggagccgcuuuguccccaucuucuccucucaaaacuggucgauucaggacaaugcccgucuacaagaaaaaagagagcucuaggucagacuacaaggacguauuccauuacauaaccuccucuuccauuuauuuacuuaacaaaauguacccagugcccacuugacagagacuggggcuggaaccugagaaaagcaacaggaguagaaguaauuacaauaaagcaaaaccaagaacugacaaaauggucaagagccggcuugcugcguugaaguacacaaaaaagaccuagcccggugugcuggagcacucggaaggcaaacgcauuaggaucucuuaaguuugaggccagccagggcuacacugagaaacccuaucgcgaaagaacaaacaaaaaaaguauaugaaacgaagauccagccgcggagugguggcgcacgccuuuaaucccagcauuugggagaggcaggcgaauuucugaguuccaggccagccuggucuacagagugaguccaggacagccagggcuauacagagaaacccugucucaaaaaaaaaaaaaaaaaccaaaaaaaaaaaaaaaaagaaaagaaaaagaaaaaagaaagaagagaagagaagagaagagaagagaagagaagagaagagaaacgaagauccauccgugaguagucuuaaaggccuccaggaaaagugagaccuagccugcacugacaacacucaccugacggguguaggucugcagccgcucuacuaacuccucgcgacucccuauaggacgaagcacagaaucagggggucagcaucaccucgagcaggccaauuuggcgaggucaggucccacaggccugucuccgccccccgccccgugggucuccuggguaaccaagcuccacuucgccacaagcccacgcagggccccucucgaccgccucugcgccucacccuggaucggcgcuccuaucucugccaaucuggccugaagcuccugcgcagcccaggcuccauaguggccuggagguggaggcgguggcaacugcaacucuccuuugggagguucgggaugcuccgccgccaucuuagccacaagaaggcgcgagaccaacacggaagcucgggucagccgccgggccuacuucc

SEQ ID NO: 9068 - RNA, 805 nt, Mus musculus
cgaaggugcaaaaggggauuuuauuuuagcagugcccuucccccaggucagcagcuggaacucagcuuggcgguccguuccuccaccggcuccgauccccuuucagcccauucaagcacgccugggcgggagugagcagacaaacacuguuuuaucagagccaucggcaccaaccucccauucgggcgccggaaaggaaucucuaugagcuccuaggagaaauaagcacccaggucucucaucauugaagggugucgggacagaagacuuaguauguguuuggccaggagagaagaagaaugcaucugcucuggguagaguaagcucuugcagccaggcagcggauguauuacuacugcugcauaccggaugucauagcgagcguucguccucuagauggcgcauccgcaaacuacaacucccagaaggcucugcaaccuccguuggcggcgauuccuauuccccgguaagggaaagggcguguguuuggaccaaguucucuccaaucaccgcgggacguggauuacgcaaccggaaguuucuggaaguaggcccggcggcugacccgagcuuccguguuggucucgcgccuucuuguggcuaagauggcggcggagcaucccgaaccucccaaaggagaguugcaguugccaccgccuccaccuccaggccacuauggagccugggcugcgcaggagcuucaggccagauuggcagagauaggagcgccgauccagggugaggcgcagaggcggucgagaggggcccugcgugggcuuguggcgaaguggagcuugguuaccca

SEQ ID NO: 9069 - RNA, 2258 nt, Mus musculus
accaaguaugaaggccacugauuuuauuaauuuaaaaaucuuuuauaaggacagugacuguuuuugccaaaaaaaggaaaggagccaaagggcauccaacagauagugagggagaagggggccaggaauccauucaggaaaguugguaacugcugccacggaacugcagggggagguggaagggaaaggcaugcaagggaaacgaucccagaaagauugaaacgcugaggggagagaacuccccauagacccuggaguacauaggaggugagggugacaacagccaucuuuuccuuuauggaggacagggaggagcccugcccugcugcagacucuggaaacugugcuguggcugggguaugagggauccccagagaacacuacaagaaggcaucacaccauucucgaaggcacccaaagcagucccgggacugcuuggcauuggcaccacauguauccuucagccauucucggaagaggucuucaucuuucuuuagcaccagaaacuggccaaggaccacauaagccugcagaauagaaaagggcauguggcuaagugucucaugggcuaaagcaacaggacuguccacgcugauaccacuccgaagaggccagaucucugaagcuagggaggguuaggugguaaauacuucagagggcaaggccauuuuuauuuugauuaagacaggguuuguugccaggcagugguggcgcacgacuuuaaucccagcacuugggaggcagagacaggcggauuucugaguucgaggccagccuggucuacagagugaguuccaggacagccagggcuacacagagaaacccugucucgaaaaaaaaaaaaaaagaaagacaggguuuguuccuuuguugucagggcuggcauuaaaucccacgggaauccucuuagcucaacuucccaaguguuagggucauaagcacaauccacuaugccuaguuucauuuucgugauauuuaaaacacacaaaagggcaggggacagugagccacaccuuuaauccuagcacugagaagcccugucucaacaaaacacaaaaaugaaggaggcaccaugccuccccagguaccccccaaacaugugugggccucacucccaaucugcgugguaccaccuguugccaaccuucgcuccuaccccucccuggcauuugcagcccccccacaccuugucaaagccccuuuccuccagccucuugcucaggacgucaccaaucccggccaggcuccccacuggcuuuucccccaugggcucugccacgaagucucggugcuuuugggagguugucaucgugaucaggcuuaaccugggaaucccccccgccaaaaaaaaaaaaaaaaaaaaaagaaaaguagguuagggcugaagaccacaagucccaagggcaauauccuaccacagcuacuguggcugcucccuugaguccccccaacccauccccggcuauucggaaauuuccacuuuccguggguccugguuuuggguauauuggauauaucagcuugcacuagcugguggcgcaccuaaggcaacagagcgacucccagacucaguagucaagguccgcccugaagcccucacagcccgcgacccuggcuacacagacacugaccccguugggaacuaacacgugguaggaacagcacgcggcucucgccagccucgccgcccucacucgggcugccggccucuuccacgccucucaggucccgcaggccccgcccugaggccccgccccgcuccgagcgccccgcccccuccacgcgccgccacccggacacaccgcgcaucgccccucccgcagacucgggcugccccgcugcaaaggcgcgccuccgcgauggauuccccucccucccgccucugcgcgccgccaccgcacgccagccggagcaccacuccgcuucucacgcucaccggaggcuccggcucugguaacggcuccucgcgccacucggccgcucccgcccagaccucaagcuacgagacgguuccucgacuuccgcuuccgggucguuuuaugcgcgaccuucaaaacuaauccccaaacugggcaggucuagcuacccggagccauagaguugacgcgcaaucgccagccgcggcgcccacgggggucgcuguuuuccgguuccucucaagaagccauccggcuuucgauggcuuuuguuucuccagcggcccuuccggucugugggaucgagaccuccgaggagaaugcguuuuccugccccgcacu

SEQ ID NO: 9070 - RNA, 2585 nt, Mus musculus
uguuguugagguggcgggacccuaagauggcggcggcggcggcggccguggcaggggcggggcgcggcggggguggcggcggcggcggcggcggcgcagcagaucccgggcaggaacggagccgggcccgaaguuggguuggcgcggaacggagugaaggccggaggugacugcgggguggcgagagggacggcaacccuuaagcugugggcacuaauggcggcggaugugguagggcuggagccugguccucgcgcaggccugguccuaucugguucgagucuggaugguacccauugacccccugaugggccgcugcccucucuggggcucagagccucgguguuucacggugcccccaaucguucaccgggggaggccuggcccucuacagccauccucugagguuggcgacccugcguuuugccuacguccauuauauugcagcgccgcgcuaccuugcaggacucuaguccggugguguagccgagccccgugccaguucacacuuaagcucuggcgcucuuuacgggcaugaccuugggcaagccccuuuucuuaagaguuucaauuuccuuguuuguaagcagugaaaguaguacuaacuauagcuacuccaccucaggcgucuuauucuggagacaaaucuagacaggaucaguuguuacccauugugaagaugaagcaacugaggcacagacauuaugucuugcccagggccacaguuuacugcagugccuggcacccuccaggacccagcacuuuuuauuuacugucucaaaccucugacucaguucccucacaacaggauggaaccaaaugaggagcuggaagaggaagacucuccagguggccgggaggauggcuucacugcugagcaccuggcugcagaggccauggcagccgauauggaccccuggcugguauuugaugcccguaccacaccugccacagagcuggaugccugguuggccaaguacccaccaucucaaguuacucgcuauggggacccagguucacccaacucugaaccugugggcuggauugcagccuaugggcaggguuacacccccaacucaggggauguacaagggcugcaggcggccugggaggcucugcagaccagugggcgacccaucacaccagguacccugcgccagcuggccaucacccaccaugugcucuccggcaaguggcugauucaccugucaccuggcuucaagcuggaccacgccugggcuggcauugcccgggcuguaguugagggccgucuccagguggccaaggugagcccacgggccaaagagggugggcgccaggucaucuguguuuacacggacgacuucacggaccgcuugggugugcuggaagcagauucugccauucgugcugcaggcauuaagugcuugcucacuuacaaaccugaugucuacaccuaccugggcaucuaccgagccaaccgcuggcaccuuugccccacucucuaugagagccguuuccagcuuggaggcaauacccguggcucucgagugcuggaccgugccaacaauguagaacugaccuaauggggccgagcaggagagaccaccuuuugcuuggauccuuccuucuucucuuccuugucccaagaaggcugagcuccuuagcccugaggacucauuggcgugggaacugccugcacucagucccuuugcacuucugcucucuuugugcagggccaacucccacccucacagguugggggcucuggcucuuggagggcggggcccucggcggcccucuuugaugcugcuccccaccacugcccaggaccacagcuugggugcagagacucgaggaagucuguccuggccaccucuguccccacuauacuuagccugcauucuuccuuuucuuuccucccucagaagggagaaaacuuagugcuuccagccccugcccuuggcgccaucauaguccagguggccgggcccuuccaggacuaagcaugcuauugggaccuguacauguucuggccaagaggagacgcagggucauggacauggggucugcuccucccugcaaacucauagccugcaucaccaccaccccuucccuggcuaccuugacaugugccugcuccugacauuucaauaaaacccagcucgggucugugucuugaguguuuuuuacaaacacuguccugaugguuaucuguguuggcucucgaggaaagauggggccggaagagacagcuccagccugagugggccgccuucuccuccucccucaguggugaaaguagugugcugcugugcggaggccaggcaccaucgcugagaaccucuucagagcuguuccccucuguaaccauggaucaaaaucaguuuuuuaagucuuuccagaaaggcccaaggccuuuuuugguauauucuuuuggucccaagguauauuuguuuuacauuuuauuuuauuaagaaagagucucucucccagcacuugggaggcagaggcaggcggguuucugaguucgaggccagccuggucuacaaagugaguuccaggacagccagggcuacacagagaaacccugucucgaaaagaca

SEQ ID NO: 9071 - RNA, 2585 nt, Mus musculus
ugucuuuucgagacaggguuucucuguguagcccuggcuguccuggaacucacuuuguagaccaggcuggccucgaacucagaaacccgccugccucugccucccaagugcugggagagagacucuuucuuaauaaaauaaaauguaaaacaaauauaccuugggaccaaaagaauauaccaaaaaaggccuugggccuuucuggaaagacuuaaaaaacugauuuugauccaugguuacagaggggaacagcucugaagagguucucagcgauggugccuggccuccgcacagcagcacacuacuuucaccacugagggaggaggagaaggcggcccacucaggcuggagcugucucuuccggccccaucuuuccucgagagccaacacagauaaccaucaggacaguguuuguaaaaaacacucaagacacagacccgagcuggguuuuauugaaaugucaggagcaggcacaugucaagguagccagggaaggggugguggugaugcaggcuaugaguuugcagggaggagcagaccccauguccaugacccugcgucuccucuuggccagaacauguacaggucccaauagcaugcuuaguccuggaagggcccggccaccuggacuaugauggcgccaagggcaggggcuggaagcacuaaguuuucucccuucugagggaggaaagaaaaggaagaaugcaggcuaaguauaguggggacagagguggccaggacagacuuccucgagucucugcacccaagcugugguccugggcagugguggggagcagcaucaaagagggccgccgagggccccgcccuccaagagccagagcccccaaccugugagggugggaguuggcccugcacaaagagagcagaagugcaaagggacugagugcaggcaguucccacgccaaugaguccucagggcuaaggagcucagccuucuugggacaaggaagagaagaaggaaggauccaagcaaaagguggucucuccugcucggccccauuaggucaguucuacauuguuggcacgguccagcacucgagagccacggguauugccuccaagcuggaaacggcucucauagagaguggggcaaaggugccagcgguuggcucgguagaugcccagguagguguagacaucagguuuguaagugagcaagcacuuaaugccugcagcacgaauggcagaaucugcuuccagcacacccaagcgguccgugaagucguccguguaaacacagaugaccuggcgcccacccucuuuggcccgugggcucaccuuggccaccuggagacggcccucaacuacagcccgggcaaugccagcccaggcgugguccagcuugaagccaggugacaggugaaucagccacuugccggagagcacauggugggugauggccagcuggcgcaggguaccuggugugaugggucgcccacuggucugcagagccucccaggccgccugcagcccuuguacauccccugaguuggggguguaacccugcccauaggcugcaauccagcccacagguucagaguugggugaaccuggguccccauagcgaguaacuugagaugguggguacuuggccaaccaggcauccagcucuguggcaggugugguacgggcaucaaauaccagccagggguccauaucggcugccauggccucugcagccaggugcucagcagugaagccauccucccggccaccuggagagucuuccucuuccagcuccucauuugguuccauccuguugugagggaacugagucagagguuugagacaguaaauaaaaagugcuggguccuggagggugccaggcacugcaguaaacuguggcccugggcaagacauaaugucugugccucaguugcuucaucuucacaauggguaacaacugauccugucuagauuugucuccagaauaagacgccugagguggaguagcuauaguuaguacuacuuucacugcuuacaaacaaggaaauugaaacucuuaagaaaaggggcuugcccaaggucaugcccguaaagagcgccagagcuuaagugugaacuggcacggggcucggcuacaccaccggacuagaguccugcaagguagcgcggcgcugcaauauaauggacguaggcaaaacgcagggucgccaaccucagaggauggcuguagagggccaggccucccccggugaacgauugggggcaccgugaaacaccgaggcucugagccccagagagggcagcggcccaucagggggucaauggguaccauccagacucgaaccagauaggaccaggccugcgcgaggaccaggcuccagcccuaccacauccgccgccauuagugcccacagcuuaaggguugccgucccucucgccaccccgcagucaccuccggccuucacuccguuccgcgccaacccaacuucgggcccggcuccguuccugcccgggaucugcugcgccgccgccgccgccgccgccacccccgccgcgccccgccccugccacggccgccgccgccgccgccaucuuagggucccgccaccucaacaaca

SEQ ID NO: 9072 - RNA, 8402 nt, Mus musculus
cgcaguugcaagccccaacuucggcaaggugcgucagggggaauccucggugcaccugggcgcggcaaggaaauugcaccauguaugggcagcugcgucagaggggggcguggccgccgcggaugcuaggggacgccaagucggucgcuuucugucuguagaggcggcuugccacccgagcagagggucgugaaguuccgagcggaccgguccacagagguucaucuggagagguggguccccugcgaggugaaaggcgccgcugagacacgcccccaccccccguggugcaagugguucagcccaagaacuuuucauucauaaaaaagaccagacuccgagaggcgcgagugagucagaaccgcagccgccaacgcggacccuaccgaacauccagcccagggcauguaccgagacuacggggaaccgggaccgagcuccggggcuggcagcccguacggucgccccgcgcagcccccgcaagcucaggcacagaccgcccagcagcaggugagacuggccgaaucgucggggggggggggaccugaguuuggacagcaucagggaugcugggauuagucuaguuugcuccgggauuuggacuggggccccgagcagcaucugacucugguggucgcgaccgaggauccugcacguucuguguggucggggaaccuauguacccgguggccaaggggacgagcgcagcgggaagcgcgaauaucugcgaauuccccuucucgcucgcccguaucucccuagcugacugucuuucugccccuccgucuccguuacggucuuacauuuccuccuaucugccccuaauacgcugucccucuaaauaccugccccaucccugccuggacaggaucagagguguucuccaucuccaguuaauaacugggaccuggggucugggcacauagagacgggguccaucagaacucagccgggacagagaauucuuagcagccuguccgaggcuguccguguguugcucugguuguccgugucccuuuauccggucaaguccucaucucuuugugcgcaguauagagcccaugggccccaggcagugguuccgagggguuccuggagaccacgaaguguugggaugugcgcggggucaccugcccggccacacucgcgcuccacauucucggcacccgacgucucucacugcuggauaggggcacuugagagguugcagguguccauuuccugucgaggggccgcgagcacgugucgccaggggagggaaggagcugcguccguuucgccgagucacagcgggccgagucacugaggcugagucacccugggugccccucccuuccuggccccaaacggccccuaaggaccgacgaccugggagcgagagaugccccuggcagugcuucuagcccagaacgggggucacugagaugcugggucccccaguauugggcuggggacauagcuguccagacuugccuaagcaugugaggugcuuccuggacuggaggggccccacauccuuagcucacagagcuugaacccaguuuucucucccagaacgcugagcccccacccccaccgacacucaaucccaacacaugccucagauuucugcaagaaaaggaaggaaaggaugccagaccccuuauaggaggcuuuuacucucuucacuuuauuucauggacuuaaaaaaccccaucaauuuugaacuuucaaguuuuuaagucgacagcuaggcaugcauuuaaucccagcauucaggaggcagaggcaggcagaucucugggaguuugaagccaauuuggucuacaaagugacuuccaggucagcuagagcuacauaauagagauccugucucaaaacuuaaaaaauaaaaaacaaaaacaaaagccgauuaaaacucugauuucugagcuaugagagcuggcuucucaacagcaauggaacguugaaugauguuaauaacagggaaacugagacuaaauaacaugccccagucucaaagcccaucaauggccaagcuccaagcugaugcuggacucccaagcucuggugcuacaugucuauagucuuggugccugggagguagaggcagaggaaucgugaguuuaggucuagccugagcuaugugagauccugcccaccccacccccggcccccaaacaacaaauucucauccugauucucagaauugccuugggagcuagaagcugaaaguaugcccaucugugaggacugggucucaaaucuuaguuucuacuuacuagcugugggucuaugggcaacugcucuccugucugaaaacaggauuauggcagcugugugagucacuauuuguuaaauaguuggaacaguguuacgcaguccauacuugauuuaaaacaaaaaaccaaacuaucucugguggggaaacagacagacgaagagagacauuuugugaccugcccaaaaucacacagcuccugaacaaguaaguuucugguugccaaauguugcuccuuguggucucccaaaacugguaucuacacugaggugaagggagacagaaguccagccucuguccccgggaagccccucaguccacacagaccuuaucauuucccuucuuaucucucagaaguuccaccuugugccaagcaucgacagcagcagccaggaacugcacuggauggugcagccucauuuccugggacccacuggcuauccccgaccucuggccuauccccaguacagucccccucagccccggccaggagucauacgagcccuagggccaccuccgggggugcgucgcaggcccugcgagcagguaagaaacagcgauguuucacuuuccauagcccguagggguccuacuagacagggacaggaucuugcuacgagggaauuucuauucagcauugaaguuccugagaggccaagaaggagguaaaaggucaccuuugagucaaggaaggcuuccuggagaaggcuacacguuaaccuaaaccacggauaggauuugcguauggaagcugaaaagaaucuucugggaggaggguuggaggcacagaauugaggugaaggggacagaguguuaagugagcaugucuccacugucugacgugcacaggguggaaggaagccugaugcuggcuuuguaccucggggugacucuucuuuucaacagucacggaaucucagccuauuucuuuuaauuaucacaaaaagugagugggcagugguggcucacaccuuaaauuucagcacuggggaggcagaggcagguggaucucuggguucaaggccagccugguuuacagagugaguuccaggacagccaaggcuacagagaaacccugucucaagaaagggaaaaaaaaagugaaugggaaauguauuucaauuuuuccaucuuccaucagaggaagugaagcauagagggguacucacuuguccagauucauacaaaugugaguaaugagacaggacugguccuggccugaggucuacucaacucccaaagucagagcuuaaugagccacugucucaaugggagcucacagaaggcugcagagggagugagcugagaacuuuugccucccugaaugccuuucuaaaauaaagaaggguguguuuugguugguuuguagagguggggucuugagagccuccugccuucccaagugcuaggaguauagguguaugcuagauacccgacagggaugacggaucuuuuaggccauagcacuuucuuuccucucccugaaguacugagacugagucuagugcagggaggccuccauacuaaaaagcuggguguacccguaaucccagaacucggaaaaucaagacaggaggagccauucaagucacgcucagaaacauggagaguuuaaggucagccugggauauauaaacccuaucuccgauaaccaaacaacaaucaaagcaaaccugacuuaaguguuaaguaggaaagaauaugcuguaagucaucagccuggcugggggacugaccgccucugagggacugaagaaccugcuucaagcccggagcccugcacucaaccccuaguggaugcacacacagauccuugccaugauggcucgaagagggauggcaagacccugggagauaugugagauuggccagagaagagccagcaacaggcuucccagcaagggaacagcuuaccucugugaucagcuggggcgugagcaagaggcaagcccagggugaauccuuccuuuagcccuguccugaggagacaccuuuugaccacggguacuaguggguuggagcugugagcuguggguagguggcuuccccucggugugcucuggaacuugaacaaaucacucauccuuccugagcuuccucacaugugagugugcagagaucuggaugggugacucagcagcggcucuggcugcuccuuagaggauccggguuccaaucucagcacccacguggcaacucacuguccacaacgucccccaaagguucugaugcccucuucuggccuccaccagcacugaaugcacaaggugcucauacaaacacacaggcaaaauacucagagguaaauuuguucuuuuuuuucuuuugagacaggguuucucuguauagcccuggcuguccuagaacucacucuacagaccaggcuggccucaaacucacagaggcaucugccugccucccaaguguugggaccaaagauguaugccaucacuauaagccuuuuuuuuuuuuguaaauuuuauuuaugaaugagugcuuccauguauaccuucaugccaggagagggcaucagauccuauuauaggugguugugagccaccguguguggcugggauuugaacucaggaccucugaaagaggagcucuuaacugcuaaaacaucucucuagccccagucuacauauuuuaaaucuuuuuuuaagauugauuuauuuauuauacauaaguacauuguagcugucuucagacacuccagaagagggcgucagaucuuguuauggaugauugugagccaccaugugguugcugggauuugaacucaggaccuuuggaagaguagucaaugcucuuacccgcugagccaucucaccagccccuuuuuuaaucuuuaaaaaaaaaagggggggggccuggagagauggcucagccguuaagagcacugaaugcuuuuccagagguccugaguucaauucccaacaaccacaugguagcucacaaccaucuguaaugggauccaaugcccucuucugguguaucugaagacagcaagggucuacucacauauguuaaauaaauaaauaaaaauuuaaaagccaggugguguugguucagacagcagaucucuguuuaaggccagccuggucugaucuacaaaccaaguuccaggacagccagggcuacacagagaaacccucuaaaaaaccaaucuauguagggggugcuggugaaauggcuccguggguaaagguacuugcugcgaaauuaaugaccugaguucaauccuugaaauccacacaguagaaggagagaaccaaccuccaagggugcuaugacacacacacacacacacacacacacacacacacacacacacacacacacacgacuauauauaugaauauaugacucuagccaggcauaguguggcacaugccuuuaaucacaguacuugggaggcagaggcaggugaaguuugaggccagccuacagagugaauuccaugacagcuagaacuaugaagaugaacccugucuuuaaaaacaacagcaacauaaagaaucuauguagggaagcuggaagggaugcugauacagucugcaauccuauuacucuagagguggaagccaaagaaucagggguuucaggccggucuugccuauacacugagcuaaaggccagccugggacacaugagacuuugucucuuuuaaaaagacaaaacaaggggguugguuagauggcucaguggguaagagcacccaacugcucuucugcagguccgaaguucaaaucccagcaaccacaugguggcucacaaccaucuguaacgaaaucugagucccucuucuggagugucugaaaacaacuacaguguacuuacauauaauaaaaauaaauaaaucuuaaaaaaaaaaaaaaaagacaaaacaagccagaugaggucugugaguuccaggccagccuggucuauaaaucaaguucaaggccaggcagggcuacucagagauucugucuaaaauacaaagaaacaaaacuacaaaaagcagaaaaaggaaucuacgaaagggcuggugaagggguguaacucagugguagagcauuugccgagcuagcauguaccaagccauggguuugaucccuagcacuaagcaaaagaaaaguccuacaaagggcuuuguuggcauaguagauugauucccaguagcuuuuggcacucaagagcaccuucuacaauucacagcuccugggggaagaaaucccaucuuccacagaugaggaggcugagaguccugugaaaagagauaaucaugucucauacacucaggagagaaggcuacuucugccugagaaaugaaaaggcuuccuggggucccaacaucuuaguccaguccuaagaugcggaagggaggaagaucaaaguuuacagagagggaaagcauuucaggaaagaaaccagcaguaaagcuaggugugugugagcuggaaaugucaccaaugagaugacaagcguccgguacagagaagcaacuguggaguguugggugguggcaccuagacuacagacugaaggaaagcuggaugaccagcucagggcagcugguggcucagagucagccucauugucucccuucuucuaucccaaccuagaucagcccagaggaggaagagcgccgcagggugagacgcgagcggaacaagcuagcagcugcuaagugcagaaaccgaagaaaggagcugacagacuuccugcaggcggugagcaucauccccaggcccggacccacagagccccaagaggggucucggcucccaagaacacaaaagacccaaaauuacuccucaggacucugucauccucccugccuguggggaaguccuggaaaaaggauaagggaaaguggcuuaaauauuguuugucgggcuucgaggcagagucgaagaugguaggcagcaauucuccuaagaugcccccgucugaugggagucauggccauuuucucccagaggcucacgggagggaguugcaguccagacuuguuggggaugacaggcacagucccuacuccagccugaggcuuggggaucuuuagccuucauuuuccuaucuuucugcuaauccuguaaaggagaccgacaaauuggaggaugagaaaucggggcugcagcgagagauugaagagcugcagaagcagaaggaacgccuugagcuggugcuggaagcccaucgccccaucugcaaaaucccagaaggagacaagaaggacccaggugguucuggcagcaccagcggugcuagcagcccaccagcccccggccgcccagugccuugcaucucccuuucuccaggacccguacuugaaccggaagcacugcauacccccacgcucaugaccacacccucucugacuccuuuuacuccgagucugguuuucaccuauccuagcacaccagaaccuugcuccuccgcucaccgaaagaguagcagcagcaguggcgaccccuccuccgacccccugggcucuccuacacuccuggcuuugugaggcacccagccacaucccuugcuggugcuacuccaagccauccccuuucucccauugauccagcaggccuggaccauacccuugccccaaaccagcagaucuuuuaucucuuccgacuagaacaaacacauuaugcuuugauguagagccagcuuggaggggauccccaaagcugcucacuguuuuucuagagcuggccuaucauaauuugcacaaaauuagaggaaaauauguucccucugccagagaacgccuggcagcccagacuuuguagauccccagggguccuuugacacccuuaccccuugcagaccacuuucccacaccacgucacuuucuucauguuauccagccuacucuacaccuagacagaaggugcccuuugacuagccuagaacacuaacucacacagcaucaacagccagcagcaccggacauccugcaggcuccuccugaauggcacaacgcaggaggcgccaggggcuucugugaggagcggagcugcacucccuagcucugagaagcgcuuagcuucaggguauccgagccuccaccgcaagggcagcugcuauuuauuuuccuaaagagacuauuuuuauacaaaccuuccaaaauggaauaaaaggcuugaagcucuag

SEQ ID NO: 9073 - RNA, 4448 nt, Mus musculus
cgaacucccggaagucgcucugcggcuacucgcccggccggggcccguacaagcuccagcuucgggcgaacccggcccgggcaucgucaugaccagcgaacuagacauuuucguggggaacacgacccuuauagaugaagacguguaucgccucuggcuggaugguuacucaggucugugagccgcccucccgggaagcuguuguuggggaucgggaagagggggcguggcuaggauuuaggcuugguuuagggaaguggacagacugcgggaagucggggaaguguaaggauuggagguggagguggaaccccuggagggccucuagggucuuaugguagcgcccacuccucagugaacgaugcaguggcucugcgaguacgcuccggaaucuuggagcagacgggagccaccacaggagugcugcagagcgacaccauggaccacuaccgcaccuuucacaugcuugagcgucugcugcacgcgccgccgaagcugcugcaccagcucaucuuccagauuccucccucccgacagacacuccucaucgagaggugcucaccaggggugggggacggggguggguacuggcagggaugucagucaaucugacuuauacccauuuuguagacugaagcugagucuggggggaggguauugggauauacacagggguagauggggugaacucaggaaauuagaaaauugagaacaagagaaaccaauuccaaacucccuucuccuucccuaauggaucaccaauaaugaccugugccuccacaagguacuacaccuuugaugaggccuuuguucgggaggucuugggcaagaagcuguccaaggguaccaagaaagaccuggaugacaucagcaccaaaacaggaauuacucucaagagcugccggaggcagguggguucuacacauaacaccacuaccugucuagcccaccucuggauccuucuuacuacucuagccccaccucuagcccguggucuagcccaugauuguggaaccaguuccuucuucauauaaacccucuccucccuccaccuccccucuggccaggcggaccaggcuuaggcucagucugaccguggcuuuccuuugcuuauagauuuucauuggcucccacuguccucgaccuucagacucagguugggucacuauagaccucucuggacuuaacauuucuugagccccaaguuuguuuuuguucaugguacuccugccuagaagaugcuguucuuggccacaucuaucccuugaaaucgacaagggagcuagauccuaccuuauccaugagccguuuugguagcauucaugccuugucuuuaagggagaaguaccaggguguaaacugggcgcagauggcuauggguaugggucugggcucuugcuacaaccuuuauaggccuugagugccuuuccuuugugucuagaaugaguucguguguguaugcugcuugguucacuccaaguuacucaggagaauccguucuaauucaggcucuugaagagccagagauugacggucgugaugcuaaauugaacuuaaggacaggaauaaguaagcauucuuuuaaggaaaaaugccaaaggcuggcaaacauugucaaaugaugguaguuauuaauaccuagucaugccaggggugcuggcgcaugcuuuuaaucccagcacucaggaggcagaggcagguggauuucugaguucgaggccagccuggucuacagagugaguuccaggacagccagggcuacacagagaaacccugucucgaaacaaacaacaaaaaccuagucauuuguugaaguguuagugcuaaauuaguaccugcccaccagauaggaggacaggagggagagaucccauagcagcucgcucaugaacgucuccugaccaguguucuguaauugccggacaguuugacaacuuuaaacgagucuucaaggugguggaagaaaugcggggcucccugguggacaacauccagcagcacuuccuccucucugaccgguuagccaggugagggucgccgccuccucucugaccgguuagccaggugagggcugccaccuccucucugaccgguuagccaggugagggccgccgccucccuuccuacucgagguuuccugggcccuuagccuguacgccuucccucuccuaacccuuuccccuccgcucuucuggaggaaugauuauucuguuagugaccuguaaacugcaucaaauugccaagcguaaggcauuuguaaagcauugaagaagugcccagugaugcaguguggccuuccgcuguacuccuuaggaacuccucguagaggugggagguugguaaggaaaugguccgugguuggucccuuggugaguuagagcagaaacacaccagagcuaaaauguugaaccaagacugcaggugggagcuaccugcuaagagggauuuaaaacaauaaagaguuucuucaagcaugguucuguguaagcuuacucaucagacacugcugugugaagcagaaaaagggauuucugguccuaagagagccacugucccugucugcagggauuacgcagccaucgucuuuuuugccaacaaccgcuuugaaacaggaaagaaaaagcugcaguaccugagcuuuggggacuuugccuucugugcagagcuuaugauccagaacuggacccuuggagccgucggugaggcccccacugacccaggugccuggacucccuacccccuuggggacugguucccugcugucaguuuguccuagcguauagauagcuuccacagcgcccucagccccagaccaccucuacggauaguccccuggcuccacgcacaccugccugcaggccaaggguucaccacugcguggccuggggcaugacauuccucuuuccaucucugagacuccagugagguaguggugaagaggguucaccucccaagauggucuuucaugcacccacaacgucuuucauggccuucgcagacucucagguggacgacauggauguggacuuagauaaggaguuucuccaagacuugaaggagcucaagguucucguggcugacaaggaccuccuggaccugcauaagaggugacugugggguccgugagaccagggauaaaauacucuuagucggcuagagacauaacugcaucuuccuacagccuggugugcacugcccuccggggaaagcugggugucuucucugagauggaaaccaacuucaagguccguugcccugugcagacccuucccccuaaagugucaagagccuccugugcgcuaccccugccaggcagcucugcucauuccugaaggugaccagcagguggcacugcugcucucccugucugcccuugagggggucccaagcucauaacaaaagggacuugauugucugagggagguggaugaacuuggggaggggccuggcccuccuuccgccucagugcgcagccuccgcaucuggagcagaagacagaacucccgagauccuugccccacagaaucugucucgggggcuggugaacguggcugccaagcugacccacaauaaggaugucagagaccuauuuguggaccucguggagaaggugagcaguccuguccccacccccugguccccagccuguccuguccccaccccugguccccagccuguccugugucuaagcaguccuaguggugccaccuguucccuuggaccuacaguuuguggaacccugccgcucugaccacuggccacugagugaugugcggcucuuccucagccaguauucagcgucaguccacucccuggauggcuuccggugagaggugccaggccugcuggcuaacuuccuugcccuccaggagacucaggcuucucuguugaacugcccuguggguggaagcuccgccucuccuuguugugaccuuggccaaguucuuaacccuucugugccuuagcucucuuaaauguaaacugagacuaaagcuagaagacucauaagguuuauggaaacuaaauaguccucagaucggcccucagcacuggguggagagcagggagaaggaagccgggcagaauggcucaaguuuguauucccagcacaucggaagcugggacaugaggauugccgcuguuuuccaggccagcuugagccacacugugagacccugucucaaaaacaaacuauccaaaaaaaaaaaaaaaaaggaggggcuguggugaggaagaaaguguagaaaacacugagcggugguguggcaggcauggcggugaguggacaucagcucucaccguuaucuucuucauugcaggcaccaggcacucugggaccgcuacaugggcacccuccguggcugccuucugcgccucuaucaugauuaaagcccuuuuccuuccucccuccgacauacccugagaauaaaguugccauaaguuuggag

SEQ ID NO: 9074 - RNA, 7915 nt, Mus musculus
gggugggggacuuggaugggaagaggcucgggaaagggcuggcacugggcccuaguguccuccgcgcccaaguucaagcuugcccgccuucccaggggcuuccauucauuucgagccaagaauacugcugcccucucccccauacuacuguaguuuugcgcuggcacggcuuggggaagcaguaccccaaguaaagagaccaccuggaggccguggauguggaugcagagggaauuggacaauuaauuuggacaauuaauuaaguuggacgagggucuggaaaccuuggaugaaguuuuaggaucaucuaagugaugaugguuuaacacuggauaaaauucugaaaggaguagaauuugaagcucugaggauuaaaugccuaguagguucugggaggcgcagaaucggguuacacggaggugcgaaugcacagcaugggauuccggaggcacagguuagauagggucuaggugggcagaauaacauuuugagugaaggcccgggguccuuaggugaguuugggggccaagcaucaaggucaguggccuaaggauccaaacuuugggaaacucuggcugggcguccgcaggcgacuccaggcagcgccgcgggggaccgggugggggccuguggccggccggggcggagaagccggggggucggggucccucccccuggcgcgggcucaggaauccgccgaagggcgggcggaggcgccggggugggccgcggccggcgggcgggcggggggcgcuuccuggggccgcgcguccagugagcugcgcgguccguccguccguccgcccgcccgcaggcacugcuggagucgacgcgugaguggccuccagcggagggagggcgcgggccguuuggcggccgagucggugcugcgcggagcggggaggccugcgcuucacgacucgcggggcgggggcggggcgguccgggauugcgggccugggccauaggccugcgaaaggauucuguccccagcccuggaagguuccagccucagcacaguccugagacgagacagcugggacccaggcuccccuuccagauagagggaauggggggugcuguggcagaaaccccugacuucugcccaccaccucccagccucaggaugcucccuuuugccuccugccuccccgggucuuugcugcucugggcguuucugcuguugcucuugggagcagcguccccacaggaucccgaggagccggacagcuacacgguggggaccguggggucaccagcuugggaugggaugggaaggacagugagaucaggauccuggggaggcugcuucugggcaagauucuccccggcuugguugguggaaagcuggaggccauuguguggagcugacccgagcaugacucugaacucuggcccuggucuuggccuggcuaguugguggagacagccaggguggucacuggccacaucggguucccuuccaggaaugcacagauggcuaugagugggaugcagacagccagcacugccggggugagucucugucugggguacuagccaucuucaggaacugggaaggggguuguuguuucccagggauaccuuaccucccagagcugcugcaggaacuugauggcccuuuucccuguccagcuugguagccagccaugcuucccuugugccacucaguuaggagcccugccccuucaagaagcuggacaaacggccucuauccugcaggagggaagggagcaccuggcuauugcccagagagaaggaaauacgcacaccuucccuggacugcacuguaccugccuagcccagcucuuuaucccaaugcagccugggagagccgugcaugccccgugggucggcaggcccgcaaaauuucucuugggcaaagguagaggcagggauuugaggaggcaggagaauggagauaccagugugaaacagggggccccacucccaguccugccaaucccuggcagggcuucugggucagcagccuuaguuugccuagcagagagaaagucuugcucuguugcucagcuuagagaaggccaaguugggcaucugccucccacuaccuccagggccagcccaggugacuggcugugcccagcaggccccucucugcagaugucaacgagugccugaccaucccggaggcuugcaagggugagaugaaaugcaucaaccacuacggggguuauuugugucugccucgcucugcugccgucaucagugaucuccauggugaaggaccuccaccgccagcggcccaugcucaacaaccaaacccuugcccgcagggcuacgagccugaugaacaggagagcuguguggguaagcaagggcugaucgggugucugggcuuccacgcgguuuaugaguuuuuuccccgagacaggguuucucuguggagcccuggcuguccuggaacucauagaccaggcuggccucgaacucagaaaucugccugccucugccucccgagugcugggauuauaggcguguguuaccauuccugacuuuuuuuuuuuuuaauuuuuaaacuaauuuuguauuuacuguacaaaguaaugcguuccaucaugguaucaucuccuggcacaugucauucuuguuuguuuucaucuucuaguagcacuuuuugguccucccuaguuuuuguuguuguuguuuuuguuuuuuauuuauuuuuuuguuuucuuuugggggcgauuuugagacaguuucuggauuugauccccaccaucacaaaaacaagaggaucucuguggguuccaagcuaguuguggucugugugguagcagacacuuguagucccaccaguggggagaugugagcaggaagaccugaagguaaagggcacccucaaccguaagggcuuugacugaggacgaccugagcugggugagcucuuaucucaaaaagggagcuaauuaauuaauuaauuaguaaaaguaauguucccuauaaaauccccaggccucaugcuccucuucccccuggcuccucagagacagauccaagucgucaucuacugcaggcuuagcauggucugcaggcccaggaaggcccuggcagccccucauuuccuguacagacacaggagcucugcucgcagccucuggcagcuuuuugaucuggagucagccuugggaaccauuggccuuggaggaggaaagauccuggcccuagagucagcugagggguguaaauggacaagguuuuguuuguuuguguauuuauuuauuuuuaagacagugucucauucuguagcucuagcuacaacuagcuuggaacccacagagauccucuugccucugccccccacguccucccccagugguggaguuaaaggugugugccaccagaccccacaaggccuuauuuuaauaugcucuccuaguggguacuucuccuagugacuccuugguggacucuuuuuuuuuuuuuuuuuuuguacuauugggaugaucugaauuacacauccaugauuuagugccaaccacccacgugcccaugugaauggagucuagggcaguccgccuccucccgaauugagaucccucacguggucaggagcauaugggggccuccaggcgaaggcugaaugcugucucucacagauguggacgaguguacccaggcuuugcaugacugucgcccuagucaggacugccauaaccuuccuggcuccuaccagugcaccugcccugaugguuaccgaaaaauuggacccgaaugugugggugaguucugaguggcucugcuagguucuuguucugugaccuuggucuggcuccuggucugaugccuuaccucaccccaguccucugcuacuagugcacuccugucacuagacacggaagauuaaaugugggugacucagcccagcucgcugacgagggcgggcaggggugguugccgaggugagccaacucaggccccaccuggccuguguucuacuuucccucccccaccuccaucucagacauagaugagugucguuaccgcuauugccagcaucgaugugugaaccugccgggcucuuuucgaugccagugugagccaggcuuccaguugggaccuaacaaccgcucuugugugggugaggcugugccagacaagguucugggauccuggguggagaugugugacgugggggcaggaucuucuucuugagcccaaguugaguguguguguguguuugggggggucugggcgugacacugcucucacccuccuguuuguccucgcacccucagaugugaaugagugugacaugggagccccaugugagcagcgcugcuucaacuccuaugggaccuuccugugucgcuguaaccagggcuaugagcugcaccgggauggcuucuccugcagcggugagagucacuugugcuacuggauacagcaucccccccccccccgccuccccccccucugccgccucccuuagcacuugcaacauauuggagcaacuccaggcgcauggucauuugcuuggggcuuccgcacgucuccuugcacucacaggccucccuaagcuccgucuugagcuugucguuuggcacucccagcuugaggggaugcuaugcuaggggcuucugaagcuugccagagagacagagaagauggaggugccagucuuccugaaaguugaguugacuugcauuggaauccuacacuggggaaaguuuucucuucuuucugggcacaugucuacugcagacagguuauuugaguauuaggggcagugauaacaggcuucaucaagucucaggcagaaauagugggaagcaccauuuguuuaucacuuaaaauuuucagucucauuuagucuggccagggaugauugacuuuuguaaaacaggacauuaauauuccuccagguuggcagaacuguggaaagcaagcagagaggucagagaaaguacugacuuucaucuuuccacuuacugagauugacaugacuguccaaguucagaggggaaagaugagccgggcuggggugugagcccaggcgucucacuguguuaccuggcaugcccucauuuacuuuaugcuuuaccgggaagcacaggaucauugguguucggcugugugaaaggaacaaaagcaaagagauaggaugcugcucgggguaggguggggggcacacacuuagcccaagucugggcauucugaccgcauauugcaagacuugaaaagaacagagcggcuauccccuuggggcaccugcucauuugacuggcacaauguggacccuuucuaaaauggguuaguaggacuuaggcccaagccucuagauucuugcugcuuuuuaagacagagucuauguaaccccggcuguuauaaagcucucuguguagaccaggcuagucuacagagaucuguuggguagugcuagaaucaaaggcacaggccacuauguuaggcgaaugcuuuguuaagucuuaaaguccuggggaagagaggugcuccgcaugcuggaagauuccuuguuguaagacagggucucacuguguagcccuggcuggccugcagucucuuauguaguagaccaggcugccucaaaccgaucugccugcuucugccucugccucccagauguugggaucaaacaccccacuguuuguuuuucaaggcauggucuuguuauguagcccuggcuggccuugaucuugauauaauccuggcuuggcuuccuauguggaccaggcuggccuuuaacuugguauaauccaccugccucuaccucccaaaugcugggauuauagacauauagcaccaugccaagcuucaaaccuuucuauucuuuuucuuuucuuuuuccucucccuuuccuugcugggauggaaccuagagcuucaagcguguuaggcaaguacucuaccacugaguuauccccagcccccaaccuuccucugaaaccugagccccccuugagcacugugggucuccuucuuuccuucucucuucccacauccauccuuaugggggugcugggcucccucucucuuggucaaggucugugggacucaguugugaggccuccccuuggcccaggguccucauccccgcccucccucagauaucgaugagugcggcuacuccaguuaccucugccaguaccgcugugucaacgagccaggccgauucuccugucacugcccacaaggcuaccagcugcuggcuacaaggcucugccaagguacaggugcuugggugggcaggaguugagcggcugggagcuuacugugaguccuagaguccaacuccaccucccuuggcacagauauugacgagugugaaacaggugcacaccaauguucugaggcccaaaccugugucaacuuccauggggguuaccgcuguguggacaccaaccguuguguggagcccuauguccaagugucagacaagugagucaaccugauggcaguuugcugugguaacuccagaggucuguggggccuacugguuuaaucggguuggugaggacucauaaugucucauuggucuuuuaugcucgggcuuuccucuuuaggagguggguauuugggaaaugggcccagcccucauuccugucccaucuuggggucucuagccgcugccucugcccugccuccaauccccuuugucgagagcagccuucauccauugugcaccgcuacaugagcaucaccucagagcgaagugugccugcugacguguuucagauccaggcaaccucugucuacccuggugccuacaaugccuuucagauccguucuggaaacacacagggggacuucuacauuaggguaaggugcuucuuuacccacacucaacugacucaaguaaucuaaaauaggaggucugaagucauguaagugggagcugcccugccucugcucccaaagcccuguccuaggaagcaggggccgugucagaagucagaguugucuccuaguaagcacgcuacaggcaguucuaaggaacagucgguuaguggggucuuacucccaguacugcuuucuccugccuggcuuugacuuccuuauacauaaaacaagaaauguaguuucugcagagcugggaucagagacuccagucugcuggcaaagggaaggcaguagggaugcuggcgcaggugugagggcucuugcacguggguccuuaagcugccuuaggcacugagauguuuggcaucaaaacuucuuucaaaaucgcuuuggggcugaccucccagcuccauggcagaacauuccucuauucuuaggcccucaguucuugcucagcaucagugucagagcgagaacugaguacucuagagggaagugggacgccucucgggcaccaaagucccauuauccccaaacuuugagucaucaggaggucaugauggagggaaagucgaggcgacuagggggcaggaaggaguugccgaggagagcaaguggcagggucucagauacugagggagaaaaaggucuacagguuagagccagggaaggacuugagcaggggccuugucagacuuuccugacuucaggccacgggaagccggcugaugcugggggaggguccuggcuccuaggcuaacaccaucucuauguucuacuguccacuguacccugcagcaaaucaacaaugucagcgccaugcugguccucgccaggccagugacgggaccccgggaguacgugcuggaccuggagauggucaccaugaauucccuuaugagcuaccgggccagcucuguacugagacucacggucuuugugggagccuauaccuucugaagacccucagggaagggccaugugggggcccccuucccccucccauagcuuaagcagccccgggggccuagggaugaccguucugcuuaaaggaacuaugaugugaaggacaauaaagggagaaagaaggaguc

SEQ ID NO: 9075 - RNA, 4785 nt, Mus musculus
uaaaaguuuuauuuauucauuuauuuauuuauuacauguaaguacacuguagcuguccucagacccuccagaagagggagucagauuucauuacagauggcugugagccaccaugugguugcugggauuugaacuucagaccuucggaaggaagagcagucgggugcucuuacccacugagccaucucaccagcccaugcccucggcuccuuuaaguggcgauaggcccaugcuucugggauuugcaucacccucaguucuuucaagaacacaaauucccaaucuguugcuacagcucagagguggagugcuugccuaccaugcauaaagcccuggguucaaugcccagcaccccagaaaaacaaguacucuucccgugucugucuucucuuacaccaaacagaaugggccagccuuaauggggcuuuguaagaaaucaaagcuaaagcaaaaagccuuacagaucuaaauaacauuaaaguauuucuuuaaugaacaccuuuaaccccggcacuuagggggcagagacaagcugaucuaagcacagccucaucuagagaaacccuguugcuaaaaaaaaaaaaaaaaaaaaaucaauucccucuacucccacuaucaaaacaggacagcuccuuccugcaacuuucucagacuuggggccaguuaaggaaaccagcucuccugcccucaggccagaauccacacuaagucaaaggcucaggcuuuagcugggguaacaguagguggggcuccagacugaaguccuagaauccaccugacccacccugaauggacuccagucacaguacaggaggccaaaggcucaacuuagcuacucauagcaccucugaacguggcaguggggugagccaaccgccccagagggaagagaggggagagcugaagagaaccuuagaaagcagugucacccaaguaaacuguauuuagcccacauguggaaaggggcucaggguaccucacuguccacuauaaagguaagaaguuucaggugugacacacucggagcccaacugcccugccuuggaacagugcaccccaacucaagaaggagaugccgcuuacuagggacugaacuagaggugaagcacagggaaaccacccauccaucucccaccacaggguccccaaaaucccaaacccaaaagccauguuguuaauuagccuuuuuauuguuuuuuuguuuuguuuuguuuuaaauugaaggucccuuacugguccugcuuccaugaguggucaagaucaaaggaaaggggagggcagccagcuggggcagggagggucauuuccacauuucauuuacacacagaacuaaacagacaagcacagagucacuauugugguuagaaguuggcagcaugggauggggagggauacggaguaggggugucguuaaaaaaaaaaauacaggcuccccccaaacugggugccuaggacgggacuuggucugcgucaacccaagaggaaucagaagaucaaaagcaguuugggaaggccagaaccgucagggauggagggagaaggacgguccagggggugggagggauguuuggcaacuggggugaagggauagcccucccccugcugggauccccccagccccuccggucuggcaggaaaggggcagccugcaacacccaagagcaggucuggggcuguuaagaugcuccaggcagggggcuggagguggcucacaaaggcuugcccuccagggaaaugacggcgcugccaccuaguuucucugccagggugcagcgguccuugaccuccucguagcaguuagcuuguaauucaugcuugauuccuacagggugaaaagagagcagugagcaggaagcacuggggugggguggaguucuaucugggaaggagccggcggagcagaugagaggaggaagguagcagcuagcaggagacugcgcccaugacuuuugcagaaggagggauccuuaccugucagcuucuucuugauggcauccuuggagcuggcauagaucauuuugcucuugaggggugcauucucgggggcccuaaagacaaagcaaagaaaaggcugcagcuacauccagggaauaaugacucaagaaaagaaacuuuuaggauacucuaacagcagggauuuucuuuuccccaaguuccucacuaguuuuuguuuuugaaacacagggucuuucuguagaccagguuaggcucaaacucacaggcaucugccugccuuugccucccucaagcugggacuaaagguguggguaccaccacaccuagcuccucacuggaaggguuguuacaacccuggcaccccccacaccuggaauaauuuccguuaagcucugagaaagggaaccagaggcaggcagaagagccugaauacggagcucaccagaagaugaacaccagguccuccuucuugcucuccuuggucucauagguugcaucauagagugcauagcggcaguccuugucuggcagcaucuugacaaaagugguguaggggucguccacagucugccccacaucuccuaccaggaucuccuugcccuccuccaggaugauguucuucuuguccucacucaggcaaaagagcaccgccuucuugcguuucuucacuucuucugguguugaagacuugcgaaccuucaugucauugaacaccuugaugacaccaucagagacagccacaccagaggccugagggacaaaucaaaaauacgccuuguaagggaaaggauucugggguauucuuugcaguuacaggaaaccucagucagaguaacaaacacacuucucagccccacacagauuaguaaugucccugcagacuuuuuucccuauccaauucaucaucuaagaacuaguuaggacaaaccuccugcaagggagagauccaauuaucuaguucaacauccccauaaauguuagaacaguacuuauuaaaaagaagaccuuagccaagagugguagaacacgccuuucucuuagucugaaaccagucuuagaucuauagaaugaguuccaggacagcaggggcaaugcagagaaauccugucucuuaaaaaaaagccaaaaagaaaacaaaaacuugcugaguugugaacaccagauucaaagaacccgaaagauacugauuaaaaugccagcauaggauagauacaaaacaccaaacuccugggccauagucucaucuccaggaaagagaaucagaacaccagaaauucacagacaccaagagcugcucgguaguuuauugcucauuagaaaugcagucauuguauaaaugacacucuuuccugccgagaucucccauacacaagaauuacaacccuuaauuaaggcccugcuggacaacucccugucauccaagaauggugaguccuuuaaaaaaaaaaaaagacugacaaauuaauaggucaaacugugaugccccaaaucgccgaaaacuuucugcuuuguacggcccugggggacgacccaaucagaaaucuacaaccaacccuccccaccaccaccauggaacugcagaggaagcuagccacgugauucacccgcuuccggaguaggcggagaaagauuggacuagguucagggccuccccaagagacacucguagcccagaggcagcgaggcggccggaccucagaugucucaacgccuaaggcucgccuuuaggaauaggcguaaacgcagucagcuggagagguagcucuggccagucucacuccaaaaaacaguuucccgugcccucaggcuaagcauaaaagcugguggcuuccgggcgguacccgccucggucacuucccuaaacgcggcuccacccucggccccauccggcagagcagcaaaaggccuagcucggcuagagcugcagccgggauggcagggcccaagcaugugcgcacgcgcuguucuagcucuagcccgagguacagugacuacagaauggaguguguaaucgcucuuucuagaaguggggcgauagccuguacaggaacccacuccgugacucguguugcaagaaggcuccagaaccagcgucucaaucagguuccccgaugccucagcaucucccagagccacaccgcggccgcccccgccccgcccugacggcggaaucccugccaccugcuguggagaccaaccuagccgcagagggaggaugaugcggggaagggaacagcccuuggguggggcgcgcgccgacaccucgcgcgcuuuucccuagcggccccgggccaggguuuggaugccgcgugcucugguccagcgcgcgccaucgagaaccagcgagcguugcccgaggccccgcacacuggaccccucccccacggccaguggccgcgcuggcgcaaaggcaggaugggggaggggagaggagccagggggcgcgcgagcgacguccgaaucggcccuucccagcgcccggaggcgcgcacgcgcggccugcccuucaaugagacccuuaaucucgcucggggugcugggggaugggauaccaagaccgcuucucugccgcccccaccccgcccggcgcgcaagcgacggaucacgaacccacuucccucgggcgcaguggccuaaugcucaccauguuuccggaaacgaaagggagacagaaagagcaacugaagaccugagccgccgcagcugcugccgggauccgacugaacgcggccucucccggccccuuccguuuaguaggagccgcacaaugaggggcggggcggccuuccggcgcuugccgcgcgggccgacgggaagugaaguccgagg

SEQ ID NO: 9076 - RNA, 1021 nt, Mus musculus
ugcagaagaucccuaguuguccgguguggccgguuaugagcgucucuccgccuggucacauguugcaaaaaacgaggagcaggagccacccuggugcccagcuauggagccccagcgacugcugcccgggugucucuagagagaucgcgagagcgucuggacacccugaugccucgcaggacaccccaggcaccccgucgccaagcuuucgucagguccaggccaccucugcuccggagcucuggacccagaagcagcuggagcuuaagguggcagagcuggugcaguucuugcugauuaaggaccagaggaagauucccaucaagcagucagggaucaugaaacaugucguccgagacuacaaaaacaucuucccagaccugcuuaaacuggcugcagaacggcuccacuacguguucggguacaagcugguggaacucgaccccaagagcaaugccuacauccucaucaacgcccuggagccagugggcaaggauggugaacugagaggcuaccagagaacgcccaccaccggccuccugaugauuauuuuagggcucaucuuaaugaauggccacagcaucccagaaaacgaugucugguguuuucuacgucguuuggggguguaucccaccaagaagcauucaguuuucggcuauccgaagaaacucauuacugaagacuucgugaaacagcguuaccuggaguaccgucggauaccccacacagauccuguggacugugagcuccagugggguccgcgagcaaaucuggaaaccagcaagaugaaaguccuuaaguuuguagccaaaauccauaaucaagaucccaaggacuggcccacucaguacugugaagcuuuggcggaugagcagcguagggucagaccagagccaaaugguccagcucugaccucuugaaguaaacguucaggauucacgagcauaagcuagaaaaauagggaagaugggugcagaaggagcauauuuccacaauaauuaaaauguauuaccuuuaaaau

SEQ ID NO: 9077 - RNA, 1421 nt, Mus musculus
uggagacgcauggcuucuucaccaggaacgcgcgaggcaucuucaguuccuccuggcccggcgcgguucgcucugguaagucgaguucguguggucgucccaccuuuucuuccaccggaucgggguugaggcgcgggaauagggacaguucaaggaaagagucgccgaggcguguccacguucuuaggacagaguguaccagggaccacgcguggcguuuccaacuacgccgaaggucgccgguguccacagagagggugcagccaggugcaccgggaucgcagaagcgcuaagccagcguccuuuagcucgacuggcguccccgcggcugcucgcgaagucuucaagugcgagcuggacggacggguucacgcuuuauuggcucgcggcgguguguguugguggcucgggcgggggugggguagggguguugaucugaucuaauuagcuuggaguggccgagagagcgauggcgcaugcguugggaaauaacggugacaacccaccuauuuguuaccugucgaaccgguuuccauuccgcugcgggugagguggccucgcggcccgggcgggguggcacgacgggggcaggguuagggggcgugcuccgguccccacacccagaagcacccggcccgccccggaccuccccugcccagcgugcucacguuugcaaacuagaguuucggagggagcgggcacggaaagggaggggagggcaacguuauuugcaccggcgcucgcacgcucugugggcgaugacauaaaacuggcccaacagguccgggcccagccuggcgcgcccggggcgccgggagaggcacaaagccgcggagcgggaaccggcgguccgggcccgaacccagcggccagggauccccaaggccagggugagcaauucuugguucagcggagagguauuugcugggcaccggguuccugcggaaaggcacgcgagacgagaggugcgcguggaccgggaggcucggaugcgccugugaauccaaagcuggagccugccuucugguuucgagggcgauuaaacugcccugaguccaaccuaacccaggccagcaccuuggcauaugggcggguguauucgcccaaacucuccuggucauaaacagccggauuucagauucugaaaaccuggaagaggcucugggauaaugacuccagcugagugagaucugacacaguccucuugccuguugcaaccaguguccucccugggugggagaucagcaagcagcucccccuccacccugcuguacucuucagcaggccuaguuggagcuaugccccacccccauugaacugagaguguuccguggccuucgugugagccacacuaugacacuuuggccgugcuggguugcuuuuacuggcugaccuauuaaaggcagggauggaaccugcag

SEQ ID NO: 9078 - RNA, 1421 nt, Mus musculus
cugcagguuccaucccugccuuuaauaggucagccaguaaaagcaacccagcacggccaaagugucauaguguggcucacacgaaggccacggaacacucucaguucaauggggguggggcauagcuccaacuaggccugcugaagaguacagcaggguggagggggagcugcuugcugaucucccacccagggaggacacugguugcaacaggcaagaggacugugucagaucucacucagcuggagucauuaucccagagccucuuccagguuuucagaaucugaaauccggcuguuuaugaccaggagaguuugggcgaauacacccgcccauaugccaaggugcuggccuggguuagguuggacucagggcaguuuaaucgcccucgaaaccagaaggcaggcuccagcuuuggauucacaggcgcauccgagccucccgguccacgcgcaccucucgucucgcgugccuuuccgcaggaacccggugcccagcaaauaccucuccgcugaaccaagaauugcucacccuggccuuggggaucccuggccgcuggguucgggcccggaccgccgguucccgcuccgcggcuuugugccucucccggcgccccgggcgcgccaggcugggcccggaccuguugggccaguuuuaugucaucgcccacagagcgugcgagcgccggugcaaauaacguugcccuccccucccuuuccgugcccgcucccuccgaaacucuaguuugcaaacgugagcacgcugggcaggggagguccggggcgggccgggugcuucuggguguggggaccggagcacgcccccuaacccugcccccgucgugccaccccgcccgggccgcgaggccaccucacccgcagcggaauggaaaccgguucgacagguaacaaauagguggguugucaccguuauuucccaacgcaugcgccaucgcucucucggccacuccaagcuaauuagaucagaucaacaccccuaccccacccccgcccgagccaccaacacacaccgccgcgagccaauaaagcgugaacccguccguccagcucgcacuugaagacuucgcgagcagccgcggggacgccagucgagcuaaaggacgcuggcuuagcgcuucugcgaucccggugcaccuggcugcacccucucuguggacaccggcgaccuucggcguaguuggaaacgccacgcguggucccugguacacucuguccuaagaacguggacacgccucggcgacucuuuccuugaacugucccuauucccgcgccucaaccccgauccgguggaagaaaaggugggacgaccacacgaacucgacuuaccagagcgaaccgcgccgggccaggaggaacugaagaugccucgcgcguuccuggugaagaagccaugcgucucca

SEQ ID NO: 9079 - RNA, 7767 nt, Mus musculus
cggggauuccaucuaguacuuggccucagguuuacaacguccugcucuuccauuccccaaacgggccggcuuuuugcuaccaaccagcuagcagugauucucaaguguuucccuuucaaacagcuucaaggggcucgggccuauagcgcacucagcuccggaagugacgucucccagaggggccggaaguggcaguggagggagggaagauggcggagguggugaguccggugcccggggcggggcggagggagccaggggagguggguagagcccgaggccccccaguagccgacccuggcgccgcgcugucuccccagggggagauaaucgagggcugccgccugcccgugcugcggcgcaaccaggacaacgaagaugaguggcgugagugacgucggggggcggguccaaggaaccugagggcgaggggcgggagggagucaacgaucgcacgggagggggaggggcuucugcaaucccggggcggucgcagauacucgggaggaggggcguggcuuuuggacguacggagaugauccgggcggggcuuggagagaggugucacuuggugacuaaaggggucuugaaccagccccucugagugcugggacacaggccuccagccuggaggugggauucaggucgaaggguggagucuccugaccugcccuggcuaagacucccugucugugugguucucauagcccuggcugagauccugagcgugaaggacaucaguggccgaaagcuuuucuauguccauuacauugacugugaguccugggccuggauggagugggguugcuggagaggguugagggcagccucuggcauucccuccugagccguuuucacugcugcagucaacaaacgucuggaugaaugggugacucacgagcggcuggacuuaaagaagauccaauuucccaagaaagaggccaagacaccuaccaagaacggacuuccugggucccgccccggcucucccgaaagagagguggugaguaggucccccauuucaucuuuucucuccugccucuuccuucuugcaucucuuggccucagggguuccugaaugggcaggaggcagcauucuucugccauggcuucagcuugcaaaggauggggaccaaguugcaggcguagcuuccagaguccagcacugccuugcuuuagagaaggcagagggugggauuccaugcugaggggcccaucccccccuucgccaucccaccaccauccccaccccagaggaagacccuggaccuaucucugcagccggccuccgcccaggccagcgggaagaccuugccaaucccgguccagaucacacuccgcuucaaccugcccaaggagcgggaggccaucccagguggcgagccugaccagccgcucuccuccagcuccugccugcaacccaaccaccgcucaacgguacccucagcaauuccagggaccuugcuuucuucucaggucccaccuucucuaccuucugacccaccuuuccugguuucucucugcagaaacggaagguggaggugguuucaccagcaaccccagugcccagcgagacagccccagccucgguuuucccucaggugagucuuccagucuuuuuucaugugucugaauguuuugucuguguuuugcauguguucuacuugcaugccuggugcaggugggcagaagagggcauuggagccacugaaacuggaguuagagaugguugugagccacucuguggguccugggaaaagaacccaggaaguccucuggaagaucagggcucuuaaccacugagccaucccaacagccugccuggucuuuccccucuuauuccuugcugucuagcauccuccuccaggaucaucucacggucgcucuuucucuugugucuuguccacagaaugggucagcccguagggcaguggcagcccagccuggacggaagcggaaaucuaauugcuugggcacugaugaggugggucuugaggagcagagggagagggaagccgggaaagggggagugggcuugggcaugguguucacucggugaggccuuaggcagggagggugguggcugggagccaagcagaugaaccccugggccucuucuacucucaguuucucagccucgcuuuauuuuggaaguggagguuggugcuuugcccuuagcugauguuagacuugcaggaagaagccaauggcagugucgugcgccacgcucugcuuaacugcuaccaucuaguauuugccaucugccuugggcaggauucucaggacagcucagauggaauaccgucagcaccacgaaugacuggcagucuggugucugaccggagccacgacgacauugucacccggaugaagaacauugaguguauugagcuuggccggcaccgccucaagccgugguacuucuccccguacccacaagagcuuaccacgcuacccguccucuaccugugcgaauuuugccucaaauauggccguagccucaagugucugcaacgccacuugguaugaggggucuugggaggcugccuauccagaguacccucaccaguccccaccugauccuccuuuuguccuuagaccaaaugugaucuucggcacccuccaggcaaugaaauuuaccgcaagggcaccaucuccuuuuuugagauugauggacggaaaaacaagguuaguggcuugggcacggcugggcuggagugagucacaugaacaaccuuuuccugcucagaacaguugaccauucugccuaugagcaggucacuguuuuuauugaauucuugacacggagcagggaauguacagaaaacugggauuuagagaaauuuucuuuccugagaggucacugucacggcagagcagacaugacagcuacucagguuccaguaacagaggggguucagcacaguucacaggaagcugucaucagagcuuggaggugugugugccuauaaucccagcacucagaaaacucccgaguucaagaguagucaggggacuaaugaguugcaagccaaccugagcuauaaaguaagaaagaccuauccggaaccaaaacaaaaaacaaaaagaagugaggcagcaaagguuaaauauaaaacuagaggcauuuaaagaacaguuuggcccagcauggugguacauuuauaaucacagcauccaggaagcugaugcuagaggaguugacauucaaggauagucugaacagcauaguaaggucuuuucucagaaccaaauaaaaaaaggaucuuugguugugugugcugguacauccuuuauucccagcauucaggaagcggaagcaggugggucucugcugguuuauagggaguuccaggccagccagggcuaauacagucagaucugcuuugaaauaguuugcagguuaaccugugagccuggagauagcugagagaacauacuuagauaguucuaagcaguuggguucagacaugcaggcacugauguaccaggaaguacaugcaaaaagaaaauggagaagaauaggugaugagagaaggucaaaggucagaugauaggcacaagaucagcggggaggagcagguuuggguuucucuaggugacaaguguggagguccuugagaugcacacuuuuuaaggccuccggggugcagagggagagaggcagcuaccuggaguggguugggagcugccuugaagaggagcuucuucaagaggaagaaacaaagcuccacgucguucugcauuaagugcgguguuugaguggaagaccagcaguugcaaagcugucaaauuccucuaggagucaugugugaugagggagccaguccagaguacuguagggaaaaugccugaggcuggcagucccucacaucuccacuggagaccagcagagcagccccggaaggaucacuguggcuguggcuggagcauuagggcucugacacccagccgcgaagaccagccacgugggucucacuauguaucccuagcugacugauuucacacuuguaccugccucugccuccuaagugcugaggucauagguauauacuaccauuccuggcuuggaaauauugacuauuguuaaguugaacagaaggcaauguagguccagggcaggcuuugcugaguauguggaagcuauauagcucacgggggucgggugggguggcggcagacgguuggacauuaggauguagguuccuggcgacuuaagaaguaguacugaucuaagcaguggugacaaucugacugcuggggugggucagggucaggguccugggggggggagcucgacccucucaacuggaacagcacaaagaaugcuccugagagcccuugagauggcucaguggguagcagugauugucacacagccuggccaccugaguucccucuguagaaccuguaguggaaggacaauggacucccaagagguuccugccuugggugugcauguuguguacaggcacaucugcagccacacgcggcauaauacacguuaacucaacaguaccccagaggauugacgggcagguuuuuuccuuuacagaguuacucacaaaaccugugucuucuggccaaguguuuccuggaccacaaaacacuguacuaugacacugaccccuuccucuucuacguaaugacggaguaugacugcaaagguuuccacaucgugggcuacuucuccaaggucagcacucauccaggcugucccucagccuugccccgagccuggcacucuuuaaaacccaccuacucuuacuccaggaaaaggaauccacagaagauuacaauguggccugcaucuugacucugccucccuaccagcgccggggcuauggcaagcugcuuauugaguucagugaguaugugcugccugaccaggagcuggcaggccaagccuguguggguguacccucaucugugcuucacaugcagacaacccagucaccaggagagccgccagaaauaaaggagacucuaccaagguccuuuccucaguugacugcccuguuuccuggaguagguuccagcaucuacuuugccuuuggcuaaaggccugugagccaccccgcuuuucccaucuggcgcugagcagcguggguagcccccaugcucaccuuugaugugcacucugaaccacuggcugugccugagcugugcgggcaguaggcauucaaaaaggcacacgagcacuacaagacagaauuguauccugguucuuuguaaggcuagucucugagaaccgacgcaggcuuuggccucuuuugaggccacggacucuuagcucugacacccagcccagcccauucacuuagcccaggaccagggagacgcuuuagcuuuuuugcuggugagaacauggaugucugacugcucgaagucaugaucuguuuggaguaucuucccgauuagagcaggagaaaggaaacucagggcaaaccgugaggaugugccugcuuugcccaguaggacacacaaaugccaacagacugauaaaaggaagggaggcaauccuuguacacaguuccuaacuagaggcaaauauggcugccaguagacuuguggggcuauuaacuguguggacccugacaccagccucucccgcccuucuuguccaagggugcuugagcaaagagggugagacuacaaauagagauucagccaggagccgagagugcuuggaucaucacgaggccaguagagcugaggggaaggaagggucuccaaacuaauggggacauaaagagcugucggcucacuggggccuaacggucucagagacugucuggcagcgccuuguggucaacacagguaagggaaagggccaccaagggucagguaccuggcucugaggagcccccuguccuuuccuauuauguccuuaaccacccagcccauucugcugagagcagcuggcguucccaggaucgcagcuaaacugaugacacugaaaagguucccauguccucagaccacaaagggcucccucauuacugccauacacccagacacaggcuggcagggcagcgacccauccuggcagccuucacuggcugacaaguacccaaccagagcugcucuucuagccuuuggcccccaacacugcagacagggaagcugcugguccacaccaagaguaagugagaggcaggcaggcagcccagcuccacagcccuucuuccucauaagcugcuguguacaugugacgcuuacuccgccuccugugcucuauugcuuuaggcuaugaacucucgaaaguagaagggaagaccggaacuccugagaaaccccugucagaucuuggccuccuauccuaccgaaguuacuggucccaaaccaucuuggagauccugauggggcugaagucggagagcggggagaggccacagaucaccaucaagugagcccaaaugcccaccuggggguugugguuuggucugucuguuccugggguuucuggggacagaugaauaucuucaggggacugaacuuucccccacuuccacccccacagugagaucagugaaaucacuaguaucaagaaagaagaugucaucuccacacugcaguaucucaaccucaucaauuacuacaagguuaggaggcaugcucaggggauagaugagauauggaugcaggcucugagcugacaugagcuggcucuaucucuugcucagggccaguauauccuaacucugucagaagacaucguggaugggcaugagcgggcuaugcucaagcggcuccuucggauugacuccaagugucugcacuucacucccaaagacuggagcaagagaggaaaguggugacacacacuacccauugccauaccacgagagcuggccgaaccauggcuagcacccugucuugucccauuugagcuucgaagaggcacgcaaagugagacaggccgaagaacagacccaagaggagaagaggccuaggaggggcccacuaguggccagugccaaggcaagcucaggucuaggccaacuccgaggauaacuggcuuacuggcccagguccgcucugaacacguggaccaaagggauccaggcagcuguguacauuaagauggguggggagcauucuguacaggaccggugauuguaaaaauuucuuuuauaaaggaggagcuggaggguggggugggcgcugguugcaaaguucuggccccucuugcccccagaaauaaauuguuuauauaggcagagcuaucaggaguucuuaccaaacugggugccauguaauggcagcuucagggugcuaaggugcccacagacucaggcauugugaagaucucauuuauugggauagaaacagucgcuccaaguggugagaagggaucugugacugucauucucaugaucugguucucaguccucagggaccugggcgugaaucugcaacaggagucacuucuacuuugugacuuauaauacacagcaguuggguggggacccagcugcucagggugauagccucgucuaagagaaaaguggggaaugccccccaccacugggaguuugggccuccggagccaugauccccgugguguuuauugcccuaaagcccccaaaucacuagagacacuauucaaaucggauagaaggacugaccaagucugaggaggaaaagggcuccugaguauacguaccgcugcugcgaggcugggccaaccuagggcccuaugcacuuuggcaucuggacccgggaccguuuccagaccccacaaggugaaauggcugaagcugc

SEQ ID NO: 9080 - RNA, 10664 nt, Mus musculus
cgcccuccaggcggggccgggaacgggaccgggaccccgagcgagccgcgcugcggagcuuguagucgggccggccucgggacaaacagccucggcguccucccgccgcgcugcgguguccccgcccgcgcgcccgccgcacaccuuccgcgcccagcgugagucgcgcaccugcucucggccccccacgcgcggcgguggcgguggcggcggcucagcgcgcaggcgcggccggauuccgggcagugacgcgacgacgggcgcgcgccgcgcauuuccgccucuggcgaauggcuuuacuuuagcgcgccgugggcucagcugcgaccccggccccgcccccgggacccugaccauggacggugaggcugcccucuggcucgggggauggcugcccuagagcuccggggccugcggcggaaucuccccccuccccgcgccgucuuccgccccuuucugcgccgcggguugcugcgcagggagcggcaggccggaugguggcacggggcggggcgggcugcgagggggucugacucaguuaccccucucaguggagggcgccuugacucagugucccuccuggguggggguacgggugaaucuugacuccguuuccuccggcuccccccacccccgugucgaugcgauuaguucuggcuuccuuuccguguaaggaagaaaguaucugacucaguuuccccagaagaggagaggaggguauuacccccuccucagugucacuuaugaacguaaaacaggcacugacucaguuuccccuggcaaaggaaugccucuguguccccuuucucuaguuccccggccucugucagggcagguuucagggucuuggcucaguuuucuuggaagggagggagcuuggcucugucaggccuucgcaggugagggugggcacuggaguuuauugacaaugugccuugucuuucccuuucagaucuguuuccccucaucuuucccucagguaaguuggaccauccauccucaguagucaggggcuguccuggagucggggccguggggauagcaccugauggcugacugugucacccacagagccagcccaggcuucugggccuuauguggagaucaucgaacagccgaagcaacggggcaugcgauuccgcuauaaaugcgaggggcgcucagcgggcaguauuccuggcgagagaagcacagauaccaccaagacacaccccaccaucaagguaagcaagagcccccaggggugucgcugggacacagaugugguggaacgcacugugcagccccagcagacuugccuccuggucaccgugcccugugucuaagagccagauuagggauugcuggccacuagaguacucuguacuuuggacagaucaauggcuacacaggaccaggaacaguucgaaucucccuggucaccaaggauccaccucaccggccucauccacaugaacuuguggggaaggacugccgggauggcuacuaugaggcugaccucugcccagaccgcaguauccauaggugaguucccuaugggcuggggguggugugagggcaggguaggagcaggccggccaggcagcucuuacaguguugcucuuuucuaaacacaggcagaauccagaguucuuaacucugucuccaguuugcaaacagaccuccuuugucuugaauucucuaacaguugggaacuccuuaucuucuuagagccacaaacccuauggcuggacaggccagccucuuagccucuuggaucagaaagauauccaaauggacccuccuagagcuuaaauaccaguugguaaaaccaggcgauaauuguacagacagauagacgagauacugguagagaauuauaacuuccaugauggaaagaaaacacaguuauaaauuaggaggaggagucuggucucaggaagcucaagcuggccuugaacucguuaggguuccccugccuccucuucucaacuccaggggaauaggcauguagcaccguguccugcugcacaggucucacgacuuuggguuggaggguuacagaaggccucugugcuaacucuuaaauggugagaaaaagcagacagacccaaaagaacauuccgugcacgagaaagaaguacaaaaaaaagcaagcaagcaagcaagcaguacgaugcccuuggaaggggaguacguuccauuucgugugcuuaggucugggaaaggaagccccuguggcugagguggggcacuggcuuggaggccugcgagggccagcucccucagagacuugccaguggguaaggagugggaagccuagacauaccugagagcuguggaguugggaggcaagaaggggcucugcuggagacacaaaacuaauaccugaggccucagcuuccagaaccuggggauccagugugugaagaagcgagaccuggagcaagccauuagccagcgaauccagaccaacaauaaccccuuucacgguaggagcaaggggcaaagacauugaucuucguguggugcaaguaucucugucaccuucccugggccucugccgcucaucucccuccauggccaacccagcagcaggaguggaaccuugcugccagcuuggcacacacucacacucugccguugagagucaggccuagagagggcuccuggagagccgugauggaucuagggucuuccuccccuuagacuucuguuuuacaucuccucaaaucaccuuccucuuuccucagagcucccuggcccguccccccucccccacccccaaugccuuccaccacaguguuuuguuuuuuguuuuuguuguuuuuuuguuuuugacaguuccuauagaggagcagcgcggggacuaugacuugaaugcagugcgccucugcuuccaggugacagugcgggacccagcaggcaggccccuccuccugaccccuguccucucacauccgauuuuugauaaccguaaguggccggcugcaguagggaugagggcgggcuugggaacugaauggggaccgggugggugaggccugggagaagagcucuggcuuccuucagucauccagcgccuuccagcugugcugcagggggugggguggagaagacccagagcugcccugugacugaagcggccaggaugcccaggagccuggugggaagugacugcuucccauaucugggguugggaagcuggucugccaagaacugugcucaggacuuuaggaaacaagcucucagagaccagauccuucuagacagcaggaauucagcuguagcagcucccaggaagcucucagaugaccuggcugacuuugauggauugcagucuuuagcagcaggguaaauuaaaggaaaaccaaagggcuucagaguccuaagaaccggaagccaggacuaacuggaagugaggcgggaugaaccgaaagcugaaacugugccgcuaagguggagggcggcagguguggucagaguguguccucuggacuggaggaucucuggagaacagggacauccggccuucagugucccuucaccuagagccaugcuacccguacugcagagagacugaucgggaauugccugacauagagagcagacagcagcggucugcagaaguguggucagcaggcuguggccuggacguggcgggcugggcguggcgggcguuagagcuccugcaggguacccugagaccgcugauguuucaggggcccccaacacugccgagcucaagaucugccgaguaaaccggaacucugggagcugccucgguggggaugagaucuucuugcugugcgacaaggugcagaaagguacacacuggacucugcacggagaggggaggggugaggcugagcggaggugaugagugccagcuaccucagcggcuucagggaaagcaggugaugucacagggaaaaacaucagguguugaggacaacaaccaguugggucacacauacuaacccauacugccacugucuccugcagaagacauugagguguauuucacgggaccaggcugggaggcacgaggcuccuuuucucaagcugaugugcaucggcaaguggccauuguguuccggacuccuccguacgccgaccccagccuccaggcuccuguucgagucuccaugcagcuacggcggccuucugaucgcgagcucagugagcccauggaguuccaguacuugccagacacaggugugacagccgccgcugcggagggagggcagggccacagccgcugcugcagagggcgggaccaaagccgcugagccccagcuaggagagagaccagggcugggugucugaggccagcacuaggguuuagauaugcuguaguucauagcguguaaugauuucugucaaaggcaagccacaugguggucccaucagacuacacugucuaaugacaaaggugucucaguguguguaaguacccuuaagacauuuguguaauaagcugggugcuccagcagcauguccaaccugagaacugguggcaugguggcucuaucaagguguuccggaagcuggccauggugacuggcccuuaggcccagcacucaggaggcagaggcaggcaaaucucucugaguuugagaccagccuggucuacagaacaaguucuuggcaagccagggcuacauagugagaucuugucucaaauaaauacauaaguagauggaugguuggauagaugagagagagagagagggagggagagagagagagagagagagagggagagagagagagagagagauaagguaguuggagcuggagugguggcagaguaguuaagagcacuugcuguuuuucccagcacccacaugguggcucacaaccaucucuaagucuuauuuccagggcgucugacacuucugaacucuacaggcaccaggcaugcacguuuugcacauacacacaagcagguacaacagucauacacaaaaauaagccuugaaaaacaaucaggugaagaguggucgagcuuugcccucagcaugcucaugagcacaucuacacaugcaugcaccuccaugaacacacacacaccacacacguguacacacacacuauaauaagagauguucauacaaugacagauuugcuaaacaacaugucuuaggauguguccccguuguuaacauuuaguuacagucagaaucugcuucuuauuuaacagugacacccaccgugcucagcucugucggcuagaucugcccagagugagcacaagcgaacgacuugacuuuaaucucucagcacuuuucaugggaagacuuaacucaccagcaguucgaggcagugguacaucugagccagggucacuuggcucuauggacuuuuugccaccuucugucucuugucacuaccauaugacccagcuucauuuugcucaaggcuuagugcaccacuaaagccugucccgggugcuguacauaagaaaucaagugaggcaggagccggagggaugguuaagaacacuggcgacacuuccaguggaccuagguuuaauuuucagcaccuacauggcaucugguaaccuuguauaacuccagucucagggcuuccaugcacaaggugcacagacaugcugacaaaacaccauacacauaagcaaagaaauauuuguuuguuuguuuguuuguuuaaugauuuacuuauguaugugaguacaaugucacugucuucagauacacccaaagagggcaucacuacagaucccauuacacaugguugugagccaccauguggguguugagaauugaacucaggaccucuggaagagcagccaguguucuuaaccacugagccaucucugcaauccuguuuuuuuguuuuaaugagacagauuccuuccucuucaccagcucagugaggagacagauguguaaaugaugugccaagugagaaaacaauggugcagaaagccggccgagguggcguuuaccugggaggauccacaaguguaguuuucauucuaguggccuaguccuggaaggacagaguuguuggggaauacacagcuggcucagggacaucgugguggaaacugucuucagacagugagcaagcccaaaagauggcccuguuaagcuuagucauaucugagguuucauucugaaagcagcagggaugcaucuaagauuucuuucuuucuuuuuuuuuuaaagauuuauuuauuuauuuauuauauguaagugcacuguagcugucuucagacacuccagaagagggcgucagaucucguuauggaugguuuugagccaccaugugguugcugggauuugaacucaguaccuuuggaagagcagucagugcucuuacccgcugagccaucucaccagcccacaucuaagauuucuaagcagagauuugacgugagcauaucuggaagcucagccuggcuucucugaguagaguguuagagauggagaggggcaggggcguagcuuaacgagggcuugccuagcauguacgaggccuugaauucagucccuaguaacccucaaaccagguguggugcugacacuuguaacccagcacuggggaggugaagacaggaggaucggaaguugagggcuagucucagcuacauaggaaguuugaugcucuccaaggcuacaugagaucuugucucaaaaaagacagaguugucaagcugaggaccucuguuuaacccacgugaucaaaggagacaguucagagugugacaguucaaugugugacucucacacauugucucugaccucuuguugcaacacacaugcacacaugaauguuuugggggcuuugggguuuuuuguuguuuguuuguuuuguuuuucgagacaggauuugucugugcagcccuggcugucguagaccucacuuuguaugccaggcuggucuugaacucagagaugcaccugccucugccuccuaaaaggcauauaccaccacuguuuggccacacacgcacauaaauguaauaaauuaggguguuuuuuuuuuccuguggggguggggugggggaauugagacuucaacagccaaaaggaauccuggcacuuuuguuguuuuuuguuuuguuuuugagacaagguuucucuggauccugguacuuuuuaagguccccuuuugaugacuaaaucucugugugcuuacucaucuccaguugcuaguaggugcuuggcaagugguguugaguuaguauuggaggauugaaagaaaaaaugauguucagaauuguuccagguugcaguuugggugccaggacagacagggagacacaggggaaagaagcagugcccuggugugaaauacugcuucaccuagacggugugcagcugagguggucaaauaauucugaagcuucaaacuaaaggaagaagccauacacugagcugagucuggagccuucggccugugaugcucugcccacagcacuucccucuccaccuacguggaugcuucugugagcagcucagauggcgugcuaggcucuugucccccagagcaggggucaagacaaccaacaaggcuggcuguguggcccacaccuuuaguuacagcacuuuggaggaagggcagugaauuucagugaguuugaagucagccuggucugguguguguaguuccaggacagccaggacuguauauagugagacagucucaaaaaaccaggggggaagaggauucaaccaacagacccuucucugaaggucacacaucccuucuuaacugguugggagacuaggucuuaggaaacuaugacuccacuacccuccuggagagcccauagaagggagaagugcagcccggcuaaggagaguaaacccaccauccauauugcuuucccagaugaucgccaccggauugaagagaagcgcaaaaggaccuaugagaccuucaagaguaucaugaagaagaguccuuucaauggugagaugaggaaagccugagggagaggagugggcaggccagccaaguccuagagucagugagaggacacccggggucugaaagcugacuuagcuuuugcccuguaggaccaacugaaccccggccuccaacccggcguauugcugugccuacccgaaacucaacuucuguccccaagccagguaaggaaguccuuuucuuuuucuagaaugagggucucauuuguucagacugaaguaguaucuucuagaaggggaccaaauuggucucaccugcagaguucugaaaucugcucuccauggggccuggacuucucagggggaggccggggucucugccaggaccauccagggcucuugucacagacugauaaacucaaggcuuugaaaguguggcacaggaacuggccauuuccuaaagucaguagaagucagaagccaugcuccugucaaacccugagcccuuuauucccugcugcucaagagaguguggcaggagggucacaaguucaaggccaucuuggacuacaagguuauuaaguuuaaggucaguuugaagaacccugucucagcuuuaaaaguaaaagcagggauacgguacagcucauguagagcgcaugccuagcaccagagacccuagauucaauauuugguaccaagggacuaaauaaucccugaguuggauaccuugagauacagacauuggaaaugucucugcccucagcucuccauugaauugagaaagaagaaaucaccucuaaaguaaucaguuguggggcuagagagauggcucgguuaaaggcacuggguucucuucucagcagcugucucuagcuauagcugcucgccaagggcgcugcacgcaugcagugcacauacauagaagcaggcaaaaugcucacaaauaaaaacauuuauuuaaaaaauuaagcugggcugggugguaguggcgcaugccuuuaauccuagcacuugggaggcagaggcaggcggauuucugaguucgaggccagccuggucuacagagugaguuccaggacagccagggcuacacagagaaaccgugucuugaaaaacugaaaaaaaaaaaauuaauagguuguggguucuggugcguggcucacaagagugacagacucccaccacugagcccgugcuccaugguucauccucuucgcuggcuuugcagcuguaacauggugagagcuuuaugaccgcaguagcuagggaacaccucacuguggcccuuggaaguggacccuacaggccuggucagauuuugguucccagaaagguacugauucuaagcaugguagagcugggucaggugguggcagaggggccguguaugucucucacugccucugagccuuuguucuuugucucucucuccagccccgcagcccuacaccuucccagcaucccucagcaccaucaacuuugaugaguuuucccccaugcuguuaccaucagggcagaucucaaaccaggcccuggccuuggcaccguccucugccccaguccuugcccagaccauggucccuuccucagccaugguaccucuggcucagcccccagcuccugccccaguucuaaccccggguccuccccagucccugucugcaccuguuccaaagagcacccaggcuggggaaggcacgcugucggaagcccugcugcaccugcaguuugaugcugaugaagacuugggggccuugcuuggcaacagcacagacccaggaguguucacagaccuggcaucuguggacaacucagaguuucagcagcuccugaaccaggguguguccaugucucacuccacagcugagcccaugcugauggaguacccugaagcuauaacucgccuggugacagggucccagaggcccccugacccagcucccacaccccuggggaccucggggcuucccaauggucucucaggagaugaagacuucuccuccauugcggacauggacuucucugcucuuuugagucagaucagcuccuaaggugcugacagcgacccugcucagagcaccagguuucagggcacugaagccuucccgaagugcguacacauucuggggagugugcuccagcugcccccgacuuguuugggugaucucucuggggcggcacguuuuacucuuuaucucgcuuucggaggugcuuucgcaggagcauuaaccuccuggagacggagcugggaggacucggugcaucccuguguugauagcuccugcuucgguagggaacucugagauccugcuuccaucuccagcuucuagcacucuccuagagagggacagacuggagccauggccuuaggccauauagccuuacuaucaagugucuuccuccacgcggauuccuguacaccuugauccaaagcagugcucccaagagcagcuccuacguggugcugcccgacaccagcacaugaggggccgcucuucuguccuguggagcuccugcccugccagcucuccaugcugagcuguggccaaggggaacaggugggauguugcuggccgccuucagaaucggggggaguuuagucugagacaucccugcucccccuuuuuucaagugccuuaauagcagggcaaacuguagagucaggagggcaggcuagaugcucagccacaagacagccuuuacugaaaaagcuauuggacucuugcucuuucuagcucugaacuaauaaaugucuuaucacgcuggccagagaguagc

SEQ ID NO: 9081 - RNA, 13016 nt, Mus musculus
ccauccuggccccgcccccaggcggagcggaggcgccgggagcggugugagcaggcagcgggaccuuggugcggaaggcagcgguggccagcuugagcccgagagguacuggcgggaucagggaucgggaggcaccagguucgggcuggauacccaacaaaguagccuggacgugaacccuuguaguguggggaggaacgggacuauuggcugcuuucgcuacacguaccccacccaaccuccugccccaguccagccccgagucagcacguccaguguucugucuccugcuggcagcucccacucccuccucugcaugagcagauucagagcuccacugaguggauucauugguucuggacuuuucucagcaaugcuggcagcugcuccugcugcugaguguguggggcucccccuauucuggggcuccccuuuucccagugugaccucuuucccagccuuugcaauccugagucuggccugggaggaaacaucugcagcacucccuggcaacagaaauagggucacgaccuccagaugugcugggaagcauccagcgccuccuccuggggcagccaggccuuccggaucugugggggcggggcaccccccuuuuccccccucagugacacaggcugcaaggaauguccuggccucaauggaccuugugugaagaugagggguggggggcagagcccaaguacaccccuuaaggcagggccagaacaagagggagcuccuggacugggcugcacacauucccagggcuccucccggcacugcggccucagucugugcccacagcuuggucuauggaccuggggccugcacaguucacacacggacauaguuggcuucaccuuucaguuuccaaggagucuucaaagaacucaugaagugcagcaucagagcuuauccuagaagacagacagacagacaggaagacccugaggaggucugcucuuguuugguucuggagacccagcugaggggcaccguggagcugcucccuguccccucccagccuggcccccuugaugccacuggaugaugcaaaaaaaaguacuaauggaggccugccccugccccagcuguuggcuccauuccuagcucacgccgagguaggcucggccuucucacaccuuuugcaccugccuaguguagcuucaccacauuuccgcacuuaguaggucccuggggccuuggguguuucagccuuacauccugugagaccuugagccucucccgucuccccucacaaggcugccuuacuccuacgcacacgggcagaguaggcaggugcagcucugacaaguccagaagcagcaguucucaaccugugugcugggaccccuuugagggucgagcaguccuuucacaggggucacacuugagauauuuaucuucuucuucuucuucuuuuuguuuuucaagacaggguuucucuguguagcccuggcuauccuggaacucacucuguagaccaggcuggccuugaacucgaaaucugccugccucugccuccccgagugcuaggauuaaaggcgugugccaacacugcccggcucauguuaugauucuuaagggcagcaaaauuacaguggugaaguagcaaugaaaauaauuuucuggcugugaggucaccaccgcauuaggaacuguauuaaagcgucacagaguuaagaagguugagaacuacugccuucgagauucagagacaagguucaaauucuaguuugaacauggaacuaauucaggcaagcucaucuucuuaacugggccucacugugaccugucucacuggguucagaccucccuguccaugcaugugaggccagguaaacagacauccacaggguccuguugggauuagccucucucaccccugggagugggcauagugaccugcaagagguuaguauuagucuuguccuuuagacuuaggugucuugggucccaugacugagcuguugugacccuagcaccuuccucaggauauaggagccaagcagggggcugggcugaguuggggccacuuccuguguuauaggaaguccucucaccacugcuucuguccugcagcagcugccccaggagcuccuguguccuugagguauugagacugcgggaauugagggcacugagucuaggccuugggugcucagcucuuuggggacccuggaggaagugggagguaccagggaggaaggucucuggggacaggacguccucccuuugucaagugggcaagacucagacaccagugacugcuuugauuuccguccuggugaaaacuguccagaauuugguggcaacccucacuuugagccuaguuccacagccaagguguacaggggagaacugggaggccccggugcccacuagacccagucacuagcaccccgagaggcaaagcaucccaguucagcucccagccuugaccuaagccugggaugggggcuggaaacuucagccccaggcagacaaggaaguggccaggaaagcggaagcagcuuugauggucccggagggggccggaagcuaaauggggugguggaagacugggcugggggccugaguuccuguuuucuccccaggcccaucugaacagcccccuccuccugcagugcaggaaccacugaagccucagccuucuggcugggcaccaaggacccgugcccaccaaugcggcccggcccccagagagucaggcccacagagcacgcccaugugggccggcgguguggggagcccucggcggggcauggccccugcaccuaccgaugaccucuuugcccguaagcuucgccaaccugcccggcccccacugacaccacauaccuuugagccgaggccagcucggggcccacucuugcgcaguggcagugaugcuggugaaguccggcccccuacaccagccagcccccgugcccgugcccacagccacgaggaugccagccgcccugcugcaaccccuacucggcucuucacugacccacuggcacugcuaggguugccagcagaagagccagagcccaccuucccgccagugcuggaaccccggugguuugcucacuaugaugugcagagcuugcucuuugacugggcuccacgaccucgggggacaggcagccauauagaggcaaacucugggaccuuagcugagggccagacuaccaccucagaucuacugcucggggcaccuggcuuugugagcgagcuugguggugagggugagcuagggcugggugggccaauauccccaccugugcccccugcacugccuaaugcggcuguguccguccuggaggagccacagacccggaccacagcuuacagccuggagcacgcagaucugggugcaggcuacuaccgcaaguacuucuauggcaaagguaaggggcaggcgagccugggagagccaggagaggaucugggucggaggucccugcggucuacauucuauacagugggaggcucaugggcuggccuucccuguaaaaaaggggcaggagcugaauugggcucuguuggcucaacucugaccaccucuuuaaggccaagcccuggugucacaccugaagucagggagugcccuucccucuggcucaucuucauaacccuccaggaggccagugagcgauuuccuauuuccauaucugugugaugaaacccuguucucaucauuagcaggaaaagcagcuuccgugucuugaaugggagaaccuaagcuuugguggagccagggcagcauuuaaccuaggaggacuuagacauuuguucccugguccugggacaagguguaaccgugggugggacugcaaacuggggugggagugaacucccagguucagcgcuuggugagagaauaccuagggugguacuucuguggugggcguagucaagaagggauaggguggucuguggguuugacugaaaggccaccgaccgaccaaccaacgaccccccacccccacccccacagaacaccagaacuucuuugggcuggaugaggcgcuggguccgguggccgugagccugcgacgggaggagaaagagggcagcggagggggcacccuacacagcuaccgggucaucgugcggaccacgcaggugggcugggauuacaggcucaggaggcagguuuccuccaccacagccuauacaaaaacugaaugucucuacauccuauccuuagcuccggacccuccguggcaccaucucggaggacgcacugccucccggccccccgaggggccuaucuccgaggaagcuucuggaacauguggcuccacggcugagccccaccugccugcgccuggguucagccucucccaaggugccccgcacgcugcuuacucuggaugagcaaguggugaguggcugggaggaaggagggcgcagcaucccggggagauggggcugaccuucaucucccuaacuagcuagcuucccuaacccugaccugaucugacgggaccucaggagagcugauccaccuccagccuuuccgagagaaggauccagggucaccggagacuuguuugauuaaccaggcuuauaaagcagccacagcauguuaggaaugcagaaucuggggcugcagccuggccugcucaggcucugcauuaaaaaacaaacagaaagcuggacaugguggcacacgccuuuaaucccagcacuugggaggcagaggcagguggauuucugaguucgaggccagccuggucuacaaagugaguuccaggacagccagggcuacacagagaaauccugucucaaaaaacaagacaaaacaaaacaaaacaaaaaaaaaaacaaaaacaaaaacagaaaagcuuaaggcaauucuuaggcaucuuuacaguauggcuggcccuguugcuacacagcuuccucaccauuuuuugucuuuauuuuuuuuuuucuucccccagcccauuuggucuccuccccacaugggaagcuuccuagagcuuccuguuccaccucaggacucuugagcuaguuggaaguccuguaccuugugcugagaguugcccacuggcccuggcucuccucuguguuguuuauuccaguggucauugaacaaauacaucucaucccuucauaguaucaggccuagaccagaugcugaaaccgcugcggaugaaaugcugucccugagugugggcagagagccccugauaaaauacaggagcugcaggauuccgugacuggaggauggggggggggggggcuagaggccacacagaggguacugacagcacccaaaguuucacacuggaaaacauacaagcccccagaccagcaugagccuguuuucugggcaggcaggauugagaaggcucuuacaauaaugauuuagagagaucucugcaugccgcaugaugcucuguguggguggagggcuugugggacuuguauggggaggcuuuuuuuuuuuuuuuuuuuuuuugucuuguagcuauugagaggcacagagggauucaggacagacagaucugagaggcacacaugggacguaggcuggacagaaaaugggcccaaagcugugguuguuguucagauuagacaugguggucagggugguuacagguaaucaugagguggcucacacuuugugacccacugaaaaggggucacaaaggugaagaagggcgagauccccagcuucugggccccugggaguuguguuauguugugggucccagggacucuggaggagagauagaggcagagacauaguaacugaggggucaagauguggccagguguagcggugcaugucuuuaguccuagcacggaggcagaggccccuggcagcuggugaaccagaccuggaguuuggggaaagggucugagcuggaagcagcugugggggagaaaagacaaaauaugcagggaagcauaggcagaguuccaaggaagaugagguucuuguugucccccaguauuagggccaacaguuccaagagugccaggauaaggccauauauauguggucuauaaggggaguugugguuuucuguggguuuugugguuugcaagaccccacauauacauacacgccccuccccugaggcaccgaagccaggaccucaggcaugcuaggaagcccucagccacagaggcuagcugugaaggagggaggugagagcugcggacuggggcaugcgauuacuucaguggggucaguagggcauaucugucugcaacuggaaaacacuaggagaggaaugugcagaaaagccaggcauagugguuuaugccuguaauccccauauuaggcagcugagacaggaggauugcagugaguucaaagccagccugggauauauagcaagaccacauuucuuucuuucuuucuuucuuucuuucuuucucucucucucucucucucucucucucucucucucucucucucucucucccucccucccucccucccucccucccucccuuucuaagauuuaauuauuucauguauaugagcacacuguagcugucuucagacacaccauaagagggcauaggauccccauuacagauggaugugagccaccaugugguugcugggaauugaacucaggaaccucuggaagagcagucaaugcucuuaaccacugagccaucucuccagcaaccuuguuucaaacaaacaaaaaaugcagguacgugucuagaauuccaauauuugggagauacaggcaaaaugaucaggaauucaaggccagucuuagcuauauaugaguuuaaguacagccuggccuauguacuauagccuaucaaaaagacaaacaggaaggggacagaaaugacuccaaaccucagagggcuggggugccagcacacuggagccuugagcugagggggacgggaacaugggcaccaugcuuggcaggggaucucagccuuccuagugcccuuucccacagcuccucaugguguggugacccugaucaaaaauuauuuucauugccacuucauaacuguaauucugcuacccuuaggaauuguaccauaaacaccugacacacagggucucugcugcaugcgaccccugugaaugggccguuagacccucagaagggucacaacuauaggcugagaacccacugguguauaggguccuuucugggaguuaucucuuuuguugcuggagaagucauuaaauccucugccucuucccugugaccucccugcucucacgagcacaggagagggcagguagaacgcacuugaugggcaaagaugcccaaauggcucagaguuccuaccagggcagcccagccccaaaggccagcucuucccauucucuacagggugggcugccaggguacugaagccuuugucuucuguuguccaugacccccucagcugagcuuccaacgcaaggugggcauccuguacugccgcgcaggccagggcucugaggaagagauguacaacaaccaggaggccggagcagccuuuaugcaguuccuuaccuugcugggugauguggugcgacucaaaggcuuugaaaguuaccgggcccagcuggauaccaaaagugagcgucccccgcccccaagggacuggagaugcagggcagaacuuuaucaguguuccuuagucugugguggcuggggcugagaaugggggcugagcugcccacagcaaucuagugcucugcuucccucuaagucuuauuucuggauucguucuaucucagcaccccuauacugauuccccuucacccugguguggggccguagucuauaggagaggggagggaauuuaccaaggauggggcucuuggucuucguggccuaagcaauagcugguggcugggacauagaaguaaauuuaagacucauugaagucacccacacuccccauguucucuuuguguccccaauugucuggcuacagcggauuccacgggcacacacucacucuacaccaccuaccaagaccaugagaucauguuucacguguccacgaugcugccuuacacgccuaauaaccagcaacaggugugugaggagcugggccaggccaaagacuuucgggaagcaguggcggguguuacuugagugcuuaauaucagaacgguggucugagcucugcugaaccuaacaacacccaucucccccaccccuggcuguaccaccuucgcaaauacccuccucgggccuuuauaaggugcagguggggaaccacugacaccuuugccaugccuaaaugagggacuggggcgggggggggcacaaagcucaccucucauuugccuaccuuuaacccccagcuccugaggaagcgucauaucggcaacgauauugugaccaucguguuccaggagcccgguagcaagcccuucugcccuacgacaauccgcucucacuuccagcacguuuucuugguggugcgugcgcaugcucccugcaccccacacaccucauacaggugggugcuagggugaacucaggucaugggcaccgaugauuggacacauuccucgcccccuuccgccccucguucccucacuacagccuuccuccacgcaggguggcagugagccgcacccaggacacuccugccuucgguccugcgcugccagaaggcggaggccccuuugcagccaaugccgauuuccgggccuuucuguuggcuaaggcacucaauggugagcaagcggcuggucaugcacgccaguuccacgccauggcuacacgcacacgccaacaguaccugcaggaccuggcuacuaaugaagugaccacuacuucgcuggacucggcuucgcgguuuggccugccaucucugggggguaggcgccgggcaaccccucggagcccaggcgcggagcuacaggcggcgggugcgcugauguggggcguacgcgcggcuccaggggcgcgggucgcagcgggagcugaaacgagcgguccggaggacgccgaggugcccugcuuguugggcaucucagcagagacacuggugcugguggcaccucgcgacggccgcguggucuucaauugugccugucgcgacguauuggccuggaccuucucagagcaccaacucgaucuguaccacgggcgcggggaggcgaucacgcugcggcucgacggggccccagggcaagccgugggcgaagucguggcacgucugcaggugaggcagugucaaaaacuaagguccccuggucgggugcguaucgggggcggagccuauuggaaacuccguuaggcugcugugguggggcggggaaaagguacuugcacaggugacucucagagucuccaauucgaauacacaacuaucagguaggucgcuagggcuccuggggcaugccggguuaaaucgaucgaggcaggggcgggaccagggcggggccucugugaagccacgccccaagggccacucucacccagccuuuccuugcagcuggugagccgcgggugugagaccagagaacuagcgcugcccagagauggccaaggucgccugggcuucgagguggaugcagaaggcuucaucacgcacguggagcgcuucacguuugcggagaccacggggcuucggccuggagcucguuugcugcgagucugcggccagacgcugcccaagcugggucccgaagcugcugcccagaugcugcgcucugcgcccaaggucugcgucacgguccuacccccagacgagagcggccggccgcgaaggucagggcaccgggguggggguugugggggguggguaggaggacucagcggcuggcccauucugugccucccguguuagcaucagcaugcucugaaucguacgguauucaucuagacuugaaacuguuuaagcucgugcuuucccucucuaaagguuaaauagcuccuucuauuauuucaauguauuagcuccuccacaccaaguacacacuaauugaccacuuccuauucuaaacccaauauaggcaaacuuuccccauagaaccccuaauaguaaauacuuuuagacuuuuggagccacuauucugccacagucacucgacucuuuuguaggaaaaugaaugugugccagcaucuacuaaaacuauggagcuggaauuuuaggauuugauguggaugcuccuugucuugugaagggguaaacccaauguaaggucaaaaaaaaaaauccaaguagaaacacauuaugcucagacuguguaauuuuuacaugccaugaaguacucuauuaauaccuuuuaaauuauuuaaacaucuaagaacuaaggccagagaaguggcucagccauuaagagcauuugcugcucuugcagaggaccugaguuggauuccuagcacccacacggugcucugugacagccuguauguaacuucagauccaggggucucacacccucuucuggucuccacagguguugcauucacaugugccugcccccuccccacguaaauacacauauacacaucaauaaauaguucaagaucucuaaaaacuauucuuagcagauaggaguuucaaagacuggcaugugugcuaauaaaaaacaaagagaagcaugggcuggauggcuccaggcagugcacuguggaugcuaagcgauuuauauuacauuguuuccacuguaaauacucuuauguauguuugacagaaaacagagagaguggccugcuuaggauacaugggcagccauggauacaaaguuaacagugauauuugucugcuguagagucaggaugccuggagcucucuuccuuuuggaugucucuggcaguggcugggaugggguggaugcuguggaggggauggaggguccuaccugaugcugccccacccccacccuccaggagcuuuucggagcucuauaugcucucucugaaggaacccagccggcggggggguccagagccaguacaggaugaaacugggaaguuggucauauugccucccaccaagcagcugcuacauuuuugccugaaagacagcagcaguccuccggggccuggggaucugacugaggagaggacagaguuccugcgcagccacaacucccugucaucuggaagguacacucacugggccagccuuuuaggaccugaaagcacagcucuggaaaagcagcucuccguucugagucaccccuacccuccuuagcucccuguccgaugaggcuccaguccugcccaacaccacuccagaccuccuccuugucaccacugccaacccaucugcaccugguacugacagagaaacacccccuucccagguaagcagaaacaaacagagcucuggagauucauugcagaggugacauuggaugcuacagccuugcuguucacuuuuguccccaggaccagucaggaagccccaguagccaugaagacaccagugacucaggcccagaacugagggccuccauccugcccagaaccuugucucugcggaauuccaucaguaagagugagucuggagccagggaauagggcaggaggagaagacagccccucccccccguuccagccccucccuccccccagccccacccucccuaagccuuucuccuuugaccugcaguuaugucggaagcuggcagugagacccuggaggaugaguggcaguccaucucagagaucgccuccacuugcaacacaauucuggagucacugucccgggagggugaggccgcaagggcccagaggggaggagccaggaggauguuuaucccuucagaccugcccacagucucucucucuccuauaggacaacccaucucagagagcggagaccccaaggaagcuuuaaagugugauucugaguaaguuuucugcccucacauacccacucuuguguguguguccuucccugccugcccauugcaguugaacgcuaucuaggcucugcauccacagauaccuaagucucagaagacaggguuggguucauuaucagucaggagugucugggagccugcacugcuuccgcugaguucugaccccauguccucaggccagaacccgggagccugucagaaaaggucucucaccuagaguccaugcucuggaagcuccaggaggaccugcagagggugaggagagagccugacgggggcgcacagggcugccccuggcaagggcucugacuaccauucuucaaccuaggagaaggcggacagggcagccuuggaggaggagguucggagccucagacacaacaaccagaggcugcuggcagaguccgagagugccgccacccgccugcuccuggccucuaagcaucugggugcacccacuacugaccuggccugaguuccaaucugaaucuggaccugcuuggaacugccuggccccucagagcaacugggucauacuagugcccuuccucaggacuucuucccugcgcugaggcgcgucuuagcacugcccccucuucccagcccauuugguggcuaaugccugucccuguuuguaaauauccuguaaagaaaaggagacaucagaguuuaaaaaaaagaaacaacaagaagaagcaaacaacucuauuuguguuuguguguucaagauacagaggagggggagucaucccccuuuccaaggucauaucaagcuccuaggagcaguaggacaggucccaggggggacauugacuuaguguuaaucuggcaccaagcagaggcucugaggauagaacaccccuuggcuccccuucauuuauuggguucucuuggaaagcagguggccacgcuucaugccugucuguuuggagcaggagagggaacacuucgagccugcagagcaggacaaccaggggugggcucuggccaugcaguauggaauucccaaauaggcccugcuaagcugagcuucagagcaucauugacuaccacuggauggaucaccuguugcaggccccagccagugccucaucagccucuccccagggcugccucugcugaagcccagacccugagagaggacaggauaaacauggcugaguaacaguggggccaugagcacaaggaagccuucucu

SEQ ID NO: 9082 - RNA, 14124 nt, Mus musculus
auuuggggagacagcuuacaaguuuauuuggcuucauuggcuccccaagccaaggcuccaaccuuggcggggcaguagaaaggcacccagagagccccggcuccaauaacuuccaggguuggggguccaggaacucagccuuggagacaggggccacaguaacaggacuuggucaaaagugcuggugacaccugaggucagccccuuuccccuggaccucccugcucccugcuccgcuccugggggcaauucccugagacaggcucugguccuccuaaccagcuagguacagugucaggccccaguggggcaguaagucaggggucccuacaguuuguaggcaugugggguguagcccccauccagugugaaggcuuucugugcaguguaguguuccugacccccaaagggucagagucccugggggaaaccaaggcagccacagaggccuccugguuccucuuccaguguaugcuaugccuccucgaaggcagccgaagcgugggguguggucuggcccacucagggcccugcuucuggugcccauggggccugggcacccaugucuuuggucugcguccugcaguccugggagccuccccggaagggguuggcagguggggagucccagaagggaucugagucugggaauaagguccacggugcccgucggggugcaggcuguggagagggcaggggugaaggccguggcccagcugacacgaagcuccaugggucaauacggcuacggaguggugagggccgaggucggcugauuaggcccaacgguggugagcgagggguuccaggugugccaggagcagagcgugauauuccuggugggggugagacgguucucccuauggggguauaaaaguacggguacaugguuaggcaggcacccacucauucuuagaugucccuuggagaaacugcccugcucuugccugggcuucuagcauuucaggguuauggguagccauagccuuguggguucuauggcuccuuacguucugagaucaucuguucaucccacaguuucagggucaggcuggcuuagaccuaucugggcuuggugacuuacuagcuguaagaaccccaagccuuugcaucuguaugcucugugcuccuuacaguuccucaucuaagcaggugagacagcuuagcaguuacaggggcuugcugucaugacuaacaaccuguguucaaccucuggcacccaggugguggaagaaaagaaccgacucucaauaucucuccaucuuugcccuguggcaugugugcccccacaaugaauaaauaaacguaaaaauaaauuaauuucuuugucuagccuggcaugguggaacaugccuguuauauuggaacuugagaugcugagacaggaggacugggacuugaguccagccugggcuacauagggagaccuugcuucaaauagacaaacaacaaauaaacaaacaaagaacuucauuaagaacugggcacaaaaaugcuucauauagccaggugugguggugcacgccuuuaaucccagcacucgggaggcagaggcaggcagauuucugaguuugaggccagccuggucuacaaagugaguuccaggacagccagggcuacagagagaaacccugucuugagaaaaaaaaaagcuucauauacagauuauaauuuaauguaauaacuucuacauagaaugguuauaguaccuggcccgaccaaucaauagguauuagucuaucaccaugagggagaucucuguaucucacagcugaaccuagagcucuagcaacagccacagagccuaagacucuguaccugccugugguccucugaguucccugccacucuucucugauggccucuuaucuccccaucagucuuugggucacucaccacgugucucuucccgucgagggcucuuggcugauggcuggccagagggaacaccuaggucuagcaauaaggguccaggagugggugaacuaugggcaucagguguuguuugugagaggcggaugagcgggguggagggcagcucaggugggcagggugagggcaucugugcaggggguggugcugucggggacuccccgcguucacggcucaggccuccuggagguugcagaucucggccaaggccuagggaagccagcagagcggucccccguagcaaugcacguuggaucaguuuaggcgucccagagcuauugccucgcuccgugggcccggcccuccguggcuccucuggcucggggcuaggccuuggaggauuaccugcgaguaucagugacacaguuagagugaggcuagcgugucugccaggagagcauccugcguggcuuuagaacaagaaccaaguucugcuucccaagggcagcuuccuuagcucuaucugucaagcagcucuuccuggucugcugaaccuucccaucacacgcauucugccuuuaaacagaagggucugggggcagggcaacugucaggagcaaugccugcaagucgcugauguggaagacaauccuccaagcugaacagcucacuucaucagagucgcugugacuucuugcaagagaccccuugccuuaucagguuuguuugugguccuauguaagagaggucuggaagggucucugggccuucagcugacacucuuaggugcucucuucuguaccuccagccagcuguccugacaguccuucacugcauaguuucaaaguccuuccugcucuaaucccuucugcccuucccuuccuugugccaggcucccagcugaccagucuggaguucuggguuggcuggagaaagacacagaaggcugggcaaugugagcuucugcugugagcaggauuuagcucggaguucuguuggcucagggagcccucuuuuuaaaaaaaguaauuuauuuguaugaguauuuuuaccuacaugugugucugcauacuaucauacaugccuggugcuuacagaggccagaagagggcauggauccccugaaacaaauuaauaauaaaaauguaaaaaagaaaucuaaaaauauuaaaauaagcaagagaaaaaugacauaagaaagggagaguggagacuggaacccaacagguugaguggcaguuccugaagugaguucugaggucccuaaagugauuuguccaagguaacuugccuagaauuuaaaguugccucuaagcucccuggaugucugaguuaucgacccugcuaccgaggagaugaugcuagugugagaggcuugaccaggagaugaagcaaacuugcuuccaaagugcuuuggguuggugaguggcucccggcaauacccauuaggcaauuucccgucagugcaggcugacuguggcugcccaagagcgaaccagagucaccagguucccaagggcagagccucuaucuggggacaggguaagcaagccucaguaguggucuaugcagcccugugagacccuagucccugacucagccagcuucccgaccaugaagauuuggaaggcugaggucagguaucaucgcagacccugauggcagcaagaguacaggcuugggcuagggaaccacaagcuuggucagcaacuaggcggggcugguggcaccaucucagaugagggaccagcuggagagguauggggucuaagucuugugucuucuucugggaccucagggaaggcacggucagaaggccuggcaggacaugacaaggacuggguuuccaggaccuugaaugcuccuuugguccuccugaccugguccauucaagaacaaaugugaucgauccccuuggucuuccaguuuucaguucagcuuucauacaacagccaauugugggcuacaacugcuggagcagaacaugugggggcuggagagauggcucagugguuaagaacacuagcugcucuuccagaggaccuggguucaguuccuggcacccacagaguggcucacaggcaucuguaauuucaguuucagggaaugugauguccucuucuggcuuccacaagcaauguagacauacaguguucaaacacauucagagaaaacauauauacauauaaaauaaaacaacaauuuaaaaaaaugucuuaguagagggcagcucaagggccugccucuggaucagcucaacucaaguucaaaucucuguucugcuagucccuacagugaaccccuuaaccucucuguaccucagucuucucuauaaaaaggagccaaugaugacaucuacagcagauaggagaaaguauuugcuguaagguggaggugauggugaugugugugugugggcugaauuggcacagauaaacaguuugaugaacagggcucuagccuaagagccacuaaaguagggucuagggcagugguccccaaccuuccuuacacugugacacuuuaauauauaauuccuuauguuguggugacccacaaccauuauguaaauaucuauguuuuccaauggccugaggggaucccugugaaaggguggcuccaucccuaaaggugucaugacugacagguugggaagcacuggucuagggucuacauucugcugugugcaguagguagggcugggaccccugaggaugcucuagguugguauaggguaccccagacaaaccacaacuuucuugacuauguggagacuaggcagcgcugagcugagcugagcugagcccucaucccucgggugguagagccccacuuagcuuccugagugguuuguggagaaggaaagcucccccagaaacccacugagacugugggagccacggcuucucugguuugagaccuuagcugggggucugagguagcuuacuccccucuuagccucaccuuuuauaccuaaaguggggagaaugucuccucccucgggagucagccguugucucccucccggugacgcuguuaucaccacagagaacagaacagcccugagcacccccagaaucucuuguccuuuccugagccuccugaggguacagugcugcacaggguccuaaaaguccucgacaggaggaccagucuccagaagcccugaggccucaggugaggccacuucugugggccuggggaccugggcuguccggcugguucugcacagccucagcuuuaguuuccuggucucgagucccuaaggcaucucugugcgcuggcucagagucuacccuccuggccccagaagaacucagcaagauccaugagcuccguacucaccguugagugccgggggaguacuaggggacccuaauggggacgagucgucugaaucuagguaccacguggcuucauccaugcgggaccgucuccuggaaagggaacaugcuugugagucuuagggcucuaaagaguagaacgccagggguguggggugcugagguacuuaccucccguucugggccuccccaggcuugggggagcugggaccccaggcccagcaagcacgccucucuccauugcuugaaucuucaagacgucugggggacuggcgaccccaagucuggccugauucuguagguuccacuguaagggaacaccacaggucagaguccauccuuauccuacauccuaacagcuaggaugggugggugggcugggcuuaggugggacuagguccugggcuagcaaugagaaugucugaauuugugcucugucacuuauuggccauguggcaaauuauucuuuuugcauuccucaccgacuaguaaugcacuagaauuauugaguuaauauuugcaaagcauucaggaaaauaaagaauauaugaccaagugcagugccacaggccuuuaauccuggcacuuagguagaucccugaguuccaagcuggccaaggcuacaaagaaacgaccccccccccaaagcgugauaugauacaauuacuugaggggggguaguuuuuggagggaacuuaaagguaaaagucuagagaaaggggagggaagccuggaagcaguauagugaggaaacaguagaaaguaacggguauggucaaaaggccgauccaucucuggacaucaggggaaguuuggggguuguggggaaggcaaggcugaccaaguuucuuacacuggauggcucggaaucuagggaaggugggcgaguccccagccccaaccucgaacacguuucuccuccgauccaggccaggagaggcuugcacugugaugcgguguuugaaaucugggguuugggaaaggaaagguuuugaaggccacacucaaaaccgcagggaugcuuaggaggcccccaggccucucccacaguggcaacaauagcuguguggcugggggugcuucaauacauuccugucucaaggcuuugagugguuggcacccagcaccagcacaaucugguagagaaauaaguuuacugugugggcaggccggccccacccucuuguccucagaacucuuccgugcaccacugacagcccgacaugcaaauaucugucagggccggcucagagacagaaaagaaaaucccaaccccaaaauaagccccuccuuauuccagcuggucaaggcaccaaaaggcuaaaccagaacucaagcgugaucacacacccuggcgccaacagccaauggcagagaggcgucggagccccgccccuuacccaggggcaugcugaugcguucuccgccgucccuugcucggaguuugcuccgcuugaaggugccccggcggcggcgcacgugcggccguucucgguccaccugcugcaguagcagcgucagcucgcgcucgaacaccuccagcucccacugcgccagcaggugcucgcgccgucgcagcugcuccgccugggaccgcugcucacgugcagcgcgcgucaguuccuccucccggcucaguaguuccuauguucgggaagagugaagaagguugaguuagcuaggcauugacccagaccucccaccuuauucucuaccccaccuuuugucccccauucuucucaccuuuuccuuggcccgcagcucaucaaacaggcccuggaucucgcguuuccagccuuccugcauggaauggaaggagucccguggcaucucccgcagcaccugcgcuucuagagcuuccaacugcugcaggauggaggcgaagucgggccugcgguggggguccugugcccagcagucuaaugggggaggguaagaggucugugagcauuugugucugggcccaggaguucugccccucaccuccccagccccauccucuuaccagccaugaguugugcaaagggcucagggcagguagaugggauggguaacguuaacuuguuuacagccacaccauaggcuacggcaagacagucgaugccacgguagggcaccuccccagucagcaguucccacagcagcacuccaaagcuguagggagacagagauucggauguucaccucaaagcaaggaggaacuaaaugguuuuggguccuggauucugccugccugaccaccccugggcuuaagcagcccuucucacccucuguagccccacacucuccggucccaacacuggcuguaccuccagacgucgcugcccuuggagaagguggaggccuugauaaccucgggagccauccaagcguaggugcccgcagcacucaucugggugguuuugugccacucucgggcgaggccgaagucaguaaucuuuagggucuuguguuccaugucgucacccucgaugggcugcagcaacagaacuggggagcaaauggaggaggauugugggggugcaaaggagaagcgugcagagcaggcgcaucucacagucauccuggccagguacugacacacagguggcuggugagacgcugcccugagaaguucacagccgggguggggggagacuugacuacucaggugacaagcagcacccauuuacuggcaagacauuacuaaguugcugccucugaguacuagaggccaacauuuuaguuaguucuacuaaaagagauaaacuaaacuaaaccaaauuaaacaaacaaaaccaugaauuaucaucauuuuacaggugaggaaauagcagggaccugcccaagucacagcaaacagauucuagucagccuagggcuccagagcuaaugcucuagccuuuucauagcacggaauggauuaaaaacuguaauguggccguuuucaguguugguggcucugcuuucaagagaaaccugagguaggcaugguggcauauuccuuuaaucccagcacucaggaggcagaggcagguggaucuuggaguucaaggcucaaggccagccugaucuacaaauggaguuucaggagagccagggcuacgcagagaaucccugucuugaaacacacacacacacacacacacacacacacacacacacacacacagagugagcgagcaagcaagagaauccauugagugucuugucacucugcugaggcaggaguaugaaucggaacuuaggccagggaacggggagggaagcccuuaaagagcaaagaucuccuccaggaggucacagcacugugaccaucacaaccucucacagcagaagacuucagaagacgucuacagcaggaguuggguguaaagagagagggaggugaagguucuggucacacuuggcaggggucacacuuagcuuugguccaaguguggcuaccaaucucagaaaaagagaggcaacaucuuagcaaaaucuugccaggauaaaaacaguucaagugagcagcagaguagcaggggaccacgucugaauccucaagggcccaucaguggugagcagugccuucuguuuugagcauguggcaggcacacccccagcucucuuacaggcuaucagucagggcugcaaugggacaggauagguacugagcgugaggaaggggggagggcaucuauguggccaggugagccaggaagggcuucuuggaggaggaaucacaccagguuuuaucuucaaaggccugaagccagaacccguuucccgggugauuuggcauuaaggccugaccccuacccacaccauccguucccagguccucuuguucgugacucuguuucccucugaaugcuucaguucuggugcucuucgagcgcagacacagacgcugccaccucugggcugccuccauccacuccagacuccugcccccucuuacauggcaagacagcaaugaugcgcucuacccacugucaacaugcccugcguggcucuucucugcccccacuccuggcagacuuccuuccaguuucuccuaguucagggaaugguguugacuccuccuacuccucuuuugcacugggagugagucuggcuccgauaaggcaaauguaccucacagguuguccaggagucuuagaccaguucagacauugaaaagccuuuagccugggccugacguguggcagaacucuucucaaugucuuucggcauagagauccugugcucacgucugucagagcccacucuugcucuccacccuuaauccuaacuuccgcccuccagccccaggucagccugccaaaggcagcagggacccguuguuaggccugugcaagcucaucucaggaggaaccacaacaggcuggggcaggaugggagagagcacagguucuuuccggagccaggacccacccuccacugaggacuugcuccugccuccagccuggucucuagcacacaugguugcccacagacgggcagagcacauucugcaucguguucuuaggcagggagccaaccugccucuuuucucguuguggaaucugaauucugguaagaggcagcacuuggugucucaggccucuaucugcagccauucugcuaccuccgucuccgcucuggguuuuguaggcaccucaccucugcguccucagcuucuccuccagcuuguuuugcauccugccuggguccuaaguuauuguugugaugcucgauggagaccuugggccugggaggucaggggccacucagaaaagcugcagagcucaaagcuuggggcagcuucccagccgucuccuuacuguccccccacccccuccuggccuuugucaggcuagggaguagccuggccagcucacaccucuuccgcuuuccucucauggucccuacuucuccuuucuaggaggccugggccaacuugggggggguauucuuugggggcaaauugggggaggucagguccaggccggcuggcuggucaguccugugacucgugggccuggagaauucccccuucucucgaggccaggccuccucacaaggcccccauuguccaggaaaaucaugccauuguuuccugccugauucccccccaccccagcccagggacuccccccaccccaaucccacagacagcaacucgggccuaggacugggucugcaagguuggaugccaggcucagaggcugagggcaccuugccugcccuucaccaacacccagacucugagagggaaacaggggaacuagggccuggaggggggcaaucccuggcuccuuccucucccgaaaccccuccacccccagcucuuuccucccuugcaggcagcugggccagggagggaacagagcuggagcuggggcaggaagccagcccaggggcagcaggaaacacaggaagcgguguggaggguggggagcaggggccuggacuauuguuccauuuuuuucuggaaggagaacggaggaaaaacagaagacaggagcccccacccccugggccuucggggaaucccccucaggcuaguggagggagcaugugugggggucccuauaugccuugggcccacccauucugcucuuagaugauaggggguggucagcugacauggaacuggguccccuggcucugcugcugcuuuccuuuggccccuguuuuacaguagcugaggccaagaugcucaaaauguccgugcugaugccccuaagaaucucugcacucuccugucacgcaggaccauguccacuacauuuccuacuguccccagcccaugcccucugcuccagcagacccaggucccgcugucuccacauugcugaccucugccucugagccugcacuguggucaggcccugcccagacacccacccaaccaaguacuucacuaagugcugccuguuuuggacuggcuugaagccugcccacuucaggaagcugucugaaccugucaccaauuuuuccugggccuaugacaggcagcgaaugggaguccgagauagugagagauggagucucccuucauauuugcaucccuggccugggggaccccugcuugcugggcauccugggucagggcuucugaagguccuuaagcugcucuggucucauuguucccauucuagggaggcugaaacugagguucugaggugaaauaaucggccggagaacauguaggcaggaaagagugggauggaacagccuuagucucugagcagggaggagggucuucccugcugagaucucuguccugaaggagcugccuaugggagagggagggaagcaacaccacguuuguaaaucucggaaggggaaggcuggaggagcagcuuccagaagacuucccugagguggugaccacgguaaagcagggugcugaagggccgccugagagagcucaguuuugaaaacuugucaaaacuucagcugaagacugggacuagggacucccaggacagaggcagaacucugccagguuccggggauuccuguuuugggggucacugauaggccacggguauucccuggacaucuaauacuccucucaggaaggagcuugugaggccagcaucucccuaacuaggcucagcugagcuaggagacgugugcaccugggccucggcugggccgugcuccgagccuccccgugcccaugcuucaugccccuggaaacucacuguuguuggacuucaggucucgguguaucacaggcaccagagccucacagugcagguagugcauuccucgggcaaucugcacagcccaguugaccagcacaugggggggcacacgccgaccagccagggcccggcuaagaggcccaccagcugcauacuccaucaccaggcauagguuuggcuccuccaggcacacagcuuugagggcaaugauguugggaugggccagcauggcaaaaagccgggccuccugucgaacacucucagcuguuacacugauguccucaucaggguccugucgggcugccuucacagccaccagcuccccucgccagcugccacgguagaccuugccgaagccaccgaugccgaucaccuccuccagucgcagcuccuggaagcuggccaccucacaggggggugggccuccaccccgagauacauaguuggauggaaaaaugcccaccuggccacccaccuggcccgcccaccagcccucaucuccugagauggcugcaucccuggacagcaccuccacacggucgcccuuccucagggcuaguucguccugcccauugggcucauagucgaacagggcuguccagacaggauuggcauaagcugcuguugccuucggagaccccuccggccggacuccaccgguacccccgccgcccccacugccacugccguuccaugaccccagcgggcucuugaggaagagguucuucaagggcuccauggcagggagccggcguuggaaugugugggggaccuucuucgggugcccgugguauccacccccgcuggcuugugaggcccuagagccggaaccugggcauccgggcccuggcccucagccccagacccacgccucucuggggagccaggagugucgccucccggccccccgcaucucgggcuuuuggaggagggcaccaagggcaguguggucaggcuggagggguggggcccacuggccuccggcgccucaccauggcugaauuggagcagcagagucccucaguuccgaaguaguccugggaaccuggcuucagcgcccgccuaccguaagguggggccugccagggucagcgcccggacucugguuguugucuccaggcacaagagguaagagaaaguccccaguugagccgaagcuaccucuucuugggcuagugccuugggccccgacagcuccgaccccggucccuucuuccuccucccuuuguacuuuggccccgggggcgggaggcagagguggaggguggaguuucacuuuuuuccgcucuucucccuccugcaggaaacagcaucagaugacgugggcggguugcaccgcuccccucccggaggcucccggcagcugugcacgggaguucccggggagguuggccaagagagguagaaggcgggccagguaguuccucccgccucccccgcccccaaacacaccggcacaacucuaagccuuacguuaggugcuccucugcucacggucgaaguggaucucugcaaagacagagaagaauccuugugucugaauucucaucagccaaaucacccuugugauugccucaaaaccaaaaucuggucuuggcuacgaaguugcagagcucuuuaagauucguucuuuccauauaugaaauaacaagauacccugcuuuucagugcuagagggggaugugaacagagaaguuugggacuucaaaaucggcuuacacuugaagcucuuggaaccauuuaaaauuaucuuccuuucacccgagaggcaaaaaccugaaacugucguucagaacuuugcccgggauuagauucagaguugaagggccuucaacaaccucuucguuaguucaucacuuguccugugucuguuacuuuaagaaagccuaugucauccuguucgacuacucaggccugaucaggaucacucucugcuucggcuaagcucugacccggaaguagaggcguaagccaagcgacaaccaugauuuacggucucgcacuaaggagaggcggcccaagucgggggugugacccgguaacgcaaacuggaaguagccgugaggagucccauucuccagcuuuuccccgccuccuguaacgcauuggaaaagcuuugcgccagucaucaagucguuacccaauggcgacucacccggccgucccauauuuugguggcucuagaauuugacugcgcgcgcgccuaagauaccucugcaucccgucacuucgcuacuucuccg

SEQ ID NO: 9083 - RNA, 30930 nt, Mus musculus
cgguacucauuccuuccacccccgaaccggguacccggguguccaaguccggacgcuagaucccggaagcagggucgccccgccccgcgcugcagccccgcccgccuucggacgcggggcgaggggggggggugcggcuccaggaaacggcgcgcucgcuacucuugagcugagaccagcucgacgcgccgcgacggccccgcagacucagccagcccaccaggcggaccccgggcaaacucagccuaggucuaaaccucagacauaucuacacggacggggcggacagauccggugacaaagaaaagagcuccagagaccauggggacccuggcugagccagcaguggugggcaagagggagucccaagccugagaagagauccggcagaguuccucaggccaugacuucaguguggaagcgccugcagcggguuggcaagcgggccgccaaguuccaguuuguggcguguuaccaugaacugguguuggagugcaccaagaaguggugaguagaagcggggccugagggaguccccuaagacugaugugggacucaacuuaguuugacucguuugaaccuggaaaaaaaauccucucaagucuaaaggcuaaagggguucccauccuagguauuccagacacugaagugccuggcagguuggggggacuccuguuguggagaaccuugugggggucaagacucgguggcuuugggagaaucagccugggcccacauuaaaucggcuguggucaggacucggggagaagcccucaagccaaggacagcggucuaggguagcaguggaaaacggaacaagauuuuagggcuccagggggcuuuggguggaaaagacuucaugguuccuaguccaguucagggugaaaauguggccuucucuuuuucagccccucccccuucagccagagugggccccagaagcuggugcugucuccacaauguccuuaaaaggggaaacugagcuuggauggauaacagggaggcggggagaggcuuaaaggggccugaaguccuaggagcugguggguucaggagaggguccguggagggaaagagaguugggugaggggacgacuugcaagagaggacaggucuuguauuggacugucaagggccccugggggcaucuggcucacauguccccaccgggcagcugcccaggccccugcgucacacccuaaauauaugugcucaccggugucagcuucccuuggcuggauuagggcacagcugugggggccucacaggccaggcagggcuaaauauagacucccaagggggaagagcugggguaggccggaaccauggggucuaaggaggcgaaggagcagaggcuggggucuuuggggguagcaccauuaaucaucagccuugaacaugcugaguguacccggaggcccuuuauaccguaaaggguaagggagcguaagaacuaguuaggcuaacacagcagagcuagcacuugaacucuggccucuggcuccugccccagcacgcugggugaggccagagggacacugggcaugguucuggugagcagacagacuauacagacggugucagugggcugagucacaaguaaauggguaaggccccgcuggguuucuuagccaggaggccaggacaggaagcuggccccugccuaggucauggcuucccaagaaggcguggcggccugagucaggcuacccaaccaggccacacccucccaaggcacccgcuauuucccuuuucugggacagcuuggcugggccauugccugugguuugaagccuggggaugguugcuuacuucugggucagaggacucuagacucagcugugugaccuuaucuagccggcaucucugugucucagaaaccucaaggguuaacaacaguaagccacuuguccugacucagccucuagagugguagcagaccuaagcauccaguuguggggcuggaaagagacagggaaugcucucacaccgccuuugccugauccuuuccuugaccaacccuaccucccugggcagaggucagcaccuugucagggcucagcccugugcagcucucuccuuguacgucucugccacacacguuugccuccccugagucuuugcagcauguuagauguucagauuagcugucacugccuggcaguguccucagacuuuccugggggcccacugccaucaucccuuuagagugguggccaguggcccuggguuugaggaaguagaacccugccagacccugcucagagccacugagugcagcaaagggcuguccacagccugccuaccucuguggguggguggugucuaauggcaagcugacccugugcugcucuggccucacuccucccauuuacugucaguccaccucugccucuccccuucccuuagguccucgcacuuggcuaguuccuccaccuggagccuucucugcacacaaagccaccuccuccacuccugccucugcucagauacccaaccucaaagagaccccaggcaggcucuuuuacagcccccuaaaagucacuuacucauuuauuuucuuacacacacacacacacacacacacacacacacacacacuuaaaaaaagauuuauucauuuuauguaugugaguacacugucgcucucuucagacacaccagaaaaggacaucagaucucauuacagaugguuaugaggcaccaugugguugcugggaauugaacucaggaccucuuaaccccugagccaucucuccagccccuguuuguuuguuuuuguuuuguuuuguuuuguuuucuuuucuuuccuuuugagacaaggucuuaccuuauagcccuggcaguccuggaauuugcuauauagaccaggcugcucuagaacucaaagaccugcuuccaucucccucuuaagaacuaguauuaaagcucugcaccagccagccagacugacuccuucuugccuauacuuuucaucagucuuccuugccucugagcccugagucauucuccuuugcuuugcccucagaacagggcugagcuucuagaagcucuccacaagcaucucugaacaaaugaacuucuuuaccacggagacuuugucuccccaaguuucugugugugcacaugugugcauguggcuaucccugucucucaccgucuuuuucauaggccccacugggcuucgauauuccaaucuccacuguccaggccuuugcccuuuggucccugccccacccuacaugagcagcuccaccuacacccuguggcccuagauaagaugcugcccaugcccucuccuugggaagaggacuagggagacccccuggccccuagggagccagaaagaagaggaagagaagauggggaagcuggauugagccuagcuaaguggugcuucccuauucucccuccaggcagccugacaagcugguggugguauggacucggcggaaccgaaggaucugcuccaaggugaggaagacugcugggggcgagguggggggaggguuccagguuggaauggagucaaagaugggccaaggagagauagauggaagcugaugggggaggguaacaagguucaagccauauugguuucuacagggagaaaggaagauaagggcucgguggugauagggaagaguuagacucaggagagggcuccuccugccucuugcaggcccacagcuggcagccuggcauccagaacccauaccguggcaccgugguauggaugguuccugagaacguggacaucucggugaccuuguacagggugagugcccggagcucagacaugggcaggcacggcagagugcagugucgcuggguagccauggggcaccccuggaggguuuucacccacaaugaaagaaccaaaucguggaaccaaagauuuugugaguuuauugcaaguggcugaaguggucugggagggggcaguauuuacccaaccuguaguaagaaagucaucugggaucagaagccaguugagagcccugguuguucuuccaaaggaucuggguuccauuccuggcacccacacggcagcuaauaaccaucagugacuccaguuccggggggggggggcggaucaaacacccucuucuguccuuuaggggcaaugcacaaauguggugcacagucacacaugcaggcaaaacacucauacgcauaaaauaaaagauaaauaaguauuuuaaaaagaauauauguauguguaugcacacacucacacacacacacacacacacacacacacacacacacucucucucucucucucucacacacuccgagaagccagagugcaucccaggagggaacacccgccccacccccagccagugcagauuguuguucugguguugccccuggaaacccugugcucacccguacuccccucuccaggacccucauguggaccaguaugaaaccaaagaguggacuuuuauuauugaaaaugugagugacuggguaggguggaccugugauugugaucucagggccucaggauagcaacugaugccccuuccucugucuucucacuccccccccccccccccccgcccacaggaguccaagggacagcggaagguacuggccacaguugaugugaaccuagcccaccaugcagggccugugccugcucagguuccacuucgacugcggcugaagcccaaaucugugaagguggugcaugccgaacugagccucacccuuucuggggugcugcugcgagaaggccgugccacgugagugcccacccgucuuccccggcacucccuggcuugugaccucugaccccagccuucgauccucaucucaaacccacagggaugaugacaugcagagucuggccagccucaugagugugaagccuagugacgugggaaaccuggaugacuuugcugagagugaugaggaggaagcuaauggcccuggggcuccugagguccggacucgaggcccccagucagguggguucacggucaccuaugggcugaccugccaggacccaagauggauguagcauucccaggucccaagugcugguugcucuggggcagggcuagcucgugcauguccagugacaaaugcucaguacuacccagcagcucucauugucccagcuugguccuggucuuguguguugugcaucagucuuaaacagaauccugcagaauguguucacaaugucauccuguguuccuggccaucugaucucuagguggucccuaccaggccugagaagcuaggucacaugacaugugggcuccuacccccgcccagucugccucccuccccucugcugucccuucccgcuccuccuuuagagccuuuuguccuugacuuuugugguucuuucucacucuuucucuuucugcaucugugggccugccucuucuucaaggccggggcugugccccaagacugggacguuucccagguaggcccugaacucuaguuggggucaggguggggccaaacuguagaguccugcccugaccugauuacaccccuccaaugaaucccuccuucagaucugucucgagagcugaagacacucugugaagaagaagaugaaggccacauacggccccagcaggcaggugagacuuagccugggacugggguuggggacuggaccuaugucacaaugcaguccucaguguccccucccuuuuccccuagcugccagacccucuagugcugaagacaccagcccugccccagugagugccccugcacccccggucagggccuuccggggccaggggucagaaccagcugcuauaaccgggggccagguggggccugaaaccccagagcccccgccauccccaccagagacaagguaaggaugauaucagcuucauugcuguuagaaguggauacacacaucccagucugcacccuucccucuacugcuauagcaugcuaaagaagaaaggaaggcugagcaugguccuaaaaagagagcccucaacauuuguuucugcucuuuccucagguccacugggcagccaggccagaccaugguccccaccccagccccucggcuccggaaaggcucugaugcacccucguccccaguccccugcaguggggaugagguccccaauaccucagaggauccuccaacaggaaugggcucuucuggggagacccaggcucagauaagcucucaggaagggacagaggcccaugaagccaggccagaaccagacauugaggucagaggcuccaaagauucucugggaggagaaagauccaaaguugaagaggaggacacuggggacaggccgggggcuaguggggcagggaauagagagaagaacacuaagaagucggacaccacagccggcgaggcuggagagagcucagaacuucaucaaguagaugcugagcacaagucaaagguucaacacagagccacagagggaccagaggcugcagggccgacgcccaaggcaaggcuuggggacacuccugaggccccuccuaggagugcucagaggaggauggggguuaggacccaggaagaggcucccagugaccugaacccaccuccagcugagccugaagaacaucuaggggaccucagggaugccaggccugcaggccaggagaaaggaagugcagaggugagggguaaagucccugcuauugggagggcaggcccggagcagggcuccucugcuagagcagcaagugcugggccccaggugagcugcguucagacagucccaucagauggccagggggugaaaucuagagaucagagggcucaggaggcagaaguuggggagucaaggguucuagaaacagaggcugagugggugccaugggagguuauagggacaucaaagacagaugcugggauaccagaaucccuggauacagaggcuggcacagcagagucugaaauauuggaggcccaggagucagaagcagcaaggucagagggccuggaacccgaggcugcugggacagcagagucugaggugcugaggacccagaauaacgagaucgugguucuggggaugccgaggacagggccugagauaagggagccugaggaauuuggggaaacagaaguuggggguuuuacaguuccagauaccaagacagugauagcagaaacugagauauuagaaacccaggggguaguggauggugaggcugcggugcugaagacacaggcugagauauuggaaacccagaagacagaggcuggggaggcagaagcgggaacacuggagucccagaagguagcagccgaagguuugggggcuccagaagugggggcagagauggcagaggcugagaaauugggggugcaggagacagagguggagauuuggaggauuccaagaauagaaaccgaaacagcaggaacugagacauuggggauccacaaaauagggcccccacagaugcaaccuagacuaguaggggaccaggagaccgauguuucagugauggagacagcagaagaugcuauacuggggacccgggagauaucagcagguuguggaguacuuuugauagaagcaaagauaccagaauccaagauugacagaucccuggagacagaggaaggagauuuagggguucuagagguagauacugggauagcagaggcuaagaucuuagggauaccagagagagcaccagggguucagaaggcucugggagcuggaacugagguagccagggucuuggaagcagaggcuagcucuucagaagucccagagacagacgcugaagaagcugagacacugcaggccaaggagcgaucugagaguucuguggcgcugagaguaguggccaaccuaccagaaucugagcucuuagggacccagaagaaggugggaggcacugggauaucacagagagagguuagagaggcagagaccgaaaucccaaagacccaggaaauaucaucugaggguucaggaguuccagacuuggaggcuaagauggaagagucugggaggaaaauggagauuugggagaccccagagguagagaaagugaauucugaguuauuuggaacccagaaaggcucagagaucccagaacuagaaacuaagaccauaaagucugagauucuggacacccaggagacagaaguagggggcuuggggcuucgucgaggagaggcugagaaagcagaagcugagauguuagaaacccaaaagacggaagcaaagacagcucgggaugaagaaauagaacuaguggauccuggggucuccaguccagaggcugaggcacugaggguccagugggcagggacuguaguuuuggagucuggggaaguaaaggcugacauuuuggggguccagaagccuggaucuuggggagcucuuaaauaugaggccuuagauguccccguaacuaagcaaaggcuuucuggggccaaggaaguggugccagagguacccagagcacaagagccagaaacuaaaguuuuggggauaguagaggccaaaucuuggacuuuggggcagcaggaagcagagauggagggguuugagucuccagagaauaaaucuaauauuuuugaggcccaggaagcagauucuggggucuugggaaccaugaaggggaaagaagcuguugaaagccucgaggaggcuggccugaguaaggcacaaguggccagugaggcaggggcuggggugcccaggcccucaggggccucuucccuagaggaaccugaagaggacaggaggcugccgggcagccagguaggguugggggccacugugugccagucugcuucucccacuaaccuggggcugauugaacaguggcucugcauggacccacccaguggacuaagaugugggauuuuugggaggcggggggggguguuucaguuucaagaagguccaucaucccuccacccccaggaugcccuggcccucgcacccagcugggcugcauggagcugcacccccuaagcugauuuucugagcugacuuugagguguggcugcgggugaccucugacuucuaggucaccuuggcagauaaccccacuacccuaagcuggaaacccuucugccuggcccaaugcucuugccagugcucucuggugaccuuguaagcucagagcugggaugguacugugccaggccugagcuuucccccaaaaggcagaggacguaagucaucagaauacaucuucuaagucaacccuugugucuccaggcaccaccuacccuggucagcuccagccagucccuguuggaguggugccaagaggucaccaacggcuaccguggugucugcaucaccaacuucaccacguccuggcgcaauggccuggccuucugugcuauuuuacaucgauucuacccagacaagaugugagcugccagggguggggggaugggugggacgugagacugcuaggacaccagcgacguccguccauuccugaccagcacucucucucugcagcgauuauuucucccuugauccccucaacaucaaacagaacaacaagcaggugagaugaggagggagcuguggcuggagauaagaucuaguuagagauucaagcugcuggccugagaauuggggucugaggugcagggcccuggccuggcuuuuagaaacuuuaaaaucuuuuugguuauuaaauuguuugcccuaguuuuguuuugguguucuaaauuuuaaaagcauguuuucgcuagauuuuuaaaucauccuuugauaacugggugggcgauguguaguugcuagguaacagcgagggugggccuugaugucagauuucccucuacuggagggcgaaggcguugcuaagcaaauccuggcucaagagucucugggacccccugggcuggcuugggucuggaggguugcugaauugaugcggcuucugaucagaugcacccuuucuaggcuuuugauggcuucgcugcccugggugugucucggcugcucgagccggcggacaugguacuucuguccguaccugacaagcucaucgucaugacguaccugugccagauccgugccuucugcacugggcaggagcugcagcuggugcaacuggagggcggcgguggcucuggcacuuaucgugugggcaacgcccagccgagccugcccgacugucuggacgcaggagaccuggcgcagcgauuacgcgagcauggggcugaagugcccacagaaccuaaggaggcugugaaccgcgggacuggggcaauaccaaagguggccuccagggacacggaccugagcugcuccucuaaggauggggaggcagagguugcccaggaagcaaucccucaagaggcgcccaccgacggcccuagagccaggucguccacaaccccgguggucccugcagaggggcuggugaacggagugggggcgucagguggugugaguggugugagacugagacgguccucugucaauggggaggcugggccaguaccuccaccccgagcacauggcucuuucucccacgugcgggacgccgauuugcuaaagaagaggcgaucgagguuaaggaauagcaacucuuucucuguggaugaccaggacucuggagcugcaguuggagcagggccugcagggccuggagcuguggugaguaccccuacccugcugcagcauaggauaguggggagcuuucagaaaugggucccgagcggccccagugucaaagcagggcaugggcgcagcuuuagaaaagccacuuugcuggaugcuggguccccugcuaugguaucaggagacaaagcccacagccgagauagccuagacuguguugccagguuuguauaugugagugguuucuaacauuugguacccaguuuguagaaacauggucuguauagaaagcuugcagauggcuccaaguuuaguacuggccuuuugggccuuuucuuucucucuguguggccuugggcgucaccuagcaacuacagcucccccccccccccuaguuagggacagggauaccguccucuaguggccucuggagcuccuucuagccuccagauucucugaguggaauauuuaacuacugaggcuuaaugagaguuaggaguggguccucuugccugggaguguuguucucucucucucucucucucucucucucucucucucucucucucucucucacacacacacacacacacacacugcagugugcuaaaggagagaagguacuacaggaaucucagggacucaggaugaacucuggcugcagacuuuugaucugagggugacgguagaaggggccacuucacccugcagcugcccaccuguggucccauguuuggagggcaucaacugagagcagcuuuguggaggaaacagcugguccucaaguuaguaagauagacaguuuucccuggugaaaaacaggggaccaaggaaauagcccagggguagagugguugcccaagagguccugguuucaaacgccagugucacuaucuaacaacaaaaugcugggcuugguggaggaugucuguaaucucagcacuuggaagguugaaggagaaagaucaggaguucaagccauuucaaaacaaaauaaaacaaaacauuccauggccggguguggguguggguacgggcgugggcgcaggcgcaggcgugggugcgggugggcuuagcaguaaagcguuuguggcacaagccccaggaccucaguuaggaucccuagcaccauguaaaaauccuguaccaauccgggcuucagguucagugagagaugcuuucucaaaaaauaagguggcaggcugauggcuuaucaggugaccugaccucuaucccugguguccacacgguggaaggaaagaaucacucacacaaguuguccucugacugucacccaugucuuggggcacacaaccuacuucaccaauacauaaauaaauaaaucugauaagaaagaaaggaagcaaacagaguggagugugauggaggaagacaacugguacacacacacacacacaaaugcacacacauacacagaugcagacagacacacacacacagaugcacacacacacacacacacacacacacacacacacacaaauaacauacaagacaagagagagaaaagaaaacgggaaggaguaguucucaaaugaggagaccucacucaggcaaaagggcagccucaggacauucaggucucauuuagggaccugacagucaugcucaugaaguccccagauagcagugaggugguugggaauaggagcccugagggaagguccagagacacaggaaccugggaaagagagguggaaaggcauuuccuucaaaagguggaggugguacuugcagcccagcuggcuaauguaggucaguggcccuuuaaaucacaaggggcgggguucacccuucugggcugagucccacagcugguuucuaagccaggcccuccuucugcccuuacuucacuggagcuauuugagcagugggaccaaggagccuuucucauuggccgacuuugcccugacaguuuuaggagguuguucagccugaccccacccuuggaagcucuccaaggccuggaguaggaugagaucaggcaccuggaggcugaggugggguggaagcagcugcaugagaaacaugggugcuuuuagggcagccccuugaggaaaguauagaaagaggaaucugggucagacacgaggaggaaguuuuggaauucccaucagggcugugugagugagcacaaauguggcugaccuuagcacacucaacccucuacuuggccuacucugccaggugggccaucugugccauugccuggcuucccacaguaucccuuacagggagccaugacuccugcuuuuuaaggguggggauagugaaguugagggagauaaagaaccgaggcagaggguugcuguugcugcugcuaaccuggguucugagacuguggugucaacugucgcccucugcuagccccccucccccgagagaggggggguccuuuuccccugaggauaagaucaaaauugugaaaacccuuugcgaagugguaugaaaccauacuaugugguaucaaaauugugagcuaaaugcugcccuagaugccuggcuggaguccugcaucgggucugggcucuaucuccaauuuuacacacaaagaugcuaucaagcccaguggggcaguguguccaggcuuggaucaaguugguuucuuugauugcuuguuuuuguuuuuuuguuuuuuugguuuuuguuuuuuguuuuuuucuuuuucuuuuaaccugagacaggauuucuuuguguguaucccuaguugucccagaacucacucuguggaccaggcugccucaaacucacagagaucugugugucucugccuccugagugcugggacuaaaggcaugcgucacaacugcugggcugggaacaaauuuugcguuagacagcccuaggccauagaucaauuucuauggcaaacuucauuucuggcuuccuacuuuauugucugcagagugagacuaaccacugccucuguggucccuagagagacgggagugcucggcagggguugccuuuaguugauguaccgcaugugcuagacuccugggcuagcuaaagggaagauggcgcaggguuaagagugaaaauuccucuuacaaaggaucugaguuugguucucaacgccuauagccaguggcucacagcuguaggccuguaaccagcuccagaaggucugacagguucuucugccuuccgacgacaccugagcucguaugcacauacacgugacuuaaaaauacaauaaccagggcuugcaggauggccuagugguuaagagugaguauuggucuccagaggacccaaguucaacugcaaacauacaaaagagggagugaguucacaauagucugugacucugguuccaggugaccucgugccucugucucuaaggguagccacaucuguguggcaugcacacacagggggaucuccgugaguucgaggccagccugggcuacagagcagguuccugccagccggagcuacauagucacauccugucccaaauacacaggccgacuguaguuaaagaggaugcaauaaccaauagcacaaggagguguguggggucugagcagccaugaggccaggaagagaggcagagguggggagggacgugcgaggggccaccuguaggagggguccaagcugggccaggaaggucgaguugguuuggagcaacucaagcuggagagugguuucaggaagcuuuuuagggaacugaaaguccauugcuguggccagagggccuuguggugguaaaggaauugaggguguagcucccgaggccugagcacugagacugggcgcugacacgggguauggagagagcuacagcagaaguagauguuuuggggaggccucgcagcuugagauggacgugaaugaugguggcggguggcaccaccgcuauuccuguccagacaggauagcaccugagcagcaugacuugucugaugggcacacguuggggugaacaguugacuaacuccuuuagguucuacaccucugagccagagaguggcugagaguguuguccaaggagccaggcuguuagaguuaaaaguuaggccccaggggccaagagcacuggcugcucuugccgaggaccugaguuugguucccagcacccacacugggucacacuguaguuuauaacuccaguuuccaagagaucuuugggccaucugacacccccuuucugaccucugcaaauauuggacaccaguacaccacauacauacaugcugguaaaacacucauaccauaaaauaaauaaauguagauuguuuuuaaaaauaauugggcccuaguaacagggaauagggaacaaugggggccagacuuaagccuuuccauaacaaaauuccuuaguuccugcaaagagcauuguaggcucuagauaugaaauccuagcagguaggagggugcccccuucuggccagaagguagaugcagacucaggguagccuagcuccugaugggguagcucugucgcugcucuuugaagggauggggaagaguggaaggaaaggguuccugcugugucuuucccacugacuuacccuaaaagaauuaucaacucaaugccccgcaggagcauuuggaggcagagaggaggaugaccccaggcccucgggugggagugaaggcauggcuuuucauugaggaaguccuuuauccugaaggaggugcuugugggacuggagaagcagcuggaccaaagcuccucccucugcuguguauuagaguccuuaguugucugcagugacuuugggaacuaaaaaaccccagcucucauuagacucuuuccacaggaagguccaaacccugccuccagcccugacgcuaacccacucccagccccagccccacagcagccgcccgguaaguaguuuggaagauggggguggugacagagcucagcucacgauguucagggauccuucugggcgcuuuuggggacuucugcuaacuggagggaccuguccugguuuuugucugcaggugggcccccuccuacugaggagucaucacccagccugggggaagagacaggccugguaaggagaguuaggugggcagaguuggugugguacuuucugagcuggccuggggugagcucaccuguccucugccuccuuccuuccccuucuagcaacgguuccaggacacaagucaguacgugugcgcagagcugcaagcccuggagcaggaacagggacagauagaugggagggccgcugagguggagaagcagcugaggagccucauggaaucaggugggaccccugauuuuggggcucgcuccucaacagccuccucccuaaaucugcccagcucugcagcagcuccugaccuugagaggagcugggaggagauaccacuagagucccuuugguggucccaggaagcugguuggugggauguagcugagacuucugagauaccacaggaaaacaagcgcuccccacccccacccccagcugcucugcccugucaggaggcaucucuggugacuggugacuguccuggccugauucaggugccaacaggcugcaggaggaggugcugauucaggaaugguucacccuggucaacaagaagaaugcgcucauccggaggcaggaccagcugcagcugcugugagucuggcuuuaagccucuugcugcuaggccucugcccgccugcccgccugcccgcccagcuggcucagggcugcccagacagcagugaagcugagcuuacuuugguuagaguuaccuggccacuucuuucuccuuuuuucaaagaucuuuuuggagagauuuugcauagucauuuuauuaguauuuugucuugucuaacuguauaaaaacauacaucucuuuuuuuuuuuuuuuuuuuuuuuuuuuuugguuuuucgagacaggguuucucuguguagcccuggcuauccuggaacucacuuuguagaccaggcuggccucgaacucagaaauucgccugccucugccucccgagugcugggauuaaaggcaugcaccaccaugcccggcucauacaccucuuuuuuuaaaagauuauuuauuuauuuaauguaugaguacacuguugcugucuucagacacaccagaagagggagucagaucucauuacagaugguugugaguuaccaugugguuccugggaauugaacucuggaccuuuggaagagcagucagugcuguuaaccgcugagccaucucuccagccuacacccccgccccuuuuaaauaauuuauuaauuuuauuuuguguacguggugugagggugacagauccucuggaacuggaguuacagacaguugugagcugccgugugggugcugggaaucgaaucccaguccucuggaagagcagccaaugcucuuagccaccaagucauuucuccaucaccaaggagaguuuguuuguuuguacaagacaggacuucucugaguaugugccccuggcuguccuggagcucucuguguagaccaugcuggccuugaacuuacagacaucugucugccuuugccuccugagugcugggaauaagucacgcaccaucacugccuggcgaagcauauacgucuuauguugguacucuuuagugagaaaucaggcccuccgcuuugacucuagcuuuacaguuaggaaaaugagcugagaguaauccgagccgguucagaagugggguggcaagccccucuccccauccuugcucuuaccgaccugcaugccagaggcagcuuugcuuccuguuugcaguuugaaucauuuccucagaacaauguuagcauacuucuuucuucuaaauaauccuaagagggguguggauugguagaaacauacguauccaaacugcaauugaaggguagcuggaacaacagggaacucugaaugggcaucagcacagagcauugagggucuccuagcccucuauggaaacggauagggaggaagugcucacagcccugggcgcuuacaucccacuucuaacuuaacauacuucucugacagcaucgaggagcaggacuuggagcggagguuugaacugcugagccgagaguugcgggccaugcuggccauugaagguaggaagugggucugggccagcaaaggcuggagguagaacagggucaggggaggaacccuccugacucaggcuccugguuucuuagaguggcagaaaacaguugcgcagcagcaccgcgagcaacuccuguuggaggagcuggugucucuggugaaccagagggaugaacugguccgggaccuggaccagaaggaacggaugugagugggggaccugggugguucuugguuuugaagaagccccagggcgcacuccuggagugcugugccuggaaucucagggcuugcaaguagggccaacuuugagacuaacuugaaccccuaucuucagcgcucuggaggaagaugagcgccuagaacgaggccuggagcagagacgucgcaaggugagccggcagcugagcaggcgggaacgcuguacccugagcugagucuccugucugguuugucccuuucucuggucguggaccgucuucgccacucccccagccugcacagcagaggccagguccccaugcuccuucagcgagcagaagcaagacugaccagacucucgggcuggagcagugagccugcuaguguuuauuuauccgaguguaugugaauguuuuggcgguggccaggaucccaggcaagggaugguguggggacugacacccacauccuccuucucuucuggagggagcaauaaaguuggaguagaacaaaccagcgccugcccuuucucaacagggccucaauggaaggaagagggugggacuuagcuaauaacgcugaugcuguguauaggauucuaacccggagccaguugaguuuagcgguucacagaugugaccuuccaaggauggaggccagagggaaagcccauuuugaaagaaaaucugaaaacacaaguguggugguguacaccuauaaaaccuuucaauccaguauuuggggugaugcuggaggacgaaggaucaagaguuccaggccagucucagcuauguugguggugcgagagaggcagaucucugugaguucaaggcuggucucauuuacauugcucucauguuuguuugcuuuuguuuuugagacaggguuucucuguacggccuuaucuauccugcaacucacucuguagaccaggcuguccucaaacucagugauguuguucuaaagaaaaaaacuauugaaaugggucauuaagauagcucaguagggguggagagauggcucagcaguuaagagcacugacugcucuuccagagguccugaguucaauucucagcagucacaugguggcucacaaccaucuguaaugggauccgaugcccuauucuggugugucugaagacagcuacaguguacuuacauacauaaaauaaauaaauaaaucuuuaaaaaaaaagauugcucaguagauaaaaaacauuguugagcaagcuugaggaucugaguucgaucccuggggccucccaaagguggaaggaaugcaccaacuccacaaaguuguccuuugaccuccaaacacgcuccaugccuccaugccugaguuuaccacccccacuagaauuuuuuguuuuuuguuuuuuguuuuuuuuguuugacauacacauacucacacaguugaauauuuuuccuagugcuagaagauuuagcccagagucgcuuggugcaugcuaagcagcccauuuaauuuuuaaaauuaacauuaucccaugacauauucauucccauaaccccuuccugcuauguucuucaagcacuccuuggugccucccgcucaggucccccaacacgaucgagcugacuuccugucgccugacuggggucagcaggcuggggucuguucugauguucugauacugaggcuggggugguuggucccaagacuggggcgucaggcagcacagugcucagagccagcucaucuuggccuaggaugccaucuugaucuucaucgguucuagagccacugggcccaaagaauuucaccauggcacggaccugaggcagcucugagaaggucucuacugcuaacaacauggccaggagccccaggagcaaguaaccuggggagaagaggcaguaggggcagcucuuagggugcucagaauacccccccccccacuucccagugugaccauccacccuggcacuacuugaaacucucaacauggcucccaguguucuuuaaacuacaacacccauuuugugcccuaggguaggaucucugugaauuguagucccuaguggucuaugggaguuguaguccagacccucucuacccuccucuuuucuggacucaccaagaagugcaaacugcccaaggugguaaauggcugggugcaggccacguccaugggcaggcagcaagucuccuaggccgaucgugcugagugagccgaaacagaaguagauggcuucuagcaggcugcagucacccuguacaccccacagcaccagugcuggcagcagcaugaagacacaggccaccaggaggcccaguccugcugccuguagcagagcagccugagcuggugccagcugccagcgaauggcuacccagucaccugggcgacugaacacaggcagcaagcaguggcgcagggcagccacaagugcuagagaggcuggcagcccaagggcugcauagaccacacagaaggccuuuccaccugaggagaguggggccauguggccauaaccuggaaaagagagagaagagggcagcaagcuuuugagugggcugccccuggcggucacuuuuucuccaucaccucccacagaagucugccuuuuggugaugacaugaaugcuucaggcugggguccucuuuucacuggaugguggacuggcuucuuaaccucacuggguuacuguugucuuuucuggaaaauuaauucugaagacagaugcccuaggcugucuguagcuggaacaauuuaaagcugauucuggcuuugagagacccuuccucuuuaucuguacuucagauggagaccagggagccccaugccuucuaggcaagcgcuccacaacuaaugucuccccagccagauccugacuuccuggguuugucaguucuuauuuuuaccauuauuuccaaaucuucaaccuguggcaugccauccgccuucuuuccccaaauguguaucugcccgggcucuggguuaugggagggaagcaggcaagggaacaagacguucugaaaagaggcagcaugcacgagagacagcauuuagagccagagaagcagggagcaagaaagggagagguaggagacuggggcaugcugggagaacaagaucagcaggguccauggguuacaaaggccaaagcuccuaggagucagcugugagguaagaguguagugaagacugggugggccagcggccauguggucuagaggcaggcuccauccugcuccagccaauuggaaaggaaguuagagauacauauuucacuuugaaaaguauuuagacuauuagcaggacaaugaaacaaaaccaacccccuaggacuaguucugugccuaagcacaucuguucucuuagccaggaauuucgcuaacccgaccuacuucugcacccuguucacugggcucugagcacaucaucaccacuuccuccccucagacuuccucgagggcggcucuaagcugugcuuccuacagcaucucucuagccaagagucuaucccacccagauguauucucugucuggcuucaggccuaugugacccggguuucucugcuggaugcagagugcugaggggcggggcuggggaggccacaccccuccuggcagcuuaaguggaggcaccaguugggguguguuguguggggagccccacuugugaugucaggucugauagagccguggcuuugucuggagcuuuggggugggggaagggcuugcacccuagagcucuuggguccuccuccugguuugcuuggugguaguggugguagugccuaccggugguggugaggaugcuggcagugaacagcagagcugagggcagaucccaguugcuugucucugagcuguugcccaggcuggaaacuccaugggccugugcucucaggaccgcaccuagcagcuccuccagggccucagguggcaagcaggcccugugcucugccuggaagcuagccaguucagccuggaccugggccuggagguggcgagcuggagggcccuccagggccugaagcaccacagccccaaggcccauggccagcaggugggccauaagcaggagcagguaucgggcccaugguuucagacuccccauagcauggcacugagucugggaaggugagggaguaggcuaagccaccaguggcaccagggaggggcugcgaagggcguggcggggaggaggugcugcguggguaggcggcugagaugacuagaaugaacgugaaugagggaggugagccacagcacgcccaguuucuggggcaagacauggcagccgggcacugggggugggcggaggaagacacuguggugagaagacugacugggugagaaaagccuggagagauccucacacgaacguacgcaaagucacgccuccuuggucacauaugcaucacucauucagacaccagggaagaugacagacacagguuuguccucuccugcugcucccauaagaaaucugcugacaaacuaccagggagcagccugcggggagggcaaacuucccaggaaaacucuuugaaggaaguaauauuccaaccagagaacaagcuaguuauggugcuggaaagauggucugcugugaggaacacuugcuguucuuccagaggaccuugguucgauuccuggcaccuacaugguggcucacgacugccagugacucuaguuccagguuaccugagagccuuccccuggcacagguauaccagguacacuugugguaaagacccaugcaggcaaaacagcaaucuauauaaaaauauagggccaagugugauggcgaaugccuucaagauuucugugaguucaaggcuaaccugaucuacaaagcagguucgaagucagggcaauagaguaagauugucuaaaauaaaauaaaaguuuaaagauaacaucagggaaaaagucauauaggagucagagaccaaccaugaagaaggggcugaggagacagguuguuguuggcaaguagaccaaagaucuugugaggaugcugaagcauucugggugggacagugaucgccuaagcagagggugggagaggcucugugggacucagaauagacacaguuggagagagcaugagguaagggcgcuugguguuccugacucuuuguucuggcucuugcugcagaucuccugccucugccuggcuggacugcagaccuggaauggcuacuuuguguaaauugggggagcuucauucauaaaccauggaaggacugcccuaaggcauugacugggugggaaccucaaggccagguccaggccaccagggagggucaccaugcuuccaggugggugggcuuccccauauccagaauaugagaggcaaacccagggcaaacccuugagauuuuucccagaggugaguaucucccuggggugaagacgacacauccugggaaagguuccuagagaugacaucgcagcugggccuagcaggcagacagggaccaccggcaacaaggaaccuccgggcaaagcaucacuugaaugguagagauggcucaaggaaaagccuggcaauggugagaggcuggcugggcugggccuuagcgacuacccaguugcugggcuugguccuaggagaggaggcacaaggccuccuagcucugccucagcuacuuaucugcccagaguucuaggggcaugaagacaaaacaccagauuaccuccaagaaaggugacauuacauuuggggagacagcuuacaaguuuauuuggcuucauuggcuccccaagccaaggcuccaaccuuggcggggcaguagaaaggcacccagagagccccggcuccaauaacuuccaggguuggggguccaggaacucagccuuggagacaggggccacaguaacaggacuuggucaaaagugcuggugacaccugaggucagccccuuuccccuggaccucccugcucccugcuccgcuccugggggcaauucccugagacaggcucugguccuccuaaccagcuagguacagugucaggccccaguggggcaguaagucaggggucccuacaguuuguaggcaugugggguguagcccccauccagugugaaggcuuucugugcaguguaguguuccugacccccaaagggucagagucccugggggaaaccaaggcagccacagaggccuccugguuccucuuccaguguaugcuaugccuccucgaaggcagccgaagcgugggguguggucuggcccacucagggcccugcuucuggugcccauggggccugggcacccaugucuuuggucugcguccugcaguccugggagccuccccggaagggguuggcagguggggagucccagaagggaucugagucugggaauaagguccacggugcccgucggggugcaggcuguggagagggcaggggugaaggccguggcccagcugacacgaagcuccaugggucaauacggcuacggaguggugagggccgaggucggcugauuaggcccaacgguggugagcgagggguuccaggugugccaggagcagagcgugauauuccuggugggggugagacgguucucccuauggggguauaaaaguacggguacaugguuaggcaggcacccacucauucuuagaugucccuuggagaaacugcccugcucuugccugggcuucuagcauuucaggguuauggguagccauagccuuguggguucuauggcuccuuacguucugagaucaucuguucaucccacaguuucagggucaggcuggcuuagaccuaucugggcuuggugacuuacuagcuguaagaaccccaagccuuugcaucuguaugcucugugcuccuuacaguuccucaucuaagcaggugagacagcuuagcaguuacaggggcuugcugucaugacuaacaaccuguguucaaccucuggcacccaggugguggaagaaaagaaccgacucucaauaucucuccaucuuugcccuguggcaugugugcccccacaaugaauaaauaaacguaaaaauaaauuaauuucuuugucuagccuggcaugguggaacaugccuguuauauuggaacuugagaugcugagacaggaggacugggacuugaguccagccugggcuacauagggagaccuugcuucaaauagacaaacaacaaauaaacaaacaaagaacuucauuaagaacugggcacaaaaaugcuucauauagccaggugugguggugcacgccuuuaaucccagcacucgggaggcagaggcaggcagauuucugaguuugaggccagccuggucuacaaagugaguuccaggacagccagggcuacagagagaaacccugucuugagaaaaaaaaaagcuucauauacagauuauaauuuaauguaauaacuucuacauagaaugguuauaguaccuggcccgaccaaucaauagguauuagucuaucaccaugagggagaucucuguaucucacagcugaaccuagagcucuagcaacagccacagagccuaagacucuguaccugccugugguccucugaguucccugccacucuucucugauggccucuuaucuccccaucagucuuugggucacucaccacgugucucuucccgucgagggcucuuggcugauggcuggccagagggaacaccuaggucuagcaauaaggguccaggagugggugaacuaugggcaucagguguuguuugugagaggcggaugagcgggguggagggcagcucaggugggcagggugagggcaucugugcaggggguggugcugucggggacuccccgcguucacggcucaggccuccuggagguugcagaucucggccaaggccuagggaagccagcagagcggucccccguagcaaugcacguuggaucaguuuaggcgucccagagcuauugccucgcuccgugggcccggcccuccguggcuccucuggcucggggcuaggccuuggaggauuaccugcgaguaucagugacacaguuagagugaggcuagcgugucugccaggagagcauccugcguggcuuuagaacaagaaccaaguucugcuucccaagggcagcuuccuuagcucuaucugucaagcagcucuuccuggucugcugaaccuucccaucacacgcauucugccuuuaaacagaagggucugggggcagggcaacugucaggagcaaugccugcaagucgcugauguggaagacaauccuccaagcugaacagcucacuucaucagagucgcugugacuucuugcaagagaccccuugccuuaucagguuuguuugugguccuauguaagagaggucuggaagggucucugggccuucagcugacacucuuaggugcucucuucuguaccuccagccagcuguccugacaguccuucacugcauaguuucaaaguccuuccugcucuaaucccuucugcccuucccuuccuugugccaggcucccagcugaccagucuggaguucuggguuggcuggagaaagacacagaaggcugggcaaugugagcuucugcugugagcaggauuuagcucggaguucuguuggcucagggagcccucuuuuuaaaaaaaguaauuuauuuguaugaguauuuuuaccuacaugugugucugcauacuaucauacaugccuggugcuuacagaggccagaagagggcauggauccccugaaacaaauuaauaauaaaaauguaaaaaagaaaucuaaaaauauuaaaauaagcaagagaaaaaugacauaagaaagggagaguggagacuggaacccaacagguugaguggcaguuccugaagugaguucugaggucccuaaagugauuuguccaagguaacuugccuagaauuuaaaguugccucuaagcucccuggaugucugaguuaucgacccugcuaccgaggagaugaugcuagugugagaggcuugaccaggagaugaagcaaacuugcuuccaaagugcuuuggguuggugaguggcucccggcaauacccauuaggcaauuucccgucagugcaggcugacuguggcugcccaagagcgaaccagagucaccagguucccaagggcagagccucuaucuggggacaggguaagcaagccucaguaguggucuaugcagcccugugagacccuagucccugacucagccagcuucccgaccaugaagauuuggaaggcugaggucagguaucaucgcagacccugauggcagcaagaguacaggcuugggcuagggaaccacaagcuuggucagcaacuaggcggggcugguggcaccaucucagaugagggaccagcuggagagguauggggucuaagucuugugucuucuucugggaccucagggaaggcacggucagaaggccuggcaggacaugacaaggacuggguuuccaggaccuugaaugcuccuuugguccuccugaccugguccauucaagaacaaaugugaucgauccccuuggucuuccaguuuucaguucagcuuucauacaacagccaauugugggcuacaacugcuggagcagaacaugugggggcuggagagauggcucagugguuaagaacacuagcugcucuuccagaggaccuggguucaguuccuggcacccacagaguggcucacaggcaucuguaauuucaguuucagggaaugugauguccucuucuggcuuccacaagcaauguagacauacaguguucaaacacauucagagaaaacauauauacauauaaaauaaaacaacaauuuaaaaaaaugucuuaguagagggcagcucaagggccugccucuggaucagcucaacucaaguucaaaucucuguucugcuagucccuacagugaaccccuuaaccucucuguaccucagucuucucuauaaaaaggagccaaugaugacaucuacagcagauaggagaaaguauuugcuguaagguggaggugauggugaugugugugugugggcugaauuggcacagauaaacaguuugaugaacagggcucuagccuaagagccacuaaaguagggucuagggcagugguccccaaccuuccuuacacugugacacuuuaauauauaauuccuuauguuguggugacccacaaccauuauguaaauaucuauguuuuccaauggccugaggggaucccugugaaaggguggcuccaucccuaaaggugucaugacugacagguugggaagcacuggucuagggucuacauucugcugugugcaguagguagggcugggaccccugaggaugcucuagguugguauaggguaccccagacaaaccacaacuuucuugacuauguggagacuaggcagcgcugagcugagcugagcugagcccucaucccucgggugguagagccccacuuagcuuccugagugguuuguggagaaggaaagcucccccagaaacccacugagacugugggagccacggcuucucugguuugagaccuuagcugggggucugagguagcuuacuccccucuuagccucaccuuuuauaccuaaaguggggagaaugucuccucccucgggagucagccguugucucccucccggugacgcuguuaucaccacagagaacagaacagcccugagcacccccagaaucucuuguccuuuccugagccuccugaggguacagugcugcacaggguccuaaaaguccucgacaggaggaccagucuccagaagcccugaggccucaggugaggccacuucugugggccuggggaccugggcuguccggcugguucugcacagccucagcuuuaguuuccuggucucgagucccuaaggcaucucugugcgcuggcucagagucuacccuccuggccccagaagaacucagcaagauccaugagcuccguacucaccguugagugccgggggaguacuaggggacccuaauggggacgagucgucugaaucuagguaccacguggcuucauccaugcgggaccgucuccuggaaagggaacaugcuugugagucuuagggcucuaaagaguagaacgccagggguguggggugcugagguacuuaccucccguucugggccuccccaggcuugggggagcugggaccccaggcccagcaagcacgccucucuccauugcuugaaucuucaagacgucugggggacuggcgaccccaagucuggccugauucuguagguuccacuguaagggaacaccacaggucagaguccauccuuauccuacauccuaacagcuaggaugggugggugggcugggcuuaggugggacuagguccugggcuagcaaugagaaugucugaauuugugcucugucacuuauuggccauguggcaaauuauucuuuuugcauuccucaccgacuaguaaugcacuagaauuauugaguuaauauuugcaaagcauucaggaaaauaaagaauauaugaccaagugcagugccacaggccuuuaauccuggcacuuagguagaucccugaguuccaagcuggccaaggcuacaaagaaacgaccccccccccaaagcgugauaugauacaauuacuugaggggggguaguuuuuggagggaacuuaaagguaaaagucuagagaaaggggagggaagccuggaagcaguauagugaggaaacaguagaaaguaacggguauggucaaaaggccgauccaucucuggacaucaggggaaguuuggggguuguggggaaggcaaggcugaccaaguuucuuacacuggauggcucggaaucuagggaaggugggcgaguccccagccccaaccucgaacacguuucuccuccgauccaggccaggagaggcuugcacugugaugcgguguuugaaaucugggguuugggaaaggaaagguuuugaaggccacacucaaaaccgcagggaugcuuaggaggcccccaggccucucccacaguggcaacaauagcuguguggcugggggugcuucaauacauuccugucucaaggcuuugagugguuggcacccagcaccagcacaaucugguagagaaauaaguuuacugugugggcaggccggccccacccucuuguccucagaacucuuccgugcaccacugacagcccgacaugcaaauaucugucagggccggcucagagacagaaaagaaaaucccaaccccaaaauaagccccuccuuauuccagcuggucaaggcaccaaaaggcuaaaccagaacucaagcgugaucacacacccuggcgccaacagccaauggcagagaggcgucggagccccgccccuuacccaggggcaugcugaugcguucuccgccgucccuugcucggaguuugcuccgcuugaaggugccccggcggcggcgcacgugcggccguucucgguccaccugcugcaguagcagcgucagcucgcgcucgaacaccuccagcucccacugcgccagcaggugcucgcgccgucgcagcugcuccgccugggaccgcugcucacgugcagcgcgcgucaguuccuccucccggcucaguaguuccuauguucgggaagagugaagaagguugaguuagcuaggcauugacccagaccucccaccuuauucucuaccccaccuuuugucccccauucuucucaccuuuuccuuggcccgcagcucaucaaacaggcccuggaucucgcguuuccagccuuccugcauggaauggaaggagucccguggcaucucccgcagcaccugcgcuucuagagcuuccaacugcugcaggauggaggcgaagucgggccugcgguggggguccugugcccagcagucuaaugggggaggguaagaggucugugagcauuugugucugggcccaggaguucugccccucaccuccccagccccauccucuuaccagccaugaguugugcaaagggcucagggcagguagaugggauggguaacguuaacuuguuuacagccacaccauaggcuacggcaagacagucgaugccacgguagggcaccuccccagucagcaguucccacagcagcacuccaaagcug

SEQ ID NO: 9084 - RNA, 2737 nt, Mus musculus
gugcaugcuaagcagcccauuuaauuuuuaaaauuaacauuaucccaugacauauucauucccauaaccccuuccugcuauguucuucaagcacuccuuggugccucccgcucaggucccccaacacgaucgagcugacuuccugucgccugacuggggucagcaggcuggggucuguucugauguucugauacugaggcuggggugguuggucccaagacuggggcgucaggcagcacagugcucagagccagcucaucuuggccuaggaugccaucuugaucuucaucgguucuagagccacugggcccaaagaauuucaccauggcacggaccugaggcagcucugagaaggucucuacugcuaacaacauggccaggagccccaggagcaaguaaccuggggagaagaggcaguaggggcagcucuuagggugcucagaauacccccccccccacuucccagugugaccauccacccuggcacuacuugaaacucucaacauggcucccaguguucuuuaaacuacaacacccauuuugugcccuaggguaggaucucugugaauuguagucccuaguggucuaugggaguuguaguccagacccucucuacccuccucuuuucuggacucaccaagaagugcaaacugcccaaggugguaaauggcugggugcaggccacguccaugggcaggcagcaagucuccuaggccgaucgugcugagugagccgaaacagaaguagauggcuucuagcaggcugcagucacccuguacaccccacagcaccagugcuggcagcagcaugaagacacaggccaccaggaggcccaguccugcugccuguagcagagcagccugagcuggugccagcugccagcgaauggcuacccagucaccugggcgacugaacacaggcagcaagcaguggcgcagggcagccacaagugcuagagaggcuggcagcccaagggcugcauagaccacacagaaggccuuuccaccugaggagaguggggccauguggccauaaccuggaaaagagagagaagagggcagcaagcuuuugagugggcugccccuggcggucacuuuuucuccaucaccucccacagaagucugccuuuuggugaugacaugaaugcuucaggcugggguccucuuuucacuggaugguggacuggcuucuuaaccucacuggguuacuguugucuuuucuggaaaauuaauucugaagacagaugcccuaggcugucuguagcuggaacaauuuaaagcugauucuggcuuugagagacccuuccucuuuaucuguacuucagauggagaccagggagccccaugccuucuaggcaagcgcuccacaacuaaugucuccccagccagauccugacuuccuggguuugucaguucuuauuuuuaccauuauuuccaaaucuucaaccuguggcaugccauccgccuucuuuccccaaauguguaucugcccgggcucuggguuaugggagggaagcaggcaagggaacaagacguucugaaaagaggcagcaugcacgagagacagcauuuagagccagagaagcagggagcaagaaagggagagguaggagacuggggcaugcugggagaacaagaucagcaggguccauggguuacaaaggccaaagcuccuaggagucagcugugagguaagaguguagugaagacugggugggccagcggccauguggucuagaggcaggcuccauccugcuccagccaauuggaaaggaaguuagagauacauauuucacuuugaaaaguauuuagacuauuagcaggacaaugaaacaaaaccaacccccuaggacuaguucugugccuaagcacaucuguucucuuagccaggaauuucgcuaacccgaccuacuucugcacccuguucacugggcucugagcacaucaucaccacuuccuccccucagacuuccucgagggcggcucuaagcugugcuuccuacagcaucucucuagccaagagucuaucccacccagauguauucucugucuggcuucaggccuaugugacccggguuucucugcuggaugcagagugcugaggggcggggcuggggaggccacaccccuccuggcagcuuaaguggaggcaccaguugggguguguuguguggggagccccacuugugaugucaggucugauagagccguggcuuugucuggagcuuuggggugggggaagggcuugcacccuagagcucuuggguccuccuccugguuugcuuggugguaguggugguagugccuaccggugguggugaggaugcuggcagugaacagcagagcugagggcagaucccaguugcuugucucugagcuguugcccaggcuggaaacuccaugggccugugcucucaggaccgcaccuagcagcuccuccagggccucagguggcaagcaggcccugugcucugccuggaagcuagccaguucagccuggaccugggccuggagguggcgagcuggagggcccuccagggccugaagcaccacagccccaaggcccauggccagcaggugggccauaagcaggagcagguaucgggcccaugguuucagacuccccauagcauggcacugagucugggaaggugagggaguaggcuaagccaccaguggcaccagggaggggcugcgaagggcguggcggggaggaggugcugcguggguaggcggcu

SEQ ID NO: 9085 - RNA, 4467 nt, Mus musculus
ccuccauggccuccagcuuccugcccugcuugaguuccugcuuuugaugaacauguuauauggaaccaugagugaaacaaaccuuuucuuuucuuuucuuuucuuuuuuuuuggcuuuucgagacaggguuucucuguguagcccuggcuguccuggaacucgcucuguagaccaggcuggccucgaacucagaaauucgccugcuucugccucccaagugcugggauuaaaggcaugagccaccaugcccggcgaaacaaaccuuuuccuccccaaguuauuuuuggucaugguguuaaucccagcuauacuaguccuaacuaagacagcaggcuuacaucaguucuaggcauugguagaagguggacagaggacacccaacacgcaaacagggaggaguguugaaauaggcagaaaacgaccucaguguagcuagccuaguuugaaagauuuagagaacuuuuuauugcagugacuguugggcagaugucaugguccugcccaucuccugcuuccccuguguggaaagacaacccugagggaaucggguauuucacagaccuaagggccacuuuaucugaggcaaguagaaauggagacucugaaaagccacacccgaguacugaagcguuaccagggagacggugguacccaaccauagcucuggccaccagccgagcccguaggucagggucaaaugugcagcagacacgcccccccuuugacuaaagcgccaggaagaccguguaagcgucacuuccgcccucagcuaccacaugugggaggcggggccguagugggggcgcaucuuauuuggaucacuuccggugagcccagcagugaccacggcaacauggccuugaacggugcagguaugcgcuugggauguuugggcaguggccguggggugcgggaggcagcucucucuaucuccugugccuguuuucucuagaugucgacgauuucaccugggagccuccgacugaagcugagacgaaggugcugcaggcgcgacgggagcggcaggaucgcaucucccgucugaugggggacuaccugcuccgugguuaccgcaugcugggcgacacgugcgccgacugcggggugaggcgagugaugaggccgaggccgcggaccgggccgcacgaccuuuccucagcucccucuucugugaacccugucucuccggcucaccuauguccauguacuuucugguccccagacgauccuccugcaagauaaacagcggaaaaucuacuguguggcuugucaggagcucgacucagacguggauaaagauaacccgggugaggguccgagugugcacuguggggagaagagaguggcgauagcuacagaggaacugugagccugggaggugacaguggaaacuccugcgugcuguggcauuaaggugccuucucguuuccgcccuagagagguguuucauucaagaaagaccaucagccuuuuguuucugacaccguggggagaguccuagcaaaauagucauccuacguuguagagugcacgugcaacccugggugcuugugcauguuggacaggcauuuuaccacugaagggcgggcaucccaguuuacaggaauagacuugaugcauagaugaggccaggccaucugucaagcaacuggaccucaaguguaaaucaguggggcaguguuuggcaagcauguguaaggagaaagaagaguagagaugagaugggauuggcuuaggcagaaaacaccagcagcucagggacaucaguaaagagcacaugacucgggagaggcggacggggcacccucacucuuccaccacuuuucuuguucuagcacugaaugcacaggcggcgcucucucaagcucgggaacaccagcuggccucaucuacagagccugccucgagcucucggcccccaucccagccaccaguaccccguccagagcacugugaaggcgcagcagccgggcucaaggcagcccaggcgccuccucuuccggcugcaccuccaaauacggacgcgguggcuuccacacagacggcccuccugcagaagcuaaccugggcgucagucgagcugggcucuagcaccuccuuggagacuaguauccagcucugugggcuuauccgggcuugcgccgaggcccuaggcagccugaaacagcuggaucacugagaccucuauccugaucccuguuccccugagaaaaacccuccagaaaaacaguuuuuccuccgcgugguuuguucuuucuugguucugagugugcaugugagccccaguucuccucgaugguuuuccuugcuuuuggcaucucaccuuuccauggucuuuucuaccugaauggugaaguucugcauucaggacaagaaguaaauggcagagggauaagugacaccuuauuccaaggacugaccucagucuucccaaaggcugggccacuaaucauugucucugacccaguacccccuuuccuccacuugagugccauuugaaguuucagucccuuugguggcuuccuuuccuuccuuuaaccauccugacucuaccaucuuucuccaucuucuggcugcuaggauguugacaaauuguggggaggggcagugaugcacuguaagagucaggcacagucuuaccuuccuaccccagacucgggccucccacauccccgugcuuuuagaauccuucccuugggagaggacacauuguauaggaaugaggcagcaaaaggucgccaaaaaaccguuucugacccuuucggccuccccugucccauccaguucuuugauggguuuuucgcuccagggucaucgccgcguuaagagaggccccgcccaugcagggggguggagcauaggcggaguccuaggagucggggacggaacaaagcacggccugcgggcgguggcugagaucucuccggagaccgggccacggagagcugguucucugggcaacagcccgcugaaaacguaagagggguccaggcggcaucgugguccacgccugccuggcuaugaacgggcugcccgcgacugaggcgccgggcggcgcgggcugcgcucuggccgggcucccgccgcuaccgcgcggccucagcggccuucuuaacgcuagugggggcucguggagggagcuggagcgugucuacagccaacggagccgcauccacgacgaacugagucgugccgcccgcgccccggaugguccucgccaugccgcuggaucugcuaacucagguucugcagcgggcccgcgccgcccgguuaaccucgacucugcacuagccgcgcugcgcaaggagauggugaguaggugggcgccucgccaggguaguagcucugaagagggcagaaauaagucugggauccgcuuccucaucucagguccagcaggaagcaucuggucacggggcuuuaggacagcacugauaguaauguguagcaauuguugcauuuuuaaaaacuugccugauuucaucuugcuggacaauguuaccccauuguauaaaugagggccaaggacuggcuggaagguuucacaguuggcaaguaccaucuguucucagaacuuucacuuaaaggugcaggaagauuggauaggguugucguccacggugggaauucuggggguggcccggacccccaacuccagcccacugucaguugucuguagguggggcugcgacagcuggauaugucccuguugugccagcuguggggccuguacgagucgauccaggacuacaagcaucugugccaagaccugagcuugugccaggaccugucauccucucugcacucggacagcuccuacccaccugaugccggccugucugaugacgaggagccuccugaugccagccugcccccagacccuccaccccucaccguaccccagacucacaaugcccgugaccagugguugcaggaugcuuuccaaaucagccuuugaaagcugagguggauaggaacgcacccauacaaaaggcucaaaacuugcccuucagcaaguccuuagucuacagugccugcucuuuuaccgguaccaccucaccucacuucaggagggcaaggcauuauacccaucaggcaaagcggucaagauugcagccugugcccaguguccugggcuuccacuucucccacaugugugcacccuagcuuggccagcccuuagucugacuguggggcccaaagcgucuugcacucccguuugcaucucugggacugggaugagugccuagcucucaucucuuuuucgucuuuugcugccucuugcagcugcuggcucagcggcaucccuaccaguggccccagggguucauugccugggacaagggcuccagaacccaccucuguagccacccacgaccagaaaggcuaaggucuuuaugcuggauauuuaaguuuagcggccaguuccugggcgggaaaauaaauaauuucagcauuguauugug

SEQ ID NO: 9086 - RNA, 17795 nt, Mus musculus
cacuggauccuggggcuuccuagcacguucucacaguauuguccagauccgggacaccacagccuccccuuucagaccagugaguaagucuagcucuucuacagccuugagcaaauucaagacccuuccccaccccccugucaaccccugccccagggcccugcugggcuucuccccagcccccugagcacucaaguagcacucccuucuccggcuguuagccugggaagggggccaggcccugagcucagaccuuggcgauuccagagugucugaggcccagagccagcgccgccagccaggccagacgaggggaaggggggagguggcagggugggcaccaggaagcccucuaaggagcgggggggggggggggaacauuggcagggaagccagguuucuagcuuuguucuuucugcucuucuucuugaggccacaggguucuccccggccaguaaacccuggccagaaggugcucucuccugcuuaaauccuuuccuucgagagaagacaggaccaggaauaaggacccaugacuucagggcuucgagaaccccuacauguacaaaggccaaugggcaaaaguuaacagaccucugauccuccaagcaaggaccaucugccucgguuuccccauuuugaccagguggaaaaguaguugggcgggggaggugugcacaggccucugcaccccgcccggaggaaucuggcggaguccccaggugaggauucuucuggaaagaacccaggucgguuccugcgcggggcgggcaccuagggggcugcccccacuccaaccggcgcccucccugccgcacaucgucgcuucuccgggcagcagcgaaagacgcuugaaccagaaggaaaaagagagaggagaaaaaaaaauugucucccuggccccgggccagcgucccagccccccucgccgccggcgcgcuccagccagggaaaacaacugcucacuucucccugcguccuccccgcgcgcucccugcuucccggcggccgcgggagaggagcccggccagggggaggcgcggagcgggcuggccgcccggccuuccucuccccucgcuccuccucuccgccuccacuugcuccggccuccucgcugcggccucaguucggggccuggcuggguuucucccggccagggaaguuucuucgcucuacccucagugcagcuuccaucgcucucccucgcaacggggaucccggccgcuccugcuguccccucccuacccuuggcuucucgccccgcucugcccucugcuaccaacacucgauccccugcucgggcucgaccuccaaucuccgagggucgugcggccccggaugcccgggccccgaggggcugcccacggccuggccccugcgaugcgccaggccggggcauuggggcugcuggcacuacuccugcuggcgcugcugggccccggcggcggggccgagggugggccggccggcgagcggggcacaggcgggggcggggcgcuggcccgcgaacgcuucaagguggucuuugcgccagugaucugcaagcggaccugucugaagggccagugucgggacagcugucagcagggcuccaacaugacgcucaucggagagaacggccacagcaccgacacgcucaccgguucuggcuuccgcgugggugagggccagggggcucuggcuggggacauaaggaagggcaggcaacagcaccaggcaggaaacagaguggagcauuggggauaagagauggggagcugggauacaucgaucgcggaucuggggccagggcucugagaggcugcgguccauggaagacagagugaggugcugggcuuuuaaguauuggauaaggguugaggcuuaagcucgggucucggaugacacagaacuccugggaggugcucaguuugaagagggagcguacaagggguuggagagaugagagcaaggguaggaauucacgcagaaggggguaaauauuucaccccccaaacagaaaucuuucaacugucucaaguuuggccugguggaaggagacaccuguguucucaggaaggcggagcuaggaucaggacuggaaugagggacuuagcucuuggcaaaaucugaggggaaaaggcuuugaggccuaagaaguaggguacuaaauaauggcacugaccugauggggggagagagaggugucauuugggguccucaaacagcuagucuguuaccuauauaacucauccguuccuauauaacucauccguuccuauauaacucaucugaaagacccucagagcugccuccacuccaagucugagggccuccuggucaaccuagagcccaccucuuccuuuagccucucucuaaagagaaggccuggugcucaagacuccuccccuggggcccugugggcuaggcuggggggaggugucccagugguaauuacccuccuggacaggguaauuaggccgugcccaggaugguaccaggaaaacagccccucucacacauucuuauguucacucacagcuucggacucaaggagucccacugugugcuucccaguucucaugaggacucuguguguguguguguguguguguguguguguguguguauguguaugcacacauguguauacacacgcacaggcuuuggcauggcacgaugugaucacuucguguucugugugucuacagucacugucugggaguguuuacacaaugagcccguaguauuugugucagaaggagucuguguaggacaggaugacugugcaugugagcguaugcaugcccagccucucgggcccccugcagggccauccugugcaggcugccgucucugucuaugcugcccacaucccccaggcucagugcccgggccacagugggaggaugucacugagaggucacacucucaccaccaugggugacucacuggaaagcaggaagaagaggauucugcccccucuggcccaggacacaccucuguugcccuugaggccuggucuccagagacuagacaggaugggauaggcuaguaugggaugcucuuagcccacccugaugaucaggaaugaguuagggcugcccugugaguguucaggaaaacaacacagccaccuuuccuccccagaaugccgaggaguggccuuagagcaggcaggcaggcaggagaggagcugcgguugggacucagggaccuccuuuggaacacagugcugaggaccaccaggcuuugcccuccaaaaugccuuucauagugguaaaggcaaauaugacuacaacucgggaaagugccagccaggcuaggcagaggguagagaaugggaaaaccuuuccuuucugggagagacacggcccagaaucagaucaggacaugaagcaacuggcaaggagucaggaauauagggacagauaggcuauaaccaugagaacacuggcacacugguaaaggguggauagguagguccuaggcagggguguacaggggcugaacagagggaguuggagucaaagaagguucuggaacauggccucaaacguaagacagggaguagaaaaguaagaugagugaagggggaaggggucuucucugcuagaacuuugccugagacacacacacagugagcuccaggacagacacacaggccugugaagcaaggccuggggcacagggagccgccugcugaugcccacagucauccagguguuuguaagauugguggcuggggaaaagucagaaaaucuccccagcacccacagcccagccaauccggagucgcugaaccugcccccgacucuuuccuugucccccuccuguacccaugucuugagaauagacaugguuuagaucuggaaauccccuacuccccacugcuccuuuauuuaauuaugcugggauuguggacaggugggcaaagacccugaggaggaccagagauaggcuuaggggacacuguagaggcugcaauugggacgcuagagucuguuacauguggcugaacagacaagaauucccagggguacucccagggagacagaggucugucaguauccuggaccagguccuggugagguuagacauggcaugucgcuggcagcuauaugagcugagguagguagcaagauggagggaggagaugaggaugagcuaggggagaaacuugagaccugagcuaaggggagagcuuugguugucacuucugcacacucuguuccacacuggaguaagagucuguauagacagugcucacucgugggaacauuaccaccggagaugaggcccagacgcaagggccagggaaauaaggccucagagagaagggcauguggccaggaguuaagccuggaacuuuagacuccacaaguccuggagagaaaaguuucggggaccuacagaaggccauuuucaugugugggaccuguugucagucagguucccaauaagagcagagcuaaugggaaguccacacagugagcccaggaugugggugaggauggccugaagagaaaccaggcccugaccccugucuccuccucaguggugugcccucuacccugcaugaacgguggccagugcucuucccgaaaccagugccugugucccccggauuucacggggcgcuucugccaggugccugcugcaggaaccggagcuggcaccgggaguucaggccccggccuggcccggaccggggccauguccacaggcccgcugccgccccuugccccagaaggagagucuguggcuagcaaacacgccauuuacgcggugcaggugaucgcagauccucccgggccgggggaggguccuccugcacaacaugcagccuucuuggugccccuggggccaggacaaaucucggcagaagguacuaggagacgggcaacccgggggugcuuaaacgggcgggcaauaaggguggucggauuaaggcgcgggccaggccccggaggagcucagcgccgcgacccuccaggagcgggacagcccugaggccaccgcgccccgccccccagugcaggcuccgccccccguggugaacgugcguguccaucacccuccugaagcuuccguucaggugcaccgcaucgaggggccgaacgcugaaggcccagccucuucccagcacuugcugccgcaucccaagccccagcacccgaggccacccacccaaaagccacugggccgcugcuuccaggacacauugcccaagcagccugugagugaaaccgcaauuccaaaagaacagucauucuauuucagggucaccugagucacaucauggccgcauacaauugagugucacagguuguggcuggaaaaaggagagaggccucuggagggaggccagugggggcggggcacucggugauuccucuccacaucccuuccucuaguguggcagcaacccuuugccuggccuuaccaagcaggaagauugcugcgguagcaucgguacugccuggggacaaagcaagugucacaagugcccacagcuucagugugagugccuggcuuagugugguaucccccacugggugacugauccagcuaucuuucucccaucccugcugugggaauuucaccccacccccacacacaucaaugcaggcuccacccccaaauuugguggggaaccuaucaaauccucucucuccuccccagagcccucacuucucuccugcagaacuccaguguuuccccccaucuuguugcuauugcgucuguccuuucucugcagauacaggggugcagaagccuggaccuguacguggggaggugggugcugacugcccccagggcuacaagaggcucaacagcacccacugccaggguauggucagcuggagagucuguggacuguagggugggccagaggucaugggugugucccaaggugggagagaaagggucugaggaaggcagaacccucaaguguguggagcagcuugcugccauguuauggccccagcuaugagaaucaaacuguuuaucacagauaucaacgaaugugcgaugccuggcaugugucgccauggugacugccucaacaacccuggcucuuaucgcugugucugcccgcccggucauagcuugggucccucgcgcacacagugcauuggugagacuuggggacuccugguccuguggauucacaaggcuggaugggaggggcagagcuucaagcacagucaagaggucacaagaggucagggcagguuaagggcggcuagcagaaaggacaagacccagagcagagagaaucggugaugagucacaugaccugagaucagaggucauagaggucagaggaagucaggguuuggugagaagagcaaauucagagcgacucuaaucaggagucaguggucacagagguuucagcgagucccaugggacagggccacauagagaucaaaaggcugacagaacagagaagcagugucagaagcaacugggcagagggacauagcaaugcucagguccugcccuccacucccaccccugcagccgacaaaccagaggagaagagccuguguuuccgccuugugagcaccgaacaccagugccagcacccucugaccacacgccuaacccgccagcucugcugcuguaguguggguaaagccuggggugcccggugccagcgcugcccggcagaugguacaggugaggcagaggcacaucguggaugauguagggaugggacggcaagcuguguacccguccaggaguucacuuguuguggugucugcaucuugaccacagcagccuucaaggagaucugcccggcugggaaaggguaccauauccucaccucccaccagacgcucaccauccagggggaaagcgacuucucccucuuccugcaccccgacgggccacccaaaccccagcagcuuccugaaagccccagccgagcaccaccccucgaggacacagaggaagagagaggucuggcuugauccaauaauuccagauccacagauaaaacucaggggcuagccgggcgugguggcgcacgccuuuaaucccagcacuugggaggcagaggcaggcggauuucugaguucgaggccagccuggucuacagagugaguuccaggacagccagggcuacacagagaaacccugucuugaaaaaaaagacucaugggcuaaggcagugguuugaaaccuguagguuggaaccccugggggcagggggugucacauaucagauauccugccuaucagauauuuacauuaggacucagaacaguagcaaaauuacaguuaugaaguagcaauuagaugauuuuauggcuggggagucaucacaacaugaggaacuguagaaaagggguggcacugggaagguugagaaccacugcucuaacauguaaaucccuagccugaacacugacacccuccaccccaggccuuauuuauucccuugcccucaccuuaccugaccugagcugucgccuccuaggcuggcacuguacagaucgagcuuaacugcugcacucuaggcaauggcuacuacgcaaaugacccuaaucccaggaucugagcuuugagccuugaugcaaaggccugccuuuugaacgcugagaccuacccuaccuauauacaccuugauccuugaccuccuguucugacauaaauaauauuccaccuucucuuuuaggagugaccauggauccagugaguaugggagcccagguggagggguggggagacagaggaaccaaggagggcuuacguuacuguaaccauagccagugagugaggagcgaucggugcagcagagccaccccacuaccaccaccucacccccccggccuuacccaggugagugaggcacugcgggggggggggggcuaaaccacugggacguaugugcuuguggagugucaguguuuggguguagccugcggagguaggagccuugcucucugaaaagccccugcuucugccugcagagcucaucucucgccccuccccaccuaccuuccaccgguuccugccagacuugcccccaucccgaagugcaguggagaucgcccccacucaggucacagguaaggccugccaucagggccacagccuggauaggccgcacauccagcuugguuuuccuccuuccaacacuccguaggcuagcgagcgggcuagcacuugcccagaacuuggagccagggaagguccagugagcaggagaggugucgcuguacuuuuccagcggccuguugguaugauggccagcucaaucugagagucuucaucagucaacuuguacuuauugagcaccuacuaugugccccccaaauaaaccccaaccaaagcaaacagaucaagccaggugugguggcucacaccuguaaucucaauacucaggaagugaaggcagaaggauugccuagaguucaagaucagccugggcuauaguaugagacccacaaaauagagcaauaauuaaagccuagcaugucucauaaaugcuacaaaaagauaagucaggaagacgggaagucugaagauuguaauaguagguaacaaugagagguugugggguguguguguguguguguguguguguguguguguauguguguauguagggcuuaaaagauugcuagacauucaagagaaguagggaggggagggacaugcagagucagaagaagaacauuccagggagguuaaaucugggcaaagguguaggaaguaugaaucauugguggaggagggagaaaccacagagaagcagggggagccagcucauggggccgccauuacaggcucgggguucgugccaaaggguaugagaagcgucugcaaggacguaggcauaggaaugauugccagcacggacugaacugucucucugccaggcucuaugugaagaacuucacagacagcaucagccugcucucuuacucugaaggggaaaugcuugccucauuuuccagaugaaaaaggcccagguucagagagguuuagcaguuugucccaggucacagagaagcuagauggagccuaugucauagggacuccaaggccacaacuauugacccugacugaaacccugagccuagaugagcuuaugagaugaggggcucagguggaaggugacuaccccuggggauuguggaaauguggaggacaaggugacugggaggggagcgagaaagccuauggacaggugcaaggcagagagcagccugcaagggcccgcuggccagguguauuccggcagagcugaguuuagcaucacccugggcuucgugaaagagguggggaucaaaagggagaggaggaaguggagcuuauaaacccgagggcgagcagagccccccaucugagcaucuggacacagcuguguuccuaggacugacuggaaucugucuugggagggcagacaaucgaccauuuggguggaaaauggaggacccacguccuuggagcaagggguguugaugucacuggcuagaagauaauagaaaaccugaagcugcaggguuuaaacuauugaggggacugggaagaacauugucucagagacucuugcaaaagaguauuaagaacauaggacagcugggcgugguggcacacaccuuuagucccagcacucaggaggcagaggcagguggauuucuuaguucgaggccagccuggucuacaaagugaguuccaggacagccagggcuacacagagaaacccugucucgaaaaaaacaaaaagaacauagggcacuucgcuguugugguuugauuugaggugacaggggucaggcucuuagaauccuaggcaggcaugaaaguaaggaagguggcagggauggcaaggacaccggaguccuguuuggagacuuucuggaacauugguguuaguauuacuugagauaaaguuuaggaaauccuaggauuuaaauacccgugugcagaagccagagggcucuccgggucaguaggguuggcgugucagucucugccucugggguguggcagaaaacaccuauucccugaucagcccuugacccaauccccucaugccacagagaccgaugagugccgauugaaccagaauaucuguggccauggacagugugugccuggccccucggauuacuccugccacugcaacgcuggcuaccggucacacccgcagcaccgcuacuguguuggugagcagggguguguggacagggguuggcuggggaggagccgccgcaggggcucacaacucgccuuugaugucuccuugcaugcugauccuuccagaugugaacgagugcgaggcagagcccugcggccccgggaaaggcaucuguaugaacacugguggcuccuacaauugucacugcaaccgaggcuaccgccuccacgugggugcagggggccgcucgugcgugggugagcgcaaccagcuccuggcuaacccggguauacugggugggaccagcuccuacugcccgccccacgccccaucgcacccugucuuugcucagaccugaacgagugcaccaagccucaccuguguggggacgguggcuucugcaucaacuucccuggucacuacaaaugcaacugcuauccuggcuaccggcucaaggccucccgaccgcccauuugcgaagguggguuacccuccagaccaaagcgggcaucauaaccgucccucgacuuaggauggaagcaagaggccugcacccaucucugauccucucaggcuggggucagggaagcuaaaacugguccguuuugccuggauuugugauggagggaggcccugucggggacuaugagcaucggaccagcuauguugaccccagacauguucucuuccuuuucccuuccaugcagacaucgacgagugucgcgacccuagcaccugcccugauggcaaaugugaaaacaaaccuggcagcuucaagugcaucgccugccagccuggcuaccguagccaggggggcggggccugucguggugagggcggaucugguuccacuuggggggggggggcgggccuccagagaauagaguucccgccccuagcccuuggaggguuggcucacccaggcaguuugucaguagggcacaguacuagcacuagcguucuucccugcagaugucaacgaaugcuccgaggguacccccugcucuccuggauggugugagaaccuuccggguucuuaccguugcacgugugcccagggauacgaacccgcacaggacggccucaguugcauaggugagcuccugcaugcugggcagaccagauacucucauucacggagguuagagagugggucacccuguaaaacuagugguuggugggggacucauucugcagucuuacuaaggcuauguuuucagcgaagcagcuagaccuuggaaaguagauucuuuuuaaguguguggauguuuugccugauugcaugcauguguaccacguacauaccuaguaucuuuagaaaccaaaaauggggggaagggugugggggacuuuugggauagcccuggagaugugaaugaagaaaguaccuaauaaaaaaaaugcaaaaaagaaaaaaaagaaaccaaaaaaggagaccagauauucuggaacugggguugcugaccucagugaacucccaaguggguguguccuguguaagagcaguaaaugcccuuaacuauugaaccaacuccugucucuuaagagaugacacuugaaacuuuaguuugagaagcuuaauaauuugaaggaaaagaagaugucagacugggggacucauuaguccucuuccuuguggcaauguuuaaguaccaaaaacuagacuagagacuagaauucagacaaacuaggaaacuuggcaaacuugucaacuagcagagacagaggccugaaggacagaggcuuccguuucucuaaaggacaguaggaguuagcuaagcaaagaagaacagagagcagcaggcuuuguggaugagugggaugagggcagugggcugggcuggccaugagaugcccugauauuagaauaaguuguuugggugucaaggucagggaaagaggggagggagucugguuuggugacuccgugcauggugcuguucauugggauaggucccugggauugggccccuuuaaaggggagguuggggggcuauccauguuagauaagcucaguaggguggcccauuugggucucucagucagaaaugccagaagcugaaaaugcagguuaggcgucuugaaccagacaugucccuauggagcuauggucuguggacuaugggggcuauggugaauugagccuucguacccaaggagacagaguuggauagaagagcaucuagcagagccuuuugguaccaacacuaggggaggcaggcuagaugaaagggcaucaggagaugggggaagaggcaugguagggcugauggaagguggcugggcuuuccgagcagcaccugagaagcuaaaggacccuaagcagcaugggaagagagggucccucuuguuuggugaguguggaugaagagugggaagacaugagcucuuauagcaucaaguaucgccacggacucuugggaacacuugacuuggccacccaugcaugguuuuuaugugggagcaggguggaaguccccugggccucagcuuugcgcuccagacaaaugggcagcagugggaggagaguaaccgaagccugagcccacggagccugcuccccugacgcuccucugugccccgcagacguggaugagugugaggcugggaaagugugccaagauggcaucugcacgaacacaccaggcucuuuccagugucagugccucuccggcuaucaucugucaagggaucggagccgcugugagggugagggguccuaagccggggcgcuggccuguucuucccuaccccgggaucucuacugcccagcuccaaggccauccagaucccaguugugauuugagggucugggagugacccaggguucuccaguguauggagucaacccaugaaauuauccaaaccauaaucucccacagacauugaugaaugugacuucccugcggccugcaucgggggugacugcaucaauaccaaugguuccuacagaugucucuguccccagggucaucgguuggugggcgguaggaagugccaagguaugagaaguuggccagggauucugaaaggagaggcagggcagugugaucuauuugacacacuguagcucuucucuaccuauuugacacacuguaguucuucucuauuugacacacuguagcucuucucuauuugacacacuguagcucuucucuaucuauuugacacacuguagcuuuucuguagucuuuguauccauccauuccccaucaauccaucuaacccauucaccaauguauuuguucucuaacaagggucgcccugcuggcugcaguguuucuaugucgcuuauuuuuccuuuuuuauuuuuuauuuauuuuuguuuuuuugauacaggguuucucuguauagcccuggcuguccuggaagucacuuuguagaccaggcugaccuugaacucagaaauccgccugccucugccucccgagugcugggauuaaaggcgugugccaccacugccuggcugaaaaauccuuuuugugcauguauguuugccugaaucaugucugaacuacauuuauacaucccuguggaggccagaagagggcauuggagcuacagaugguugugaguggacaugugggugcugggucaucuggaagagcagccaguguucacaagggcagagccaucucuccagccccucuggucagccucuuacagauaugauagucugaccuaucaaccaacugaccucuauguaccuucacugucaugugauaccugcacagcccuguuugccaagugguguacuagguauuucagcaaugaacugggccuucuacauuggagggggacaugaaaaugagccucagguucagggugaggguacccagaagcuaauuaaagggagaugacuguagaguggagauuaaaaacauaaggagccuuuuagcaggggcucuggggagggaagggaucccucugagugggaaggggucucucuggguaggaaggggucucuaaguggggcucugggugggaagggucucucagcagaggcucugggugggaagaaucucucugcagugucaugaacagcaguugcaauguacucagugugucuuuuagagggguagggacaacucuaccuuaagcaaaaauuugggaggagugaaagagugcagagccaaguuugauggcacguaccugccaucccagcugcauaggaggcugaggcaggaggauaucaagcaacugacuauccgucgaggaauagcaagggaaagggagcgggagaugagcaggaaggucuccaugucagcugagggucaggagcucauuccagugacccaggcugacagcagugucacaaaccuacccacacagacagacaaacaggcccaaggggacuucuauuguaugcccuuugaaaccaaagcagaaacucagguucugagccuguguaagguguuugggcacaccccagggaaagggggcuguguuucuccgcagcggagguuguucuugcuuccuggucuccuugccucuccuagauauagaugagugcagccaggacccaggccugugccugccccacggggccugcgagaaccuccagggcuccuaugucugugucugugaugaggguuucacacucacccaggaccagcaugggugugagggugaguacccucucuucucucagacugguaacccuuggagcuacagcuggcugggacaugugucccaauuccaccuuuuggaauuucuggaacaggaagaaauccucuuugccugggaggaguggguggaguuagaccucuccccaggugacaaggagggcuagggcaggugaaggccagagugggugcaguuuugggguacagcagacagggccaaagcuacuaucuccaugaacuugaacuguccccuucuccagagguggagcagccccaccacaagaaggagugcuaccuuaacuucgaugacacaguguucugugacagcguauuggcuaccaaugucacucagcaggaaugcuguugcucucugggagcugguuggggagaccacugcgaaaucuaucccuguccagucuacagcucagguaagagggauauacccaccccuucccagagcucccuuuuggucaucuggaaaccaaagggcucugggugggugggagggaaaggagaaaguggauguguggcgagugcgugcucagcccugcuuuuccugcccucucacccugcagccgaauuucacagccuguguccugaugggaaaggcuacacucaggacaacaacauugugaacuauggcauuccugcccaccgugguaagcuccgaccugccgccuccuugcuucuuuccguuacaguuugguuuaguuuaagggugcugguugggucugccacuugcaggguaaacuccaccccuuacaacagcuugaccccaaggauccccaccgaaaacccagccuuggguucaacucucccaauaagccccgcccacaagucucagccaaggggcccaaagcuccaagugaagcccgaggccauugggcacucacauuucccuuggucacacagacaucgacgaaugcauauuguuuggggcagagaucugcaaggagggcaagugugugaacacgcagcccggcuacgagugcuacugcaagcagggcuucuacuacgauggcaaccugcuggagugcgugggugagcccagcuacagugcuucccgggaaagcagccuaauccaggcccguuccugucaccagcccuucuuucucuccccagacguggaugagugcuuggaugagucuaacugcaggaacggagugugugagaacacacguggcggcuaccgcugugccugcacgccgccggcagaguacagucccgcacagcgccagugucugagcccggaggagaugggugaggcccggggaaacagugcggggggggggggggaagaagggaccagagcccaugcugaauugugauuaccaccuccaccaauccccucgaugucccauagacguggaugagugccaggauccggcugcuugccgcccuggccgcugcgucaaccucccgggcuccuaccgcugcgagugucacccgcccugggagcccgggcccuccggccgcgacugccagcuccccgagagccaggcgggugagggcgacauucguccugggccgauuuugaguucugucaggguggagcccccaggccacagccugcagccgggaugggacagcaguggguagucccugccucccuccuguugaugugggucauguuccacagagcacgccccagagagacgugaagugugcuggggccagcgaggagaggacggcauguguauggggccccuggcgggaccugcccucacuuuugaugacugcugcugccgccagggccgcggcugggguacccagugcagaccgugcccgccacguggcaccggugagcuaccccugagggacuagagguagggagaggcguacagcaguguugcuaacucuuguacccauuuccagggucccagugcccgacuucacagagugagagcaauucauucugggacacaagcccccugcuacuggggaagucuccgcgaggugaggccaagggggcaaagguguagauuaguggccaucagugggagcccauauugauaucuguauuccucuggcccacacagacgaagacagcucagaggaggauucagaugagugccguugugugagcggacgcugugugccacggccaggcggggcgguaugcgaguguccuggaggcuuucagcuggacgccucccgugcccgcugcgugggugagcaagacguuagggacugaagggcagagcccgcggggugcagauugcaccacagugggacuucacaagccugcaucuauuaugccaccuugcagacauugaugagugccgagaacugaaccagcggggacuacuguguaagagcgagcggugcgugaacaccaguggauccuuccgcugugucugcaaagcuggcuucacgcgcagccgcccucacggggccugcgugccucagcgccgccgcugaugaugcagccauagcccacaccucagugaucgaucaucgaggguauuuuccacugaaaguggagacagacaaguacauccuuugcuccugaccaaacgagagcauggacccaaggauccuucagggcccacaaaucuccuucccacaccccaacacccaagggugcuccugucugcagagugcugucugcuuuauccccaagggugauuccuagaaacuucgacaucagaucugccccuuuaauuuacucuuggcuuucaaggcaaauugauauucacauccaaagcgggcagcaucaacugcuuggcggguuggacugagcugggacccaggaugugaaauagaauuuauuguggcucugauuauguacacuagaugugccugaccugcugaccaggcucacaugguuuguacaauaaauacauccgccgggccugcucuccagugguuggaagcccaguggcuugggggugggguugucaguccagcuuccgggcucccagcuucaugggccccuugguggucuuuuucucugcccguuuggcuuccauuucucuucuccuuuccucucgcuuuuuccgggccagcucugccuuuaccugucc

SEQ ID NO: 9087 - RNA, 2641 nt, Mus musculus
accauuuuggucaaaguucuagcaaucugggaucaggagaaggcgggucaggguggagcacagcagucaagugcaggugcuaaaaucagacuccauuuagacaccggggcuaggucuacagaagugcacaggaggggcucagagcagccauccuugcuaugcuuucucugacugugaccuucaguacaauucuauuugugggggaaagguguugguguucuuuugcaacuacgcagccauggaacucacuaugugggccaggaggcucucaaauucagagaacuaccugaacuugcccccaaagugcuggaauuaaggguacaccaccacacuuggcucuuggguucaauuuacuagauuuguguaaacucaucaacauuuuuaucacaacagugucacagagcacgccagugacaaaggccaccaagcuguacacugacaaugugagagcaacaaguaaccacauauaagugcucugugggccacagagauggcucagccccaagaucgauaaccugauucaauuccuacuacccacacagugggaggagagaagagacaucggcaaguugcucuuugaccuccauuugugccucauggaacuagaacugcuccccucccccaagcaaauuuaaguuaaaaaaaaaaguauccugugacagaagugccuguuuuggaagggacagggccugcaggggcagggugagacauccagucgggucccguggucuggaugucggucaagguccucuaacugcacaggcuaacgcuacugaccacagacuuuacauacuugguuuuuucuuuguuuuuuguucuuguuuuguuuguuuguuugagacaggauuucucuguguagcccuggcuguccugaaacucacuuuguagaccaggcuguccucgaacucagaaauccgccugccucugucucccaagugcugggauuaaaggcgugugccaccacgccuggcuuguuuauuuuuugagacagagucucuuuacaugaacucagagaucuaccugccucugccuccugaguaccgggaugaaagacuugcacuaccacaccugacccggucacacaccaucucagggcacugacugauauggcucagcuggucaaagugcuggcugccaagcuugccaaccucagcucaauaauccccagagccgagugguagaaggagacccaauccaacaacacugcccucugccccuccccugcgccggcacacaugcacaaguguaagaaacauuucagucagguuagguuaagccacugguggaaaacggaauaagauaccuuauuguuguacaggaagaaaaucaagacgacuugggacaguugaauacucacacgaguaaccaggaaacuagagaagaguugagguaggagguaggaccgcccucaccauauagcaaagcuccaacugcagcacuuggccuggaacugacauagaaacccaccagccgcugccugguggcugugacauagaaacccaccagccgcugccugguggcugugacauagaaacauaccagcugcugccugguggcugugacuugaguuauguguagcaacaagaggcuuccuacccacacaucacuccuuacaaaguccagauagaaccaaaaaaaaaaaaaaaaaaaagcacgagauucaaaggauaguguugaauuagaccaagcuuucugagcucaucauaagaugcagaaaaaaauaccaauaaacaaguacaucuguauauuuaaaaugcucaacagcaaagugucauaaacuauaaaagucagagaggaccagaaguguuugcaacacaaaugguuacuuuccuuaauauguaaagaacacuuuaaaucaauaagcacaccaauuaaagcuacaauugagaauuacccuucaccucucacauugaugcaugcccaagguuagggacaaguacuggugaagguguggggaaggccaacuggaagcaccuuacagaaggcuuagcuggugcauccugugugcguccccaugcuucuccucgggcauacuugucucgacacaugaaaacacauguaaauagauauuuaagacuuaguaaaauacacucaguguugcuagaaacagcucaguuguucccccgagcaggacuggguagucuaaauguggcuacagcucuguuggcccaacagucccaagugcaagacaagguguggcaagucugcaugcuaccacaccaugcgcugucuggaaagcaagaggucaccuacacauuugcaguuuuaacaugaacaaguaucacuuuaaacauucuguguguauaaggggcaaaaucuggagggaacgcgcugugggguuacacagucagcagaggggacaguacacuggucaccagagugaaaggaagcccaacauaaccugcuguggaggaagaggcugccagacugaagcuggccccaccauccagugucugacucucugggacccugggaggcaaggacgagacagagggagcucacaccuguucccugggcacuugguggccuuagaggacagaguacccuuaaucuagagagugguguaggaguacugaaggaacaagcaagucugaauguagcuuucccaagcgucauaaccguccucaugaagguuuuuuua

SEQ ID NO: 9088 - RNA, 2738 nt, Mus musculus
acguguucugacagcaaccauagacuccucccagcuuggaaacacuggcaaguucagauguuggccugcuacaaaaagagaaugacguuuccaauccugacaauccugacaugugccauugaguuuaucuuaggaugucaagccaccagaaggaccuuuaaugugagcuuaugucugcauugcugagggccugugaaagcauuaaccgaggucauguccaugccuuaggugcuauugcugaagcaaguaauauaagggguuucugacaggcuaauauuuguauguccuucccaaaaucuggaugcaaauaggauugucaggaagagaacaaaaccaaaauaagguaucaggugggauccugagaccuucugggacaggaugcccuccucgcaccugugcuaggcugcugaaggcaacugucaccugccucuguccuucccacaccucagugguuucuuacugaguucucaagcauaaaaaagguuggacuguuaaguuuugcagaaaagcaaaugggggaaaaacacucuuuuccauuaacgagcgugccggcaaugucucagacuuuucucuuccugggcaucagcuauacguacgcuuguacaacagugggauugugccuugguucugucugcagcggguucucugugaugcaaggugagaacuguguccugacauucaaagcauccuuuuaguaguuccaaaugcucuacugcauuacugucugauuaaacaauccuauuuacacacgaacucguguggagggagaggacgacuuccucccgcagcaggugcuguccacugcugggcaggcgugccagccgccuucagcuguugguuuccuuuugggaaaucaggguuuagugagugacuugucgcucaagcuccuucaccucuguuacucccuggagauaucaaaaucaguuucuagaauaaaaugacugucaaaucuucuuaacuuuaggcucacauugcucagcugcuguccagagggcuuuuucugaguuacuguucuguaaacguuucuguaaagcuggugugugcauagaccucagaguaguguggcuggccaguguacauggacaauguuaugaguccagcuucccuguguguguauacauaccauuugcucacagaguguccuuaacaugauuucaauugauugguugguugauugauugccauuguaacauuuuguggucagauacacuccgcagaaacuuuagccauuauaaguccaguuuagugguauagcagauuagaguuggacaacuggccuccagacuuugcaaaaucugaaauuacccauuaggcaacuuaaaauguggguuucccagucccuuucugugaguguauauagaauaauauaacuuguauauagaauaauaguguuucucuugucuuaguuauuuucgguguuaggcguguguauggaggucagagaucccagggcucaaccucaaccaucagguuugugccgccggcaacuuuauccacuggaauccagcguugaucuuguugacugaugauuuuucaucuugguuguaugauucucuuugcuuucauacaagcuaagucauuggcauuuuguaccuuuuucagcaugugugugcugguaagcaugcuuguauugccucugccugugggccucuuguucuugugacuucccugcugugggauggaugcagcuaucauucugagaacgcaucuucagcuguuuaggauacagcacaggcauccugaugguuguagggugacagacauucccugugaucucccacuccguaugccuauuggccauguccuuggaguccuuuuuaugcuuaaaaggcuauggauuuguuaaccacgguugaccugcaggauuuggcugucuucuggguguuagcucugugaucagcugugauuucacugacguuuucuuccacuccauaaaggugccugcugagcuguuuuucuuuguaguugcauguauuauuucuugugugugugugugcaugcuuccacucaucgagucugugucacagcacuccugaaggucagaggacagcuugugggagucaaucuuacuuuccaccccacacaucugagagaccaaauaucauuguccaucagguuuggcagccaaugccuuuacccacaaagccuucgucucagcccaaguuuuacgcuguggcauuguuagugugcguuugcuuuuguugccugaacuguuggugucauaucuaagaaaucauugccagauccaacgucagaaagucuguauuauuccuuuguuuucuguuauuguuuuguuuuaaaaacacucggcaagugcucuaccacuaaauuacauccucagaccuuaaaagugccucgucuuaaucuaccuuucuguaacuauuggccaaucacgaguuuuacgguucaacccacugucuguauuuuccaucuucaaccauaaugaccuugcaguguuuguguuuaggaggguuagcuuggaccaggucuaucaaacguaucuccuuauuuucucaauuauuaagaacaagauaaauaugauguacaaggauuuaaaccaucuaaaucugaccauagcugauaaguugcuuggagcugguucuuuuuucuccagcuguucuugucugggcuugcccuguggacagagauauucucacgcaggcgguuuccucccacugcuaggaaugguggugagcuaucgcucugcuuuccccaauaucagucuuucauaaucaugu

SEQ ID NO: 9089 - RNA, 3289 nt, Mus musculus
acaauucuaagaagcuucaaucucaaaccuuuauuuugcuguaaaggggaggaaaaugguuaguggguuuguacacugaacacuuuaguacagagaagcgugugcgaccaaccugcaguuacagcuuucuucacauuuccccauuccacacagcuguuccaaugagcgaucuugcccuggucacaccacuuuuaagcacacucacaaaacaaccacauauacaggguuuucacaaauaugcaaauaaacaggguuuucagaaccaauuuuuacaaaguguuaucuaguaagaugacccagggcccagucucuuuuauuucccaaacugcuuugacugacaguuuaacagcuuccccucugcucagggaugguuuuuaagcaccauucaagccaaacccacaauggauguauucaguggcaaagcacucaugagguuucuacaagcaucacaaugaucucauagcaagcgcaagacccuguccccuugucacaaugacugauuugaaagguuaaauaagcaaacccuguugucuucuggccaauuccagaaauucaagauguguuuugaaggcauggcucacacauuaaauuccuguauguguuguauaaggcaugacucccauaugaaauuccuuuagauagcagcauuggaauucuuaaucacacaguaugacagaauuucaauagagacccagaagagucugccaaccuccccauacuaugguuucagagcccacaacgggaggcguuuacaagccccuccccagcuucacuucuuggcaaucagcuuccccccaccaggcuccaccccuguggccugccuaggucaggguagugacaaccaucuauugagcaacuaagaaaagcuuuucaaugucacccuuccccauucaacagugaagcaaaacaauuuugcucuuccccuuguaggauuuugguauuuuccaagcaacugcaucucaaaguagugccaccugcagggauuuaccaucagccuuuagauuuucaugugaacuauuuaguucccaaacuguuauucccaucaacccacgguuccaggcacaauccucacccgcaccccgacuccuucaacccaccaaugccaagcugagcccugcuuucucccacaagucccauaucuggugccaaaaguauuauucccaagcuugauccauaacucagguuucaccuuggaaggccauuguuucaggacacugucaucugagcagggcugugaacccaggccagccugguauacacagccaggcccuaagucauaaaagcuaaugaacaaaaggggccagaaccacuguugccacucaaccacccaguaucaaauccacacccugggagagaccauucccagggaccacuucgggcccacggaucccuuuuaguccagaagacgucccaaagcccaaauuagauacggcaucuaccaagucggcagaauuuguggcuaacuugcgccuucccacuguuaaaccacaaacccuacccauuuuacaaccagcuccaucuaaggaagauuccuccacaccagucauuuacaacccaacagcuuuccccaacacccacaaguuuucaguuaagaaucccucugaccaaugcagaggcaggcaggcugcagaagcagggaaggugggcgaggucacuggggucccgaucuacagugcagcacgcugcgcagacguuaaaguguccuacaccuuacgcaaucuucucgaggccaaguucgcagcacagaacuacaaaggcuggauggaggcuuguuuagaagaugcagcagucgaacgccucuacccccaugaaaaagggugccugcugccauucaugcauccgcaaagaaugaugcucccagaacaagacauucaucuggaacauucacagccgacggccccuccggcuggaagcaccugcccacccccuacaagcugacuucaacgauggccuccugagcacagggcuuccugagaaaggccuggacccagggcagggacgcgcuuccuaagccucuggaauucacuguguaggcgucaaccgaggccgcugucuccuccagggugagcccuccugcacugcuacgacucacacuggcaggggcuccauaucuccuggugccaucugcuugccauggugaacacuauagugauaaaccacguccaugaagcauuugggugaccggaaacauggcugugagcccaccccaggguccacacucacgucccgcccucugugaaucaacaccaucccuccccgcccagucaggguguccuccaccuuuaccaaaaugccgugcccaagacuccagcaccgacucuacauccuccacaggcuuaccggacgacccaggggcaagguuuuaagugaccccuuaaccucagagugaggggcaagaguagggaagagugagaccacagaagaggaagcacggaaccuaggcaaaguccagagagggcacugcuaucugaaaaauaaaguugugauuaauguggccccaagacuugcgccuucaaucuccaugguccccgccuggcagaccugacaguaaaaacaacuugucucugcagccuccuccggccuccccucgcaccccgaagugggugcagacaggccacacccaaauuacauaccacccugggccagagcuguccgcccagcgaagcuaaguccaccuuccauaagaccaggccucauccccagguggguucacaaccccuuaucuggaaaaaaaggggucugcugguuuugucaagaucaaaggcgaccuccacuacgcaccuaguccugccccacugccuguccucuaugauuuccggggccuucaagggcccccaguccacccgucuccaucaacugcugcucugccacucaaguuaggacacugcccccauguaggccugugaaacuugugcccuccuggacgucaagugccagcagacagcagggauagccuggucuugaaagcugcugguucuuuguggauuguuaaaggcgcuuuggaagcugccuuccacacguccacugucccaaaaucuagucuccuuuauacuuagccccgcuucuccucgcacccccauccuaguggcugccucuaauucugccaccucucucaucugagcccugaacuggccacugccuccccaccacuagccccaagagcgagcccuccuugucacuaacuccuacagguggagguuacaacuuuugcuuuuauacucuugugucgcgucacccaaacacugcuaaacggaacgauuccuccacgggcacuuaaaaaaaaguuccu

SEQ ID NO: 9090 - RNA, 25575 nt, Mus musculus
cagucggagaggcggggccucggguuugugcuuccucccgcggcagcuucugcggcguaacgccugcgaaucgacccugggcaggaccggagaccccgccggccgguguggugguggguccagaacuggaggccugagucggguggcauucuggagugaggcagugggcucugcgacccugcaaggugagagcguagccacacccugcccguguccccgcccuggacaggggcgcgucccgacuuguuuggccauuucuugagaaacuugagaccccugcaccugacggucacuucccugacucagcccacccgaucugcacucggcugagggucacucucuacuuucacccuacacauuugaucccugaacauagguuaagaauuguagaccgagaccccuuugcuucuugguugagagcuugaggagaccaucuccuuaagaccccccccccauuaauugucuagaguucuuuuugcagauggagggggcagaaggcaacgcggggcagcccggcccugcggagcggucccaccgaaguagcgucucuucagugggugcccgagguaggucucuacuuucuucuuucaucucuuuugaacucuuugguuccagccuggggacgugacuccaguuugucuuuuucaguaaguuaaucauguaguaaauaauaagauuuguuuagauguggcggacucagaaaucaaaggacuuagcugagaucugucucuagcuuagugacugagccacacuccugaacuuucucuuguuuucaaaugaagacacaugauuggaaaagggcaccacuuccuuugucccauuucuuuuuuugcagacagcucuuugaaagcagggauucuccaccucuucauuuuauugggaggaaauuaggaccuagagagguuguuaggucucagacuacuggagcagaccaagguugaucaugaacuugacccuucagggcugguuuuucugccuguaaaguggaucugagccagucuccuggucucuccaaguagcuguuggagcagaaaagaccagaaucucaaaagcuccuucauuaugauguccacucucaccagccguacuggauuggcggugaccuuuugaagaagcgcuauuaacuguuuuuacagauuuacagcuggaucacagagucagaaaaggaugcaggcugagaacgaggccuccacacuccaugcuccuuuacugcgccuguaguucagggauggggaauuugagucuggccaaccugccaagcaucuuuggcucuggcuucaaaugggaauccagcuuguuauaagggaacacuggcuguuugaguuguuuauucuuuccuggacugcuuaaagcuaucugcagaagccacagcauugauucuuaaaguuuugaagagucccagugaagccgagaccuggaaccugcuguaacccaagguggccuuagaaauccucauuguccuccuagucagacccagucagagucaggucacuaguuggccuuguucccagccugauagggaacugucaccucaggauggguuaccccguguuguuucuccaccugagaaauauuggaaacaacaauauuuuggugcugcagaggaaggggggugguuuuuaucacccuacuuugagccucaggggugaaauggggcugguaccuggcccgaguuucuggaugguuugagguccuugaaggcagcauuuuuuauuuguuuauuuuuaaaauacugggucuugcuauguagcccaggcugaccugggacuuggaauccuccagcuuuagccuccugcguccugucuuggacugcagauguaugucaccguaagccguagcgucacgaugugucaguguggccuggcucgugauaaggagcaaagggguggugggaaaugcugauuggaccucacccgacccugcccgacccguauuccagcagccgauguccugguguaccuggcggaugauacaguagugccccuggccguggagaauuuguccucaaucagugcccaugagcugcaccgcgcaguccgugaaguccugcagcucccagacguggcuuuggaggccuuugcacucuggcucgucuccccucucuuggguaaggucuggcagcagggcaaacauccuggggaggugaggacaccacaaccuguggccgcuuccugucagggaggaugggaccuggugugucccagagucucugggaggaggugucgagauccuuugccccugccuuuuucuugugcugauuugaugcugcuggagcccugaccuucagaagagcagaaggguccucugcucacagggcaugcagcuugggccucaccuggggaguauagcuucaguguuucccauggcucagguccauccuaccuaccugugaaguccuaagaucuggaacagugggcgggugagugucaggacugugggguugccggcaguagggaggaggguggauagagccccagaagugguccuguacagggacuccucugcuugggugugggcugcagggagaagaggaacaugguuuuucuguauggggccuccacccuaccuggugucuggcacuauggcuacacgcuuccugccccuguagacuagggccccaccacggaaugggagugaagacagggugugauagacucuagggccagugaauaaagucccucauuguggucccugagucuguugacauggaaguagagacuuuuggaggcucagugucaucauuuggggaacugcaucagcgcuggcacugggaguguuuucugaacuuaaauuuuccuuuaggggccagcaagagggcucaguggguaaaggugcuugccccuaagccuggggacccuaggaccaggguccugucucuggggccuguaugguggaaggaaagaaccaauuccuacaaguguucuguugauguccacacucaugagcacacaugcauacacaauaguaaagauaguaaugauucccagccaggcagugguggcacacgcuuguaaucccagcacuuggaaggcagaggcaggcagauuucugaguucgaggccagccugguguacagagugaguucuaggacaaccagggcuauacagagaaacccugucuugaaaaaccaaauaaauaaauaaauaaauaaauaaauaauaaauaaauaaaaauucccuuugaggaucaagaauacaacucauuagaguaguugccuagccugugcaaagcccaggguucaguccccaguguugaaaacaauaggcuagacagugguggugcacacuuuuaaguccagcauauaaggcagagaggcagagggaggcggaggcaggcgaaucucuggguucaaggucaguuugguuuacacagugaguuccaggaugacuagggcucugcagagaaacccugucuugggggaguugggggggugaaggaaacaacagauagugaccguucccuuugcuguggaggaaggagcacacuuggucucaauaauuugaucgaggcagccugggucgggccccaaaggguggggaggucggggugugugugccugagaccccuaagguuucugccucugucuugugguaggagcuccagccccucacccccaccgacaucguuguuccucccugucccccugcccccccccccacuuccugcacaguuguuguucccaugcucgcgcccacacucuuccugcuggcccagccccuccucugcccucugcgccucucagggcuguaggccccuuggcuguguggaaagcuggggauagcaggcccuaguggguugccacucucugccccaggaggcucccagcgcugcugcugggcagccugcuuccccucccccucucuuccucccccuccuccaucccacuccuucacauuccacagccugccagugacuagugcugaauaaguugccuguguggccaggccgggccaggagugccugaagcugcagugcacucaacaccccuguucuucccaggcugggguggggucugaaaggcuacuucagaucccaggacacacacacacacacacacacacacacacagacuaagcagagcccuggcuugccgugccagcgugaaugccggugaagaagcaggggcuuucauguuccucauuuggauugaguguuggccuucuccccauccucugcaugcaucggguuccacauguuagcuuuaccuggauggugguggcaagggaagacguucccacccagaagucugaggcuguggugggagagcccuauucugauggcaggaucucugggacuugggaaugaaggcaggaggagcacaugccugucugcaggucuguugucccacgccgugaauguuaauacagauagggacucagacccugggacccucugacagaggaccgaugcauguuuacugaagaaacgcuugggagccuuggcccuggaccuguguggccacucacuucugugugggccugggaagcugccaucccuugugggcaucaggugaagggagugaugcuguugucccauagccccguccugugagccuagggauaggggcagcgggaagcgugacagaaaugauggcuguggacagaaauacgacaagaaaggacuggagcugaugcaguuggguggaggugacaaggcaagaaggccaccuggaggcugggcugcugucuggucaagcucaggguccagaaggaagguccaaguguccagagaaucauuggcaucuggcuggcaggacaaggugcccugccauuagcagggaaagggacagcaagagggaggacauuugugucggaagacuggcaagcacaugguagcauccucaccacacaucucuguacaucccucugugaguucgacaacaucuccacucucggggggcccauuaccuacuuccuagggcccuaguggacacguugaaucaaucgcauacccugacuugggauaauugaccuaaccacccugagccugguucucucaggguuauuccagggugaagucccuugagcccuuuggaguggcucuggaccugcucagugacuguuggucauggccguccucacuguugguggacaguauacuagguggcuuggcacgacuggccuggccaacggcuucauggccauauccucucuugcccugcagaggugcaauugaaacccaagcaccagcccuauaaacugggccgccaguggccggagcugcugcugcgcuucaccaacgccuccgaugaugaugucgccaugggucagugucuggggccggggugucugaagggagccuugggaagggugggcuggaaggggcugugaacagagauguacugugugcugucuggucagaagcccccacucaggagagcucuccauggagaagagcuggggugugggccgugcaggguagggcagguuggggcugccuuaagcaaggggaccagaaaaugacucuauccccucucuccagaugagccuucccuucaguuccgaaggaauguuuuuuucccaaggcgccgagagcuccagguaaggcagagcccagguagugccacaggguuccugcaugccagugcccaguccccugaccccuagacacuuaggcagucaugcuugccuagcuccucugagccagugucuccgugccauacugguuugcagauccaugaugaggaggucuugcggcugcucuaugaggaagccaagggcaaugugcugaccgcucgguacccuugugacuuggaggacugcgaggugcuggguggccuugugugccgugugcagcuugggcccuaccagccuggccagccugccgccugcacucugagguaaggacagugagacuugagaugggcacccagugggaaaguugccgugcaagagucgagucuaccuaccuacauguaggucuagggccugcaagguggacaguccugaagucaggccucugaugcacgcaugcucacuggaugcccuuagugaguucuccacuucucugagccuccuuuuccuucuucccaguggauauacacauuaggugcugucuaagaggugaccucagcacaaggguacaagauacucggauggaucccccagcucuagcuggagucuggaggaacagccagaaacuaaccauguguugaccccccaguaaccacaaacagcucaacuccaaaccccaagaacagaauccuuuuccccaggcgcuuaccaagcccugcuagcugcugcugguccaucuagaaagaugagaguuggagggcagagguggcgugcacccuuaauccaagcacucagggucaggauaggaggcagaggcagguggaugucugugaguucaagggcagccuggucuauagagggagucccagaacagccagggcuacacagagaaacccugccuugaaaagaagagaauugagucugucauaauaacagagcagguugggcucugccuggguugaugugacccugagguuuagaaauaauuccaggggccaggugugacacacacuguaaucccagcacugagacugagacaggauuaucaugaauuccaagccagccugggcuaaagaguugugagccaggcauaucucacagugggguguggaagcuggaaugucaggcuuucgaggucauucuuaacuacuagagugaguuugaggcuagccuguacuacaugaaacccugucauaaacaaaacuuguaauagagucaggugaccguaaaccuugacugugaccuguuucuaaccugggcuccuuguuucuccaaccugcaaagcaguuuauggggccagagacuuggugcuaaugacuguuuggagcccagcaaggacugcccuggguucaaagucccccgaaggcuuauagcugagcucucuaaggcugguggccauggccaugguaucccggaccucaggaugggcgugucugguuuucuugggccugacaagcucagcucguuugcacaggagguccccuugcucacucaugugacaugcaaggccagacagucagggugccuuggacugcacucagcugugucccagacccuguucuccuucuuagucagcccuugucucguuggccagcacaaggucagacauggaagcccaguggccggugucugcagcaacugucuguugcagaggagaguccccucuuaccuugcaggcuugcucucauggcacauagcuuaguccccagguccauccagagguuggaaguccaguggcucugcccuugaugggcugcagcucagucucagggacaccgaaucugcacacacccaaagccgagacaggcuuuuccaugacaaguggaaacugcugucaaacacaggacuuggguaggggugggacacagacggugaaaugggcacagcugcccugagaagggagggcagccagcccuccaagaccccuccugcacccugugacucaggcugacaacuuccugcccuucgccuucucuccccuugcugccucucccagcagccugguuguuuaggcuccagacacccuagcaggacuccucucuggaaaagguggcaccaugaagguuuaccaaguuaacccgaagccaagggccguguuggggucucucucucucucucucucucucucucucucucucucugugcccuugggacuugugguccucuuguagacagggccuggauauagacacugacuuugaggccucagacccagaacuccugauguugucuguuggagugguugaaucccugccagcagaagcccagguggccuaagguagaaagcagucauguuuuagcugagagccccccuguucuccgagugaaugggccuuuucccacucaaaaauggcaugauacuccgugugagcuacuuuuuuuuaggguuuuuaaaaauauuuuaugugcguugguguucugccugcguguaugucugugugagggugucagauccccugcaacuagaauuaaagacaguugugagcugccaugcgagugcugagaauugaaccuggguccuuugggagaacagccaguguacuuaaccgcugaaccaucuccccacucccaccagugcuggcuauucuuaugucuacuugacacuagcucucgucugagaggaggaaaccugaauggagaaaaugcuuccagauggucaggcugucaggucuguagaguagaucuggguccaagcucugagccacugagugagccucaggcccuagcuguguaaggaagacacccuauuucccaugaaccugugaugaucucguugguguucagucaucccucccuugcugaguagagcacugagagcugccuuagccgcagucacuguugcugugaugaaacaccaugaccgauagcagccugggcaggaaaggguuuauguggaucacacauccucagucaccauccacugagggaagccaaggcagggagggacucaaaccaggugggaaccuggaggcaggagcugaugcagaggccauggaggaugcugcuuacuggcuuguuccccauggcuugcucagccugcuuucuuauagaacccaagaccaccagcccaagcauggcacuacccacaguggaccgggcccucccacaucagucacuaauaagaaaaugcccuacaggcuuaacuauaguugcaucuuagggagguauugucucaguugagguucccuccucucaggugauuccagcuuguguguugacauaaaacuagccagaacguagagucgcaccauuuguauuauuuuggauggagaaaguugcauucauuuagaaagcucagcuguccagccucaggggugcugcucugauacccgcuccagccaggcucuuccucugccgccuuuuucuggcuucccaucccgacccaagcacaucccaggccccucugccauccccggguccugagugucggccagaccucaucugaugggaaagggguucuccauagugccucgcaugcaccaugguggugaagauuggucuugaugacacugucugcccucugcccgcguggagcacucucugcagggagggagguuuuguguguggugcagcaggagagagcaggauccgagugcgccuucagugggaacccuauuuggccuuuaugugcgagguguccuucccguccuaggcuugcagagcuuuacugugucuuagugucagggugaucugucccugcucugcagauagguaggugccccuugcuggucucacggcuggcuaugacagacagaaggcccgcagaagggcucugaucugaccacacccgggccuucuccccucugcucccccauguauacucuagggucucucucucucuuucaagauuuauuuuuuuuauguauaugaguacacuguagcugucuucagacacaccaucugauaccauuacagaugguugugagccaccacguaguagcugggaauugaacacaggaccucuugaagaacaaucaaugcucuuaacugcugagccaucucuccagcccucuuucuuuuuugcgagacaggguuucucuguguaaaaguccugccugugcuggaacucgcucuguugaccaggcuggccuugaacccucagagaucaccugucccugccuccucugggaaccucauuuuucucuuaagaggaagaacaccccacccccagcucaguagugggccuugcauaucaggcaggguuggcgcugagccgagcaagccacagcugcuugggggcaguggaaauuugucugcagucuguguuuaggaccccugucacccuccagcgcauacacacacacacucacacacugcccagcagugggccuuggugcagucgagccuugaagccuugaaggucccuacggccugccaccugccaauccuugccuacccuaugagcauaguacucacacccugaagacuucaguaccccagagggccaccacuauuuuccuccccuucagagagaagcuggacuccuuccucccugcccaccucugcaagcgagggcauggccucuuugcugccuuccggggccguggggccaagacugggccaggugagcaaggccugcugaaugccuaccgccagguaaaggaagugacaggcaacaacagugaacgugaggccaccuugggcucccacuaccgcgcauaccuccucaagugccacgagcugcccuucuacggguaagugaugcaucucgggagcuccugcccccucucaguacccuccagacugcccuguccccgacacguggcagcccgcggcccaccugugcuccaguggcucuguccucuuaaagagcuguccuggcaggggucccaucucugacuaggaguccuucaucuguccucucuuccuaccagcuacagccacucccuggccuggcucgugcucacacacaugcuguauaacgaauaguuguuuccugguggguaugucccgcacagugcaggagcuuuccuuugaaugggaagucagaguuagagaaccccgguaaauagcagugaggagagcagaaguggugggagcagcagccuagacggggugaguucccagacucggagcuugcuguguuguccaguugcauuugcugggaugcaggcugcagguuuguuaaggugggaaccuggccuugcaugugacagcugaaaaagcccauuagaugaaugcugauucuacaugagcauuugggcuccuggucuggggcuaaaaaaaugaugggugaaugguuucaaaucuggagcccugcggaaugaauggccagggagaugaguagaggagaagugggggugauggacggggagggaccgggguguguaugugauggggacugggaugggacaacaacaccuuccaggcaggagcgucccuccaggccagcaccacauguuccaguuccucuuaaaagucauguucacugugcccuauggagcccagguuugugcugugcacuggccucagccugcuggaggugggagaggaggauagcaugagagagaagaaggcuaggaacagcgagugcugggcacuccaggagugaguaaaaaguugauagaagugggugggucuuacgacagcuucucuuuccucaucuccugcaccucagagcugaggagggcguagaauuucccaggagggaaguauacucaccucuaguacccuccuguacagagagagcuggcuuugaccugggcugugauguaggcaagggugagccuuggcaugagugacaucaugaccggccaugagggaggcagcagcgagugccuugccaccacacuuaaaccaccucacuuuccccuuuagccuuggcccagaagccacucuccuaggcagaaugaccuuggucccugcugcugaaggacuucugcuguggacagugcugcaggcucaaccuuaccucuuacggagccucagguuccccaugcagcuugcucuguccccuuccuugggucugugcucuccucugcccacgguguccagccauuaccuagguccuuccaccggcuccgucuaguucuguauggccaaucggguguuaucauccccagcugcccacauuacucccucuuuccgccucuguccccccccaauccucggggcaggauuuuuuucuuucuuucuucuuccuuuuuuuucuuuuucuuuuugguuuuucgagaugguuucucuguguagcucuggcuguccuggaacucacucuguagaccaagcuggccuugaacucagaagucugucugcuucugccucccaagugcuaacggcgugcgccaccacugccugguggcuauuuucuacuugcccgucagucacccaaacagcuuaagcuucuaggguagccagaguagacuucccucgugugcuaggugcuggagggagcagcugacaccaguccccuuuccaggugugccuucuuccauggcgagguugacaagccagcccagggcuucuugcaucgaggugggcgcaaaccagugacuguggccaucagucuggagggugugcacgucaucgacaacagggagaagguaccacagcuccauugagccccuuaggcaggacugaacggucuguggugggguagaagggaguggggucuugaccaugccuuccugguucccccaggacuauggcagccuaggaacagcauugaguggacuguaggagacugccucccucaugcccugacaucugcuuaugcccucuagaaccuccuuugagccuguucugggucuguuuuccugaaccacgcacucgacuaaggcagagggguggcagcugggauccugacugagcggacugugucugccagcaccuugcugcuuccuccuggccaaugauggaggcuggcuggccauuuuccacagagacuccugcugggagcucccugugcuggccaagaccugcucacccccgcauugguggcugucuuaccucuggcucgccauauaggcuguggugucaccagcccucccugugcagcaguugccagcaaccaguggccgauucccugaccgucggggggccugacugucagaggaaagcauugaagaguccaguuccuggccucauguaggaagaaaugcagacuuagcguggaggucugguagaguucaugccugccuuguauacauaaggcucucuguucaguucucagugccacaaaacaaacaagaacaaucaauauccucucuucccagcagagggaggcagaggcagccagaugucugugagccugaggcuggccggggcugcauagugagagcuucuuucagaaagucaguguggagaggaaggugcgcugcaucagcugagaaggcgaggccucagcucuguucuuugucucccuguggccagcaugugcugcugggccugcgcuuucaggagcugucgugggaucacacuuccccugaggaggaagagccuguccuguggcuggaguucgauggugacagugagggcacgccugucaacaagcugcuaaggaucuacuccaagcagguagugcugugcucacacacacucggacugacugauaggccggcaagcagguagugcuaugucacacacacucggacugacugacgggccggcaagcagguagugcugugcucacacacacucggacugacugacaggccggcaagcagguagugcuaugucacacacauucagacuaacuugacaggcaagcagguagugcuguucacacacacucggacugacugacaggccagcaagcagguagugcuaugucauacacauucagacugacuugacaggcaagcagguagugcuguucacacacacucggacugacugacaggccggcaagcagguagugcugugcucacacacacucggacugacugacaggccggcaagcagguagugcugugcucacacacacucggacugacugacaggcaagcagguagugcugugcucacacacacucggacugacugacaggccagcaagcagguagugcugugcucacacacacucggacugacugacaggccggcaagcagguagugcuaugucacacacacucggacugacugacgggccggcaagcagguagugcuaugucacacacauucagacugacuugacaggcaagcagguagugcuguucacacacacucggacucacugacaggccggcaagcagguagugcugugcucacacacacucagacugacugacaggcaagcagguagugcugugcucacacacacucggacugacugacaggccggcaagcagguagugcuaugucacacacauucagacugacugaugggccggcaagcagguagugcuaugucacacacauucagacugacuugacaggcaagcagguagugcuguucacacacacucggacugacugacaggccggcaagcagguagugcugugcucacacacacucggacugacugacaggccggcaagcagguagugcuaugucacacacacucagacugacuugacaggccggcaagcagguagugcugugcucacacacacucagacugacugacaggccggcaagcagguagugcuaugucacacacauucagacugacuugacaggcaagcagguagugcuguucacacacacucggacugacugacaggccggcaagcagguagugcuguucacacacacuuggacugacaggccaguauccggaaaggagggugcugugggucuggggaaugacccuggugagcucugcacaacucugggaucacacaccagggguggcgucccuugagggucugcccaugccaugccaugccagcccuguuacaaagacccugagaggucagcugagaagcuggggcagaaggacagaggcagggagggccuguguugcuuagauccguucuuucugcccacuacccauucgcuuccucuuccucugccugcaucagagccgcaccgggcucugagccucucuggggacucuucuuccccccaccccccacccuccuuuuagcacauagacaaauuccagggacuccuuugaaaacauauguccucucccucuggucuucaaaaaaauugaauacacuaaccugcagauaggaauacaaguuguguuuagcccuuguguggcagcugcugagagcagcugcuuuucacugacacaggcuucagauuagucccucugugucugugucuguguguguuuuuguuuuguuuuguuuuguuuugaaacagaucucacuauauugcccugacuggccuggaaccaauacagacccugguggccuagaacucacagagauccacccgccucuacuggcaguacacgguggccaucuuugccuauuucauuggugguggugauagugguggguugauuucaucacagauggugagagcugauucuaccuuccauagacgaggucucuugguagauauuagcagauauuuccguucaguguauacccuggccuuucguuuucuuucuuguuuugguuuguuuuauuuaauugauucacuuuugagacagccuuugucugguuguccugaaacuuacuccaaagaccaaacuagccucaaacucagagaugggccugccuuugccucccaaguguugggauuaaaggaauaugccauugagucuggcuggcuuuucauucucucucucucucucuuuuuuuaaagauuuauuuauucauuuuaaauauaugacgaguacacuguaacugucuuuagacacaccagaagagggcaucagaccgcauuacaaaugguugugagccaccaugugggugcuaggaauugaacacaggaccucuggaagagcagucagugcuccuaacuacugagccaucucuccagcccuggcuuuucauuuucuuaacaaugccacuagaagaaauguuuucauuccuuuuagaauuuuucaagacaagguuucucuguaacccuggccauucuaaaacucaaucuguagaccaggcuggacccuggccauucuaaaacucaaucuguagaccaggcuggccucaaacucagagaguugucugcuucuuccucauaaauucuggaauuaaaggcaugagacaccacuacccgggaagauguuuuaauucuaaugaaauuaucugucugucugucugucuauguaucuaucuauguaucuaucucuauuucuuucacucuucuuacacacacacacacacacccuccucuauguaggcagagucuccuggaacccuagcuggccucagaccuguguagcugaggaugccuguccucccucugcgucuguguuuugagcgcuaggauugcaggcgugagccaccaugcagcuugcgugacguugaggaaugaguccugggcuucgugcguguuaggcagauauucugugaguucagccacaucucuauccuguuuguuuuguuuuguuuuguuguuguuuucaagucaggcuuucucuguauagcccucgauguccuggaauucccucuauagacaaggcuggccucaaacucagagaucagccucccgagugcugggauuaaaggugugcgccaccacugccagacuucugguuuguuuuguuuguuuuuuuaagacaaguucccaauauguaccccuggaauuuaguauaucggccaaguuggccucagagucagccucccaaaugcuaggauuacuggugugcacuaugcagcccagguucguugguuagacauaaagugugguugauacacuaggucaaaguucacuuaacguuuaugcauagccaguuguuccguugccugcuguuugaaacuguccuuucucaaugggcuuguucuugcaaagucacuuuguguauaugugagguuuaauuuuuguucauuuuuaagauuuauauguaugucauacguaugcaggggcucuugaggccaucuagaguuacaggaaguugugacccaucugaugugggugcuggguacagaacuuggguccucuggaaaugcagcaagggcucuaaccacugaacgaugucuccagccccgacguguggguuuucuguuguuguuuucuggauucacuagcuggucugagccauuggucugugugugugguucacugguaaucacaguccuuuaacugaauggugugcguggugcuaggcacaguggugugugcacuacagaccaggcguguacauccagccagacgacaucccaaggaaggaagacaggaagagaaggaaaggagcugggccagggagaugauggcuccuggguaaaacugcuuccugcgcaagacuggccugauucuggaucccuggaccccacauaaaccaaugccugauguaacacacacugcaauuccccgacucccggcugagcgugguggcgcacgccuuuagucccagcacucgggaggcagaggcaggcggauuucugaggccagccuggucuacaaagugagucccaguacagccagggcuacacagagaaacccugucuuggaaaaaagaaaaaaaaaaaauccccccacucccauggggagacaggaggugcagacaggagacucacuagacacucagggaucagcauggggcacuugccaaagcuaaggaagcaaacccugagucucaacugagguggaagagcagggaggcaggcgcgugaccugugcagucaccacgcgcacacacacgcacacacacacgcgcacacaccauacguagguacacccagacauuuucaacacgaacacauauguaugcacacacacaugcaaauuuguuuuuuaaaaaggaaagaguuaaaaaggagaaaaagacuggagaagcagcugaagauaagacuuagagaggacugggguccguuugcagacgcccccucgacauaguggcucaaaacugccuugagcuccauucugggggacugaccuccauguucaggguuuuccguguagcugcuuauguugugugaauggugacagucuggucugucaccucccggccugcaugcuccccaugcuuuugcucuuugugcuuggagaguuggaugacagucaggacaaugcugaauagagggugucuuuggccuuccccucagcagugugggugcuuccuggaugccuugcauccgccggucaggcuuucugcaguggcugguggugugacucaggagaggaugcggugaaugguaacccugcacuuuagguagaucaggacuggauguggagacuaggccuaaaguguaggagcucgccugcucuccucuuccuccccaggcugggcuaggcugcugucaaggccauggguaacacuggacaggcagcagaggcuagaccagugucuaugacgucauccccaggcuccugaccugugagcacacaggggucuaauauagccggccccuuguuggggccacucacaguaggugcucuguaacucuccacaaagaugccucguccauagccugagcagagcccuaggcugcugucauggugcccagcugugcugucagauguuuguuuggccacuugugcuuccagguguuuggccuguuguguuucuagacccaugaggugucacucacauuagaaaacugcucagagggagccacccugcccagugaccucacccucuuccuuaggccaaaguuucuugcagccagcacaggcagcgcccuucagcacccccccccgcacccccccacacacagagcuuaccucaucuguggcagcccaguccacugcuuuccuuagaggugccucugacuagaacucccuccuuucuagaccucaccucugaagucaucucagguggacaccuucccugcccucugggcccagaagcucuccucccugcucugccuccugccccccaccaggaagcgaaggcuuuagagcugugugugucucauugucaucccucaacaguggcugcucuguggccucauaccagccccucucccuucccuaggcugagcugaugagcggccucauugaguacugcauugagcugagccaggcugccgagccuacucuuucccaggagagugcauccggcccucacgaagcucccagccccucuccaccucccacccagcgccccaagcugcgaaggcaggguagcgugguguguagccggauucagcaucucucuaccauugacuauguggaagacgguaagccgcugguuacaguguguauacagcacacuggcucacaugugugccacagggacuccagauggugucccuguaccuccgggacaucuccugucugucccuucuuuucuacagugacacacuuguccacuguagcaucuaucuugcagaauguggaaaacaggaaggagacuucuuuuggaaugggguguucagagacaggauccucuguguaacccuggcugucuuagaacuagcucuguagaccagacuagccucaaacucauagagaauccaucugccucugccuccagagugcugggauuaaagguaugugucaccaccacccagcaaggcccugucuucuuuuuuuucucuuuuggauguauuuauuuuauguauaugaguaugcuguagcugucuucaggcacaccagaagaggguauuggauucuauuacauaugguugugagccaccaagugguugcuaggaauugaacucgggaccuggaagagcagucagugcucuuaacucgugagccuucccugcagccugagaggcccugucuuagaaaacaaaaaacuucagcguaaugagaguuaaaccuagagcuucagccacuuuaagcaagugcucugcuccugagcucuacucuuauuucugagcacugaguauagguguguuagggaagggugagagagcucccgaaagugggaagcggggaggaguaucucgcccguccaguguguuugauuaucggggugaguuuauacacuuagacucauuccaagauaaacaggguuuuaugguggggagacuggugaguuggcucagcauguaagggacuugccaucaaggcucaggauccgagcuccauccccagggccacugguggaaggagagucaacaccacacggcuguccucugaucuccacgccugccaguggugcgcaaacuccuuucucccaagaagauuuuugguuuguuuguugagacaagauuucccuguuucccuguguagcucuaaguucuccguauagaccaggcuggccuugaacuagaagagaucugccugccacugccuggaaaguggugggauuacagauaaauaccaccacagccagcuaaggucauuuucauaaucugaaaaggaguauuuugcucagguguggaggccuaugacucuaaucccagagcuuuaacuaccuugaacugggggugcagcucagugguggagcacuugccuggcacgccuaaggcccugagucuagcccuggugccacaaaaccuaaauaagauuuacuucauaugauauauugauaaagaugugaaguguagcucaucacagcugauggcuucuggcagaggauggagauaggggaaggacacaguuuucauuaagggcugcccacugggaauuugcccuugcuccagugagaauauggacagcacaaauuggacuuaguggauuuuuuuuucucuuuucccuucuuuacuggggauagaagaagggugggaggagggggacuugggaggaauggaaagcaaguuugaucaggauauauugugugauguuuccaaauaauuaauaaaaauauuauauuggggggagaaaguuaaaaagaugaccugagccgggcaaugguggugcacgccuuuagucccagcacucgggaggcagaggcaggcggauuucugaguucaaggccagccuggucuacagagugagcuccaggacagccagggcuacacagagaaacccugugucgaaaaacaaaaaacaaaacaaaacaaaaaagaugaccugaauuuuguacauaauuuaaaaauucuaucuuauauauaugaauauuugccuucauauauguauauacacgucccaccugugugccuagugccuacagaggccagaagagggagucagauccccugcaaacaggaauuacaaaugguuuugagcuucaugugggugcuggaaaccaaaccaaacuuguccccugcaagaacaaaugaacaagugaacaagggacugugggcacugagcuuucaagcuccugcgguguuguuaguuuguuuaguuaguuaguugguugguugguugguugguugguugguugguugguugguugguugguuuuucaagacaggguuucucgggcuggugagauggcucaguggguaagagcaccagacugcucuuccgaagguccagaguucaaaucccagcaaccacaugguggcucacaaccaucuguaaugagaucugacucccucuucuggaaugucugaagacagcuacaguguacuuacauauaauaaauaaauaaaucuuuuuuuuuuuuuuuuuuuuuuuaaagauuuauuuauuuuuauuauauguaaguacacuguagcugccuucaaacacuccagaagucagaucucauuacggaugguugugagccaccaugugguugcugggauuugaacuucggaccuuuggaagagcagucgggugcucuuaccaacugagccaucucaccagcccuaaauaaaucuuuaaaaaaaaaaaaaaaaaagacaggguuucucuguaugguccuggcugcccuggaacucacucuguagacuaggcuggccuugaacucagaaauccgccugccucugcuuccuaaaugcugggauuaaaggcgugcgccaccaccacccgggugagauguuauuuucaaagccagcuaugauaaauacagcuguuagcuuuguacuugggagguaaaggcaagaucagaaguccaaagccaccuugggcuaaauagugaguucuaugcuagcuagccuauguagacuauuuauuaaaauuuuuuuguuuugccgggcauggugaccaggcuggccucgaacuuuuagagaacugccugccucugcuacucugcugggacaaaggugugcaccaccaugcaccaccaugccuggcccagaggacaugaaauugucccuccucuuccucuugggcagcauugugauucuuccuuccuugucuuucucuccuccuccuccuccuccuccuccuccuccuccuccuccuccuccuuuuagguuuaauauuuaaacuuaguuacagucuauacguguuugccuuccugugggucuguaccacuugaguuucuagugacuaaggaggccgacgagggagcugggacuggagcuuggagcuggaguuacagaggguugugagccgcccuaccagugcuaggaacugaacucggaccucuggaagagcagccagagcucugaauggcugagccaucacuccagccccaguauucacuucuuuuuuauuguaguaccuuacccagugugcacuguggcccaggcugaccuggagcauggcauuguccucucgccucagagacuccuggccacacgcuguguagcugucgggccuugguuuggccugaguauuuuguaaaaggccuguugcuagaauuggcugguuuuccucgagaguugaugaguuuggggaugugaaccggcagaacaggguggcuccucacugccguaauugugccccgacuauagccacacaugcccuccaucuuuuauuuggcuucccauccucagcuaucccugucuuaguggucgucacccagcagucagucuggagucuucuggagcuucugaugggaugguggaggugaccauggggcccuccugccacugaugauacagcccagggacaggcucagugaugacaguucugauggggaagcacaguuuaagcgacuccaggagaaacugacccaguaagaguggagcccagccuccuggggugugggccaccuacccagugccucuucucagccucucugucacccucacaggcaaggggaucaagcgggugaaaccaaagcgaaccaccuccuucuucagccgacagcucuccuccagccagggaagcuacaccguggugcagcccaccgacgacagccuggagcagagcugagggaagccacggccagcagcaggaggacaucugggugcccuagacacaaccaggcacagcccuaggcagggccaggccacacucgucucagaugcugugggccuggguggggugcugugcagggucugcuggaguuucagaccauggaaaacugacauccaagccuucccugagccugguguggguagagcugugcuccagcccuuucuacagccugccucuuccucugcuccaggcuggcagcugacaaacccugcugcccuccugcucuuccccaagugcacuggucuucccucuggagggacugcuggcgguuccgauggcaggugacugaaggcagagcuugggaccugcaaguucaguguuugccuucggucaugggcccuuggugacuuuaucuugcauuccuucugcugacauuccaccaugcuggccggccaggcugccaccuuuuccccuaaguuauguuggaacuggagggcaccucugcaggcuaaccccuuucuuguuggccuuuacugaugucucugugcugaaugguggcucuccuaggaaccgguuccaugcugcacauaggaaaagcccuuacaugucccugggcuggauuggcugucccauaccaaccaguuccuuuguuuuccugugaucuggguuuaaggguuagauuuugccuugucuccugugcucugagcugauaaagccuggggcguggcaacuccgaauugcacugcacugugggauucccugaggccagccacagcggcucaagccaccucucuccgaaggacaucgcaaaggccuaucuguccccagcucugcaccccuggcagccuugacugcuccugggaagagcuaguucugggaguggagcuguccuggcccuuaagcccuuuguacucccugggaauccccacuggaucccagagacauagcuuagcuuugucuucuugguggaaagccacagaaauggaaaccaucaucucugaaaaugaaaccaguuugccugccagugagcuccagaaguuuuggcagcagagagaaagaaaaggcugaccucacuauaaggcauugucuguaagaugaugucaccugccacuguaguuaacccuuuaggagccuuguguguucccugagcuaccagcccacucuuggcaaccuuuaggucaucuugacugcuguugauggcuucagaucauuaugugaggggcccagaugcgugugcacagguacacaaacucuacauuuccauuugagccuuugaguuuuuuaauuaccacaugugccuuaacccucuaggacagagcacuguuuuacuaaauaaaugucuugaguguucccagucuuuccuaucacuggacuuaauaaaaucaucaccuagcacacuuuggaaugguuauaauauggaauagccagaguaugguaaccacacguguccugugugcccaugguauagccucaggucuucaccccaguaaaaucucaucugguagcuccuggggaccggucuccaggucuccauaggaaccaggucugggaagacuugggcucacuucugucugggaggaaccuguacuucccccacugcaagcuguggcagcagcgauguuuggagcuuuggcccuauggaauaaagaccagagguugcagguucagucucacuguuuucagaggaagggagccacaugucuuuuucauuauuuaagauuuauuuauuuacuucauauaugugaguacacugucccugucuuuagacacaccagaagagggcaucgguucuauuacagaugguugugagccaccaugagguugcugggaauugaauccaggaccucuggaagagcagccagugcacugagccaucucuccagcuccugucccuuacuuuugagaugggggucucgauaaguuaccaauacucgccuuaaacccuugguucugucagccuccugaguucuggggugauagcuuuaagguaacuggaaccgagaggccaugaggaaagccugaguuugaccuggauggagccuugcaaaccagagcagccuggacccgagggaagaguaaaucucagggcagauucucacuacccguccuugucccugacugggaagcccuucagaagucucuggcacuccacccaguccaggacuguaccuggguucagauccuuccccccacccccaaguccagugccuagggguggagagucauuucugagccugcagaacagcagguccagcugugaccagcagggggcagcugagcccucucuuucuguugggcugcaggcaucgugagucagcacuugaggcccggcccagcccaguuguggcgccuggaacggaauguaccuccagggacagaagcccuacucaagaacaugcacucuugauggccagaaccuuccccgugccccuggguuccagguauaugagaaccccaggauccaggaccaugaaauggauucugcuuuggaaacuguuuguuuuucuguaaaaugucaacucagucccaauguucaaagccaggaggacuguuuggggaaauccagaggugggcagggcuugaggacagucaccucauguguuccacccgguucccacggaagcugcugucucagccccuggccuugcacugcgcaccuuccucuucccagcugcccucauuccccacucaccgagcccucaccuagucuucuguccuuuuaaugccugggagcaagcccagggccccgugacugcugcauaagcacccuaguacuagagaacccguugacccucccccuuaacaaaaacagggguucuccuuguagccccugcugucuuagaacuuguucugcagaccaggcuggcuucaaacucacagagauuugccugccucugucuccugagugcugggauuaaauaccucggagcuuggu

SEQ ID NO: 9091 - RNA, 1457 nt, Mus musculus
ucucucugcugccaaaacuucuggagcucacuggcaggcaaacugguuucauuuucagagaugaugguuuccauuucuguggcuuuccaccaagaagacaaagcuaagcuaugucucugggauccaguggggauucccagggaguacaaagggcuuaagggccaggacagcuccacucccagaacuagcucuucccaggagcagucaaggcugccaggggugcagagcuggggacagauaggccuuugcgauguccuucggagagagguggcuugagccgcuguggcuggccucagggaaucccacagugcagugcaauucggaguugccacgccccaggcuuuaucagcucagagcacaggagacaaggcaaaaucuaacccuuaaacccagaucacaggaaaacaaaggaacugguugguaugggacagccaauccagcccagggacauguaagggcuuuuccuaugugcagcauggaaccgguuccuaggagagccaccauucagcacagagacaucaguaaaggccaacaagaaagggguuagccugcagaggugcccuccaguuccaacauaacuuaggggaaaagguggcagccuggccggccagcaugguggaaugucagcagaaggaaugcaagauaaagucaccaagggcccaugaccgaaggcaaacacugaacuugcaggucccaagcucugccuucagucaccugccaucggaaccgccagcagucccuccagagggaagaccagugcacuuggggaagagcaggagggcagcaggguuugucagcugccagccuggagcagaggaagaggcaggcuguagaaagggcuggagcacagcucuacccacaccaggcucagggaaggcuuggaugucaguuuuccauggucugaaacuccagcagacccugcacagcaccccacccaggcccacagcaucugagacgaguguggccuggcccugccuagggcugugccugguugugucuagggcacccagauguccuccugcugcuggccguggcuucccucagcucugcuccaggcugucgucggugggcugcaccacgguguagcuucccuggcuggaggagagcugucggcugaagaaggaggugguucgcuuugguuucacccgcuugauccccuugccugugagggugacagagaggcugagaagaggcacuggguagguggcccacaccccaggaggcugggcuccacucuuacugggucaguuucuccuggagucgcuuaaacugugcuuccccaucagaacugucaucacugagccugucccugggcuguaucaucaguggcaggagggccccauggucaccuccaccaucccaucagaagcuccagaagacuccagacugacugcugggugacgaccacuaagacagggauagcugaggaugggaagccaaauaaaagauggagggca

SEQ ID NO: 9092 - RNA, 5812 nt, Mus musculus
cuacauuccaagcuccauuuauuuacaaauuuguuugauauuuaugguuguuugcacaugugugcaccauuucgggcaaugcucacagaggccggaagagggcgccagaaucccuggaacuggagcuacaaguacucacguggguucugggaacuugaaccacacgcaaucuugcugcucuugcagaaccaugaauccaagaugaguuuaugcuacacaagcaaggcugcaucucaaaaacuaaggagacuugcuauuuuccauuuuugugcucugcuuauuacaauuguuggagcaauauagacacaauguuauucccgcaguucaccaucagguucauccuuaaugucgcugcucugaggguuuacagauacagugcacacaauacaugcccuguaucuaccacgacuguagcuuccuggccuugaaaacauccugugauccauccagucagcccuuacuccucaucuucugcuaaccaguuaucucuucauuuugucuuuuuucuuccuaucuuuuccagaaagucuaagguucagaaucauucaagacaccacuuucucaagauggucuuuaagaaggcucaguggguaaaagugcuugaugccaaacucggcaacccgaguucgauuccuggaacacacaugguagaaagagagaacagaaacauggacacuaacgugacuuauacaugccccuuguuucaaaaaaaaaagaaaagaaaagaaaaaaaagugaaucggucuggagggcauugccugaggaccaguuuguuucugcagcuuaaaaguagacuccauauuccaccuuucaugcugaggcuggcacuacccucaaugaucaucucgucaaguucauuuccuggugugacaaugaauauggggacagaaccaaggugguggcacuuaggguccacauggcuuccaaagaguaagggccucugggccaccaggucaagcgggaucaggagaggaagagagggauuucuuuguuggggguguccuugccccuacucagcaccccaacacacagaacauccccuccuuauaguacugcaccauaggucagcaacaauguucaggucccuccaaaagggacaccugccaccuuuuugacuugagccauccuuuucugucccuggauuuuaaauauuuauuuauuuauuuauuuauuuugguuuuucaagacaggguuucucuguguagcccccuuugcaguccuggaacucucucuguagaccaggcuggcuucaaauucacagagaucagucugucucugccuccagaguacugccauuaaaggccugugccaccacuguccugcuacaacauucuuugaucgggcugcccaugucucuugaccccuucagcccacccuuauuuaaccuccuuugcuuguacaauucugagccaccuccaauagaaugacaucuaaacuagcagggcuuagugguaaauucuguaaucacagcaguugagagguggcggcaggaggauccggagcugaaggccagucucagcuacauacaguucaaagucggccuaggcuacgugagaccuuaugucagggagggaagagcuggcgaaauagcuuggcaguucuagagggcuugcugcuccucuagaggugcuggguucaguucgcagccuucacaucaggcagcucuuugauugccuguaacuccagcuugugagggucugaaacccucuucugcccucuugugcuuacuugcaugcaugugcacacauaaauaaaacaacaaaaaucugaaccccugaaucugccuaacccugccacucuccccucuuuucuccccggaguaagcaacacccgcuacaccucauguccucuaccugccuaggcuuucuucaggcaccacccuaccucucccccgcccccggccacgcgcaucuccccacccuugccaaaguuccugccuuuacugacaccugcauuagaugaggcuucagucggggaaaguguguggaccaacccuuccucuccauuaaccaugaaggcagaggcgucuucaucagcucaugcccagcugagcauaacgcccaggugcgaaaguuagacgcagucagcucuuaacuuuuggagugucgaggugccuagaaucccaagaaaagcaccaucuauucaaugaaugcuuguccaucuuauguagcuugaucggccaugcugugaccucuauaacugugaagagccuugggaccgcuccaaucccucugcauccuugaugcuccaaacucuuguagugcgcccagggggaucugcagguccugugugagccugcccugguguuccgggccucugcugcccucucccgggucagguaacccccacaagggagcugaucccaggugcgcagaccaauuacuugaaagagaaggccagaaugcuacacaaagauuggcuaaggccauugucccucuuuuuuuucugcacgguuggggaaaucgaggcacggauuuaccuaaggccaugcagggugugcgcaaagaccgcuagggcggagugcuagcucugcaggccugcgcccuaaggugaggggguggggagcuggcucagcccuacagcgggucugcggcagggaccggccgggguggggcuaccguuugucuagcguccggcagaagucagcucucauccagccaggggcagcuccagcaagcaguugcagccaccagagguaaucccugcuucgccgagcgccggcugggcuggaagacagcugcaacccagaggcacgcgggggcgcaggaggcggguggaggacuguguuggcggcgucacugagccggaucguccccaguaccuucccggagggcgacauaggguggggccggcggcucugcaacucgagcugcggcccuaguuaaaaauaccccuugcccuacccucucucuggccggcggugcccuucugucccaguccaacccuucucacccggaccggcgaccggcuccucccgggagacaacucugccauuuaccaauuuguccucucgcagagcuggcuuagagucugcagaggaagggggcggggggaggggacugaaagacacccuaaguaagagauaguaaaaaaguguugcgggggagauaagggagagccuagagggagcgggguaagagccucgggcguagguggaggaccagggagggagggaccagggccgaggggcgguggaggagggcggggaggagggcagggaggagggcagggaggagcgcucuuccugguugggcccugcccugagcugccaccaaggaagccagccccagggaccgcagcaaucucccaaacuccccuuccccagguaagaaguuggguguccagacuacgacuguuugacccaggccacugcuucugggguuagggggcugucgcugaucagccccugcuucaggucuucuguguguuugccugaggguuaaggguccggaagcagcucaacccaggcgcucagcucaaccuguccgcuguagcugggccaguguccagugcucugauguucagcuuguggaaaggcaucagugcguggaguuuucaguuccuaagccgaggaaaggggcaaaugaacuagaugcuuggcagcuuuguggaggggaaguuacaggcaggcaaauggugucagggaucguaccuggaguaccucugcucugcugcuguggcuggccuccacccuauccuaccugccuggauggcugauaccaaacugucaccucugggcgguaagaauagggaaaagagagguggugaccaggauaccuagaaacuggacaccccuuuccagauucugagagccuaacaacaagguggcugagagucccaggcacuguaaagggagcagugacccauguuuggggaggaaugaguccaggagaaugucggcaggcaguuguguuuuaucccugggaaggccugcaucucuaccaggcccauguguuccccaggaugacagaggaguuaaucaccccuguguacugcaccggggugucagcccaaguacagaagaagcgggacaaggagcugggcuugggccgccaugaaaacgccaucaaguaccugggccaggauuaugaaacgcuucgggcaagaugccugcagagugggguccucuuccaagacgaggccuucccuccgguuucucauagccugggcuucaaggaacuggguccucauuccucuaaaaccuauggcaucaaauggaagcggccuacgguaagagggccacucuggguggaacuugguucugaugguggugggcaaugggacugggcccccccauuauucguggugucuggguaccaguuucuaggagggacuggcccaggaacaugaccgugggucuuguaggaacugaugucaaacccccaguucaucguggauggagccacccggacagacaucugccagggagcacuggguaggcccccaggggugggguucugggcguuugccccauuguaguucuccguucccguuccauugggcacugccccaacuccucccuccugcagguccagacagguuuugacuaucagcauaggugcugguucgcccagauuccugggucuuuucuguaagcggaggggagaugaaggguaccccacccagggaaucccugguggcccccggcaucccacauacacagcaccucccuccccugggcagauccggaaagcaagccugaugagggucuuuccuauuccaggggacuguuggcuccuggcugccauugccucccucacccucaacgagacuauucugcaccgagugguucccuacggccagagcuuucaggauggcuacgcuggcaucuuucauuuccaggugaaggucccugcacccucccugggccagaggaauagcugacuuuagggagaugggaaaggauggcccacagcacugugaagcugagauggccggggccaugcccuucgagggcagcccucccucuggaagguauuuggccucucugugccaccucuggucagucaugugugaauggucaagcagguauuuucagcuugcagcucuccuagguaagguugugcuuagcagagaaaguguggaagaagugcuuuggcuuuuugccccagccucaguuuccccaucuucaccugucaguucacccuuuucccaguuucccagacuuggcaaaccugacagaguguagaggaaaagacagacauggcguuuaaacaccauucccugauguuucugacagggcccacguuucaaguuacauuagugaauucuccaggagcuaguguugagagucacaccccaaaagucuugguugaggccuuuucuaccaugaugaucccagucaugccugaagggggucucuguguuccuuccuucugccuaauuuggucccacuaccucacucugcccacgccagaagaaauggcagcuauuauucuaugcugagugccccaaccaagacagcucugucacccuuuucccuacccccuuuccucaaaucuccaaucuacuccucuuccagcuucuauuuggcacagucagugccgcuucccaaauccuucagugauccucuuaccucaucauucugggcuucucccugcaacaauuuuugguguuuuccgaagcuucugucccuaggcagccuaggccugcaucccuggagcaaaucuggugcauuuggaaccagccugcccaucugugguugagggucugggcacaacauugucuuuccacaucucccacuuacuucuauacucaggcuuaaaauaaggaagcaaggggcugugaagcugagauggccggggcuacgccc

SEQ ID NO: 9093 - RNA, 8482 nt, Mus musculus
ucucauugguccgcguaacuuuaucgcaaccaaucggcgguagccacgggaacaaacucacuccuacacaaccugcguuggggggagguaaccugggaagaccuauaucuguuuucugcaccgcuauuuuuuuccgagaagcacuuaacuucuuaccgugucguagcuaucccuggaaugaggcgcuuacacauuuuauuucuuucaugccugacauaaagucuggcccuugcucgcuccugccccccguccaaauggcucggcccgcggaacgccccaucuuccaggcacauugagagccggagucuuggaggaguuuaggguggugauucuacaacggcgacuagcaaguggcgggcuucagcccuuucccgcugcucuccuggucgcgaccacacgucacagcucucgcucguuccgguugcucgcgcacgggccccagaagcgcaggcgagaucggagcgcgcaaagagaacuugguacgguccacuccgccgcgccccgcgccgccggaagugaggugucuuacccccgaaguuccgguucgcaggggguggggaguguuguuaaccggagcggcugccgcagucgcggugauugagcgugcucgcggcgcugggcuccuggugagugggccugguccugauugggguuggggggucggcgucuaggaccuuguccuuuggggucacugcgaucagcccgccccgcugcguucggccgccaguuuucggccugucagauggcuggagaccuuaggcggcggcgcggccaccguuccagaggccgggccccgccugcgagguucgcaacuccuagcguucacaggugcgcgacugugaggcgaccugacugguucucagccccgccgccgcacccuggcggucggccguuucuccgguucucagaguggacacugcugggggcgggggggggggcaggguuccagacugacguaccccgaugggcgcgcgucugcgcugaccacccuggcacagcugucacugguugugucgccuucucaagcugugcccucugcaccuugccuccuccaccccuggcgggcccagcgaaccugccucuaaagccuaucaucccagcuccuucagagggucagcgguggcagccccccuccuccuaacuuugccucagugacucccuagaggaggcgccuuggcagacagcguggaagagcccuagauuugaaacgagauugauccaaguucuaggccuugcaucagugugagccucuaaccccuuugaguccuaguuucucguuugugaaacagggaguauaugcuguuuugaaucuaauggcugucaaggugaaaugaguguuugcccuuacacucugccagggacugugcuagguuuacauaguguggauaucacaaaugucauuuuccuugugcaggucucugggccagggcgauguuccgcaccgcagugaugauggcggccagccuggcgcuaaccggggcagugguggcucaugccuacuaccucaaacaccaguucuaccccacuguaguguauuugaccaaguccagccccagcauggcagugaguucagggcucagggaagaaggaaugcccggggagggaaggaggggcagaaguggggcuacaugucauagaaguaggagagaaauagcccugggccgccugacuuggaauuaucuaugacagucuuggggaccugucagaaugauuagccccaggcaggggaaagcagaaaauaaccucaaaccacgaccuuuccucacccccagguccuguacauccaggccuuuguccuugucuuccucuugggcaaggugaugggcaagguguucuucgggcagcugagggcagcagagauggagguaauauguugguggccccaaaggacaggguucagaggaggguacccaaaugauugguuuucauaucauccacuucucaccccacagcaccuucuggaacgguccugguacgcuguuacugagacuuguuuggccuucaccguuuuucgggaugacuucagcccucgcuuuguggcgcucuuuacgcugcuccucuuccucaaauguuuccauugguuggcugaagaccguguggacuuugugaguugggaguggcugaugggcaugccaguggauugggguauggggcaaccccaaccaucuugauggugucccucucugccucagauggaacgcagccccaacaucuccuggcucuuccacugccgcaucgucuguaagugagacucauugaagaggugggggugacuugagggaaaagaggccacugaggaguagacugaaaagucaaaaccuaugagccacuacccagagcccuggcugccccuccauccacagcugcacaggaaagauaauuuaagaaguuaauuugcauagucucuacucuguuccacuccagggcuucuuaacugccugggcacucagcucucugccuucuccccugggccuggguugccccaacacccugccugggcaaaaguaguucccagaggauucggcuuagguguacacauuuaaguagaugguggggccaaucgccauggggugggauugucguggagcaggaagugauugucaggccucugcugaccucgauucccucccuuugggggucuccacagcucucauguuucuccuggguauccuggacuuccucuucgucagccacgcuuaucacagcauccugacccguggggcuucugugcagcugguauuuggcuuugagguaaaacuggcuugggggaagaagcugagcugguccugcgugugcugugagcaaccccacaagugcuucugagggccugccaugucucuacccacuuacuggccaccagggagccucugccaucuuguccuggccacccucauagacuucuaggcuauugcagaaggacacaaaggaaggcuggugucguguagaagauucuugaccaaguaccuuagcaagccuuccuggaggcugaugucaugaauggaaaagagaaaacuguuggguagaucacccaggagacgugucccagcucacaucugcugagugcuuaccacaugcugggcccugugcuguguucauaggugacaguuaaugcuuuggagguagagucaguugcuuucgucccagacugggaggaccccagcugugucugcagccuguguugguaucacugcaccucugucuugaagccuagcuuggcuagagcaaggggaagcugguacucacauccaucuccugucccucccuccaguacgccauucugaugaccauggugcuuaccaucuucaucaaguaugugcugcacuccguggaccuccagagcgagaaccccugggacaacaaggcuguauacaugcucuacacggagcuguuuacagguaacggauuccuaggccucuuccgguccacagcagcauccgucggugugucugccagcccuauggccagcugcgcucucccuuuccuccucaggcuucaucaagguccugcuguacauggccuucaugaccaucaugaucaaggugcacacauucccacucuuugccauuaggcccauguaccuggccaugaggugaguccagccuugucccuuacuuccucagacuggucucucccaugucuucuuucacucacugacuugucucuucaggcaguucaagaaagcugugacagaugccaucaugucucgccgagccauccgcaacaugaacacacuguaagugggcuuguucuggcuacucccaaacuccgagguccccgugcuuccaguucuggucuugacauggacucugccaucuuaaccagguacccagaugccacccccgaggagcuccaggcaauggauaaugucugcaucaucugcagagaagaaauggugacuggugcuaagagauugccuugcaaccacaucuuucacacgaggugggagaaggucugggagaccugcaucgugggcacaggcucauggggaccugcugaccgcugccugaucuuacucccagcugccugcgcuccugguuccagagacagcagaccugcccgacaugccgcauggauguccugcgggcaucguugccagcccagucaccaccaccuccugagccugcugaccaaggaccaccccccgccccucauccccaaccgcugcugccacagcccccuaauuguaaguggcccuucauuugcccacagaggaccuucuuuguccucagguacuugcccucggcuggguaccgacagugcuggggaauccccgagaagcucauucuggguaggaaggggugagaagaugagaaauagacaaaugaugagugguaagcagggccugccagaguggaggagaucuccuaguagccaagcgcacugccuggggugagacugucagcccagccucuucucacuacuguuuguuucucugcagucccccagggccuccugccuccuuuuccuccaggcauguucccacuguggcccccaaugggucccuuuccaccugucccgccucccccaagcucaggagaggcugcggccccuccacccaccaguacaggugagccuugugcaugccaaggcagcugggggguggcagucggaucuggagaccaggagacugacuuccauuuugcauuugccagccguuucucggccuaguggagcagccaccaccacagcugcuggcaccaguacuucugccccagcaccugggucuguaccuggcccagaggcugguccugcccccggcuucccuuucccuccuccuuggauggguaugccucugccuccaccuuuugguaaguuggccacucucugggauaucugggguggagagcugaggcccagguagcucagccugaccucuguaucuccugccagccuuccccccaaugccugugcccccugcgggcuuugcuggccuaaccccagaggagcugcgagcacuagagggccaugagcggcagcaccuggaggcccggcugcagagucugcgcaacauacacacacuacuggaugcugccaugcuucaaaucaaccaguaccucacugugcuggcuucccugggguacgcaugccacauucaguagcgcuccaaaaaggucccaugugguuuugacaucuuucccaugcgacauguuucccaugcacccuguauucaggccaccugucuacaggcgugcacaggagcucuuggccacucuaccugcuuucauccuucauucaggaagugcaucugcacagccauggaggaucaauuuauuagugagcuggcugugaaauuuacuuguuuuuuucuaagcucaaauuauuuuugacauucgcugcuacaacucaucaccucacggcugccagggcugacacgcugagggagcagaucacagucaccugaagccagcuugacccaugcuuaagugcuagucucaucacuugccugaagacuuguauauuagaauagaaaucaaaucccuagucacgugacaugugcagaggccugguaggaagccggaguccaaggcuuuagccuucugaccugcucagugccuacccuaucacuggagacugaagacuaauaggaaagugucagcugucugccugcaagugauucagaauccucggggacgaauuacucgacccuuucauugcucuaccugauaauccaauccgccuauucacuuauacuuacucgucacaaggacucaaggauagcuugccuuagagcuuguccugcaaggcucaugguggugggugggucguaggagaaucugugcagcccagaaggccaaggucaggccucuugucccuucucuuggcaggccccccaggccagcuacuucagugaaccccacugaagagacugccucuacagugguaucugcugccccuuccaccagcgcccccagcucugaggcuccuaccccgucuccgggagcuuccccaccaauuccugaagcagaaaagccuccugguaagugaggaaccucuaggggugggaugaaggguucucugggcuucaccucugaccucuccuucuagcuccugagucagugggcauuguagaggagcuucccgaggauggagagccugaugcugcagaacuccgccggcgucgccugcagaagcuggaguccccuguugcccacugacacugcccagaccuggcccuguucucuugaguggcccucacuggaacacguccugccaucaagugccagcucccucucugcuugcaccagggaguaauagccccaguugagaaagacuuggcaggaucucugaggaucaaggagaagugucugggcuuccagucgauccauccccagugccccuggcagccauggagauacuggucagcucuaaccucccuccacuucugccauguucaacuggggccuucaaaguagaagcugaaucucugguaagccuucucuuccaugcuuucugggagaaggugaagccccuccaagcccugcuugugaguaugggaccaugcugcagugccgaacaguauuagcuucuguucccaacuguggaaacccagaggggcugaagacagaccaggaccuugccccacccuccugccaagacugguaccagucucuuuccucuagcccagucuucccagaaccccuuugugaugguggcugugccccccgaagcccuguggcauuuccaugucuuacuggcaaccacacaacucagggaaaggagugccuggggguggggcacaggcgggcagcaccgagggacccugcccugccccuccccagcucuuuccccauaucacccagcagccacugccuggugggccuggcuaagggugugugcugcuccuuaaaccacugcuccccagaacccaaggcaggccaccuccaaccugugggaugucgucaggauuggaacuauucuguaccuacuggcuuugggcuuaaauuuugucuucugaauuugaaugcuugaccccaggaaggaggagcagguguggggcuagguaccuggacuucgcaguuuagaacaagcucugggccgggccgggccaggccaggccuagggagccaaggccuagcugcugcuuccuucuuuugguuuuguguuacaggaguuucuggagaguuucagaugauuauuuaauuuguaaauauuguauaaauuuuaauagcuuaaauuguauauacagcucaauaaaaacuugcauuaaugauugguagaacgugucaccuaggguagggcugggcucuuagucuacagaccuaagaauggaccggccugugguuccugggaugagggugcugagaucagcaacuagagagcacugggagguugcuaccgcuagcuaccuuaggucugaggucacacaggguaggcagguucugaacaccguuuaacauuguuuagccaguuuaaugguggguuggacauguggcuggugaggugggcgccagaagugaaaggucugcauuuugucuucacaccccuguauaguugauuacaggucacagggugauuccccaacccuaccuaguacagcacucagaaccuaagauauugcuugucucauccacucccguccaugucuuuuugcuguacugucuucuguuccauagcuuccaccacgcccggccuauagcaggagcucuaggucaaggauugauuccuugaugggucuaugcugugaagccuccagaacaggguuggguggucgcuuccagaacagcaaacaauaggaaauguauuaaguuuauaaugggacagcaguuuguaaucucaggcuuuuccacuggugcucagcccaguuccugaauuaugacuuacaggcgcauuuguaugugcaaugcuuauggccguaaacuagacuugcucccacuaguucauaacccauuuaacccauuuaaacgagacuacgccugccacauggcuggugaguuuccucuccucaguuugcuacauccugcuuccuccaaguccagggugaaucucccugucagaugucccgccuucuaguccugccucagcucacuggccaucagcuuuugauugacaggggaugcuuccacacaaugcacaagagauuaucuauacagcaguuaauaucugcuuuugauagcuugauuguugcuauggccucccauguugggacagcucucaaguggacacauggacacacaggucuacuuguacuuuaugaaagcaaggccuuaucucaaagcccuuucauccuaaguacuuaagcccugauuuuuguaucccauuccagagacucaaauccaccuccucucuggaggccagucugucgcgagcacugccacagggcugaccaucaggccucagaagccuuucucaagaagccaggcuuuaaguugcucaucaaaguagcccuugauucgaagaguaccugucaccucauuaaccugggugauaggugucuuucccagcagugggcucagaaauucuuccacauccuucuguagggccu
